US007183083B2

(12) United States Patent
Doucette-Stamm et al.

(10) Patent No.: US 7,183,083 B2
(45) Date of Patent: Feb. 27, 2007

(54) **NUCLEIC ACID AND AMINO ACID SEQUENCES RELATING TO *STAPHYLOCOCCUS EPIDERMIDIS* FOR DIAGNOSTICS AND THERAPEUTICS**

(75) Inventors: Lynn Doucette-Stamm, Framingham, MA (US); David Bush, Somerville, MA (US)

(73) Assignee: Wyeth, Madison, NJ (US)

( * ) Notice: Subject to any disclaimer, the term of this patent is extended or adjusted under 35 U.S.C. 154(b) by 105 days.

(21) Appl. No.: 10/724,972

(22) Filed: Dec. 1, 2003

(65) Prior Publication Data

US 2004/0147734 A1    Jul. 29, 2004

Related U.S. Application Data

(60) Division of application No. 09/450,969, filed on Nov. 29, 1999, now Pat. No. 7,060,458, which is a continuation-in-part of application No. 09/134,001, filed on Aug. 13, 1998, now Pat. No. 6,380,370.

(60) Provisional application No. 60/064,964, filed on Nov. 8, 1997, provisional application No. 60/055,779, filed on Aug. 14, 1997.

(51) Int. Cl.
  C12P 21/04    (2006.01)
  C12N 1/20    (2006.01)
  C07H 21/04    (2006.01)
  A61K 39/00    (2006.01)
  A61K 39/085    (2006.01)

(52) U.S. Cl. .................. 435/69.7; 435/6; 435/252.1; 435/252.3; 435/320.1; 435/882; 435/884; 536/23.1; 536/23.7; 536/24.33; 424/130.1; 424/150.1; 424/164.1; 424/165.1; 424/243.1

(58) Field of Classification Search ............. 424/165.1, 424/130.1, 150.1, 164.1, 243.1; 435/6, 252.3, 435/320.1, 69.7, 882, 884, 252.1; 536/23.1, 536/23.7, 24.33
See application file for complete search history.

(56) References Cited

U.S. PATENT DOCUMENTS

| | | | |
|---|---|---|---|
| 5,587,307 A | 12/1996 | Alborn, Jr. et al. ....... | 435/240.1 |
| 5,635,348 A | 6/1997 | Leong ........................ | 435/6 |
| 5,679,520 A | 10/1997 | Hogan et al. ................ | 435/6 |
| 5,770,375 A * | 6/1998 | Ohno et al. ................. | 435/6 |
| 5,807,673 A | 9/1998 | Ohno et al. ................. | 435/6 |
| 5,994,066 A | 11/1999 | Bergeron et al. ........... | 435/6 |
| 6,001,564 A | 12/1999 | Bergeron et al. ........... | 435/6 |
| 6,025,132 A | 2/2000 | Jannes et al. .............. | 435/6 |

OTHER PUBLICATIONS

Wieser et al , Int J Syst Evol Microbiol. May 2000;50 Pt 3:1087-93).*
Biochemistry 1999, Parikh et al, 38; 13623-13633.*
Infect Immun. May 1994; 62(5): 1843-7.*
Antimicrobial Agents and Chemotherapy, Mar. 2001, p. 805-809, vol. 45, No. 3.*
Emerging Infectious Diseases 2005, vol. 11, (9) 1389-1393.*
1, .BioEssays, vol. 18, No. 12, pp. 973 981(1996)]; 2, Journal of Leukocyte Biology, vol. 61, No. 5, pp. 545-550 (1997) 3, Journal of Molecular Biology, vol. 244, pp. 332 350 1994.*
1. "Peptide Hormones", edited by Parsons, J.A., University Park Press, Jun. 1976, 2. The Journal of Cell Biology, 111:2129 2138, 1990, 3, Molecular and Cellular Biology, 8(3): 1247 1252, 1988, 4, Mol. Microbiol. 1991, 5(7): 1755 67.*
Goh et al Clin Microbiol. Apr. 1996;34(4):818-23.*
Martineau F, J Clin Microbiol. Dec. 1996: 34(12): 2888-93.*
Dunne WM Jr.Clin Microbiol Rev. Apr. 2002;15(2):155-66.*
Ip D et al , J Orthop Surg (Hong Kong). Aug. 2005; 13(2): 125-30.*
Gill SR, Fouts DE et al Bacteriol. Apr. 2005: 187(7): 2426-37.*
O'Gara JP, Humphreys H. J Med Microbiol. Jul. 2001;50(7):582-7.*
Risitano DC, Minerva Anestesiol. Sep. 2005; 71(9): 561-4.*
Zilhao, R., and Courvalin, P., "Nucleotide sequence of the fosB gene conferring fosfomycin resistance in *Staphyloccocus epidermidis*," *FEMS Microbiol. Lett.*, 68:267-272 (1990).
McKevitt, A.I., et al., "Amino acid sequence of a deltalike toxin from *Staphylococcus epidermidis*," *Infect. Immun.*, 58(5) :1473-5 (1990).
Sreedharan, S., et al., "Ciprofloxacin resistance in coagulase-positive and -negative *staphylococci*: role of mutations at serine 84 in the DNA gyrase A protein of *Staphylococcus aureus* and *Staphylococcus epidermidis*," *Antimicrob. Agents & Chemother.*, 35(10) :2151-4 (1991).
Roberts, R.J., "Staphylococcal transfer ribonucleic acids. II. Sequence analysis of isoaccepting glycine transfer ribonucleic acids IA and IB from *Staphylococcus epidermidis* Texas 26," *J. Biol. Chem.*, 249(15) : 4787-96 (1974).
Kupke, T., and Gotz, F., "Expression, purification, and characterization of EpiC, an enzyme involved in the biosynthesis of the lantibiotic epidermin, and sequence analysis of *Staphylococcus epidermidis* epiC mutants," *J. Bacteriol.*, 178(5) : 1335-40 (1996).
Martineau, F., et al., "Species-specific and ubiquitous DNA-based assays for rapid identification of *Staphylococcus epidermidis*," *J. Clin. Microbiol.*, 34(12) :2888-93 (1996).

* cited by examiner

Primary Examiner—Bruce R. Campell
Assistant Examiner—Padma Baskar
(74) *Attorney, Agent, or Firm*—Drinker Biddle & Reath LLP

(57) ABSTRACT

The invention provides isolated polypeptide and nucleic acid sequences derived from *Staphylococcus epidermidis* that are useful in diagnosis and therapy of pathological conditions; antibodies against the polypeptides; and methods for the production of the polypeptides. The invention also provides methods for the detection, prevention and treatment of pathological conditions resulting from bacterial infection.

11 Claims, No Drawings

NUCLEIC ACID AND AMINO ACID SEQUENCES RELATING TO *STAPHYLOCOCCUS EPIDERMIDIS* FOR DIAGNOSTICS AND THERAPEUTICS

RELATED APPLICATIONS

This application is a divisional application of U.S. patent application Ser. No. 09/450,969, filed Nov. 29, 1999, now U.S. Pat. No. 7,060,458, which is a Continuation-in-Part which claims priority to U.S. application Ser. No. 09/134,001, filed Aug. 13, 1998, now U.S. Pat. No. 6,380,370, which claims the benefit of both U.S. Provisional Application No. 60/064,964, filed Nov. 8, 1997 and U.S. Provisional Application No. 60/055,779, filed Aug. 14, 1997, the contents of which are incorporated in their entirety.

SEQUENCE LISTING

The instant application contains a "lengthy" Sequence Listing which has been submitted via CD-R in lieu of a printed paper copy, and is hereby incorporated by reference in its entirety. Said CD-R, recorded on Mar. 10, 2006, are labeled CRF, "Copy 1" and "Copy 2", respectively, and each contains only one identical 9.8 Mb file (470407US.APP).

BACKGROUND OF THE INVENTION

*Staphylococcus epidermidis* (*S. epidermidis*) is a species of staphylococcal bacteria that are Gram-positive, nonmotile, nonpigmented and coagulase-negative cocci, which are mainly found on the skin and mucous membrane of warm-blooded animals. Their large numbers and ubiquitous distribution result in frequent contamination of specimens collected from or through the skin, making these organisms amongst the most frequently isolated in the clinical laboratory. In the past, *S. epidermidis* was rarely the cause of significant infections, but with the increasing use of implanted catheters and prosthetic devices, it has emerged as an important agent of hospital-acquired infections and has been recognized as a true pathogen (Lowy and Hammer, 1983, Ann Intern Med. 99: 834–9; Blum and Rodvold, 1987, Clin Pharm, 6: 464–75; Hamory, Parisi et al., 1987, Am J Infect Control, 15: 59–74). *S. epidermidis* is a major cause of infection of indwelling foreign devices such as, orthopedic devices, intravenous catheters, prosthetic heart valves, central nervous system shunts, and peritoneal dialysis catheters (Blum and Rodvold, 1987, Clin Pharm, 6: 464–75; Archer, 1988, J Antimicrob Chemother, 21 Suppl C: 133–8) (Lowy and Hammer, 1983, Ann Intern Med, 99: 834–9; Hamory, Parisi et al., *Staphylococcus* 1987, Am J Infect Control, 15: 59–74). In addition *S. epidermidis* is a common cause of postoperative wound infections, bacteremia of immunosuppressed patients, intensive-care unit patients and premature newborns (MacLowry, 1983, Am J Med, 75: 2–6)(Eykyn, 1988, Lancet, 1: 100–4). According to a national survey (Centers for Disease Control, 1981:7) *S. epidermidis* caused 8.9% of primary nosocomial bacteremias.

Treatment of *S. epidermidis* infections remains difficult because of the occult nature, association with foreign bodies, and frequent resistance to antimicrobial agents. Ordinarily, *S. epidermidis* is an organism with low virulence, however breaks in host defense caused by surgery, catheter placement, prosthesis insertion or immuno-suppression is prerequisite for infection. The presence of foreign bodies itself facilitates infection by protecting the organism from elimination by host defenses or antimicrobial therapy (Lowy and Hammer, 1983, Ann Intern Med, 99: 834–9). Furthermore, *S. epidermidis* due to its ability to produce extracellular polysaccharide material or slime, may be uniquely adapted to adhere to smooth surfaces such as plastics or metal. Slime producing strains of *S. epidermidis* appear to be more pathogenic than non-slime producing strains (Christensen, Simpson et al., 1983, Infect Immun, 40: 407–10; Peters and Pulverer, 1984, J Antimicrob Chemother, 14 Suppl D: 67–71; Gallimore, Gagnon et al., 1991, J Infect Dis, 164: 1220–3). This property and many factors are involved in the pathogenesis of device associated infections. Despite the increased recognition as a pathogen, *S. epidermidis* infections are difficult to diagnose. Differentiating clinically important from clinically unimportant bacterial isolates of *S. epidermidis* is difficult because of the high rate of contamination.

Although laboratory isolates of *S. epidermidis* have generally been susceptible to semisynthetic penicillins (methicillin, nafcillin, oxacillin), cephalosporins, amino-glycosides, vancomycin and rafampin, recent clinical isolates have had an increased resistance. Recent reports (Karchmer, 1985, Am J Med, 78: 116–27; Karchmer, 1991, J Hosp Infect, 18 Suppl A: 355–66) show that 83% of *S. epidermidis* isolates from patients with prosthetic valve endocarditis are methicillin resistant and 32% are gentamicin resistant as well. Multi-drug resistant staphylococci have emerged in the midst of high level use of penicillin and aminoglycosides (Centers for Disease Control and Prevention, 1993 *MMWR* 42:597; and S. Handwerger et al., 1993, *Clin Infect Dis* 16:750).

The use of antibiotics for therapeutics and prophylactic purposes, promotes the selection of resistant organisms and the spread of antibiotic resistance genes among bacteria. Previous studies have shown that virtually all staphylococci carry some antibiotic resistance genes on naturally occurring extrachromosomal mobile genetic elements, such as the plasmids. Survey and analysis of plasmids in clinical isolates of *S. epidermidis* have shown that more that 80% of isolates carry plasmids and in several cases more than one plasmid (Archer et al., 1982, Infect Immun, 35:627–632; Kloos et al., 1981, Can J Microbiol, 27:271–278; Moller, 1988, J Hosp Infect 12:19–27). Though the most important forms of resistance has been the inactivation of antibiotics, particularly penicillins and cephalosporins, recent clinical isolates have resistance to one or more of the following antibiotics, methicillin, tetracycline, erythromycin, gentamycin, kanamycin and chloramphenicol. In fact due to the wide spread occurrence of plasmids and their involvement in antibiotic resistance, plasmid profiling has been used as an epidemiological reagent to study nosocomial infections. This invention relates to isolated nucleic acids and polypeptides derived from *S. epidermidis* plasmids that are useful as molecular targets for diagnosis, prophylaxis and treatment of pathological conditions, as well as materials and methods for the diagnosis, prevention, and amelioration of pathological conditions resulting from bacterial infection.

These concerns point to the need for diagnostic tools and therapeutics aimed at proper identification of strain and eradication of virulence. The design of vaccines that will limit the spread of infection and halt transfer of resistance factors is very desirable.

SUMMARY OF THE INVENTION

The present invention fulfills the need for diagnostic tools and therapeutics by providing bacterial-specific compositions and methods for detecting *Staphylococcus* species including *S. epidermidis*, as well as compositions and methods useful for treating and preventing *Staphylococcus* infection, in particular, *S. epidermidis* infection, in vertebrates including mammals.

The present invention encompasses isolated nucleic acids and polypeptides derived from *S. epidermidis* that are useful as reagents for diagnosis of bacterial disease, components of effective antibacterial vaccines, and/or as targets for antibacterial drugs including anti-*S. epidermidis* drugs. They can also be used to detect the presence of *S. epidermidis* and other *Staphylococcus* species in a sample; and in screening compounds for the ability to interfere with the *S. epidermidis* life cycle or to inhibit *S. epidermidis* infection. They also have use as biocontrol agents for plants.

In one aspect, the invention features compositions of nucleic acids corresponding to entire coding sequences of *S. epidermidis* proteins (SEQ ID NO: 1–SEQ ID NO: 3702), including surface or secreted proteins or parts thereof, nucleic acids capable of binding mRNA from *S. epidermidis* proteins to block protein translation, and methods for producing *S. epidermidis* proteins or parts thereof using peptide synthesis and recombinant DNA techniques. This invention also features antibodies and nucleic acids useful as probes to detect *S. epidermidis* infection. In addition, vaccine compositions and methods for the protection or treatment of infection by *S. epidermidis* are within the scope of this invention.

In another aspect, the invention relates to the nucliec acids corresponding to 2 naturally occurring plasmids of *S. epidermidis* (SEQ ID NO: 3703–SEQ ID NO: 3772) and the corresponding amino acid sequences (SEQ ID NO: 7475–SEQ ID NO: 7544).

The nucleotide sequences provided in SEQ ID NO: 1–SEQ ID NO: 3772, a fragment thereof, or a nucleotide sequence at least about 99.5% identical to a sequence contained within SEQ ID NO: 1–SEQ ID NO: 3772 may be "provided" in a variety of medias to facilitate use thereof. As used herein, "provided" refers to a manufacture, other than an isolated nucleic acid molecule, which contains a nucleotide sequence of the present invention, i.e., the nucleotide sequence provided in SEQ ID NO: 1–SEQ ID NO: 3772, a fragment thereof, or a nucleotide sequence at least about 99.5% identical to a sequence contained within SEQ ID NO: 1–SEQ ID NO: 3772. Uses for and methods for providing nucleotide sequences in a variety of media is well known in the art (see e.g., EPO Publication No. EP 0 756 006).

In one application of this embodiment, a nucleotide sequence of the present invention can be recorded on computer readable media. As used herein, "computer readable media" refers to any media which can be read and accessed directly by a computer. Such media include, but are not limited to: magnetic storage media, such as floppy discs, hard disc storage media, and magnetic tape; optical storage media such as CD-ROM; electrical storage media such as RAM and ROM; and hybrids of these categories such as magnetic/optical storage media. A person skilled in the art can readily appreciate how any of the presently known computer readable media can be used to create a manufacture comprising computer readable media having recorded thereon a nucleotide sequence of the present invention.

As used herein, "recorded" refers to a process for storing information on computer readable media. A person skilled in the art can readily adopt any of the presently known methods for recording information on computer readable media to generate manufactures comprising the nucleotide sequence information of the present invention.

A variety of data storage structures are available to a person skilled in the art for creating a computer readable media having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable media. The sequence information can be represented in a word processing text file, formatted in commercially-available software such as WordPerfect and Microsoft Word, or represented in the form of an ASCII file, stored in a database application, such as DB2, Sybase, Oracle, or the like. A person skilled in the art can readily adapt any number of data processor structuring formats (e.g. text file or database) in order to obtain computer readable media having recorded thereon the nucleotide sequence information of the present invention.

By providing the nucleotide sequence of SEQ ID NO: 1–SEQ ID NO: 3772, a fragment thereof, or a nucleotide sequence at least about 99.5% identical to SEQ ID NO: 1–SEQ ID NO: 3772 in computer readable form, a person skilled in the art can routinely access the coding sequence information for a variety of purposes. Computer software is publicly available which allows a person skilled in the art to access sequence information provided in a computer readable media. Examples of such computer software include programs of the "Staden Package", "DNA Star", "MacVector", GCG "Wisconsin Package" (Genetics Computer Group, Madison, Wis.) and "NCBI Toolbox" (National Center For Biotechnology Information). Suitable programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997).

Computer algorithms enable the identification of *S. epidermidis* open reading frames (ORFs) within SEQ ID NO: 1–SEQ ID NO: 3772 which contain homology to ORFs or proteins from other organisms. Examples of such similarity-search algorithms include the BLAST [Altschul et al., J. Mol. Biol. 215:403–410 (1990)] and Smith-Waterman [Smith and Waterman (1981) Advances in Applied Mathematics, 2:482–489] search algorithms. Suitable search algorithms are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997). Such algorithms are utilized on computer systems as exemplified below. The ORFs so identified represent protein encoding fragments within the *S. epidermidis* genome and *S. epidermidis* plasmids and are useful in producing commercially important proteins such as enzymes used in fermentation reactions and in the production of commercially useful metabolites.

The present invention further provides systems, particularly computer-based systems, which contain the sequence information described herein. Such systems are designed to identify commercially important fragments of the *S. epidermidis* genome and plasmids. As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A person skilled in the art can readily appreciate that any one of the currently available computer-based systems is suitable for use in the present invention. The computer-based systems of the present invention comprise a data storage means having stored therein a nucleotide sequence of the present invention and the necessary hardware means and software means for supporting and implementing a search means. As used herein, "data storage means" refers to memory which can store nucleotide sequence information of the present invention, or a memory access means which can access manufactures having recorded thereon the nucleotide sequence information of the present invention.

As used herein, "search means" refers to one or more programs which are implemented on the computer-based system to compare a target sequence or target structural motif with the sequence information stored within the data storage means. Search means are used to identify fragments or regions of the S. epidermidis genome and plasmids which are similar to, or "match", a particular target sequence or target motif. A variety of known algorithms are known in the art and have been disclosed publicly, and a variety of commercially available software for conducting homology-based similarity searches are available and can be used in the computer-based systems of the present invention. Examples of such software includes, but is not limited to, FASTA (GCG Wisconsin Package), Bic_SW (Compugen Bioccelerator), BLASTN2, BLASTP2, BLASTX2 (NCBI) and Motifs (GCG). Suitable software programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997). A person skilled in the art can readily recognize that any one of the available algorithms or implementing software packages for conducting homology searches can be adapted for use in the present computer-based systems.

As used herein, a "target sequence" can be any DNA or amino acid sequence of six or more nucleotides or two or more amino acids. A person skilled in the art can readily recognize that the longer a target sequence is, the less likely a target sequence will be present as a random occurrence in the database. The most preferred sequence length of a target sequence is from about 10 to 100 amino acids or from about 30 to 300 nucleotide residues. However, it is well recognized that many genes are longer than 500 amino acids, or 1.5 kb in length, and that commercially important fragments of the S. epidermidis genome and plasmids from S. epidermidis, such as sequence fragments involved in gene expression and protein processing, will often be shorter than 30 nucleotides.

As used herein, "a target structural motif," or "target motif," refers to any rationally selected sequence or combination of sequences in which the sequence(s) are chosen based on a specific functional domain or three-dimensional configuration which is formed upon the folding of the target polypeptide. There are a variety of target motifs known in the art. Protein target motifs include, but are not limited to, enzymatic active sites, membrane-spanning regions, and signal sequences. Nucleic acid target motifs include, but are not limited to, promoter sequences, hairpin structures and inducible expression elements (protein binding sequences).

A variety of structural formats for the input and output means can be used to input and output the information in the computer-based systems of the present invention. A preferred format for an output means ranks fragments of the S. epidermidis genome and plasmids possessing varying degrees of homology to the target sequence or target motif. Such presentation provides a person skilled in the art with a ranking of sequences which contain various amounts of the target sequence or target motif and identifies the degree of homology contained in the identified fragment.

A variety of comparing means can be used to compare a target sequence or target motif with the data storage means to identify sequence fragments of the S. epidermidis genome and plasmids. In the present examples, implementing software which implement the BLASTP2 and bic_SW algorithms (Altschul et al., J Mol. Biol. 215:403–410 (1990); Compugen Biocellerator) was used to identify open reading frames within the S. epidermidis genome and plasmids. A person skilled in the art can readily recognize that any one of the publicly available homology search programs can be used as the search means for the computer-based systems of the present invention. Suitable programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997).

The invention features S. epidermidis polypeptides, preferably a substantially pure preparation of an S. epidermidis polypeptide, or a recombinant S. epidermidis polypeptide. In preferred embodiments: the polypeptide has biological activity; the polypeptide has an amino acid sequence at least about 60%, 70%, 80%, 90%, 95%, 98%, or 99% identical to an amino acid sequence of the invention contained in the Sequence Listing, preferably it has about 65% sequence identity with an amino acid sequence of the invention contained in the Sequence Listing, and most preferably it has about 92% to about 99% sequence identity with an amino acid sequence of the invention contained in the Sequence Listing; the polypeptide has an amino acid sequence essentially the same as an amino acid sequence of the invention contained in the Sequence Listing; the polypeptide is at least about 5, 10, 20, 50, 100, or 150 amino acid residues in length; the polypeptide includes at least about 5, preferably at least about 10, more preferably at least about 20, still more preferably at least about 50, 100, or 150 contiguous amino acid residues of the invention contained in the Sequence Listing. In yet another preferred embodiment, the amino acid sequence which differs in sequence identity by about 7% to about 8% from the S. epidermidis amino acid sequences of the invention contained in the Sequence Listing is also encompassed by the invention.

In preferred embodiments: the S. epidermidis polypeptide is encoded by a nucleic acid of the invention contained in the Sequence Listing, or by a nucleic acid having at least about 60%, 70%, 80%, 90%, 95%, 98%, or 99% homology with a nucleic acid of the invention contained in the Sequence Listing.

In a preferred embodiment, the subject S. epidermidis polypeptide differs in amino acid sequence at about 1, 2, 3, 5, 10 or more residues from a sequence of the invention contained in the Sequence Listing. The differences, however, are such that the S. epidermidis polypeptide exhibits an S. epidermidis biological activity, e.g., the S. epidermidis polypeptide retains a biological activity of a naturally occurring S. epidermidis enzyme.

In preferred embodiments, the polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

In yet other preferred embodiments, the *S. epidermidis* polypeptide is a recombinant fusion protein having a first *S. epidermidis* polypeptide portion and a second polypeptide portion, e.g., a second polypeptide portion having an amino acid sequence unrelated to *S. epidermidis*. The second polypeptide portion can be, e.g., any of glutathione-S-transferase, a DNA binding domain, or a polymerase activating domain. In preferred embodiment the fusion protein can be used in a two-hybrid assay.

Polypeptides of the invention include those which arise as a result of alternative transcription events, alternative RNA splicing events, and alternative translational and postrans-lational events.

In a preferred embodiment, the encoded *S. epidermidis* polypeptide differs (e.g., by amino acid substitution, addition or deletion of at least one amino acid residue) in amino acid sequence at about 1, 2, 3, 5, 10 or more residues, from a sequence of the invention contained in the Sequence Listing. The differences, however, are such that: the *S. epidermidis* encoded polypeptide exhibits an *S. epidermidis* biological activity, e.g., the encoded *S. epidermidis* enzyme retains a biological activity of a naturally occurring *S. epidermidis*.

In preferred embodiments, the encoded polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

The *S. epidermidis* strain, 18972, from which genomic sequences have been sequenced, has been deposited on Jul. 10, 1997, in the American Type Culture Collection and assigned the ATCC designation # 55998.

Included in the invention are: allelic variations; natural mutants; induced mutants; proteins encoded by DNA that hybridize under high or low stringency conditions to a nucleic acid which encodes a polypeptide of the invention contained in the Sequence Listing (for definitions of high and low stringency see Current Protocols in Molecular Biology, John Wiley & Sons, New York, 1989, 6.3.1–6.3.6, hereby incorporated by reference); and, polypeptides specifically bound by antisera to *S. epidermidis* polypeptides, especially by antisera to an active site or binding domain of *S. epidermidis* polypeptide. The invention also includes fragments, preferably biologically active fragments. These and other polypeptides are also referred to herein as *S. epidermidis* polypeptide analogs or variants.

The invention further provides nucleic acids, e.g., RNA or DNA, encoding a polypeptide of the invention. This includes double stranded nucleic acids as well as coding and antisense single strands.

In preferred embodiments, the subject *S. epidermidis* nucleic acid will include a transcriptional regulatory sequence, e.g., at least one of a transcriptional promoter or transcriptional enhancer sequence, operably linked to the *S. epidermidis* gene sequence, e.g., to render the *S. epidermidis* gene sequence suitable for expression in a recombinant host cell.

In yet a further preferred embodiment, the nucleic acid which encodes an *S epidermidis* polypeptide of the invention, hybridizes under stringent conditions to a nucleic acid probe corresponding to at least about 8 consecutive nucleotides of the invention contained in the Sequence Listing; more preferably to at least about 12 consecutive nucleotides of the invention contained in the Sequence Listing; still more preferably to at least about 20 consecutive nucleotides of the invention contained in the Sequence Listing; most preferably to at least about 40 consecutive nucleotides of the invention contained in the Sequence Listing.

In another aspect, the invention provides a substantially pure nucleic acid having a nucleotide sequence which encodes an *S. epidermidis* polypeptide. In preferred embodiments: the encoded polypeptide has biological activity; the encoded polypeptide has an amino acid sequence at least about 60%, 70%, 80%, 90%, 95%, 98% or 99% homologous to an amino acid sequence of the invention contained in the Sequence Listing; the encoded polypeptide has an amino acid sequence essentially the same as an amino acid sequence of the invention contained in the Sequence Listing; the encoded polypeptide is at least about 5, 10, 20, 50, 100, or 150 amino acids in length; the encoded polypeptide comprises at least about 5, preferably at least about 10, more preferably at least about 20, still more preferably at least about 50, 100, or 150 contiguous amino acids of the invention contained in the Sequence Listing.

In another aspect, the invention encompasses: a vector including a nucleic acid which encodes an *S. epidermidis* polypeptide or an *S. epidermidis* polypeptide variant as described herein; a host cell transfected with the vector; and a method of producing a recombinant *S. epidermidis* polypeptide or *S. epidermidis* polypeptide variant; including culturing the cell, e.g., in a cell culture medium, and isolating an *S. epidermidis* or *S. epidermidis* polypeptide variant, e.g., from the cell or from the cell culture medium.

One embodiment of the invention is directed to substantially isolated nucleic acids. Nucleic acids of the invention include sequences comprising at least about 8 nucleotides in length, more preferably at least about 12 nucleotides in length, even more preferably at least about 15–20 nucleotides in length, that correspond to a subsequence of any one of SEQ ID NO: 1–SEQ ID NO: 3772 or complements thereof. Alternatively, the nucleic acids comprise sequences contained within any ORF (open reading frame), including a complete protein-coding sequence, of which any of SEQ ID NO: 1–SEQ ID NO: 3772 forms a part. The invention encompasses sequence-conservative variants and function-conservative variants of these sequences. The nucleic acids may be DNA, RNA, DNA/RNA duplexes, protein-nucleic acid (PNA), or derivatives thereof.

In another aspect, the invention features a purified recombinant nucleic acid having at least about 50%, 60%, 70%, 80%, 90%, 95%, 98%, or 99% homology with a sequence of the invention contained in the Sequence Listing The invention also encompasses recombinant DNA (including DNA cloning and expression vectors) comprising these *S. epidermidis*-derived sequences; host cells comprising such DNA, including fungal, bacterial, yeast, plant, insect, and mammalian host cells; and methods for producing expression products comprising RNA and polypeptides encoded by the *S. epidermidis* sequences. These methods are carried out by incubating a host cell comprising an *S. epidermidis*-derived nucleic acid sequence under conditions in which the sequence is expressed. The host cell may be native or recombinant. The polypeptides can be obtained by (a) harvesting the incubated cells to produce a cell fraction and a medium fraction; and (b) recovering the *S. epidermidis* polypeptide from the cell fraction, the medium fraction, or both. The polypeptides can also be made by in vitro translation.

In another aspect, the invention features nucleic acids capable of binding mRNA of *S. epidermidis*. Such nucleic acid is capable of acting as antisense nucleic acid to control the translation of mRNA of *S. epidermidis*. A further aspect features a nucleic acid which is capable of binding specifically to an *S. epidermidis* nucleic acid. These nucleic acids are also referred to herein as complements and have utility as probes and as capture reagents.

In another aspect, the invention features an expression system comprising an open reading frame corresponding to *S. epidermidis* nucleic acid. The nucleic acid further comprises a control sequence compatible with an intended host. The expression system is useful for making polypeptides corresponding to *S. epidermidis* nucleic acid.

In another aspect, the invention encompasses: a vector including a nucleic acid which encodes an *S. epidermidis* polypeptide or an *S. epidermidis* polypeptide variant as described herein; a host cell transfected with the vector; and a method of producing a recombinant *S. epidermidis* polypeptide or *S. epidermidis* polypeptide variant; including culturing the cell, e.g., in a cell culture medium, and isolating the *S. epidermidis* or *S. epidermidis* polypeptide variant, e.g., from the cell or from the cell culture medium.

In yet another embodiment of the invention encompasses reagents for detecting bacterial infection, including *S. epidermidis* infection, which comprise at least one *S. epidermidis*-derived nucleic acid defined by any one of SEQ ID NO: 1–SEQ ID NO: 3772, or sequence-conservative or function-conservative variants thereof. Alternatively, the diagnostic reagents comprise nucleotide sequences that are contained within any open reading frames (ORFs), including preferably complete protein-coding sequences, contained within any of SEQ ID NO: 1–SEQ ID NO: 3772, or polypeptide sequences contained within any of SEQ ID NO: 3773–SEQ ID NO: 7544, or polypeptides of which any of the above sequences forms a part, or antibodies directed against any of the above peptide sequences or function-conservative variants and/or fragments thereof.

The invention further provides antibodies, preferably monoclonal antibodies, which specifically bind to the polypeptides of the invention. Methods are also provided for producing antibodies in a host animal. The methods of the invention comprise immunizing an animal with at least one *S. epidermidis*-derived immunogenic component, wherein the immunogenic component comprises one or more of the polypeptides encoded by any one of SEQ ID NO: 1–SEQ ID NO: 3772 or sequence-conservative or function-conservative variants thereof; or polypeptides that are contained within any ORFs, including complete protein-coding sequences, of which any of SEQ ID NO: 1–SEQ ID NO: 3772 forms a part; or polypeptide sequences contained within any of SEQ ID NO: 3773–SEQ ID NO: 7544; or polypeptides of which any of SEQ ID NO: 3773–SEQ ID NO: 7544 forms a part. Host animals include any warm blooded animal, including without limitation mammals and birds. Such antibodies have utility as reagents for immunoassays to evaluate the abundance and distribution of *S. epidermidis*-specific antigens.

In yet another aspect, the invention provides diagnostic methods for detecting *S. epidermidis* antigenic components or anti-*S. epidermidis* antibodies in a sample. *S. epidermidis* antigenic components may be detected by known processes, including but not limited to detection by a process comprising: (i) contacting a sample suspected to contain a bacterial antigenic component with a bacterial-specific antibody, under conditions in which a stable antigen-antibody complex can form between the antibody and bacterial antigenic components in the sample; and (ii) detecting any antigen-antibody complex formed in step (i), wherein detection of an antigen-antibody complex indicates the presence of at least one bacterial antigenic component in the sample. In different embodiments of this method, the antibodies used are directed against a sequence encoded by any of SEQ ID NO: 1–SEQ ID NO: 3772 or sequence-conservative or function-conservative variants thereof, or against a polypeptide sequence contained in any of SEQ ID NO: 3773–SEQ ID NO: 7544 or function-conservative variants thereof.

In yet another aspect, the invention provides a method for detecting antibacterial-specific antibodies in a sample, which comprises: (i) contacting a sample suspected to contain antibacterial-specific antibodies with an *S. epidermidis* antigenic component, under conditions in which a stable antigen-antibody complex can form between the *S. epidermidis* antigenic component and antibacterial antibodies in the sample; and (ii) detecting any antigen-antibody complex formed in step (i), wherein detection of an antigen-antibody complex indicates the presence of antibacterial antibodies in the sample. In different embodiments of this method, the antigenic component is encoded by a sequence contained in any of SEQ ID NO: 1–SEQ ID NO: 3772 or sequence-conservative and function-conservative variants thereof, or is a polypeptide sequence contained in any of SEQ ID NO: 3773–SEQ ID NO: 7544 or function-conservative variants thereof.

In another aspect, the invention features a method of generating vaccines for immunizing an individual against *S. epidermidis*. The method includes: immunizing a subject with an *S. epidermidis* polypeptide, e.g., a surface or secreted polypeptide, or a combination of such peptides or active portion(s) thereof, and a pharmaceutically acceptable carrier. Such vaccines have therapeutic and prophylactic utilities.

In another aspect, the invention features a method of evaluating a compound, e.g., a polypeptide, e.g., a fragment of a host cell polypeptide, for the ability to bind an *S. epidermidis* polypeptide. The method includes contacting the compound to be evaluated with an *S. epidermidis* polypeptide and determining if the compound binds or otherwise interacts with the *S. epidermidis* polypeptide. Compounds which bind or otherwise interact with *S. epidermidis* polypeptides are candidates as modulators, including activators and inhibitors, of the bacterial life cycle. These assays can be performed in vitro or in vivo.

In another aspect, the invention features a method of evaluating a compound, e.g., a polypeptide, e.g., a fragment of a host cell polypeptide, for the ability to bind an *S. epidermidis* nucleic acid, e.g., DNA or RNA. The method includes contacting the compound to be evaluated with an *S. epidermidis* nucleic acid and determining if the compound binds or otherwise interacts with the *S. epidermidis* nucleic acid. Compounds which bind *S. epidermidis* are candidates as modultors, including activators and inhibitors, of the bacterial life cycle. These assays can be performed in vitro or in vivo.

A particularly preferred embodiment of the invention is directed to a method of screening test compounds for anti-bacterial activity, which method comprises: selecting as a target a bacterial specific sequence, which sequence is essential to the viability of a bacterial species; contacting a test compound with said target sequence; and selecting those test compounds which bind to said target sequence as potential anti-bacterial candidates. In one embodiment, the target sequence selected is specific to a single species, or even a single strain, such as, for example, the strain *S.*

*epidermidis* 18972. In a second embodiment, the target sequence is common to at least two species of bacteria. In a third embodiment, the target sequence is common to a family of bacteria. The target sequence may be a nucleic acid sequence or a polypeptide sequence. Methods employing sequences common to more than one species of microorganism may be used to screen candidates for broad spectrum anti-bacterial activity.

The invention also provides methods for preventing or treating disease caused by certain bacteria, including *S. epidermidis*, which are carried out by administering to an animal in need of such treatment, in particular a warm-blooded vertebrate, including but not limited to birds and mammals, a compound that specifically inhibits or interferes with the function of a bacterial polypeptide or nucleic acid. In a particularly preferred embodiment, the mammal to be treated is human.

DETAILED DESCRIPTION OF THE INVENTION

The sequences of the present invention include the specific nucleic acid and amino acid sequences set forth in the Sequence Listing that forms a part of the present specification, and which are designated SEQ ID NO: 1–SEQ ID NO: 7544. Use of the terms "SEQ ID NO: 1–SEQ ID NO: 3772", "SEQ ID NO: 3773–SEQ ID NO: 7544, "the sequences depicted in Table 2", etc., is intended, for convenience, to refer to each individual SEQ ID NO individually, and is not intended to refer to the genus of these sequences unless such reference would be indicated. In other words, it is a shorthand for listing all of these sequences individually. The invention encompasses each sequence individually, as well as any combination thereof.

DEFINITIONS

"Nucleic acid" or "polynucleotide" as used herein refers to purine- and pyrimidine-containing polymers of any length, either polyribonucleotides or polydeoxyribonucleotides or mixed polyribo-polydeoxyribo nucleotides. This includes single- and double-stranded molecules, i.e., DNA-DNA, DNA-RNA and RNA-RNA hybrids, as well as "protein nucleic acids" (PNA) formed by conjugating bases to an amino acid backbone. This also includes nucleic acids containing modified bases.

A nucleic acid or polypeptide sequence that is "derived from" a designated sequence refers to a sequence that corresponds to a region of the designated sequence. For nucleic acid sequences, this encompasses sequences that are homologous or complementary to the sequence, as well as "sequence-conservative variants" and "function-conservative variants." For polypeptide sequences, this encompasses "function-conservative variants." Sequence-conservative variants are those in which a change of one or more nucleotides in a given codon position results in no alteration in the amino acid encoded at that position. Function-conservative variants are those in which a given amino acid residue in a polypeptide has been changed without altering the overall conformation and function of the native polypeptide, including, but not limited to, replacement of an amino acid with one having similar physico-chemical properties (such as, for example, acidic, basic, hydrophobic, and the like). "Function-conservative" variants also include any polypeptides that have the ability to elicit antibodies specific to a designated polypeptide.

An "*S. epidermidis*-derived" nucleic acid or polypeptide sequence may or may not be present in other bacterial species, and may or may not be present in all *S. epidermidis* strains. This term is intended to refer to the source from which the sequence was originally isolated. Thus, an *S. epidermidis*-derived polypeptide, as used herein, may be used, e.g., as a target to screen for a broad spectrum antibacterial agent, to search for homologous proteins in other species of bacteria or in eukaryotic organisms such as bacteria humans, etc.

A purified or isolated polypeptide or a substantially pure preparation of a polypeptide are used interchangeably herein and, as used herein, mean a polypeptide that has been separated from other proteins, lipids, and nucleic acids with which it naturally occurs. Preferably, the polypeptide is also separated from substances, e.g., antibodies or gel matrix, e.g., polyacrylamide, which are used to purify it. Preferably, the polypeptide constitutes at least about 10, 20, 50 70, 80 or 95% dry weight of the purified preparation. Preferably, the preparation contains sufficient polypeptide to allow protein sequencing; at least about 1, 10, or preferably 100 mg of polypeptide.

A purified preparation of cells refers to, in the case of plant or animal cells, an in vitro preparation of cells and not an entire intact plant or animal. In the case of cultured cells or microbial cells, it consists of a preparation of at least about 10%, more preferably at least about 50%, of the subject cells.

A purified or isolated or a substantially pure nucleic acid, e.g., a substantially pure DNA, (are terms used interchangeably herein) is a nucleic acid which is one or both of the following: not immediately contiguous with both of the coding sequences with which it is immediately contiguous (i.e., one at the 5' end and one at the 3' end) in the naturally-occurring genome and plasmids of the organism from which the nucleic acid is derived; or which is substantially free of a nucleic acid with which it occurs in the organism from which the nucleic acid is derived. The term includes, for example, a recombinant DNA which is incorporated into a vector, e.g., into an autonomously replicating plasmid or virus, or into the genomic DNA of a prokaryote or eukaryote, or which exists as a separate molecule (e.g., a cDNA or a genomic DNA fragment produced by PCR or restriction endonuclease treatment) independent of other DNA sequences. Substantially pure DNA also includes a recombinant DNA which is part of a hybrid gene encoding additional *S. epidermidis* DNA sequence.

A "contig" as used herein is a nucleic acid representing a continuous stretch of genomic sequence of an organism.

An "open reading frame", also referred to herein as ORF, is a region of nucleic acid which encodes a polypeptide. This region may represent a portion of a coding sequence or a total sequence and can be determined from a stop to stop codon or from a start to stop codon.

As used herein, a "coding sequence" is a nucleic acid which is transcribed into messenger RNA and/or translated into a polypeptide when placed under the control of appropriate regulatory sequences. The boundaries of the coding sequence are determined by a translation start codon at the five prime terminus and a translation stop code at the three prime terminus. A coding sequence can include but is not limited to messenger RNA, synthetic DNA, and recombinant nucleic acid sequences.

A "complement" of a nucleic acid as used herein refers to an anti-parallel or antisense sequence that participates in Watson-Crick base-pairing with the original sequence.

A "gene product" is a protein or structural RNA which is specifically encoded by a gene.

As used herein, the term "probe" refers to a nucleic acid, peptide or other chemical entity which specifically binds to a molecule of interest. Probes are often associated with or capable of associating with a label. A label is a chemical moiety capable of detection. Typical labels comprise dyes, radioisotopes, luminescent and chemiluminescent moieties, fluorophores, enzymes, precipitating agents, amplification sequences, and the like. Similarly, a nucleic acid, peptide or other chemical entity which specifically binds to a molecule of interest and immobilizes such molecule is referred herein as a "capture ligand". Capture ligands are typically associated with or capable of associating with a support such as nitro-cellulose, glass, nylon membranes, beads, particles and the like. The specificity of hybridization is dependent on conditions such as the base pair composition of the nucleotides, and the temperature and salt concentration of the reaction. These conditions are readily discernable to one of ordinary skill in the art using routine experimentation.

"Homologous" refers to the sequence similarity or sequence identity between two polypeptides or between two nucleic acid molecules. When a position in both of the two compared sequences is occupied by the same base or amino acid monomer subunit, e.g., if a position in each of two DNA molecules is occupied by adenine, then the molecules are homologous at that position. The percent of homology between two sequences is a function of the number of matching or homologous positions shared by the two sequences divided by the number of positions compared× 100. For example, if 6 of 10 of the positions in two sequences are matched or homologous then the two sequences are 60% homologous. By way of example, the DNA sequences ATTGCC and TATGGC share 50% homology. Generally, a comparison is made when two sequences are aligned to give maximum homology.

Nucleic acids are hybridizable to each other when at least one strand of a nucleic acid can anneal to the other nucleic acid under defined stringency conditions. Stringency of hybridization is determined by: (a) the temperature at which hybridization and/or washing is performed; and (b) the ionic strength and polarity of the hybridization and washing solutions. Hybridization requires that the two nucleic acids contain complementary sequences; depending on the stringency of hybridization, however, mismatches may be tolerated. Typically, hybridization of two sequences at high stringency (such as, for example, in a solution of 0.5×SSC, at 65° C.) requires that the sequences be essentially completely homologous. Conditions of intermediate stringency (such as, for example, 2×SSC at 65° C.) and low stringency (such as, for example 2×SSC at 55° C.) require correspondingly less overall complementarity between the hybridizing sequences. (1×SSC is 0.15 M NaCl, 0.015 M Na citrate).

The terms peptides, proteins, and polypeptides are used interchangeably herein.

As used herein, the term "surface protein" refers to all surface accessible proteins, e.g. inner and outer membrane proteins, proteins adhering to the cell wall, and secreted proteins.

A polypeptide has S. epidermidis biological activity if it has one, two or preferably more of the following properties: (1) if when expressed in the course of an S. epidermidis infection, it can promote, or mediate the attachment of S. epidermidis to a cell; (2) it has an enzymatic activity, structural or regulatory function characteristic of an S. epidermidis protein; (3) the gene which encodes it can rescue a lethal mutation in an S. epidermidis gene. A polypeptide has biological activity if it is an antagonist, agonist, or super-agonist of a polypeptide having one of the above-listed properties.

A biologically active fragment or analog is one having an in vivo or in vitro activity which is characteristic of the S. epidermidis polypeptides of the invention contained in the Sequence Listing, or of other naturally occurring S. epidermidis polypeptides, e.g., one or more of the biological activities described herein. Especially preferred are fragments which exist in vivo, e.g., fragments which arise from post transcriptional processing or which arise from translation of alternatively spliced RNA's. Fragments include those expressed in native or endogenous cells as well as those made in expression systems, e.g., in CHO (Chinese Hamster Ovary) cells. Because peptides such as S. epidermidis polypeptides often exhibit a range of physiological properties and because such properties may be attributable to different portions of the molecule, a useful S. epidermidis fragment or S. epidermidis analog is one which exhibits a biological activity in any biological assay for S. epidermidis activity. The fragment or analog possesses about 10%, preferably about 40%, more preferably about 60%, 70%, 80% or 90% or greater of the activity of S. epidermidis, in any in vivo or in vitro assay.

Analogs can differ from naturally occurring S. epidermidis polypeptides in amino acid sequence or in ways that do not involve sequence, or both. Non-sequence modifications include changes in acetylation, methylation, phosphorylation, carboxylation, or glycosylation. Preferred analogs include S. epidermidis polypeptides (or biologically active fragments thereof) whose sequences differ from the wild-type sequence by one or more conservative amino acid substitutions or by one or more non-conservative amino acid substitutions, deletions, or insertions which do not substantially diminish the biological activity of the S. epidermidis polypeptide. Conservative substitutions typically include the substitution of one amino acid for another with similar characteristics, e.g., substitutions within the following groups: valine, glycine; glycine, alanine; valine, isoleucine, leucine; aspartic acid, glutamic acid; asparagine, glutamine; serine, threonine; lysine, arginine; and phenylalanine, tyrosine. Other conservative substitutions can be made in view of the table below.

TABLE 1

CONSERVATIVE AMINO ACID REPLACEMENTS

| For Amino Acid | Code | Replace with any of |
|---|---|---|
| Alanine | A | D-Ala, Gly, beta-Ala, L-Cys, D-Cys |
| Arginine | R | D-Arg, Lys, D-Lys, homo-Arg, D-homo-Arg, Met, Ile, D-Met, D-Ile, Orn, D-Orn |
| Asparagine | N | D-Asn, Asp, D-Asp, Glu, D-Glu, Gln, D-Gln |
| Aspartic Acid | D | D-Asp, D-Asn, Asn, Glu, D-Glu, Gln, D-Gln |
| Cysteine | C | D-Cys, S-Me-Cys, Met, D-Met, Thr, D-Thr |
| Glutamine | Q | D-Gln, Asn, D-Asn, Glu, D-Glu, Asp, D-Asp |
| Glutamic Acid | E | D-Glu, D-Asp, Asp, Asn, D-Asn, Gln, D-Gln |
| Glycine | G | Ala, D-Ala, Pro, D-Pro, β-Ala, Acp |
| Isoleucine | I | D-Ile, Val, D-Val, Leu, D-Leu, Met, D-Met |
| Leucine | L | D-Leu, Val, D-Val, Leu, D-Leu, Met, D-Met |
| Lysine | K | D-Lys, Arg, D-Arg, homo-Arg, D-homo-Arg, Met, D-Met, Ile, D-Ile, Orn, D-Orn |
| Methionine | M | D-Met, S-Me-Cys, Ile, D-Ile, Leu, D-Leu, Val, D-Val |
| Phenylalanine | F | D-Phe, Tyr, D-Thr, L-Dopa, His, D-His, Trp, D-Trp, Trans-3,4, or 5-phenylproline, cis-3,4, or 5-phenylproline |

TABLE 1-continued

CONSERVATIVE AMINO ACID REPLACEMENTS

| For Amino Acid | Code | Replace with any of |
|---|---|---|
| Proline | P | D-Pro, L-I-thioazolidine-4-carboxylic acid, D-or L-1-oxazolidine-4-carboxylic acid |
| Serine | S | D-Ser, Thr, D-Thr, allo-Thr, Met, D-Met, Met(O), D-Met(O), L-Cys, D-Cys |
| Threonine | T | D-Thr, Ser, D-Ser, allo-Thr, Met, D-Met, Met(O), D-Met(O), Val, D-Val |
| Tyrosine | Y | D-Tyr, Phe, D-Phe, L-Dopa, His, D-His |
| Valine | V | D-Val, Leu, D-Leu, Ile, D-Ile, Met, D-Met |

Other analogs within the invention are those with modifications which increase peptide stability; such analogs may contain, for example, one or more non-peptide bonds (which replace the peptide bonds) in the peptide sequence. Also included are: analogs that include residues other than naturally occurring L-amino acids, e.g., D-amino acids or non-naturally occurring or synthetic amino acids, e.g., β or γ amino acids; and cyclic analogs.

As used herein, the term "fragment", as applied to an *S. epidermidis* analog, will ordinarily be at least about 20 residues, more typically at least about 40 residues, preferably at least about 60 residues in length. Fragments of *S. epidermidis* polypeptides can be generated by methods known to those skilled in the art. The ability of an *Staphylococcus* fragment to exhibit a biological activity of *S. epidermidis* polypeptide can be assessed by methods known to those skilled in the art as described herein. Also included are *S. epidermidis* polypeptides containing residues that are not required for biological activity of the peptide or that result from alternative mRNA splicing or alternative protein processing events.

An "immunogenic component" as used herein is a moiety, such as an *S. epidermidis* polypeptide, analog or fragment thereof, that is capable of eliciting a humoral and/or cellular immune response in a host animal.

An "antigenic component" as used herein is a moiety, such as an *S. epidermidis* polypeptide, analog or fragment thereof, that is capable of binding to a specific antibody with sufficiently high affinity to form a detectable antigen-antibody complex.

The term "antibody" as used herein is intended to include fragments thereof which are specifically reactive with *S. epidermidis* polypeptides.

As used herein, the term "cell-specific promoter" means a DNA sequence that serves as a promoter, i.e., regulates expression of a selected DNA sequence operably linked to the promoter, and which effects expression of the selected DNA sequence in specific cells of a tissue. The term also covers so-called "leaky" promoters, which regulate expression of a selected DNA primarily in one tissue, but cause expression in other tissues as well.

Misexpression, as used herein, refers to a non-wild type pattern of gene expression. It includes: expression at non-wild type levels, i.e., over or under expression; a pattern of expression that differs from wild type in terms of the time or stage at which the gene is expressed, e.g., increased or decreased expression (as compared with wild type) at a predetermined developmental period or stage; a pattern of expression that differs from wild type in terms of increased expression (as compared with wild type) in a predetermined cell type or tissue type; a pattern of expression that differs from wild type in terms of the splicing size, amino acid sequence, post-translational modification, or biological activity of the expressed polypeptide; a pattern of expression that differs from wild type in terms of the effect of an environmental stimulus or extracellular stimulus on expression of the gene, e.g., a pattern of increased or decreased expression (as compared with wild type) in the presence of an increase or decrease in the strength of the stimulus.

As used herein, "host cells" and other such terms denoting microorganisms or higher eukaryotic cell lines cultured as unicellular entities refers to cells which can become or have been used as recipients for a recombinant vector or other transfer DNA, and include the progeny of the original cell which has been transfected. It is understood by individuals skilled in the art that the progeny of a single parental cell may not necessarily be completely identical in genomic or total DNA compliment to the original parent, due to accident or deliberate mutation.

As used herein, the term "control sequence" refers to a nucleic acid having a base sequence which is recognized by the host organism to effect the expression of encoded sequences to which they are ligated. The nature of such control sequences differs depending upon the host organism; in prokaryotes, such control sequences generally include a promoter, ribosomal binding site, terminators, and in some cases operators; in eukaryotes, generally such control sequences include promoters, terminators and in some instances, enhancers. The term control sequence is intended to include at a minimum, all components whose presence is necessary for expression, and may also include additional components whose presence is advantageous, for example, leader sequences.

As used herein, the term "operably linked" refers to sequences joined or ligated to function in their intended manner. For example, a control sequence is operably linked to coding sequence by ligation in such a way that expression of the coding sequence is achieved under conditions compatible with the control sequence and host cell.

The "metabolism" of a substance, as used herein, means any aspect of the expression, function, action, or regulation of the substance. The metabolism of a substance includes modifications, e.g., covalent or non-covalent modifications of the substance. The metabolism of a substance includes modifications, e.g., covalent or non-covalent modification, the substance induces in other substances. The metabolism of a substance also includes changes in the distribution of the substance. The metabolism of a substance includes changes the substance induces in the distribution of other substances.

A "sample" as used herein refers to a biological sample, such as, for example, tissue or fluid isloated from an individual (including without limitation plasma, serum, cerebrospinal fluid, lymph, tears, saliva and tissue sections) or from in vitro cell culture constituents, as well as samples from the environment.

Technical and scientific terms used herein have the meanings commonly understood by one of ordinary skill in the art to which the present invention pertains, unless otherwise defined. Reference is made herein to various methodologies known to those of skill in the art. Publications and other materials setting forth such known methodologies to which reference is made are incorporated herein by reference in their entireties as though set forth in full. The practice of the invention will employ, unless otherwise indicated, conventional techniques of chemistry, molecular biology, microbiology, recombinant DNA, and immunology, which are within the skill of the art. Such techniques are explained fully in the literature. See e.g., Sambrook, Fritsch, and Maniatis, *Molecular Cloning; Laboratory Manual* 2nd ed. (1989); *DNA Cloning*, Volumes I and II (D. N Glover ed. 1985); *Oligonucleotide Synthesis* (M. J. Gait ed, 1984); *Nucleic Acid Hybridization* (B. D. Hames & S. J. Higgins eds. 1984); the series, *Methods in Enzymoloqy* (Academic Press, Inc.), particularly Vol. 154 and Vol. 155 (Wu and Grossman, eds.); *PCR-A Practical Approach* (McPherson, Quirke, and Taylor, eds., 1991); *Immunology*, 2d Edition, 1989, Roitt et al., C.V. Mosby Company, and New York; *Advanced Immunology*, 2d Edition, 1991, Male et al., Grower Medical Publishing, New York.; *DNA Cloning: A Practical Approach*, Volumes I and II, 1985 (D. N. Glover ed.); *Oligonucleotide Synthesis*, 1984, (M. L. Gait ed); *Transcription and Translation*, 1984 (Hames and Higgins eds.); *Animal Cell Culture*, 1986 (R. I. Freshney ed.); *Immobilized Cells and Enzymes*, 1986 (IRL Press); Perbal, 1984, *A Practical Guide to Molecular Cloning; Gene Transfer Vectors for Mammalian Cells*, 1987 (J. H. Miller and M. P. Calos eds., Cold Spring Harbor Laboratory); Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997).

Any suitable materials and/or methods known to those of skill can be utilized in carrying out the present invention; however, preferred materials and/or methods are described. Materials, reagents and the like to which reference is made in the following description and examples are obtainable from commercial sources, unless otherwise noted.

*S. epidermidis* Genomic Sequence

This invention provides nucleotide sequences of the genome of *S. epidermidis* which thus comprises a DNA sequence library of *S. epidermidis* genomic DNA. The detailed description that follows provides nucleotide sequences of *S. epidermidis*, and also describes how the sequences were obtained and how ORFs and protein-coding sequences were identified. Also described are compositions and methods of using the disclosed *S. epidermidis* sequences in methods including diagnostic and therapeutic applications. Furthermore, the library can be used as a database for identification and comparison of medically important sequences in this and other strains of *S. epidermidis*.

To determine the genomic sequence of *S. epidermidis*, DNA from strain 18972 of *S. epidermidis* was isolated and a library of DNA fragments were transformed into DH5α cells. DNA sequencing was achieved using established ABI sequencing methods on ABI377 automated DNA sequencers. The cloning and sequencing procedures are described in more detail in the Exemplification.

Individual sequence reads were assembled using PHRAP (P. Green, Abstracts of DOE Human Genome Program Contractor-Grantee Workshop V, January 1996, p. 157). The average contig length was about 3–4 kb.

All subsequent steps were based on sequencing by ABI377 automated DNA sequencing methods. The cloning and sequencing procedures are described in more detail in the Exemplification.

A variety of approaches may be used to order the contigs so as to obtain a continuous sequence representing the entire *S. epidermidis* genome. Synthetic oligonucleotides are designed that are complementary to sequences at the end of each contig. These oligonucleotides may be hybridized to libaries of *S. epidermidis* genomic DNA in, for example, lambda phage vectors or plasmid vectors to identify clones that contain sequences corresponding to the junctional regions between individual contigs. Such clones are then used to isolate template DNA and the same oligonucleotides are used as primers in polymerase chain reaction (PCR) to amplify junctional fragments, the nucleotide sequence of which is then determined.

The *S. epidermidis* sequences were analyzed for the presence of open reading frames (ORFs) comprising at least 180 nucleotides. As a result of the analysis of ORFs based on stop-to-stop codon reads, it should be understood that these ORFs may not correspond to the ORF of a naturally-occurring *S. epidermidis* polypeptide. These ORFs may contain start codons which indicate the initiation of protein synthesis of a naturally-occurring *S. epidermidis* polypeptide. Such start codons within the ORFs provided herein were identified by those of ordinary skill in the relevant art, and the resulting ORF and the encoded *S. epidermidis* polypeptide is within the scope of this invention. For example, within the ORFs a codon such as AUG or GUG (encoding methionine or valine) which is part of the initiation signal for protein synthesis were identified and the portion of an ORF to corresponding to a naturally-occurring *S. epidermidis* polypeptide was recognized. The predicted coding regions were defined by evaluating the coding potential of such sequences with the program GENEMARK™ (Borodovsky and McIninch, 1993, *Comp.* 17:123).

Each predicted ORF amino acid sequence was compared with all sequences found in current GENBANK, SWISS-PROT, and PIR databases using the BLAST algorithm. BLAST identifies local alignments occurring by chance between the ORF sequence and the sequence in the databank (Altschal et al., 1990, L Mol. Biol. 215:403–410). Homologous ORFs (probabilities less than $10^{-5}$ by chance) and ORF's that are probably non-homologous (probabilities greater than $10^{-5}$ by chance) but have good codon usage were identified. Both homologous, sequences and non-homologous sequences with good codon usage, are likely to encode proteins and are encompassed by the invention.

*S. epidermidis* Plasmid Sequences

This invention also provides nucleotide sequences of two naturally occurs plasmids which thus comprises a DNA sequence library of *S. epidermidis* plasmid DNA. One plasmid disclosed is approximately 39 Kb and nucleic acid sequence is contained within SEQ ID NO: 3703–SEQ ID NO: 3764. The other plasmid is approximately 2.9 Kb contained within SEQ ID NO: 3765–SEQ ID NO: 3772. The detailed description that follows provides nucleotide sequences of *S. epidermidis*, and also describes how the sequences were obtained and how ORFs and protein-coding sequences were identified. Also described are compositions and methods of using the disclosed *S. epidermidis* sequences in methods including diagnostic and therapeutic applications. The plasmid sequences can also be used as vectors and gene expression. Furthermore, the plasmid library can be used as a database for identification and comparison of medically important sequences in this and other strains of *S. epidermidis*.

Similar methods were used to determine to plasmid sequences of *S. epidermidis* as described above in determining the genomic sequence. A more detailed description of the methods are in the Exemplification.

*S. epidermidis* Nucleic Acids

The present invention provides a library of *S. epidermidis*-derived nucleic acid sequences. The libraries provide probes, primers, and markers which are used as markers in epidemiological studies. The present invention also provides a library of *S. epidermidis*-derived nucleic acid sequences which comprise or encode targets for therapeutic drugs.

The nucleic acids of this invention may be obtained directly from the DNA of the above referenced *S. epidermidis* strain by using the polymerase chain reaction (PCR). See "*PCR, A Practical Approach*" (McPherson, Quirke, and Taylor, eds., IRL Press, Oxford, UK, 1991) for details about the PCR. High fidelity PCR is used to ensure a faithful DNA copy prior to expression. In addition, the authenticity of amplified products is verified by conventional sequencing methods. Clones carrying the desired sequences described in this invention may also be obtained by screening the libraries by means of the PCR or by hybridization of synthetic oligonucleotide probes to filter lifts of the library colonies or plaques as known in the art (see, e.g., Sambrook et al., *Molecular Cloning, A Laboratory Manual* 2nd edition, 1989, Cold Spring Harbor Press, NY).

It is also possible to obtain nucleic acids encoding *S. epidermidis* polypeptides from a cDNA library in accordance with protocols herein described. A cDNA encoding an *S. epidermidis* polypeptide can be obtained by isolating total mRNA from an appropriate strain. Double stranded cDNAs can then be prepared from the total mRNA. Subsequently, the cDNAs can be inserted into a suitable plasmid or viral (e.g., bacteriophage) vector using any one of a number of known techniques. Genes encoding *S. epidermidis* polypeptides can also be cloned using established polymerase chain reaction techniques in accordance with the nucleotide sequence information provided by the invention. The nucleic acids of the invention can be DNA or RNA. Preferred nucleic acids of the invention are contained in the Sequence Listing.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

In another example, DNA can be chemically synthesized using, e.g., the phosphoramidite solid support method of Matteucci et al., 1981, *J. Am. Chem. Soc.* 103:3185, the method of Yoo et al., 1989, *J. Biol. Chem.* 764:17078, or other well known methods. This can be done by sequentially linking a series of oligonucleotide cassettes comprising pairs of synthetic oligonucleotides, as described below.

Nucleic acids isolated or synthesized in accordance with features of the present invention are useful, by way of example, without limitation, as probes, primers, capture ligands, antisense genes and for developing expression systems for the synthesis of proteins and peptides corresponding to such sequences. As probes, primers, capture ligands and antisense agents, the nucleic acid normally consists of all or part (approximately twenty or more nucleotides for specificity as well as the ability to form stable hybridization products) of the nucleic acids of the invention contained in the Sequence Listing. These uses are described in further detail below.

Probes

A nucleic acid isolated or synthesized in accordance with the sequence of the invention contained in the Sequence Listing can be used as a probe to specifically detect *S. epidermidis*. With the sequence information set forth in the present application, sequences of twenty or more nucleotides are identified which provide the desired inclusivity and exclusivity with respect to *S. epidermidis*, and extraneous nucleic acids likely to be encountered during hybridization conditions. More preferably, the sequence will comprise at least about twenty to thirty nucleotides to convey stability to the hybridization product formed between the probe and the intended target molecules.

Sequences larger than 1000 nucleotides in length are difficult to synthesize but can be generated by recombinant DNA techniques. Individuals skilled in the art will readily recognize that the nucleic acids, for use as probes, can be provided with a label to facilitate detection of a hybridization product.

Nucleic acid isolated and synthesized in accordance with the sequence of the invention contained in the Sequence Listing can also be useful as probes to detect homologous regions (especially homologous genes) of other *Staphylococcus* species using appropriate stringency hybridization conditions as described herein.

Capture Ligand

For use as a capture ligand, the nucleic acid selected in the manner described above with respect to probes, can be readily associated with a support. The manner in which nucleic acid is associated with supports is well known. Nucleic acid having twenty or more nucleotides in a sequence of the invention contained in the Sequence Listing have utility to separate *S. epidermidis* nucleic acid from one strain from the nucleic acid of other another strain as well as from other organisms. Nucleic acid having twenty or more nucleotides in a sequence of the invention contained in the Sequence Listing can also have utility to separate other *Staphylococcus* species from each other and from other organisms. Preferably, the sequence will comprise at least about twenty nucleotides to convey stability to the hybridization product formed between the probe and the intended target molecules. Sequences larger than 1000 nucleotides in length are difficult to synthesize but can be generated by recombinant DNA techniques.

Primers

Nucleic acid isolated or synthesized in accordance with the sequences described herein have utility as primers for the amplification of *S. epidermidis* nucleic acid. These nucleic acids may also have utility as primers for the amplification of nucleic acids in other *Staphylococcus* species. With respect to polymerase chain reaction (PCR) techniques, nucleic acid sequences of ≧10–15 nucleotides of the invention contained in the Sequence Listing have utility in conjunction with suitable enzymes and reagents to create copies of *S. epidermidis* nucleic acid. More preferably, the sequence will comprise twenty or more nucleotides to convey stability to the hybridization product formed between the primer and the intended target molecules. Binding conditions of primers greater than 100 nucleotides are more difficult to control to obtain specificity. High fidelity PCR can be used to ensure a faithful DNA copy prior to expression. In addition, amplified products can be checked by conventional sequencing methods.

The copies can be used in diagnostic assays to detect specific sequences, including genes from *S. epidermidis* and/or other *Staphylococcus* species. The copies can also be incorporated into cloning and expression vectors to generate polypeptides corresponding to the nucleic acid synthesized by PCR, as is described in greater detail herein.

The nucleic acids of the present invention find use as templates for the recombinant production of *S. epidermidis*-derived peptides or polypeptides Antisense Nucleic acid or nucleic acid-hybridizing derivatives isolated or synthesized in accordance with the sequences described herein have utility as antisense agents to prevent the expression of S. epidermidis genes. These sequences also have utility as antisense agents to prevent expression of genes of other Staphylococcus species.

In one embodiment, nucleic acid or derivatives corresponding to S. epidermidis nucleic acids is loaded into a suitable carrier such as a liposome or bacteriophage for introduction into bacterial cells. For example, a nucleic acid having twenty or more nucleotides is capable of binding to bacteria nucleic acid or bacteria messenger RNA. Preferably, the antisense nucleic acid is comprised of 20 or more nucleotides to provide necessary stability of a hybridization product of non-naturally occurring nucleic acid and bacterial nucleic acid and/or bacterial messenger RNA. Nucleic acid having a sequence greater than 1000 nucleotides in length is difficult to synthesize but can be generated by recombinant DNA techniques. Methods for loading antisense nucleic acid in liposomes is known in the art as exemplified by U.S. Pat. No. 4,241,046 issued Dec. 23, 1980 to Papahadjopoulos et al.

The present invention encompasses isolated polypeptides and nucleic acids derived from S. epidermidis that are useful as reagents for diagnosis of bacterial infection, components of effective anti-bacterial vaccines, and/or as targets for anti-bacterial drugs, including anti-S. epidermidis drugs.

Expression of S. epidermidis Nucleic Acids

Table 2, which is appended herewith and which forms part of the present specification, provides a list of open reading frames (ORFs) in both strands and a putative identification of the particular function of a polypeptide which is encoded by each ORF, based on the homology match (determined by the BLASTP2 algorithm) of the predicted polypeptide with known proteins encoded by ORFs in other organisms. An ORF is a region of nucleic acid which encodes a polypeptide. This region may represent a portion of a coding sequence or a total sequence and was determined from stop to stop codons. The first column contains a designation for the ORF ("ORF Name"). The second and third columns list the SEQ ID numbers for the nucleic acid ("NT ID") and amino acid ("AA ID") sequences corresponding to each ORF, respectively. The fourth and fifth columns list the length of the nucleic acid ORF ("NT LN") and the length of the amino acid ORF ("AA LN"), respectively. The nucleotide sequence corresponding to each ORF begins at the first nucleotide immediately following a stop codon and ends at the nucleotide immediately preceding the next downstream stop codon in the same reading frame. It will be recognized by one skilled in the art that the natural translation initiation sites will correspond to ATG, GTG, or TTG codons located within the ORFs. The natural initiation sites depend not only on the sequence of a start codon but also on the context of the DNA sequence adjacent to the start codon. Usually, a recognizable ribosome binding site is found within 20 nucleotides upstream from the initiation codon. In some cases where genes are translationally coupled and coordinately expressed together in "operons", ribosome binding sites are not present, but the initiation codon of a downstream gene may occur very close to, or overlap, the stop codon of the an upstream gene in the same operon. The correct start codons can be generally identified without undue experimentation because only a few codons need be tested. It is recognized that the translational machinery in bacteria initiates all polypeptide chains with the amino acid methionine, regardless of the sequence of the start codon. In some cases, polypeptides are post-translationally modified, resulting in an N-terminal amino acid other than methionine in vivo. The sixth and seventh columns provide metrics for assessing the likelihood of the homology match (determined by the BLASTP2 algorithm), as is known in the art, to the genes indicated in the description frame ("Desciption") below the ORF Name. These genes in the Description were identified when the designated ORF was compared against a comprehensive non-redundant protein database. Specifically, the sixth column represents the Blast Score ("Score") for the match (a higher score is a better match), and the seventh column represents the probability ("P-value") for the match (the probability that such a match can have occurred by chance; the lower the value, the more likely the match is valid). If a BLASTP2 score of less than 100 was obtained, no value is reported in the table. The Description provides, where available, the Swissprot accession number (SP), the locus name (LN), the Organism (OR), Source of variant (SR), E.C. number (EC), the gene name (GN), the product name (PN), the Function Description (FN), Left End (LE), Right End (RE), Coding Direction (DI), and the description (DE) or notes (NT) for each ORF. This information allows one of ordinary skill in the art to determine a potential use for each identified coding sequence and, as a result, allows to use the polypeptides of the present invention for commercial and industrial purposes.

Using the information provided in SEQ ID NO: 1–SEQ ID NO: 3772, SEQ ID NO: 3773–SEQ ID NO: 7544 and in Table 2 together with routine cloning and sequencing methods, one of ordinary skill in the art will be able to clone and sequence all the nucleic acid fragments of interest including open reading frames (ORFs) encoding a large variety of proteins of S. epidermidis.

Nucleic acid isolated or synthesized in accordance with the sequences described herein have utility to generate polypeptides. The nucleic acid of the invention exemplified in SEQ ID NO: 1–SEQ ID NO: 3772 and in Table 2 or fragments of said nucleic acid encoding active portions of S. epidermidis polypeptides can be cloned into suitable vectors or used to isolate nucleic acid. The isolated nucleic acid is combined with suitable DNA linkers and cloned into a suitable vector.

The function of a specific gene or operon can be ascertained by expression in a bacterial strain under conditions where the activity of the gene product(s) specified by the gene or operon in question can be specifically measured. Alternatively, a gene product may be produced in large quantities in an expressing strain for use as an antigen, an industrial reagent, for structural studies, etc. This expression can be accomplished in a mutant strain which lacks the activity of the gene to be tested, or in a strain that does not produce the same gene product(s). This includes, but is not limited to, Eucaryotic species such as the yeast Saccharomyces cerevisiae, Methanobacterium strains or other Archaea, and Eubacteria such as E. coli, B. Subtilis, S. Aureus, S. Pneumonia or Pseudomonas putida. In some cases the expression host will utilize the natural S. epidermidis promoter whereas in others, it will be necessary to drive the gene with a promoter sequence derived from the expressing organism (e.g., an E. coli beta-galactosidase promoter for expression in E. coli).

To express a gene product using the natural S. epidermidis promoter, a procedure such as the following can be used. A restriction fragment containing the gene of interest, together with its associated natural promoter element and regulatory sequences (identified using the DNA sequence data) is cloned into an appropriate recombinant plasmid containing an origin of replication that functions in the host organism and an appropriate selectable marker. This can be accomplished by a number of procedures known to those skilled in the art. It is most preferably done by cutting the plasmid and the fragment to be cloned with the same restriction enzyme to produce compatible ends that can be ligated to join the two pieces together. The recombinant plasmid is introduced into the host organism by, for example, electroporation and cells containing the recombinant plasmid are identified by selection for the marker on the plasmid. Expression of the desired gene product is detected using an assay specific for that gene product.

In the case of a gene that requires a different promoter, the body of the gene (coding sequence) is specifically excised and cloned into an appropriate expression plasmid. This subcloning can be done by several methods, but is most easily accomplished by PCR amplification of a specific fragment and ligation into an expression plasmid after treating the PCR product with a restriction enzyme or exonuclease to create suitable ends for cloning.

A suitable host cell for expression of a gene can be any procaryotic or eucaryotic cell. Suitable methods for transforming host cells can be found in Sambrook et al. (*Molecular Cloning: A Laboratory Manual*, 2nd Edition, Cold Spring Harbor Laboratory Press (1989)), and other laboratory textbooks.

For example, a host cell transfected with a nucleic acid vector directing expression of a nucleotide sequence encoding an *S. epidermidis* polypeptide can be cultured under appropriate conditions to allow expression of the polypeptide to occur. Suitable media for cell culture are well known in the art. Polypeptides of the invention can be isolated from cell culture medium, host cells, or both using techniques known in the art for purifying proteins including ion-exchange chromatography, gel filtration chromatography, ultrafiltration, electrophoresis, and immunoaffinity purification with antibodies specific for such polypeptides. Additionally, in many situations, polypeptides can be produced by chemical cleavage of a native protein (e.g., tryptic digestion) and the cleavage products can then be purified by standard techniques.

In the case of membrane bound proteins, these can be isolated from a host cell by contacting a membrane-associated protein fraction with a detergent forming a solubilized complex, where the membrane-associated protein is no longer entirely embedded in the membrane fraction and is solubilized at least to an extent which allows it to be chromatographically isolated from the membrane fraction. Chromatographic techniques which can be used in the final purification step are known in the art and include hydrophobic interaction, lectin affinity, ion exchange, dye affinity and immunoaffinity.

One strategy to maximize recombinant *S. epidermidis* peptide expression in *E. coli* is to express the protein in a host bacteria with an impaired capacity to proteolytically cleave the recombinant protein (Gottesman, S., *Gene Expression Technology: Methods in Enzymology* 185, Academic Press, San Diego, Calif. (1990) 119–128). Another strategy would be to alter the nucleic acid encoding an *S. epidermidis* peptide to be inserted into an expression vector so that the individual codons for each amino acid would be those preferentially utilized in highly expressed *E. coli* proteins (Wada et al., (1992) *Nuc. Acids Res.* 20:2111–2118). Such alteration of nucleic acids of the invention can be carried out by standard DNA synthesis techniques.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See, e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

The present invention provides a library of *S. epidermidis*-derived nucleic acid sequences. The libraries provide probes, primers, and markers which can be used as markers in epidemiological studies. The present invention also provides a library of *S. epidermidis*-derived nucleic acid sequences which comprise or encode targets for therapeutic drugs.

Nucleic acids comprising any of the sequences disclosed herein or sub-sequences thereof can be prepared by standard methods using the nucleic acid sequence information provided in SEQ ID NO: 1–SEQ ID NO: 3772. For example, DNA can be chemically synthesized using, e.g., the phosphoramidite solid support method of Matteucci et al., 1981, *J. Am. Chem. Soc.* 103:3185, the method of Yoo et al., 1989, *J. Biol. Chem.* 764:17078, or other well known methods. This can be done by sequentially linking a series of oligonucleotide cassettes comprising pairs of synthetic oligonucleotides, as described below.

Of course, due to the degeneracy of the genetic code, many different nucleotide sequences can encode polypeptides having the amino acid sequences defined by SEQ ID NO: 3773–SEQ ID NO: 7544 or sub-sequences thereof. The codons can be selected for optimal expression in prokaryotic or eukaryotic systems. Such degenerate variants are also encompassed by this invention.

Insertion of nucleic acids (typically DNAs) encoding the polypeptides of the invention into a vector is easily accomplished when the termini of both the DNAs and the vector comprise compatible restriction sites. If this cannot be done, it may be necessary to modify the termini of the DNAs and/or vector by digesting back single-stranded DNA overhangs generated by restriction endonuclease cleavage to produce blunt ends, or to achieve the same result by filling in the single-stranded termini with an appropriate DNA polymerase.

Alternatively, any site desired may be produced, e.g., by ligating nucleotide sequences (linkers) onto the termini. Such linkers may comprise specific oligonucleotide sequences that define desired restriction sites. Restriction sites can also be generated by the use of the polymerase chain reaction (PCR). See, e.g., Saiki et al., 1988, *Science* 239:48. The cleaved vector and the DNA fragments may also be modified if required by homopolymeric tailing.

The nucleic acids of the invention may be isolated directly from cells. Alternatively, the polymerase chain reaction (PCR) method can be used to produce the nucleic acids of the invention, using either chemically synthesized strands or genomic material as templates. Primers used for PCR can be synthesized using the sequence information provided herein and can further be designed to introduce appropriate new restriction sites, if desirable, to facilitate incorporation into a given vector for recombinant expression.

The nucleic acids of the present invention may be flanked by natural *S. epidermidis* regulatory sequences, or may be associated with heterologous sequences, including promoters, enhancers, response elements, signal sequences, polyadenylation sequences, introns, 5'- and 3'-noncoding regions, and the like. The nucleic acids may also be modified by many means known in the art. Non-limiting examples of such modifications include methylation, "caps", substitution of one or more of the naturally occurring nucleotides with an analog, internucleotide modifications such as, for example, those with uncharged linkages (e.g., methyl phosphonates, phosphotriesters, phosphoroamidates, carbamates, etc.) and with charged linkages (e.g., phosphorothioates, phosphorodithioates, etc.). Nucleic acids may contain one or more additional covalently linked moieties, such as, for example, proteins (e.g., nucleases, toxins, antibodies, signal peptides, poly-L-lysine, etc.), intercalators (e.g., acridine, psoralen, etc.), chelators (e.g., metals, radioactive metals, iron, oxidative metals, etc.), and alkylators. PNAs are also included. The nucleic acid may be derivatized by formation of a methyl or ethyl phosphotriester or an alkyl phosphoramidate linkage. Furthermore, the nucleic acid sequences of the present invention may also be modified with a label capable of providing a detectable signal, either directly or indirectly. Exemplary labels include radioisotopes, fluorescent molecules, biotin, and the like.

The invention also provides nucleic acid vectors comprising the disclosed S. epidermidis-derived sequences or derivatives or fragments thereof. A large number of vectors, including plasmid and bacterial vectors, have been described for replication and/or expression in a variety of eukaryotic and prokaryotic hosts, and may be used for cloning or protein expression.

The encoded S. epidermidis polypeptides may be expressed by using many known vectors, such as pUC plasmids, pET plasmids (Novagen, Inc., Madison, Wis.), or pRSET or pREP (Invitrogen, San Diego, Calif.), and many appropriate host cells, using methods disclosed or cited herein or otherwise known to those skilled in the relevant art. The particular choice of vector/host is not critical to the practice of the invention.

Recombinant cloning vectors will often include one or more replication systems for cloning or expression, one or more markers for selection in the host, e.g. antibiotic resistance, and one or more expression cassettes. The inserted S. epidermidis coding sequences may be synthesized by standard methods, isolated from natural sources, or prepared as hybrids, etc. Ligation of the S. epidermidis coding sequences to transcriptional regulatory elements and/or to other amino acid coding sequences may be achieved by known methods. Suitable host cells may be transformed/transfected/infected as appropriate by any suitable method including electroporation, $CaCl_2$ mediated DNA uptake, bacterial infection, microinjection, microprojectile, or other established methods.

Appropriate host cells include bacteria, archebacteria, fungi, especially yeast, and plant and animal cells, especially mammalian cells. Of particular interest are S. epidermidis, E. coli, B. Subtilis, Saccharomyces cerevisiae, Saccharomyces carlsbergensis, Schizosaccharomyces pombi, SF9 cells, C129 cells, 293 cells, Neurospora, and CHO cells, COS cells, HeLa cells, and immortalized mammalian myeloid and lymphoid cell lines. Preferred replication systems include M13, ColE1, SV40, baculovirus, lambda, adenovirus, and the like. A large number of transcription initiation and termination regulatory regions have been isolated and shown to be effective in the transcription and translation of heterologous proteins in the various hosts. Examples of these regions, methods of isolation, manner of manipulation, etc. are known in the art. Under appropriate expression conditions, host cells can be used as a source of recombinantly produced S. epidermidis-derived peptides and polypeptides.

Advantageously, vectors may also include a transcription regulatory element (i.e., a promoter) operably linked to the S. epidermidis portion. The promoter may optionally contain operator portions and/or ribosome binding sites. Non-limiting examples of bacterial promoters compatible with E. coli include: b-lactamase (penicillinase) promoter; lactose promoter; tryptophan (trp) promoter; araBAD (arabinose) operon promoter; lambda-derived $P_1$ promoter and N gene ribosome binding site; and the hybrid tac promoter derived from sequences of the trp and lac UV5 promoters. Non-limiting examples of yeast promoters include 3-phosphoglycerate kinase promoter, glyceraldehyde-3-phosphate dehydrogenase (GAPDH) promoter, galactokinase (GAL1) promoter, galactoepimerase promoter, and alcohol dehydrogenase (ADH) promoter. Suitable promoters for mammalian cells include without limitation viral promoters such as that from Simian Virus 40 (SV40), Rous sarcoma virus (RSV), adenovirus (ADV), and bovine papilloma virus (BPV). Mammalian cells may also require terminator sequences, polyA addition sequences and enhancer sequences to increase expression. Sequences which cause amplification of the gene may also be desirable. Furthermore, sequences that facilitate secretion of the recombinant product from cells, including, but not limited to, bacteria, yeast, and animal cells, such as secretory signal sequences and/or prohormone pro region sequences, may also be included. These sequences are well described in the art.

Nucleic acids encoding wild-type or variant S. epidermidis-derived polypeptides may also be introduced into cells by recombination events. For example, such a sequence can be introduced into a cell, and thereby effect homologous recombination at the site of an endogenous gene or a sequence with substantial identity to the gene. Other recombination-based methods such as nonhomologous recombinations or deletion of endogenous genes by homologous recombination may also be used.

The nucleic acids of the present invention find use as templates for the recombinant production of S. epidermidis-derived peptides or polypeptides.

Identification and Use of S. epidermidis Nucleic Acid Sequences

The disclosed S. epidermidis polypeptide and nucleic acid sequences, or other sequences that are contained within ORFs, including complete protein-coding sequences, of which any of the disclosed S. epidermidis-specific sequences forms a part, are useful as target components for diagnosis and/or treatment of S. epidermidis-caused infection It will be understood that the sequence of an entire protein-coding sequence of which each disclosed nucleic acid sequence forms a part can be isolated and identified based on each disclosed sequence. This can be achieved, for example, by using an isolated nucleic acid encoding the disclosed sequence, or fragments thereof, to prime a sequencing reaction with genomic S. epidermidis DNA as template; this is followed by sequencing the amplified product. The isolated nucleic acid encoding the disclosed sequence, or fragments thereof, can also be hybridized to S. epidermidis genomic libraries to identify clones containing additional complete segments of the protein-coding sequence of which the shorter sequence forms a part. Then, the entire protein-coding sequence, or fragments thereof, or nucleic acids encoding all or part of the sequence, or sequence-conservative or function-conservative variants thereof, may be employed in practicing the present invention.

Preferred sequences are those that are useful in diagnostic and/or therapeutic applications. Diagnostic applications include without limitation nucleic-acid-based and antibody-based methods for detecting bacterial infection. Therapeutic applications include without limitation vaccines, passive immunotherapy, and drug treatments directed against gene products that are both unique to bacteria and essential for growth and/or replication of bacteria.

Identification of Nucleic Acids Encoding Vaccine Components and Targets for Agents Effective Against S. epidermidis The disclosed S. epidermidis genome sequence includes segments that direct the synthesis of ribonucleic acids and polypeptides, as well as origins of replication, promoters, other types of regulatory sequences, and intergenic nucleic acids. The invention encompasses nucleic acids encoding immunogenic components of vaccines and targets for agents effective against S. epidermidis. Identification of said immunogenic components involved in the determination of the function of the disclosed sequences, which can be achieved using a variety of approaches. Non-limiting examples of these approaches are described briefly below.

Homology to Known Sequences:

Computer-assisted comparison of the disclosed S. epidermidis sequences with previously reported sequences present in publicly available databases is useful for identifying functional S. epidermidis nucleic acid and polypeptide sequences. It will be understood that protein-coding sequences, for example, may be compared as a whole, and that a high degree of sequence homology between two proteins (such as, for example, >80–90%) at the amino acid level indicates that the two proteins also possess some degree of functional homology, such as, for example, among enzymes involved in metabolism, DNA synthesis, or cell wall synthesis, and proteins involved in transport, cell division, etc. In addition, many structural features of particular protein classes have been identified and correlate with specific consensus sequences, such as, for example, binding domains for nucleotides, DNA, metal ions, and other small molecules; sites for covalent modifications such as phosphorylation, acylation, and the like; sites of protein: protein interactions, etc. These consensus sequences may be quite short and thus may represent only a fraction of the entire protein-coding sequence. Identification of such a feature in an S. epidermidis sequence is therefore useful in determining the function of the encoded protein and identifying useful targets of antibacterial drugs.

Of particular relevance to the present invention are structural features that are common to secretory, transmembrane, and surface proteins, including secretion signal peptides and hydrophobic transmembrane domains. S. epidermidis proteins identified as containing putative signal sequences and/ or transmembrane domains are useful as immunogenic components of vaccines.

Targets for therapeutic drugs according to the invention include, but are not limited to, polypeptides of the invention, whether unique to S. epidermidis or not, that are essential for growth and/or viability of S. epidermidis under at least one growth condition. Polypeptides essential for growth and/or viability can be determined by examining the effect of deleting and/or disrupting the genes, i.e., by so-called gene "knockout". Alternatively, genetic footprinting can be used (Smith et al., 1995, Proc. Natl. Acad Sci. USA 92:5479–6433; Published International Application WO 94/26933; U.S. Pat. No. 5,612,180). Still other methods for assessing essentiality includes the ability to isolate conditional lethal mutations in the specific gene (e.g., temperature sensitive mutations). Other useful targets for therapeutic drugs, which include polypeptides that are not essential for growth or viability per se but lead to loss of viability of the cell, can be used to target therapeutic agents to cells.

Strain-Specific Sequences:

Because of the evolutionary relationship between different S. epidermidis strains, it is believed that the presently disclosed S. epidermidis sequences are useful for identifying, and/or discriminating between, previously known and new S. epidermidis strains. It is believed that other S. epidermidis strains will exhibit at least about 70% sequence homology with the presently disclosed sequence. Systematic and routine analyses of DNA sequences derived from samples containing S. epidermidis strains, and comparison with the present sequence allows for the identification of sequences that can be used to discriminate between strains, as well as those that are common to all S. epidermidis strains. In one embodiment, the invention provides nucleic acids, including probes, and peptide and polypeptide sequences that discriminate between different strains of S. epidermidis. Strain-specific components can also be identified functionally by their ability to elicit or react with antibodies that selectively recognize one or more S. epidermidis strains.

In another embodiment, the invention provides nucleic acids, including probes, and peptide and polypeptide sequences that are common to all S. epidermidis strains but are not found in other bacterial species.

S. epidermidis Polypeptides

This invention encompasses isolated S. epidermidis polypeptides encoded by the disclosed S. epidermidis genomic sequences, including the polypeptides of the invention contained in the Sequence Listing. Polypeptides of the invention are preferably at least about 5 amino acid residues in length. Using the DNA sequence information provided herein, the amino acid sequences of the polypeptides encompassed by the invention can be deduced using methods well-known in the art. It will be understood that the sequence of an entire nucleic acid encoding an S. epidermidis polypeptide can be isolated and identified based on an ORF that encodes only a fragment of the cognate protein-coding region. This can be achieved, for example, by using the isolated nucleic acid encoding the ORF, or fragments thereof, to prime a polymerase chain reaction with genomic S. epidermidis DNA as template; this is followed by sequencing the amplified product.

The polypeptides of the present invention, including function-conservative variants of the disclosed ORFs, may be isolated from wild-type or mutant S. epidermidis cells, or from heterologous organisms or cells (including, but not limited to, bacteria, fungi, insect, plant, and mammalian cells) including S. epidermidis into which an S. epidermidis-derived protein-coding sequence has been introduced and expressed. Furthermore, the polypeptides may be part of recombinant fusion proteins.

S. epidermidis polypeptides of the invention can be chemically synthesized using commercially automated procedures such as those referenced herein, including, without limitation, exclusive solid phase synthesis, partial solid phase methods, fragment condensation or classical solution synthesis. The polypeptides are preferably prepared by solid phase peptide synthesis as described by Merrifield, 1963, J. Am. Chem. Soc. 85:2149. The synthesis is carried out with amino acids that are protected at the alpha-amino terminus. Trifunctional amino acids with labile side-chains are also protected with suitable groups to prevent undesired chemical reactions from occurring during the assembly of the polypeptides. The alpha-amino protecting group is selectively removed to allow subsequent reaction to take place at the amino-terminus. The conditions for the removal of the alpha-amino protecting group do not remove the side-chain protecting groups.

Methods for polypeptide purification are well-known in the art, including, without limitation, preparative disc-gel electrophoresis, isoelectric focusing, HPLC, reversed-phase HPLC, gel filtration, ion exchange and partition chromatography, and countercurrent distribution. For some purposes, it is preferable to produce the polypeptide in a recombinant system in which the *S. epidermidis* protein contains an additional sequence tag that facilitates purification, such as, but not limited to, a polyhistidine sequence. The polypeptide can then be purified from a crude lysate of the host cell by chromatography on an appropriate solid-phase matrix. Alternatively, antibodies produced against an *S. epidermidis* protein or against peptides derived therefrom can be used as purification reagents. Other purification methods are possible.

The present invention also encompasses derivatives and homologues of *S. epidermidis*-encoded polypeptides. For some purposes, nucleic acid sequences encoding the peptides may be altered by substitutions, additions, or deletions that provide for functionally equivalent molecules, i.e., function-conservative variants. For example, one or more amino acid residues within the sequence can be substituted by another amino acid of similar properties, such as, for example, positively charged amino acids (arginine, lysine, and histidine); negatively charged amino acids (aspartate and glutamate); polar neutral amino acids; and non-polar amino acids.

The isolated polypeptides may be modified by, for example, phosphorylation, sulfation, acylation, or other protein modifications. They may also be modified with a label capable of providing a detectable signal, either directly or indirectly, including, but not limited to, radioisotopes and fluorescent compounds.

To identify *S. epidermidis*-derived polypeptides for use in the present invention, essentially the complete genomic sequence of a virulent, methicillin-resistant isolate of *Staphylococcus mirabilis* isolate was analyzed. While, in very rare instances, a nucleic acid sequencing error may be revealed, resolving a rare sequencing error is well within the art, and such an occurrence will not prevent one skilled in the art from practicing the invention.

Also encompassed are any *S. epidermidis* polypeptide sequences that are contained within the open reading frames (ORFs), including complete protein-coding sequences, of which any of SEQ ID NO: 1–SEQ ID NO: 3772 forms a part. Table 2, which is appended herewith and which forms part of the present specification, provides a putative identification of the particular function of a polypeptide which is encoded by each ORF, based on the homology match (determined by the BLAST algorithm) of the predicted polypeptide with known proteins encoded by ORFs in other organisms. As a result, one skilled in the art can use the polypeptides of the present invention for commercial and industrial purposes consistent with the type of putative identification of the polypeptide.

The present invention provides a library of *S. epidermidis*-derived polypeptide sequences, and a corresponding library of nucleic acid sequences encoding the polypeptides, wherein the polypeptides themselves, or polypeptides contained within ORFs of which they form a part, comprise sequences that are contemplated for use as components of vaccines. Non-limiting examples of such sequences are listed by SEQ ID NO in Table 2, which is appended herewith and which forms part of the present specification.

The present invention also provides a library of *S. epidermidis*-derived polypeptide sequences, and a corresponding library of nucleic acid sequences encoding the polypeptides, wherein the polypeptides themselves, or polypeptides contained within ORFs of which they form a part, comprise sequences lacking homology to any known prokaryotic or eukaryotic sequences. Such libraries provide probes, primers, and markers which can be used to diagnose *S. epidermidis* infection, including use as markers in epidemiological studies. Non-limiting examples of such sequences are listed by SEQ ID NO in Table 2, which is appended hereto and part hereof.

The present invention also provides a library of *S. epidermidis*-derived polypeptide sequences, and a corresponding library of nucleic acid sequences encoding the polypeptides, wherein the polypeptides themselves, or polypeptides contained within ORFs of which they form a part, comprise targets for therapeutic drugs.

SPECIFIC EXAMPLE

Determination of *Staphylococcus* Protein Antigens for Antibody and Vaccine Development The selection of *Staphylococcus* protein antigens for vaccine development can be derived from the nucleic acids encoding *S. epidermidis* polypeptides. First, the ORF's can be analyzed for homology to other known exported or membrane proteins and analyzed using the discriminant analysis described by Klein, et al. (Klein, P., Kanehsia, M., and DeLisi, C. (1985) *Biochimica et Biophysica Acta* 815, 468–476) for predicting exported and membrane proteins.

Homology searches can be performed using the BLAST algorithm contained in the Wisconsin Sequence Analysis Package (Genetics Computer Group, University Research Park, 575 Science Drive, Madison, Wis. 53711) to compare each predicted ORF amino acid sequence with all sequences found in the current GenBank, SWISS-PROT and PIR databases. BLAST searches for local alignments between the ORF and the databank sequences and reports a probability score which indicates the probability of finding this sequence by chance in the database. ORF's with significant homology (e.g. probabilities lower than $1 \times 10^{-6}$ that the homology is only due to random chance) to membrane or exported proteins represent protein antigens for vaccine development. Possible functions can be provided to *S. epidermidis* genes based on sequence homology to genes cloned in other organisms.

Discriminant analysis (Klein, et al. supra) can be used to examine the ORF amino acid sequences. This algorithm uses the intrinsic information contained in the ORF amino acid sequence and compares it to information derived from the properties of known membrane and exported proteins. This comparison predicts which proteins will be exported, membrane associated or cytoplasmic. ORF amino acid sequences identified as exported or membrane associated by this algorithm are likely protein antigens for vaccine development.

Production of Fragments and Analogs of *S. epidermidis* Nucleic Acids and Polypeptides Based on the discovery of the *S. epidermidis* gene products of the invention provided in the Sequence Listing, one skilled in the art can alter the disclosed structure of *S.*

*epidermidis* genes, e.g., by producing fragments or analogs, and test the newly produced structures for activity. Examples of techniques known to those skilled in the relevant art which allow the production and testing of fragments and analogs are discussed below. These, or analogous methods can be used to make and screen libraries of polypeptides, e.g., libraries of random peptides or libraries of fragments or analogs of cellular proteins for the ability to bind *S. epidermidis* polypeptides. Such screens are useful for the identification of inhibitors of *S. epidermidis*.

Generation of Fragments

Fragments of a protein can be produced in several ways, e.g., recombinantly, by proteolytic digestion, or by chemical synthesis. Internal or terminal fragments of a polypeptide can be generated by removing one or more nucleotides from one end (for a terminal fragment) or both ends (for an internal fragment) of a nucleic acid which encodes the polypeptide. Expression of the mutagenized DNA produces polypeptide fragments. Digestion with "end-nibbling" endonucleases can thus generate DNAs which encode an array of fragments. DNAs which encode fragments of a protein can also be generated by random shearing, restriction digestion or a combination of the above-discussed methods.

Fragments can also be chemically synthesized using techniques known in the art such as conventional Merrifield solid phase f-Moc or t-Boc chemistry. For example, peptides of the present invention may be arbitrarily divided into fragments of desired length with no overlap of the fragments, or divided into overlapping fragments of a desired length.

Alteration of Nucleic Acids and Polypeptides: Random Methods

Amino acid sequence variants of a protein can be prepared by random mutagenesis of DNA which encodes a protein or a particular domain or region of a protein. Useful methods include PCR mutagenesis and saturation mutagenesis. A library of random amino acid sequence variants can also be generated by the synthesis of a set of degenerate oligonucleotide sequences. (Methods for screening proteins in a library of variants are elsewhere herein).

PCR Mutagenesis

In PCR mutagenesis, reduced Taq polymerase fidelity is used to introduce random mutations into a cloned fragment of DNA (Leung et al., 1989, *Technique* 1:11–15). The DNA region to be mutagenized is amplified using the polymerase chain reaction (PCR) under conditions that reduce the fidelity of DNA synthesis by Taq DNA polymerase, e.g., by using a dGTP/dATP ratio of five and adding $Mn^{2+}$ to the PCR reaction. The pool of amplified DNA fragments are inserted into appropriate cloning vectors to provide random mutant libraries.

Saturation Mutagenesis

Saturation mutagenesis allows for the rapid introduction of a large number of single base substitutions into cloned DNA fragments (Mayers et al., 1985, *Science* 229:242). This technique includes generation of mutations, e.g., by chemical treatment or irradiation of single-stranded DNA in vitro, and synthesis of a complimentary DNA strand. The mutation frequency can be modulated by modulating the severity of the treatment, and essentially all possible base substitutions can be obtained. Because this procedure does not involve a genetic selection for mutant fragments both neutral substitutions, as well as those that alter function, are obtained. The distribution of point mutations is not biased toward conserved sequence elements.

Degenerate Oligonucleotides

A library of homologs can also be generated from a set of degenerate oligonucleotide sequences. Chemical synthesis of a degenerate sequences can be carried out in an automatic DNA synthesizer, and the synthetic genes then ligated into an appropriate expression vector. The synthesis of degenerate oligonucleotides is known in the art (see for example, Narang, S A (1983) *Tetrahedron* 39:3; Itakura et al. (1981) *Recombinant DNA, Proc 3rd Cleveland Sympos. Macromolecules*, ed. A G Walton, Amsterdam: Elsevier pp273–289; Itakura et al. (1984) *Annu. Rev. Biochem.* 53:323; Itakura et al. (1984) *Science* 198:1056; Ike et al. (1983) *Nucleic Acid Res.* 11:477. Such techniques have been employed in the directed evolution of other proteins (see, for example, Scott et al. (1990) *Science* 249:386–390; Roberts et al. (1992) *PNAS* 89:2429–2433; Devlin et al. (1990) *Science* 249: 404–406; Cwirla et al. (1990) *PNAS* 87: 6378–6382; as well as U.S. Pat. Nos. 5,223,409, 5,198,346, and 5,096,815).

Alteration of Nucleic Acids and Polypeptides: Methods for Directed Mutagenesis

Non-random or directed, mutagenesis techniques can be used to provide specific sequences or mutations in specific regions. These techniques can be used to create variants which include, e.g., deletions, insertions, or substitutions, of residues of the known amino acid sequence of a protein. The sites for mutation can be modified individually or in series, e.g., by (1) substituting first with conserved amino acids and then with more radical choices depending upon results achieved, (2) deleting the target residue, or (3) inserting residues of the same or a different class adjacent to the located site, or combinations of options 1–3.

Alanine Scanning Mutagenesis

Alanine scanning mutagenesis is a useful method for identification of certain residues or regions of the desired protein that are preferred locations or domains for mutagenesis, Cunningham and Wells (*Science* 244:1081–1085, 1989). In alanine scanning, a residue or group of target residues are identified (e.g., charged residues such as Arg, Asp, His, Lys, and Glu) and replaced by a neutral or negatively charged amino acid (most preferably alanine or polyalanine). Replacement of an amino acid can affect the interaction of the amino acids with the surrounding aqueous environment in or outside the cell. Those domains demonstrating functional sensitivity to the substitutions are then refined by introducing further or other variants at or for the sites of substitution. Thus, while the site for introducing an amino acid sequence variation is predetermined, the nature of the mutation per se need not be predetermined. For example, to optimize the performance of a mutation at a given site, alanine scanning or random mutagenesis may be conducted at the target codon or region and the expressed desired protein subunit variants are screened for the optimal combination of desired activity.

Oligonucleotide-Mediated Mutagenesis

Oligonucleotide-mediated mutagenesis is a useful method for preparing substitution, deletion, and insertion variants of DNA, see, e.g., Adelman et al., (*DNA* 2:183, 1983). Briefly, the desired DNA is altered by hybridizing an oligonucleotide encoding a mutation to a DNA template, where the template is the single-stranded form of a plasmid or bacteriophage containing the unaltered or native DNA sequence of the desired protein. After hybridization, a DNA polymerase is used to synthesize an entire second complementary strand of the template that will thus incorporate the oligonucleotide primer, and will code for the selected alteration in the desired protein DNA. Generally, oligonucleotides of at least about 25 nucleotides in length are used. An optimal oligonucleotide will have 12 to 15 nucleotides that are completely complementary to the template on either side of the nucleotide(s) coding for the mutation. This ensures that the oligonucleotide will hybridize properly to the single-stranded DNA template molecule. The oligonucleotides are readily synthesized using techniques known in the art such as that described by Crea et al. (*Proc. Natl. Acad Sci.* USA, 75: 5765[1978]).

Cassette Mutagenesis

Another method for preparing variants, cassette mutagenesis, is based on the technique described by Wells et al. (*Gene*, 34:315[1985]). The starting material is a plasmid (or other vector) which includes the protein subunit DNA to be mutated. The codon(s) in the protein subunit DNA to be mutated are identified. There must be a unique restriction endonuclease site on each side of the identified mutation site(s). If no such restriction sites exist, they may be generated using the above-described oligonucleotide-mediated mutagenesis method to introduce them at appropriate locations in the desired protein subunit DNA. After the restriction sites have been introduced into the plasmid, the plasmid is cut at these sites to linearize it. A double-stranded oligonucleotide encoding the sequence of the DNA between the restriction sites but containing the desired mutation(s) is synthesized using standard procedures. The two strands are synthesized separately and then hybridized together using standard techniques. This double-stranded oligonucleotide is referred to as the cassette. This cassette is designed to have 3' and 5' ends that are comparable with the ends of the linearized plasmid, such that it can be directly ligated to the plasmid. This plasmid now contains the mutated desired protein subunit DNA sequence.

Combinatorial Mutagenesis

Combinatorial mutagenesis can also be used to generate mutants (Ladner et al., WO 88/06630). In this method, the amino acid sequences for a group of homologs or other related proteins are aligned, preferably to promote the highest homology possible. All of the amino acids which appear at a given position of the aligned sequences can be selected to create a degenerate set of combinatorial sequences. The variegated library of variants is generated by combinatorial mutagenesis at the nucleic acid level, and is encoded by a variegated gene library. For example, a mixture of synthetic oligonucleotides can be enzymatically ligated into gene sequences such that the degenerate set of potential sequences are expressible as individual peptides, or alternatively, as a set of larger fusion proteins containing the set of degenerate sequences.

Other Modifications of *S. epidermidis* Nucleic Acids and Polypeptides

It is possible to modify the structure of an *S. epidermidis* polypeptide for such purposes as increasing solubility, enhancing stability (e.g., shelf life ex vivo and resistance to proteolytic degradation in vivo). A modified *S. epidermidis* protein or peptide can be produced in which the amino acid sequence has been altered, such as by amino acid substitution, deletion, or addition as described herein.

An *S. epidermidis* peptide can also be modified by substitution of cysteine residues preferably with alanine, serine, threonine, leucine or glutamic acid residues to minimize dimerization via disulfide linkages. In addition, amino acid side chains of fragments of the protein of the invention can be chemically modified. Another modification is cyclization of the peptide.

In order to enhance stability and/or reactivity, an *S. epidermidis* polypeptide can be modified to incorporate one or more polymorphisms in the amino acid sequence of the protein resulting from any natural allelic variation. Additionally, D-amino acids, non-natural amino acids, or non-amino acid analogs can be substituted or added to produce a modified protein within the scope of this invention. Furthermore, an *S. epidermidis* polypeptide can be modified using polyethylene glycol (PEG) according to the method of A. Sehon and co-workers (Wie et al., supra) to produce a protein conjugated with PEG. In addition, PEG can be added during chemical synthesis of the protein. Other modifications of *S. epidermidis* proteins include reduction/alkylation (Tarr, *Methods of Protein Microcharacterization*, J. E. Silver ed., Humana Press, Clifton N.J. 155–194 (1986)); acylation (Tarr, supra); chemical coupling to an appropriate carrier (Mishell and Shiigi, eds, *Selected Methods in Cellular Immunology*, WH Freeman, San Francisco, Calif. (1980), U.S. Pat. No. 4,939,239; or mild formalin treatment (Marsh, (1971) *Int. Arch. of Allergy and Appl. Immunol*, 41: 199–215).

To facilitate purification and potentially increase solubility of an *S. epidermidis* protein or peptide, it is possible to add an amino acid fusion moiety to the peptide backbone. For example, hexa-histidine can be added to the protein for purification by immobilized metal ion affinity chromatography (Hochuli, E. et al., (1988) *Bio/Technology*, 6: 1321–1325). In addition, to facilitate isolation of peptides free of irrelevant sequences, specific endoprotease cleavage sites can be introduced between the sequences of the fusion moiety and the peptide.

To potentially aid proper antigen processing of epitopes within an *S. epidermidis* polypeptide, canonical protease sensitive sites can be engineered between regions, each comprising at least one epitope via recombinant or synthetic methods. For example, charged amino acid pairs, such as KK or RR, can be introduced between regions within a protein or fragment during recombinant construction thereof. The resulting peptide can be rendered sensitive to cleavage by cathepsin and/or other trypsin-like enzymes which would generate portions of the protein containing one or more epitopes. In addition, such charged amino acid residues can result in an increase in the solubility of the peptide.

Primary Methods for Screening Polypeptides and Analogs

Various techniques are known in the art for screening generated mutant gene products. Techniques for screening large gene libraries often include cloning the gene library into replicable expression vectors, transforming appropriate cells with the resulting library of vectors, and expressing the genes under conditions in which detection of a desired activity, e.g., in this case, binding to *S. epidermidis* polypeptide or an interacting protein, facilitates relatively easy isolation of the vector encoding the gene whose product was detected. Each of the techniques described below is amenable to high through-put analysis for screening large numbers of sequences created, e.g., by random mutagenesis techniques.

Two Hybrid Systems

Two hybrid assays such as the system described below (as with the other screening methods described herein), can be used to identify polypeptides, e.g., fragments or analogs of a naturally-occurring *S. epidermidis* polypeptide, e.g., of cellular proteins, or of randomly generated polypeptides which bind to an *S. epidermidis* protein. (The *S. epidermidis* domain is used as the bait protein and the library of variants are expressed as prey fusion proteins.) In an analogous fashion, a two hybrid assay (as with the other screening methods described herein), can be used to find polypeptides which bind an *S. epidermidis* polypeptide.

Display Libraries

In one approach to screening assays, the Staphylococcus peptides are displayed on the surface of a cell or viral particle, and the ability of particular cells or viral particles to bind an appropriate receptor protein via the displayed product is detected in a "panning assay". For example, the gene library can be cloned into the gene for a surface membrane protein of a bacterial cell, and the resulting fusion protein detected by panning (Ladner et al., WO 88/06630; Fuchs et al. (1991) *Bio/Technology* 9:1370–1371; and Goward et al. (1992) *TIBS* 18:136–140). In a similar fashion, a detectably labeled ligand can be used to score for potentially functional peptide homologs. Fluorescently labeled ligands, e.g., receptors, can be used to detect homologs which retain ligand-binding activity. The use of fluorescently labeled ligands, allows cells to be visually inspected and separated under a fluorescence microscope, or, where the morphology of the cell permits, to be separated by a fluorescence-activated cell sorter.

A gene library can be expressed as a fusion protein on the surface of a viral particle. For instance, in the filamentous phage system, foreign peptide sequences can be expressed on the surface of infectious phage, thereby conferring two significant benefits. First, since these phage can be applied to affinity matrices at concentrations well over $10^-$ phage per milliliter, a large number of phage can be screened at one time. Second, since each infectious phage displays a gene product on its surface, if a particular phage is recovered from an affinity matrix in low yield, the phage can be amplified by another round of infection. The group of almost identical *E. coli* filamentous phages, M13, fd., and f1, are most often used in phage display libraries. Either of the phage gIII or gVIII coat proteins can be used to generate fusion proteins without disrupting the ultimate packaging of the viral particle. Foreign epitopes can be expressed at the $NH_2$-terminal end of pIII and phage bearing such epitopes recovered from a large excess of phage lacking this epitope (Ladner et al. PCT publication WO 90/02909; Garrard et al., PCT publication WO 92/09690; Marks et al. (1992) *J. Biol. Chem.* 267:16007–16010; Griffiths et al. (1993) *EMBO J* 12:725–734; Clackson et al. (1991) *Nature* 352:624–628; and Barbas et al. (1992) *PNAS* 89:4457–4461).

A common approach uses the maltose receptor of *E. coli* (the outer membrane protein, LamB) as a peptide fusion partner (Charbit et al. (1986) *EMBO* 5, 3029–3037). Oligonucleotides have been inserted into plasmids encoding the LamB gene to produce peptides fused into one of the extracellular loops of the protein. These peptides are available for binding to ligands, e.g., to antibodies, and can elicit an immune response when the cells are administered to animals. Other cell surface proteins, e.g., OmpA (Schorr et al. (1991) *Vaccines* 91, pp. 387–392), PhoE (Agterberg, et al. (1990) *Gene* 88, 37–45), and PAL (Fuchs et al. (1991) *Bio/Tech* 9, 1369–1372), as well as large bacterial surface structures have served as vehicles for peptide display. Peptides can be fused to pilin, a protein which polymerizes to form the pilus-a conduit for interbacterial exchange of genetic information (Thiry et al. (1989) *Appl. Environ. Microbiol.* 55, 984–993). Because of its role in interacting with other cells, the pilus provides a useful support for the presentation of peptides to the extracellular environment. Another large surface structure used for peptide display is the bacterial motive organ, the flagellum. Fusion of peptides to the subunit protein flagellin offers a dense array of many peptide copies on the host cells (Kuwajima et al. (1988) *Bio/Tech*. 6, 1080–1083). Surface proteins of other bacterial species have also served as peptide fusion partners. Examples include the *Staphylococcus* protein A and the outer membrane IgA protease of *Neisseria* (Hansson et al. (1992) *J. Bacteriol.* 174, 4239–4245 and Klauser et al. (1990) *EMBO J.* 9, 1991–1999).

In the filamentous phage systems and the LamB system described above, the physical link between the peptide and its encoding DNA occurs by the containment of the DNA within a particle (cell or phage) that carries the peptide on its surface. Capturing the peptide captures the particle and the DNA within. An alternative scheme uses the DNA-binding protein LacI to form a link between peptide and DNA (Cull et al. (1992) *PNAS USA* 89:1865–1869). This system uses a plasmid containing the Lacd gene with an oligonucleotide cloning site at its 3'-end. Under the controlled induction by arabinose, a LacI-peptide fusion protein is produced. This fusion retains the natural ability of Lacd to bind to a short DNA sequence known as LacO operator (LacO). By installing two copies of LacO on the expression plasmid, the LacI-peptide fusion binds tightly to the plasmid that encoded it. Because the plasmids in each cell contain only a single oligonucleotide sequence and each cell expresses only a single peptide sequence, the peptides become specifically and stably associated with the DNA sequence that directed its synthesis. The cells of the library are gently lysed and the peptide-DNA complexes are exposed to a matrix of immobilized receptor to recover the complexes containing active peptides. The associated plasmid DNA is then reintroduced into cells for amplification and DNA sequencing to determine the identity of the peptide ligands. As a demonstration of the practical utility of the method, a large random library of dodecapeptides was made and selected on a monoclonal antibody raised against the opioid peptide dynorphin B. A cohort of peptides was recovered, all related by a consensus sequence corresponding to a six-residue portion of dynorphin B. (Cull et al. (1992) *Proc. Natl. Acad. Sci. U.S.A.* 89–1869)

This scheme, sometimes referred to as peptides-on-plasmids, differs in two important ways from the phage display methods. First, the peptides are attached to the C-terminus of the fusion protein, resulting in the display of the library members as peptides having free carboxy termini. Both of the filamentous phage coat proteins, pIII and pVIII, are anchored to the phage through their C-termini, and the guest peptides are placed into the outward-extending N-terminal domains. In some designs, the phage-displayed peptides are presented right at the amino terminus of the fusion protein. (Cwirla, et al. (1990) *Proc. Natl. Acad. Sci. U.S.A.* 87, 6378–6382) A second difference is the set of biological biases affecting the population of peptides actually present in the libraries. The Lacd fusion molecules are confined to the cytoplasm of the host cells. The phage coat fusions are exposed briefly to the cytoplasm during translation but are rapidly secreted through the inner membrane into the periplasmic compartment, remaining anchored in the membrane by their C-terminal hydrophobic domains, with the N-termini, containing the peptides, protruding into the periplasm while awaiting assembly into phage particles. The peptides in the LacI and phage libraries may differ significantly as a result of their exposure to different proteolytic activities. The phage coat proteins require transport across the inner membrane and signal peptidase processing as a prelude to incorporation into phage. Certain peptides exert a deleterious effect on these processes and are underrepresented in the libraries (Gallop et al. (1994) *J. Med. Chem.* 37(9):1233–1251). These particular biases are not a factor in the Lac display system.

The number of small peptides available in recombinant random libraries is enormous. Libraries of $10^7$–$10^9$ independent clones are routinely prepared. Libraries as large as $10^{11}$ recombinants have been created, but this size approaches the practical limit for clone libraries. This limitation in library size occurs at the step of transforming the DNA containing randomized segments into the host bacterial cells. To circumvent this limitation, an in vitro system based on the display of nascent peptides in polysome complexes has recently been developed. This display library method has the potential of producing libraries 3–6 orders of magnitude larger than the currently available phage/phagemid or plasmid libraries. Furthermore, the construction of the libraries, expression of the peptides, and screening, is done in an entirely cell-free format.

In one application of this method (Gallop et al. (1994) *J. Med. Chem.* 37(9):1233–1251), a molecular DNA library encoding $10^{12}$ decapeptides was constructed and the library expressed in an *E. coli* S30 in vitro coupled transcription/translation system. Conditions were chosen to stall the ribosomes on the mRNA, causing the accumulation of a substantial proportion of the RNA in polysomes and yielding complexes containing nascent peptides still linked to their encoding RNA. The polysomes are sufficiently robust to be affinity purified on immobilized receptors in much the same way as the more conventional recombinant peptide display libraries are screened. RNA from the bound complexes is recovered, converted to cDNA, and amplified by PCR to produce a template for the next round of synthesis and screening. The polysome display method can be coupled to the phage display system. Following several rounds of screening, cDNA from the enriched pool of polysomes was cloned into a phagemid vector. This vector serves as both a peptide expression vector, displaying peptides fused to the coat proteins, and as a DNA sequencing vector for peptide identification. By expressing the polysome-derived peptides on phage, one can either continue the affinity selection procedure in this format or assay the peptides on individual clones for binding activity in a phage ELISA, or for binding specificity in a completion phage ELISA (Barret, et al. (1992) *Anal. Biochem* 204,357–364). To identify the sequences of the active peptides one sequences the DNA produced by the phagemid host.

Secondary Screening of Polypeptides and Analogs

The high through-put assays described above can be followed by secondary screens in order to identify further biological activities which will, e.g., allow one skilled in the art to differentiate agonists from antagonists. The type of a secondary screen used will depend on the desired activity that needs to be tested. For example, an assay can be developed in which the ability to inhibit an interaction between a protein of interest and its respective ligand can be used to identify antagonists from a group of peptide fragments isolated though one of the primary screens described above.

Therefore, methods for generating fragments and analogs and testing them for activity are known in the art. Once the core sequence of interest is identified, it is routine for one skilled in the art to obtain analogs and fragments.

Peptide Mimetics of *S. epidermidis* Polypeptides

The invention also provides for reduction of the protein binding domains of the subject *S. epidermidis* polypeptides to generate mimetics, e.g. peptide or non-peptide agents. The peptide mimetics are able to disrupt binding of a polypeptide to its counter ligand, e.g., in the case of an *S. epidermidis* polypeptide binding to a naturally occurring ligand. The critical residues of a subject *S. epidermidis* polypeptide which are involved in molecular recognition of a polypeptide can be determined and used to generate *S. epidermidis*-derived peptidomimetics which competitively or noncompetitively inhibit binding of the *S. epidermidis* polypeptide with an interacting polypeptide (see, for example, European patent applications EP-412,762A and EP-B31,080A).

For example, scanning mutagenesis can be used to map the amino acid residues of a particular *S. epidermidis* polypeptide involved in binding an interacting polypeptide, peptidomimetic compounds (e.g. diazepine or isoquinoline derivatives) can be generated which mimic those residues in binding to an interacting polypeptide, and which therefore can inhibit binding of an *S. epidermidis* polypeptide to an interacting polypeptide and thereby interfere with the function of *S. epidermidis* polypeptide. For instance, non-hydrolyzable peptide analogs of such residues can be generated using benzodiazepine (e.g., see Freidinger et al. in *Peptides: Chemistry and Biology*, G. R. Marshall ed., ESCOM Publisher: Leiden, Netherlands, 1988), azepine (e.g., see Huffman et al. in *Peptides: Chemistry and Biology*, G. R. Marshall ed., ESCOM Publisher: Leiden, Netherlands, 1988), substituted gama lactam rings (Garvey et al. in *Peptides: Chemistry and Biology*, G. R. Marshall ed., ESCOM Publisher: Leiden, Netherlands, 1988), keto-methylene pseudopeptides (Ewenson et al. (1986) *J Med Chem* 29:295; and Ewenson et al. in *Peptides: Structure and Function* (Proceedings of the 9th American Peptide Symposium) Pierce Chemical Co. Rockland, Ill., 1985), b-turn dipeptide cores (Nagai et al. (1985) *Tetrahedron Lett* 26:647; and Sato et al. (1986) *J Chem Soc Perkin Trans* 1:1231), and b-aminoalcohols (Gordon et al. (1985) *Biochem Biophys Res Commun* 126:419; and et al. (1986) *Biochem Biophys Res Commun* 134:71).

Vaccine Formulations for *S. epidermidis* Nucleic Acids and Polypeptides

This invention also features vaccine compositions for protection against infection by *S. epidermidis* or for treatment of *S. epidermidis* infection. In one embodiment, the vaccine compositions contain one or more immunogenic components such as a surface protein from *S. epidermidis*, or portion thereof, and a pharmaceutically acceptable carrier. Nucleic acids within the scope of the invention are exemplified by the nucleic acids of the invention contained in the Sequence Listing which encode *S. epidermidis* surface proteins. Any nucleic acid encoding an immunogenic *S. epidermidis* protein, or portion thereof, which is capable of expression in a cell, can be used in the present invention. These vaccines have therapeutic and prophylactic utilities.

One aspect of the invention provides a vaccine composition for protection against infection by *S. epidermidis* which contains at least one immunogenic fragment of an *S. epidermidis* protein and a pharmaceutically acceptable carrier. Preferred fragments include peptides of at least about 10 amino acid residues in length, preferably about 10–20 amino acid residues in length, and more preferably about 12–16 amino acid residues in length.

Immunogenic components of the invention can be obtained, for example, by screening polypeptides recombinantly produced from the corresponding fragment of the nucleic acid encoding the full-length *S. epidermidis* protein.

In addition, fragments can be chemically synthesized using techniques known in the art such as conventional Merrifield solid phase f-Moc or t-Boc chemistry.

In one embodiment, immunogenic components are identified by the ability of the peptide to stimulate T cells. Peptides which stimulate T cells, as determined by, for example, T cell proliferation or cytokine secretion are defined herein as comprising at least one T cell epitope. T cell epitopes are believed to be involved in initiation and perpetuation of the immune response to the protein allergen which is responsible for the clinical symptoms of allergy. These T cell epitopes are thought to trigger early events at the level of the T helper cell by binding to an appropriate HLA molecule on the surface of an antigen presenting cell, thereby stimulating the T cell subpopulation with the relevant T cell receptor for the epitope. These events lead to T cell proliferation, lymphokine secretion, local inflammatory reactions, recruitment of additional immune cells to the site of antigen/T cell interaction, and activation of the B cell cascade, leading to the production of antibodies. A T cell epitope is the basic element, or smallest unit of recognition by a T cell receptor, where the epitope comprises amino acids essential to receptor recognition (e.g., approximately 6 or 7 amino acid residues). Amino acid sequences which mimic those of the T cell epitopes are within the scope of this invention.

Screening immunogenic components can be accomplished using one or more of several different assays. For example, in vitro, peptide T cell stimulatory activity is assayed by contacting a peptide known or suspected of being immunogenic with an antigen presenting cell which presents appropriate MHC molecules in a T cell culture. Presentation of an immunogenic *S. epidermidis* peptide in association with appropriate MHC molecules to T cells in conjunction with the necessary co-stimulation has the effect of transmitting a signal to the T cell that induces the production of increased levels of cytokines, particularly of interleukin-2 and interleukin-4. The culture supernatant can be obtained and assayed for interleukin-2 or other known cytokines. For example, any one of several conventional assays for interleukin-2 can be employed, such as the assay described in *Proc. Natl. Acad. Sci USA*, 86: 1333 (1989) the pertinent portions of which are incorporated herein by reference. A kit for an assay for the production of interferon is also available from Genzyme Corporation (Cambridge, Mass.).

Alternatively, a common assay for T cell proliferation entails measuring tritiated thymidine incorporation. The proliferation of T cells can be measured in vitro by determining the amount of $^3$H-labeled thymidine incorporated into the replicating DNA of cultured cells. Therefore, the rate of DNA synthesis and, in turn, the rate of cell division can be quantified.

Vaccine compositions of the invention containing immunogenic components (e.g., *S. epidermidis* polypeptide or fragment thereof or nucleic acid encoding an *S. epidermidis* polypeptide or fragment thereof) preferably include a pharmaceutically acceptable carrier. The term "pharmaceutically acceptable carrier" refers to a carrier that does not cause an allergic reaction or other untoward effect in patients to whom it is administered. Suitable pharmaceutically acceptable carriers include, for example, one or more of water, saline, phosphate buffered saline, dextrose, glycerol, ethanol and the like, as well as combinations thereof. Pharmaceutically acceptable carriers may further comprise minor amounts of auxiliary substances such as wetting or emulsifying agents, preservatives or buffers, which enhance the shelf life or effectiveness of the antibody. For vaccines of the invention containing *S. epidermidis* polypeptides, the polypeptide is co-administered with a suitable adjuvant.

It will be apparent to those of skill in the art that the therapeutically effective amount of DNA or protein of this invention will depend, inter alia, upon the administration schedule, the unit dose of antibody administered, whether the protein or DNA is administered in combination with other therapeutic agents, the immune status and health of the patient, and the therapeutic activity of the particular protein or DNA.

Vaccine compositions are conventionally administered parenterally, e.g., by injection, either subcutaneously or intramuscularly. Methods for intramuscular immunization are described by Wolff et al. (1990) *Science* 247: 1465–1468 and by Sedegah et al. (1994) *Immunology* 91: 9866–9870. Other modes of administration include oral and pulmonary formulations, suppositories, and transdermal applications. Oral immunization is preferred over parenteral methods for inducing protection against infection by *S. epidermidis*. Cain et. al. (1993) *Vaccine* 11: 637–642. Oral formulations include such normally employed excipients as, for example, pharmaceutical grades of mannitol, lactose, starch, magnesium stearate, sodium saccharine, cellulose, magnesium carbonate, and the like.

The vaccine compositions of the invention can include an adjuvant, including, but not limited to aluminum hydroxide; N-acetyl-muramyl-L-threonyl-D-isoglutamine (thr-MDP); N-acetyl-nor-muramyl-L-alanyl-D-isoglutamine (CGP 11637, referred to as nor-MDP); N-acetylmuramyl-L-alanyl-D-isoglutaminyl-L-alanine-2-(1'-2'-dipalmitoyl-sn-glycero-3-hydroxyphos-phoryloxy)-ethylamine (CGP 19835A, referred to a MTP-PE); RIBI, which contains three components from bacteria; monophosphoryl lipid A; trehalose dimycoloate; cell wall skeleton (MPL+TDM+CWS) in a 2% squalene/Tween 80 emulsion; and cholera toxin. Others which may be used are non-toxic derivatives of cholera toxin, including its B subunit, and/or conjugates or genetically engineered fusions of the *S. epidermidis* polypeptide with cholera toxin or its B subunit, procholeragenoid, fungal polysaccharides, including schizophyllan, muramyl dipeptide, muramyl dipeptide derivatives, phorbol esters, labile toxin of *E. coli*, non-*S. epidermidis* bacterial lysates, block polymers or saponins.

Other suitable delivery methods include biodegradable microcapsules or immuno-stimulating complexes (IS-COMs), cochleates, or liposomes, genetically engineered attenuated live vectors such as viruses or bacteria, and recombinant (chimeric) virus-like particles, e.g., bluetongue. The amount of adjuvant employed will depend on the type of adjuvant used. For example, when the mucosal adjuvant is cholera toxin, it is suitably used in an amount of 5 mg to 50 mg, for example 10 mg to 35 mg. When used in the form of microcapsules, the amount used will depend on the amount employed in the matrix of the microcapsule to achieve the desired dosage. The determination of this amount is within the skill of a person of ordinary skill in the art.

Carrier systems in humans may include enteric release capsules protecting the antigen from the acidic environment of the stomach, and including *S. epidermidis* polypeptide in an insoluble form as fusion proteins. Suitable carriers for the vaccines of the invention are enteric coated capsules and polylactide-glycolide microspheres. Suitable diluents are 0.2 N NaHCO$_3$ and/or saline.

Vaccines of the invention can be administered as a primary prophylactic agent in adults or in children, as a secondary prevention, after successful eradication of *S.*

*epidermidis* in an infected host, or as a therapeutic agent in the aim to induce an immune response in a susceptible host to prevent infection by *S. epidermidis*. The vaccines of the invention are administered in amounts readily determined by persons of ordinary skill in the art. Thus, for adults a suitable dosage will be in the range of 10 mg to 10 g, preferably 10 mg to 100 mg. A suitable dosage for adults will also be in the range of 5 mg to 500 mg. Similar dosage ranges will be applicable for children. Those skilled in the art will recognize that the optimal dose may be more or less depending upon the patient's body weight, disease, the route of administration, and other factors. Those skilled in the art will also recognize that appropriate dosage levels can be obtained based on results with known oral vaccines such as, for example, a vaccine based on an *E. coli* lysate (6 mg dose daily up to total of 540 mg) and with an enterotoxigenic *E. coli* purified antigen (4 doses of 1 mg) (Schulman et al., *J. Urol.* 150:917–921 (1993); Boedecker et al., *American Gastroenterological Assoc.* 999:A-222 (1993)). The number of doses will depend upon the disease, the formulation, and efficacy data from clinical trials. Without intending any limitation as to the course of treatment, the treatment can be administered over 3 to 8 doses for a primary immunization schedule over 1 month (Boedeker, *American Gastroenterological Assoc.* 888:A-222 (1993)).

In a preferred embodiment, a vaccine composition of the invention can be based on a killed whole *E. coli* preparation with an immunogenic fragment of an *S. epidermidis* protein of the invention expressed on its surface or it can be based on an *E. coli* lysate, wherein the killed *E. coli* acts as a carrier or an adjuvant.

It will be apparent to those skilled in the art that some of the vaccine compositions of the invention are useful only for preventing *S. epidermidis* infection, some are useful only for treating *S. epidermidis* infection, and some are useful for both preventing and treating *S. epidermidis* infection. In a preferred embodiment, the vaccine composition of the invention provides protection against *S. epidermidis* infection by stimulating humoral and/or cell-mediated immunity against *S. epidermidis*. It should be understood that amelioration of any of the symptoms of *S. epidermidis* infection is a desirable clinical goal, including a lessening of the dosage of medication used to treat *S. epidermidis*-caused disease, or an increase in the production of antibodies in the serum or mucous of patients.

Antibodies Reactive with *S. epidermidis* Polypeptides

The invention also includes antibodies specifically reactive with the subject *S. epidermidis* polypeptide. Anti-protein/anti-peptide antisera or monoclonal antibodies can be made by standard protocols (See, for example, *Antibodies: A Laboratory Manual* ed. by Harlow and Lane (Cold Spring Harbor Press: 1988)). A mammal such as a mouse, a hamster or rabbit can be immunized with an immunogenic form of the peptide. Techniques for conferring immunogenicity on a protein or peptide include conjugation to carriers or other techniques well known in the art. An immunogenic portion of the subject *S. epidermidis* polypeptide can be administered in the presence of adjuvant. The progress of immunization can be monitored by detection of antibody titers in plasma or serum. Standard ELISA or other immunoassays can be used with the immunogen as antigen to assess the levels of antibodies.

In a preferred embodiment, the subject antibodies are immunospecific for antigenic determinants of the *S. epidermidis* polypeptides of the invention, e.g. antigenic determinants of a polypeptide of the invention contained in the Sequence Listing, or a closely related human or non-human mammalian homolog (e.g., 90% homologous, more preferably at least about 95% homologous). In yet a further preferred embodiment of the invention, the anti-*S. epidermidis* antibodies do not substantially cross react (i.e., react specifically) with a protein which is for example, less than 80% percent homologous to a sequence of the invention contained in the Sequence Listing. By "not substantially cross react", it is meant that the antibody has a binding affinity for a non-homologous protein which is less than 10 percent, more preferably less than 5 percent, and even more preferably less than 1 percent, of the binding affinity for a protein of the invention contained in the Sequence Listing. In a most preferred embodiment, there is no cross-reactivity between bacterial and mammalian antigens.

The term antibody as used herein is intended to include fragments thereof which are also specifically reactive with *S. epidermidis* polypeptides. Antibodies can be fragmented using conventional techniques and the fragments screened for utility in the same manner as described above for whole antibodies. For example, F(ab')$_2$ fragments can be generated by treating antibody with pepsin. The resulting F(ab')$_2$ fragment can be treated to reduce disulfide bridges to produce Fab' fragments. The antibody of the invention is further intended to include bispecific and chimeric molecules having an anti-*S. epidermidis* portion.

Both monoclonal and polyclonal antibodies (Ab) directed against *S. epidermidis* polypeptides or *S. epidermidis* polypeptide variants, and antibody fragments such as Fab' and F(ab')$_2$, can be used to block the action of *S. epidermidis* polypeptide and allow the study of the role of a particular *S. epidermidis* polypeptide of the invention in aberrant or unwanted intracellular signaling, as well as the normal cellular function of the *S. epidermidis* and by microinjection of anti-*S. epidermidis* polypeptide antibodies of the present invention.

Antibodies which specifically bind *S. epidermidis* epitopes can also be used in immunohistochemical staining of tissue samples in order to evaluate the abundance and pattern of expression of *S. epidermidis* antigens. Anti-*S. epidermidis* polypeptide antibodies can be used diagnostically in immuno-precipitation and immuno-blotting to detect and evaluate *S. epidermidis* levels in tissue or bodily fluid as part of a clinical testing procedure. Likewise, the ability to monitor *S. epidermidis* polypeptide levels in an individual can allow determination of the efficacy of a given treatment regimen for an individual afflicted with such a disorder. The level of an *S. epidermidis* polypeptide can be measured in cells found in bodily fluid, such as in urine samples or can be measured in tissue, such as produced by gastric biopsy. Diagnostic assays using anti-*S. epidermidis* antibodies can include, for example, immunoassays designed to aid in early diagnosis of *S. epidermidis* infections. The present invention can also be used as a method of detecting antibodies contained in samples from individuals infected by this bacterium using specific *S. epidermidis* antigens.

Another application of anti-*S. epidermidis* polypeptide antibodies of the invention is in the immunological screening of cDNA libraries constructed in expression vectors such as λgt11, λgt18-23, λZAP, and λORF8. Messenger libraries of this type, having coding sequences inserted in the correct reading frame and orientation, can produce fusion proteins. For instance, λgt11 will produce fusion proteins whose amino termini consist of β-galactosidase amino acid sequences and whose carboxy termini consist of a foreign polypeptide. Antigenic epitopes of a subject *S. epidermidis* polypeptide can then be detected with antibodies, as, for example, reacting nitrocellulose filters lifted from infected plates with anti-*S. epidermidis* polypeptide antibodies. Phage, scored by this assay, can then be isolated from the infected plate. Thus, the presence of *S. epidermidis* gene homologs can be detected and cloned from other species, and alternate isoforms (including splicing variants) can be detected and cloned.

Kits Containing Nucleic Acids, Polypeptides or Antibodies of the Invention

The nucleic acid, polypeptides and antibodies of the invention can be combined with other reagents and articles to form kits. Kits for diagnostic purposes typically comprise the nucleic acid, polypeptides or antibodies in vials or other suitable vessels. Kits typically comprise other reagents for performing hybridization reactions, polymerase chain reactions (PCR), or for reconstitution of lyophilized components, such as aqueous media, salts, buffers, and the like. Kits may also comprise reagents for sample processing such as detergents, chaotropic salts and the like. Kits may also comprise immobilization means such as particles, supports, wells, dipsticks and the like. Kits may also comprise labeling means such as dyes, developing reagents, radioisotopes, fluorescent agents, luminescent or chemiluminescent agents, enzymes, intercalating agents and the like. With the nucleic acid and amino acid sequence information provided herein, individuals skilled in art can readily assemble kits to serve their particular purpose. Kits further can include instructions for use.

Bio Chip Technology

The nucleic acid sequence of the present invention may be used to detect *S. epidermidis* or other species of *Staphylococcus* acid sequence using bio chip technology. Bio chips containing arrays of nucleic acid sequence can also be used to measure expression of genes of *S. epidermidis* or other species of *Staphylococcus*. For example, to diagnose a patient with a *S. epidermidis* or other *Staphylococcus* infection, a sample from a human or animal can be used as a probe on a bio chip containing an array of nucleic acid sequence from the present invention. In addition, a sample from a disease state can be compared to a sample from a non-disease state which would help identify a gene that is up-regulated or expressed in the disease state. This would provide valuable insight as to the mechanism by which the disease manifests. Changes in gene expression can also be used to identify critical pathways involved in drug transport or metabolism, and may enable the identification of novel targets involved in virulence or host cell interactions involved in maintenance of an infection. Procedures using such techniques have been described by Brown et al., 1995, *Science* 270: 467–470.

Bio chips can also be used to monitor the genetic changes of potential therapeutic compounds including, deletions, insertions or mismatches. Once the therapeutic is added to the patient, changes to the genetic sequence can be evaluated for its efficacy. In addition, the nucleic acid sequence of the present invention can be used to determine essential genes in cell cycling. As described in Iyer et al., 1999 (*Science*, 283:83–87) genes essential in the cell cycle can be identified using bio chips. Furthermore, the present invention provides nucleic acid sequence which can be used with bio chip technology to understand regulatory networks in bacteria, measure the response to environmental signals or drugs as in drug screening, and study virulence induction. (Mons et al., 1998, *Nature Biotechnology*, 16: 45–48. Patents teaching this technology include U.S. Pat. Nos. 5,445,934, 5,744,305, and 5,800,992.

Drug Screening Assays Using *S. epidermidis* Polypeptides

By making available purified and recombinant *S. epidermidis* polypeptides, the present invention provides assays which can be used to screen for drugs which are either agonists or antagonists of the normal cellular function, in this case, of the subject *S. epidermidis* polypeptides, or of their role in intracellular signaling. Such inhibitors or potentiators may be useful as new therapeutic agents to combat *S. epidermidis* infections in humans. A variety of assay formats will suffice and, in light of the present inventions, will be comprehended by the person skilled in the art.

In many drug screening programs which test libraries of compounds and natural extracts, high throughput assays are desirable in order to maximize the number of compounds surveyed in a given period of time. Assays which are performed in cell-free systems, such as may be derived with purified or semi-purified proteins, are often preferred as "primary" screens in that they can be generated to permit rapid development and relatively easy detection of an alteration in a molecular target which is mediated by a test compound. Moreover, the effects of cellular toxicity and/or bioavailability of the test compound can be generally ignored in the in vitro system, the assay instead being focused primarily on the effect of the drug on the molecular target as may be manifest in an alteration of binding affinity with other proteins or change in enzymatic properties of the molecular target. Accordingly, in an exemplary screening assay of the present invention, the compound of interest is contacted with an isolated and purified *S. epidermidis* polypeptide.

Screening assays can be constructed in vitro with a purified *S. epidermidis* polypeptide or fragment thereof, such as an *S. epidermidis* polypeptide having enzymatic activity, such that the activity of the polypeptide produces a detectable reaction product. The efficacy of the compound can be assessed by generating dose response curves from data obtained using various concentrations of the test compound. Moreover, a control assay can also be performed to provide a baseline for comparison. Suitable products include those with distinctive absorption, fluorescence, or chemiluminescence properties, for example, because detection may be easily automated. A variety of synthetic or naturally occurring compounds can be tested in the assay to identify those which inhibit or potentiate the activity of the *S. epidermidis* polypeptide. Some of these active compounds may directly, or with chemical alterations to promote membrane permeability or solubility, also inhibit or potentiate the same activity (e.g., enzymatic activity) in whole, live *S. epidermidis* cells.

Overexpression Assays

Overexpression assays are based on the premise that overproduction of a protein would lead to a higher level of resistance to compounds that selectively interfere with the function of that protein. Overexpression assays may be used to identify compounds that interfere with the function of virtually any type of protein, including without limitation enzymes, receptors, DNA- or RNA-binding proteins, or any proteins that are directly or indirectly involved in regulating cell growth.

Typically, two bacterial strains are constructed. One contains a single copy of the gene of interest, and a second contains several copies of the same gene. Identification of useful inhibitory compounds of this type of assay is based on a comparison of the activity of a test compound in inhibiting growth and/or viability of the two strains. The method involves constructing a nucleic acid vector that directs high level expression of a particular target nucleic acid. The vectors are then transformed into host cells in single or multiple copies to produce strains that express low to moderate and high levels of protein encoding by the target sequence (strain A and B, respectively). Nucleic acid comprising sequences encoding the target gene can, of course, be directly integrated into the host cell.

Large numbers of compounds (or crude substances which may contain active compounds) are screened for their effect on the growth of the two strains. Agents which interfere with an unrelated target equally inhibit the growth of both strains. Agents which interfere with the function of the target at high concentration should inhibit the growth of both strains. It should be possible, however, to titrate out the inhibitory effect of the compound in the overexpressing strain. That is, if the compound is affecting the particular target that is being tested, it should be possible to inhibit the growth of strain A at a concentration of the compound that allows strain B to grow.

Alternatively, a bacterial strain is constructed that contains the gene of interest under the control of an inducible promoter. Identification of useful inhibitory agents using this type of assay is based on a comparison of the activity of a test compound in inhibiting growth and/or viability of this strain under both inducing and non-inducing conditions. The method involves constructing a nucleic acid vector that directs high-level expression of a particular target nucleic acid. The vector is then transformed into host cells that are grown under both non-inducing and inducing conditions (conditions A and B, respectively).

Large numbers of compounds (or crude substances which may contain active compounds) are screened for their effect on growth under these two conditions. Agents that interfere with the function of the target should inhibit growth under both conditions. It should be possible, however, to titrate out the inhibitory effect of the compound in the overexpressing strain. That is, if the compound is affecting the particular target that is being tested, it should be possible to inhibit growth under condition A at a concentration that allows the strain to grow under condition B.

Ligand-Binding Assays

Many of the targets according to the invention have functions that have not yet been identified. Ligand-binding assays are useful to identify inhibitor compounds that interfere with the function of a particular target, even when that function is unknown. These assays are designed to detect binding of test compounds to particular targets. The detection may involve direct measurement of binding. Alternatively, indirect indications of binding may involve stabilization of protein structure or disruption of a biological function. Non-limiting examples of useful ligand-binding assays are detailed below.

A useful method for the detection and isolation of binding proteins is the Biomolecular Interaction Assay (BIAcore) system developed by Pharmacia Biosensor and described in the manufacturer's protocol (LKB Pharmacia, Sweden). The BIAcore system uses an affinity purified anti-GST antibody to immobilize GST-fusion proteins onto a sensor chip. The sensor utilizes surface plasmon resonance which is an optical phenomenon that detects changes in refractive indices. In accordance with the practice of the invention, a protein of interest is coated onto a chip and test compounds are passed over the chip. Binding is detected by a change in the refractive index (surface plasmon resonance).

A different type of ligand-binding assay involves scintillation proximity assays (SPA, described in U.S. Pat. No. 4,568,649).

Another type of ligand binding assay, also undergoing development, is based on the fact that proteins containing mitochondrial targeting signals are imported into isolated mitochondria in vitro (Hurt et al., 1985, *Embo J.* 4:2061–2068; Eilers and Schatz, *Nature*, 1986, 322:228–231). In a mitochondrial import assay, expression vectors are constructed in which nucleic acids encoding particular target proteins are inserted downstream of sequences encoding mitochondrial import signals. The chimeric proteins are synthesized and tested for their ability to be imported into isolated mitochondria in the absence and presence of test compounds. A test compound that binds to the target protein should inhibit its uptake into isolated mitochondria in vitro.

Another ligand-binding assay is the yeast two-hybrid system (Fields and Song, 1989, *Nature* 340:245–246). The yeast two-hybrid system takes advantage of the properties of the GAL4 protein of the yeast *Saccharomyces cerevisiae*. The GAL4 protein is a transcriptional activator required for the expression of genes encoding enzymes of galactose utilization. This protein consists of two separable and functionally essential domains: an N-terminal domain which binds to specific DNA sequences ($UAS_G$); and a C-terminal domain containing acidic regions, which is necessary to activate transcription. The native GAL4 protein, containing both domains, is a potent activator of transcription when yeast are grown on galactose media. The N-terminal domain binds to DNA in a sequence-specific manner but is unable to activate transcription. The C-terminal domain contains the activating regions but cannot activate transcription because it fails to be localized to $UAS_G$. In the two-hybrid system, a system of two hybrid proteins containing parts of GAL4: (1) a GAL4 DNA-binding domain fused to a protein 'X' and (2) a GAL4 activation region fused to a protein 'Y'. If X and Y can form a protein-protein complex and reconstitute proximity of the GAL4 domains, transcription of a gene regulated by $UAS_G$ occurs. Creation of two hybrid proteins, each containing one of the interacting proteins X and Y, allows the activation region of $UAS_G$ to be brought to its normal site of action.

The binding assay described in Fodor et al., 1991, *Science* 251:767–773, which involves testing the binding affinity of test compounds for a plurality of defined polymers synthesized on a solid substrate, may also be useful.

Compounds which bind to the polypeptides of the invention are potentially useful as antibacterial agents for use in therapeutic compositions.

Pharmaceutical formulations suitable for antibacterial therapy comprise the antibacterial agent in conjunction with one or more biologically acceptable carriers. Suitable biologically acceptable carriers include, but are not limited to, phosphate-buffered saline, saline, deionized water, or the like. Preferred biologically acceptable carriers are physiologically or pharmaceutically acceptable carriers.

The antibacterial compositions include an antibacterial effective amount of active agent. Antibacterial effective amounts are those quantities of the antibacterial agents of the present invention that afford prophylactic protection against bacterial infections or which result in amelioration or cure of an existing bacterial infection. This antibacterial effective amount will depend upon the agent, the location and nature of the infection, and the particular host. The amount can be determined by experimentation known in the art, such as by establishing a matrix of dosages and frequencies and comparing a group of experimental units or subjects to each point in the matrix.

The antibacterial active agents or compositions can be formed into dosage unit forms, such as for example, creams, ointments, lotions, powders, liquids, tablets, capsules, suppositories, sprays, aerosols or the like. If the antibacterial composition is formulated into a dosage unit form, the dosage unit form may contain an antibacterial effective amount of active agent. Alternatively, the dosage unit form may include less than such an amount if multiple dosage unit forms or multiple dosages are to be used to administer a total dosage of the active agent. Dosage unit forms can include, in addition, one or more excipient(s), diluent(s), disintegrant(s), lubricant(s), plasticizer(s), colorant(s), dosage vehicle(s), absorption enhancer(s), stabilizer(s), bactericide(s), or the like.

For general information concerning formulations, see, e.g., Gilman et al. (eds.), 1990, *Goodman and Gilman's: The Pharmacological Basis of Therapeutics*, 8th ed., Pergamon Press; and *Remington's Pharmaceutical Sciences*, 17th ed., 1990, Mack Publishing Co., Easton, Pa.; Avis et al. (eds.), 1993, *Pharmaceutical Dosage Forms: Parenteral Medications*, Dekker, N.Y.; Lieberman et al (eds.), 1990, *Pharmaceutical Dosage Forms: Disperse Systems*, Dekker, New York.

The antibacterial agents and compositions of the present invention are useful for preventing or treating *S. epidermidis* infections. Infection prevention methods incorporate a prophylactically effective amount of an antibacterial agent or composition. A prophylactically effective amount is an amount effective to prevent *S. epidermidis* infection and will depend upon the specific bacterial strain, the agent, and the host. These amounts can be determined experimentally by methods known in the art and as described above.

*S. epidermidis* infection treatment methods incorporate a therapeutically effective amount of an antibacterial agent or composition. A therapeutically effective amount is an amount sufficient to ameliorate or eliminate the infection. The prophylactically and/or therapeutically effective amounts can be administered in one administration or over repeated administrations. Therapeutic administration can be followed by prophylactic administration, once the initial bacterial infection has been resolved.

The antibacterial agents and compositions can be administered topically or systemically. Topical application is typically achieved by administration of creams, ointments, lotions, or sprays as described above. Systemic administration includes both oral and parental routes. Parental routes include, without limitation, subcutaneous, intramuscular, intraperitoneal, intravenous, transdermal, inhalation and intranasal administration.

Exemplification

Cloning and Sequencing *S. epidermidis* Genomic Sequence

This invention provides nucleotide sequences of the genome of *S. epidermidis* which thus comprises a DNA sequence library of *S. epidermidis* genomic DNA. The invention also provides nucleotide sequences of two naturally occurring plasmids in *S. epidermidis*. The detailed description that follows provides nucleotide sequences of *S. epidermidis*, and also describes how the sequences were obtained and how ORFs (Open Reading Frames) and protein-coding sequences can be identified. Also described are methods of using the disclosed *S. epidermidis* sequences in methods including diagnostic and therapeutic applications. Furthermore, the library can be used as a database for identification and comparison of medically important sequences in this and other strains of *S. epidermidis* as well as other species of *Staphylococcus*.

Chromosomal DNA from strain 18972 of *S. epidermidis*, was isolated using a protocol described by Storrs, et al.(*J. Bacteriol.* 173: 4347–4352 (1991). The only exception to this protocol was that lysostaphin (120 U/ml) was used instead of lysozyme. Two endogenous plasmids of approximately 39 Kb and 2.9 Kb in size were identified upon visualization of the *S. epidermidis* genomic DNA on a 0.5% agarose gel. The first library constructed contained fragments from the *S. epidermidis* genome as well as from the endogenous plasmid. A second library was later constructed with genomic DNA, from which the plasmid DNA was removed by CsCl centrifugation. The genomic DNA prep involved a lysozyme:lysostaphin digestion, sodium dodecyl sulfate lysis, Proteinase K and RNase treatment, phenol:chloroform extraction, and sodium acetate precipitation, followed by the CsCl gradient to remove the plasmid.

In the construction of both libraries, genomic *S. epidermidis* DNA was hydrodynamically sheared in an HPLC and then separated on a standard 1% agarose gel. A fraction corresponding to 2000–3000 bp in length was excised from the gel and purifed by the GeneClean procedure (Bio101, Inc.).

The purified DNA fragments were then blunt-ended using T4 DNA polymerase. The healed DNA was then ligated to unique BstXI-linker adapters (5'-GTCTTCACCACGGGG-3' (SEQ ID NO: 7545) and 5'-GTGGTGAAGAC-3' (SEQ ID NO: 7546) in 100–1000 fold molar excess). These linkers are complimentary to the BstXI-cut pGTC vector, while the overhang is not self-complimentary. Therefore, the linkers will not concatermerize nor will the cut-vector religate itself easily. The linker-adapted inserts were separated from the unincorporated linkers on a 1% agarose gel and purified using GeneClean. The linker-adapted inserts were then ligated to BstXI-cut vector to construct a "shotgun" sublclone libraries.

Only major modifications to the protocols are highlighted. Briefly, the library was then transformed into DH5á competent cells (Gibco/BRL, DH5α transformation protocol). It was assessed by plating onto antibiotic plates containing ampicillin and IPTG/Xgal. The plates were incubated overnight at 37° C. Transformants were then used for plating of clones and picking for sequencing. The cultures were grown overnight at 37° C. DNA was purified using a silica bead DNA preparation (Engelstein, 1996) method. In this manner, 25 μg of DNA was obtained per clone.

These purified DNA samples were then sequenced using primarily ABI dye-terminator chemistry. All subsequent steps were based on sequencing by ABI377 automated DNA sequencing methods. The ABI dye terminator sequence reads were run on ABI377 machines and the data was transferred to UNIX machines following lane tracking of the gels. Base calls and quality scores were determined using the program PHRED (Ewing et al., 1998, Genome Res. 8: 175–185; Ewing and Green, 1998, Genome Res. 8: 685–734). Reads were assembled using PHRAP (P. Green, Abstracts of DOE Human Genome Program Contractor-Grantee Workshop V, January 1996, p. 157) with default program parameters and quality scores.

Finishing followed the initial assembly. Missing mates (sequences from clones that only gave reads from one end of the *Staphylococcus* DNA inserted in the plasmid) were identified and sequenced with ABI technology to allow the identification of additional overlapping contigs.

End-sequencing of randomly picked genomic lambda was also performed. Sequencing of both sides was done for all lambda sequences. The lambda library backbone helped to verify the integrity of the assembly and allowed closure of some of the physical gaps. Primers for walking off the ends of contigs would be selected using pick_primer (a GTC program) near the ends of the clones to facilitate gap closure. These walks can be sequenced using the selected clones and primers. These data are then reassembled with PHRAP. Additional sequencing using PCR-generated templates and screened and/or unscreened lambda templates can be done in addition.

Additional templates for the physical gaps were obtained through PCR using primers designed from the ends of the contigs. These templates were then used in sequencing reactions to close the gaps.

Contigs were ordered by aligning identified *S. epidermidis* genes to the published physical maps. Order was confirmed by PCR. The final chromosomal assembly included 23 ordered contigs and the two plasmids each contained 1 contig each.

To identify *S. epidermidis* polypeptides the complete genomic sequence of *S. epidermidis* were analyzed essentially as follows: First, all possible stop-to-stop open reading frames (ORFs) greater than 180 nucleotides in all six reading frames were translated into amino acid sequences. Second, the identified ORFs were analyzed for homology to known (archeabacter, prokaryotic and eukaryotic) protein sequences. Third, the coding potential of non-homologous sequences were evaluated with the program GENEMARK™ (Borodovsky and McIninch, 1993, Comp. Chem. 17:123).

Identification, Cloning and Expression of *S. epidermidis* Nucleic Acids

Expression and purification of the *S. epidermidis* polypeptides of the invention can be performed essentially as outlined below.

To facilitate the cloning, expression and purification of membrane and secreted proteins from *S. epidermidis*, a gene expression system, such as the pET System (Novagen), for cloning and expression of recombinant proteins in *E. coli*, is selected. Also, a DNA sequence encoding a peptide tag, the His-Tag, is fused to the 3' end of DNA sequences of interest in order to facilitate purification of the recombinant protein products. The 3' end is selected for fusion in order to avoid alteration of any 5' terminal signal sequence.

PCR Amplification and Cloning of Nucleic Acids Containing ORF's Encoding Enzymes Nucleic acids chosen (for example, from the nucleic acids set forth in SEQ ID NO: 1–SEQ ID NO: 3772 for cloning from the 18972 strain of *S. epidermidis* and plasmids are prepared for amplification cloning by polymerase chain reaction (PCR). Synthetic oligonucleotide primers specific for the 5' and 3' ends of open reading frames (ORFs) are designed and purchased from GibcoBRL Life Technologies (Gaithersburg, Md., USA). All forward primers (specific for the 5' end of the sequence) are designed to include an NcoI cloning site at the extreme 5' terminus. These primers are designed to permit initiation of protein translation at a methionine residue followed by a valine residue and the coding sequence for the remainder of the native *S. epidermidis* DNA sequence. All reverse primers (specific for the 3' end of any *S. epidermidis* ORF) include a EcoRI site at the extreme 5' terminus to permit cloning of each *S. epidermidis* sequence into the reading frame of the pET-28b. The pET-28b vector provides sequence encoding an additional 20 carboxy-terminal amino acids including six histidine residues (at the extreme C-terminus), which comprise the His-Tag.

Genomic DNA or plasmid DNA prepared from the 18972 strain of *S. epidermidis* is used as the source of template DNA for PCR amplification reactions (Current Protocols in Molecular Biology, John Wiley and Sons, Inc., F. Ausubel et al., eds., 1994). To amplify a DNA sequence containing an *S. epidermidis* ORF, genomic DNA (50 nanograms) is introduced into a reaction vial containing 2 mM $MgCl_2$, 1 micromolar synthetic oligonucleotide primers (forward and reverse primers) complementary to and flanking a defined *S. epidermidis* ORF, 0.2 mM of each deoxynucleotide triphosphate; dATP, dGTP, dCTP, dTTP and 2.5 units of heat stable DNA polymerase (Amplitaq, Roche Molecular Systems, Inc., Branchburg, N.J., USA) in a final volume of 100 microliters.

Upon completion of thermal cycling reactions, each sample of amplified DNA is washed and purified using the Qiaquick Spin PCR purification kit (Qiagen, Gaithersburg, Md., USA). All amplified DNA samples are subjected to digestion with the restriction endonucleases, e.g., NcoI and EcoRI (New England BioLabs, Beverly, Mass., USA)(Current Protocols in Molecular Biology, John Wiley and Sons, Inc., F. Ausubel et al., eds., 1994). DNA samples are then subjected to electrophoresis on 1.0% NuSeive (FMC BioProducts, Rockland, Me. USA) agarose gels. DNA is visualized by exposure to ethidium bromide and long wave uv irradiation. DNA contained in slices isolated from the agarose gel is purified using the Bio 101 GeneClean Kit protocol (Bio 101 Vista, Calif., USA).

Cloning of *S. epidermidis* Nucleic Acids Into an Expression Vector

The pET-28b vector is prepared for cloning by digestion with restriction endonucleases, e.g., NcoI and EcoRI (Current Protocols in Molecular Biology, John Wiley and Sons, Inc., F. Ausubel et al., eds., 1994). The pET-28a vector, which encodes a His-Tag that can be fused to the 5' end of an inserted gene, is prepared by digestion with appropriate restriction endonucleases.

Following digestion, DNA inserts are cloned (Current Protocols in Molecular Biology, John Wiley and Sons, Inc., F. Ausubel et al., eds., 1994) into the previously digested pET-28b expression vector. Products of the ligation reaction are then used to transform the BL21 strain of E. coli (Current Protocols in Molecular Biology, John Wiley and Sons, Inc., F. Ausubel et al., eds., 1994) as described below.

Transformation of Competent Bacteria with Recombinant Plasmids

Competent bacteria, E coli strain BL21 or E. coli strain BL21 (DE3), are transformed with recombinant pET expression plasmids carrying the cloned S. epidermidis sequences according to standard methods (Current Protocols in Molecular, John Wiley and Sons, Inc., F. Ausubel et al., eds., 1994). Briefly, 1 microliter of ligation reaction is mixed with 50 microliters of electrocompetent cells and subjected to a high voltage pulse, after which, samples are incubated in 0.45 milliliters SOC medium (0.5% yeast extract, 2.0% tryptone, 10 mM NaCl, 2.5 mM KCl, 10 mM MgCl2, 10 mM MgSO4 and 20, mM glucose) at 37°C with shaking for 1 hour. Samples are then spread on LB agar plates containing 25 microgram/ml kanamycin sulfate for growth overnight. Transformed colonies of BL21 are then picked and analyzed to evaluate cloned inserts as described below.

Identification of Recombinant Expression Vectors with S. epidermidis Nucleic Acids Individual BL21 clones transformed with recombinant pET-28b S. epidermidis ORFs are analyzed by PCR amplification of the cloned inserts using the same forward and reverse primers, specific for each S. epidermidis sequence, that were used in the original PCR amplification cloning reactions. Successful amplification verifies the integration of the S. epidermidis sequences in the expression vector (Current Protocols in Molecular Biology, John Wiley and Sons, Inc., F. Ausubel et al., eds., 1994).

Isolation and Preparation of Nucleic Acids from Transformants

Individual clones of recombinant pET-28b vectors carrying properly cloned S. epidermidis ORFs are picked and incubated in 5 mls of LB broth plus 25 microgram/ml kanamycin sulfate overnight. The following day plasmid DNA is isolated and purified using the Qiagen plasmid purification protocol (Qiagen Inc., Chatsworth, Calif., USA).

Expression of Recombinant S. epidermidis Sequences in E. coli

The pET vector can be propagated in any E. coli K-12 strain e.g. HMS174, HB101, JM109, DH5, etc. for the purpose of cloning or plasmid preparation. Hosts for expression include E. coli strains containing a chromosomal copy of the gene for T7 RNA polymerase. These hosts are lysogens of bacteriophage DE3, a lambda derivative that carries the lacI gene, the lacUV5 promoter and the gene for T7 RNA polymerase. T7 RNA polymerase is induced by addition of isopropyl-B-D-thiogalactoside (IPTG), and the T7 RNA polymerase transcribes any target plasmid, such as pET-28b, carrying its gene of interest. Strains used include: BL21(DE3) (Studier, F. W., Rosenberg, A. H., Dun, J. J., and Dubendorff, J. W. (1990) Meth. Enzymol. 185, 60–89).

To express recombinant S. epidermidis sequences, 50 nanograms of plasmid DNA isolated as described above is used to transform competent BL21(DE3) bacteria as described above (provided by Novagen as part of the pET expression system kit). The lacZ gene (beta-galactosidase) is expressed in the pET-System as described for the S. epidermidis recombinant constructions. Transformed cells are cultured in SOC medium for 1 hour, and the culture is then plated on LB plates containing 25 micrograms/ml kanamycin sulfate. The following day, bacterial colonies are pooled and grown in LB medium containing kanamycin sulfate (25 micrograms/ml) to an optical density at 600 nM of 0.5 to 1.0 O.D. units, at which point, 1 millimolar IPTG was added to the culture for 3 hours to induce gene expression of the S. epidermidis recombinant DNA constructions.

After induction of gene expression with IPTG, bacteria are pelleted by centrifugation in a Sorvall RC-3B centrifuge at 3500×g for 15 minutes at 4° C. Pellets are resuspended in 50 milliliters of cold 10 mM Tris-HCl, pH 8.0, 0.1 M NaCl and 0.1 mM EDTA (STE buffer). Cells are then centrifuged at 2000×g for 20 min at 4° C. Wet pellets are weighed and frozen at −80° C. until ready for protein purification.

A variety of methodologies known in the art can be utilized to purify the isolated proteins. (Current Protocols in Protein Science, John Wiley and Sons, Inc., J. E. Coligan et al., eds., 1995). For example, the frozen cells may be thawed, resupended in buffer and ruptured by several passages through a small volume microfluidizer (Model M-110S, Microfluidics International Corporation, Newton, Mass.). The resultant homogenate may be centrifuged to yield a clear supernatant (crude extract) and following filtration the crude extract may be fractionated over columns. Fractions may be monitored by absorbance at $OD_{280}$ nm. and peak fractions may analyzed by SDS-PAGE The concentrations of purified protein preparations may be quantified spectrophotometrically using absorbance coefficients calculated from amino acid content (Perkins, S. J. 1986 Eur. J. Biochem. 157, 169–180). Protein concentrations are also measured by the method of Bradford, M. M. (1976) Anal. Biochem. 72, 248–254, and Lowry, O. H., Rosebrough, N., Farr, A. L. & Randall, R. J. (1951) J. Biol. Chem. 193, pages 265–275, using bovine serum albumin as a standard.

SDS-polyacrylamide gels of various concentrations may be purchased from BioRad (Hercules, Calif., USA), and stained with Coomassie blue. Molecular weight markers may include rabbit skeletal muscle myosin (200 kDa), E. coli (-galactosidase (116 kDa), rabbit muscle phosphorylase B (97.4 kDa), bovine serum albumin (66.2 kDa), ovalbumin (45 kDa), bovine carbonic anhydrase (31 kDa), soybean trypsin inhibitor (21.5 kDa), egg white lysozyme (14.4 kDa) and bovine aprotinin (6.5 kDa).

EQUIVALENTS

Those skilled in the art will recognize, or be able to ascertain using no more than routine experimentation, many equivalents to the specific embodiments and methods described herein. The specific embodiments described herein are offered by way of example only, and the invention is to limited only by the terms of the appended claims, along with the full scope of equivalents to which such claims are entitled.

| ORF Name | NTID | AAID | NT Length | AA Length | score | probability |
|---|---|---|---|---|---|---|
| AI7503000979_10192177_f1_14 | 1 | 3773 | 135 | 44 | | |

Description
NO-HIT

| ORF Name | NTID | AAID | NT Length | AA Length | score | probability |
|---|---|---|---|---|---|---|
| AI7503000979_10578392_f2_146 | 2 | 3774 | 510 | 169 | 525 | 1.7e-50 |

Description
gp:[GI:g2735511] [LN:SCU96108] [AC:U96108] [PN:YwpF homolog] [OR:Staphylococcus carnosus] [DB:genpept-bct2] [DE:Staphylococcus carnosus (3R)-hydroxymyristoyl acyl carrier proteindehydrase homolog (fabZ) gene, partial cds, YwpF homolog, single-strand binding protein homolog (ssb), SceD precursor (sceD), SceA precursor (sceA) and SceE precursor (sceE) genes, completecds, and TenA homolog (tenA) gene, partial cds.] [NT:Orf2; similar to B. subtilis YwpF protein encoded] [LE:219] [RE:668] [DI:complement]

| ORF Name | NTID | AAID | NT Length | AA Length | score | probability |
|---|---|---|---|---|---|---|
| AI7503000979_10632763_f1_106 | 3 | 3775 | 135 | 44 | | |

Description
NO-HIT

| ORF Name | NTID | AAID | NT Length | AA Length | score | probability |
|---|---|---|---|---|---|---|
| AI7503000979_10739063_c1_376 | 4 | 3776 | 693 | 230 | 601 | 1.5e-58 |

Description
gp:[GI:g2735513] [LN:SCU96108] [AC:U96108] [PN:SceD precursor] [GN:sceD] [OR:Staphylococcus carnosus] [DB:genpept-bct2] [DE:Staphylococcus carnosus (3R)-hydroxymyristoyl acyl carrier proteindehydrase homolog (fabZ) gene, partial cds, YwpF homolog, single-strand binding protein homolog (ssb), SceD precursor (sceD), SceA precursor (sceA) and SceE precursor (sceE) genes, completecds, and TenA homolog (tenA) gene, partial cds.] [NT:secreted protein] [LE:1825] [RE:2523] [DI:direct]

| ORF Name | NTID | AAID | NT Length | AA Length | score | probability |
|---|---|---|---|---|---|---|
| AI7503000979_10939577_f1_79 | 5 | 3777 | 153 | 50 | | |

Description
NO-HIT

| ORF Name | NTID | AAID | NT Length | AA Length | score | probability |
|---|---|---|---|---|---|---|
| AI7503000979_1206255_f2_219 | 6 | 3778 | 126 | 41 | | |

Description
NO-HIT

| ORF Name | NTID | AAID | NT Length | AA Length | score | probability |
|---|---|---|---|---|---|---|
| AI7503000979_12111018_f3_297 | 7 | 3779 | 426 | 141 | 174 | 2.7e-13 |

Description
gp:[GI:g642965] [LN:ABCARRA] [AC:X70360] [GN:carR] [OR:Azospirillum brasilense] [DB:genpept-bct1] [DE:A.brasilense carR gene.] [NT:ORF2] [LE:59] [RE:580] [DI:direct]

| ORF Name | NTID | AAID | NT Length | AA Length | score | probability |
|---|---|---|---|---|---|---|
| AI7503000979_12142768_f1_110 | 8 | 3780 | 300 | 99 | 110 | 4.2e-06 |

Description pir:[LN:D71245] [AC:D71245 ] [PN:hypothetical protein PH0221] [GN:PH0221 ]
[OR:Pyrococcus horikoshii] [DB:pir2] >gp:[GI:d1030234:g3256608] [LN:AP000001]
[AC:AP000001:AB009465:AB009464:AB009466:AB009467:AB009468:AB009469] [PN:235aa long
hypothetical protein] [GN:PH0221] [OR:Pyrococcus horikoshii] [SR:Pyrococcus horikoshii
(strain:OT3) DNA] [DB:genpept-bct1] [DE:Pyrococcus horikoshii OT3 genomic DNA, 1-287000
nt. position (1/7).] [LE:194212] [RE:194919] [DI:complement]

| ORF Name | NTID | AAID | NT Length | AA Length | score | probability |
|---|---|---|---|---|---|---|
| AI7503000979_1250_c3_509 | 9 | 3781 | 714 | 237 | 644 | 4.2e-63 |

Description gp:[GI:g2735516] [LN:SCU96108] [AC:U96108] [PN:TenA homolog] [GN:tenA]
[OR:Staphylococcus carnosus] [DB:genpept-bct2] [DE:Staphylococcus carnosus
(3R)-hydroxymyristoyl acyl carrier proteindehydrase homolog (fabZ) gene, partial cds,
YwpF homolog,single-strand binding protein homolog (ssb), SceD precursor (sceD),SceA
precursor (sceA) and SceE precursor (sceE) genes, completecds, and TenA homolog (tenA)
gene, partial cds.] [NT:similar to TenA of B. subtilis, encoded by GenBank] [LE:4569]
[RE:>5086] [DI:direct]

| ORF Name | NTID | AAID | NT Length | AA Length | score | probability |
|---|---|---|---|---|---|---|
| AI7503000979_12587886_f1_33 | 10 | 3782 | 138 | 45 | | |

Description

NO-HIT

| ORF Name | NTID | AAID | NT Length | AA Length | score | probability |
|---|---|---|---|---|---|---|
| AI7503000979_1281557_c3_517 | 11 | 3783 | 1131 | 376 | 903 | 1.5e-90 |

Description sp:[LN:DDL_BACSU] [AC:P96612] [GN:DDLA:DDL] [OR:BACILLUS SUBTILIS] [EC:6.3.2.4]
[DE:D-ALANINE--D-ALANINE LIGASE, (D-ALANYLALANINE SYNTHETASE)] [SP:P96612]
[DB:swissprot] >pir:[LN:D69613] [AC:D69613 ] [PN:D-alanyl-D-alanine ligase A ddlA]
[GN:ddlA ] [CL:D-alanine--D-alanine ligase] [OR:Bacillus subtilis] [DB:pir2]
>gp:[GI:d1020046:g1881266] [LN:AB001488] [AC:AB001488] [PN:PROBABLE
D-ALANINE--D-ALANINE LIGASE A] [GN:ddlA] [OR:Bacillus subtilis] [SR:Bacillus subtilis
(strain:168) DNA] [DB:genpept-bct1] [EC:6.3.2.4] [DE:Bacillus subtilis genome sequence,
148 kb sequence of the regionbetween 35 and 47 degree.] [LE:41311] [RE:42375]
[DI:direct] >gp:[GI:e1182422:g2632756] [LN:BSUB0003] [AC:Z99106:AL009126]
[PN:D-alanyl-D-alanine ligase A] [GN:ddlA] [FN:peptidoglycan biosynthesis] [OR:Bacillus
subtilis] [DB:genpept-bct1] [EC:6.3.2.4] [DE:Bacillus subtilis complete genome (section
3 of 21): from 402751 to611850.] [SP:P96612] [LE:105055] [RE:106119] [DI:direct]

| ORF Name | NTID | AAID | NT Length | AA Length | score | probability |
|---|---|---|---|---|---|---|
| AI7503000979_1292842_c2_415 | 12 | 3784 | 672 | 223 | 790 | 1.4e-78 |

Description gp:[GI:d1037675:g4126674] [LN:AB016431] [AC:AB016431] [OR:Staphylococcus aureus]
[SR:Staphylococcus aureus (strain:912) DNA] [DB:genpept-bct1] [DE:Staphylococcus
aureus, zinc responsible operon czr genes, completeand partial cds.] [NT:Hypothetical
protein] [LE:2175] [RE:2813] [DI:direct]

| ORF Name | NTID | AAID | NT Length | AA Length | score | probability |
|---|---|---|---|---|---|---|
| AI7503000979_12_f1_1 | 13 | 3785 | 243 | 80 | 75 | 0.0084 |

Description
pir:[LN:A44803] [AC:A44803 ] [PN:pG1 protein] [OR:Homo sapiens] [SR:, man] [DB:pir2]

| ORF Name | NTID | AAID | NT Length | AA Length | score | probability |
|---|---|---|---|---|---|---|
| AI7503000979_1366660_c3_484 | 14 | 3786 | 1215 | 404 | 566 | 7.8e-55 |

Description
pir:[LN:A70842] [AC:A70842 ] [PN:probable amiB protein] [GN:amiB ] [OR:Mycobacterium tuberculosis] [DB:pir2] >gp:[GI:e1251137:g2894215] [LN:MTV016] [AC:AL021841:AL123456] [PN:amiB] [GN:amiB] [OR:Mycobacterium tuberculosis] [DB:genpept-bct1] [DE:Mycobacterium tuberculosis H37Rv complete genome; segment 143/162.] [NT:Rv3306c, (MTV016.05c), len: 394. amiB, Probable] [LE:3363] [RE:4547] [DI:complement] >gp:[GI:e1251137:g2894215] [LN:MTV016] [AC:AL021841:AL123456] [PN:amiB] [GN:amiB] [OR:Mycobacterium tuberculosis] [DB:genpept] [DE:Mycobacterium tuberculosis H37Rv complete genome; segment 143/162.] [NT:Rv3306c, (MTV016.05c), len: 394. amiB, Probable] [LE:3363] [RE:4547] [DI:complement]

| ORF Name | NTID | AAID | NT Length | AA Length | score | probability |
|---|---|---|---|---|---|---|
| AI7503000979_13790952_c2_422 | 15 | 3787 | 1194 | 397 | 1350 | 6.5e-138 |

Description
pir:[LN:B69619] [AC:B69619 ] [PN:phosphodeoxyribomutase drm] [GN:drm ] [CL:phosphopentomutase] [OR:Bacillus subtilis] [DB:pir2] >gp:[GI:d1013330:g1303995] [LN:BACJH642] [AC:D84432:D82370] [PN:YqkN] [OR:Bacillus subtilis] [SR:Bacillus subtilis (strain:JH642(trpC2 PheA1)) DNA] [DB:genpept-bct1] [DE:Bacillus subtilis DNA, 283 Kb region containing skin element.] [LE:271220] [RE:272404] [DI:direct] >gp:[GI:e1185619:g2634785] [LN:BSUB0013] [AC:Z99116:AL009126] [PN:phosphodeoxyribomutase] [GN:drm] [FN:conversion of ribose-1-P/deoxyribose-1-P to] [OR:Bacillus subtilis] [DB:genpept-bct1] [EC:5.4.2.7] [DE:Bacillus subtilis complete genome (section 13 of 21): from 2395261to 2613730.] [NT:alternate gene name: yqkN] [SP:P46353] [LE:51215] [RE:52399] [DI:complement]

| ORF Name | NTID | AAID | NT Length | AA Length | score | probability |
|---|---|---|---|---|---|---|
| AI7503000979_1415877_c2_413 | 16 | 3788 | 912 | 303 | 201 | 3.7e-16 |

Description
gp:[GI:g4982462] [LN:AE001824] [AC:AE001824:AE000512] [PN:conserved hypothetical protein] [GN:TM1876] [OR:Thermotoga maritima] [DB:genpept-bct2] [DE:Thermotoga maritima section 136 of 136 of the complete genome.] [NT:similar to GB:Pyro_h percent identity: 60.17;] [LE:4717] [RE:5481] [DI:direct]

| ORF Name | NTID | AAID | NT Length | AA Length | score | probability |
|---|---|---|---|---|---|---|
| AI7503000979_14160455_c2_466 | 17 | 3789 | 162 | 53 | | |

Description
NO-HIT

| ORF Name | NTID | AAID | NT Length | AA Length | score | probability |
|---|---|---|---|---|---|---|
| AI7503000979_14225327_f1_91 | 18 | 3790 | 1029 | 342 | 1252 | 1.6e-127 |

Description
gp:[GI:d1037673:g4126672] [LN:AB016431] [AC:AB016431] [GN:czrB] [FN:Zinc resistance] [OR:Staphylococcus aureus] [SR:Staphylococcus aureus (strain:912) DNA] [DB:genpept-bct1] [DE:Staphylococcus aureus, zinc responsible operon czr genes, completeand partial cds.] [NT:czcD] [LE:724] [RE:1701] [DI:complement]

| ORF_Name | NTID | AAID | NT Length | AA Length | score | probability |
|---|---|---|---|---|---|---|
| AI7503000979_1438927_c1_356 | 19 | 3791 | 1686 | 561 | 2118 | 2.7e-219 |

Description sp:[LN:PYRG_BACSU] [AC:P13242] [GN:CTRA] [OR:BACILLUS SUBTILIS] [EC:6.3.4.2] [DE:CTP SYNTHASE, (UTP--AMMONIA LIGASE) (CTP SYNTHETASE)] [SP:P13242] [DB:swissprot] >pir:[LN:SYBSTP] [AC:A32354:S55423:C69610 ] [PN:CTP synthase,:CTP-synthetase:UTP--ammonia ligase] [GN:ctrA:pyrG ] [CL:CTP synthase] [OR:Bacillus subtilis] [EC:6.3.4.2] [DB:pir1] [MP:37 min ] >gp:[GI:g143597] [LN:BACSPO0FA] [AC:M22039] [PN:CTP synthetase] [GN:ctrA] [OR:Bacillus subtilis] [SR:Bacillus subtilis (strains JH642 and UOT0550) DNA] [DB:genpept-bct1] [DE:Bacillus subtillis spoOF, CTP synthetase (ctrA), andfructose-bisphosphate aldolase (orfY-tsr) genes, complete cds.] [LE:339] [RE:1946] [DI:direct] >gp:[GI:g853762] [LN:BSDNA320D] [AC:Z49782] [PN:CTP synthase] [GN:pyrG] [OR:Bacillus subtilis] [DB:genpept-bct1] [DE:B.subtilis chromosomal DNA (region 320-321 degrees).] [SP:P13242] [LE:9480] [RE:11087] [DI:direct] >gp:[GI:e1186216:g2636252] [LN:BSUB0020] [AC:Z99123:AL009126] [PN:CTP synthetase] [GN:ctrA] [FN:pyrimidine biosynthesis] [OR:Bacillus subtilis] [DB:genpept-bct1] [EC:6.3.4.2] [DE:Bacillus subtilis complete genome (section 20 of 21): from 3798401to 4010550.] [NT:alternate gene name: pyrG] [SP:P13242] [LE:11346] [RE:12953] [DI:complement]

| ORF_Name | NTID | AAID | NT Length | AA Length | score | probability |
|---|---|---|---|---|---|---|
| AI7503000979_14454660_f1_26 | 20 | 3792 | 138 | 45 | | |

Description

NO-HIT

| ORF_Name | NTID | AAID | NT Length | AA Length | score | probability |
|---|---|---|---|---|---|---|
| AI7503000979_14492142_f1_81 | 21 | 3793 | 126 | 41 | | |

Description

NO-HIT

| ORF_Name | NTID | AAID | NT Length | AA Length | score | probability |
|---|---|---|---|---|---|---|
| AI7503000979_14634450_f2_208 | 22 | 3794 | 171 | 56 | 52 | 0.029 |

Description pir:[LN:H71683] [AC:H71683 ] [PN:hypothetical protein RP285] [GN:RP285 ] [OR:Rickettsia prowazekii] [DB:pir2] >gp:[GI:e1342590:g3860846] [LN:RPXX02] [AC:AJ235271:AJ235269] [PN:unknown] [GN:RP285] [OR:Rickettsia prowazekii] [DB:genpept-bct1] [DE:Rickettsia prowazekii strain Madrid E, complete genome; segment2/4.] [LE:68773] [RE:69213] [DI:complement]

| ORF_Name | NTID | AAID | NT Length | AA Length | score | probability |
|---|---|---|---|---|---|---|
| AI7503000979_14849093_c3_469 | 23 | 3795 | 294 | 97 | 133 | 6.0e-09 |

Description pir:[LN:F71245] [AC:F71245 ] [PN:hypothetical protein PHS004] [GN:PHS004 ] [OR:Pyrococcus horikoshii] [DB:pir2] >gp:[GI:d1030236:g3256610] [LN:AP000001] [AC:AP000001:AB009465:AB009464:AB009466:AB009467:AB009468:AB009469] [PN:58aa long hypothetical protein] [GN:PHS004] [OR:Pyrococcus horikoshii] [SR:Pyrococcus horikoshii (strain:OT3) DNA] [DB:genpept-bct1] [DE:Pyrococcus horikoshii OT3 genomic DNA, 1-287000 nt. position (1/7).] [NT:similar to GENPEPT:Z47547 percent identity:50.000] [LE:195255] [RE:195431] [DI:direct]

| ORF Name | NTID | AAID | NT Length | AA Length | score | probability |
|---|---|---|---|---|---|---|
| AI7503000979_14855051_c1_401 | 24 | 3796 | 471 | 156 | 409 | 3.4e-38 |

Description pir:[LN:H69773] [AC:H69773 ] [PN:conserved hypothetical protein ydcK] [GN:ydcK ]
[CL:hypothetical protein HI1173] [OR:Bacillus subtilis] [DB:pir2]
>gp:[GI:d1020070:g1881290] [LN:AB001488] [AC:AB001488] [GN:ydcK] [OR:Bacillus subtilis]
[SR:Bacillus subtilis (strain:168) DNA] [DB:genpept-bct1] [DE:Bacillus subtilis genome
sequence, 148 kb sequence of the regionbetween 35 and 47 degree.] [NT:FUNCTION
UNKNOWN.] [LE:61365] [RE:61817] [DI:direct] >gp:[GI:e1182445:g2632779] [LN:BSUB0003]
[AC:Z99106:AL009126] [GN:ydcK] [FN:unknown] [OR:Bacillus subtilis] [DB:genpept-bct1]
[DE:Bacillus subtilis complete genome (section 3 of 21): from 402751 to611850.]
[NT:similar to hypothetical proteins] [LE:125110] [RE:125562] [DI:direct]

| ORF Name | NTID | AAID | NT Length | AA Length | score | probability |
|---|---|---|---|---|---|---|
| AI7503000979_15798901_c3_471 | 25 | 3797 | 123 | 40 | | |

Description

NO-HIT

| ORF Name | NTID | AAID | NT Length | AA Length | score | probability |
|---|---|---|---|---|---|---|
| AI7503000979_16251305_c3_501 | 26 | 3798 | 786 | 261 | 724 | 1.4e-71 |

Description sp:[LN:ATP6_BACST] [AC:P42010] [GN:ATPB] [OR:BACILLUS STEAROTHERMOPHILUS] [EC:3.6.1.34]
[DE:ATP SYNTHASE A CHAIN, (PROTEIN 6)] [SP:P42010] [DB:swissprot]
>gp:[GI:d1007828:g534857] [LN:BACATPSAC] [AC:D38059] [PN:ATPase subunit a] [OR:Bacillus
stearothermophilus] [SR:Bacillus stearothermophilus (strain IFO1035) (library: library
o] [DB:genpept-bct1] [DE:Bacillus stearothermophilus genes for ATPase subunits a and
c,complete cds.] [LE:256] [RE:966] [DI:direct]

| ORF Name | NTID | AAID | NT Length | AA Length | score | probability |
|---|---|---|---|---|---|---|
| AI7503000979_165888_f3_321 | 27 | 3799 | 156 | 51 | | |

Description

NO-HIT

| ORF Name | NTID | AAID | NT Length | AA Length | score | probability |
|---|---|---|---|---|---|---|
| AI7503000979_19693831_c1_350 | 28 | 3800 | 165 | 54 | | |

Description

NO-HIT

| ORF Name | NTID | AAID | NT Length | AA Length | score | probability |
|---|---|---|---|---|---|---|
| AI7503000979_19728433_f2_133 | 29 | 3801 | 1215 | 404 | 691 | 4.4e-68 |

Description sp:[LN:YWCF_BACSU] [AC:P39604] [GN:YWCF:IPA-42D] [OR:BACILLUS SUBTILIS]
[DE:HYPOTHETICAL 43.3 KD PROTEIN IN QOXD-VPR INTERGENIC REGION] [SP:P39604]
[DB:swissprot] >pir:[LN:S39697] [AC:S39697:A70053 ] [PN:cell-division protein homolog
ywcF:protein ipa-42d] [GN:ywcF ] [OR:Bacillus subtilis] [DB:pir2] >gp:[GI:g413966]
[LN:BSGENR] [AC:X73124] [GN:ipa-42d] [OR:Bacillus subtilis] [DB:genpept-bct1]
[DE:B.subtilis genomic region (325 to 333).] [SP:P39604] [LE:44053] [RE:45234]
[DI:direct] >gp:[GI:e1186311:g2636347] [LN:BSUB0020] [AC:Z99123:AL009126] [GN:ywcF]
[FN:unknown] [OR:Bacillus subtilis] [DB:genpept-bct1] [DE:Bacillus subtilis complete
genome (section 20 of 21): from 3798401to 4010550.] [NT:alternate gene name: ipa-42d;
similar to] [SP:P39604] [LE:112728] [RE:113909] [DI:complement]

| ORF Name | NTID | AAID | NT Length | AA Length | score | probability |
|---|---|---|---|---|---|---|
| AI7503000979_19739675_c3_494 | 30 | 3802 | 636 | 211 | 638 | 1.8e-62 |

Description
sp:[LN:KITH_BACSU] [AC:Q03221] [GN:TDK] [OR:BACILLUS SUBTILIS] [EC:2.7.1.21]
[DE:THYMIDINE KINASE,] [SP:Q03221] [DB:swissprot] >pir:[LN:S55432] [AC:S55432:D69721 ]
[PN:thymidine kinase, tdk] [GN:tdk ] [CL:thymidine kinase] [OR:Bacillus subtilis]
[EC:2.7.1.21] [DB:pir2] >gp:[GI:g405819] [LN:BACRHOTDKX] [AC:M97678] [PN:thymidine
kinase] [GN:tdk] [OR:Bacillus subtilis] [SR:Bacillus subtilis (Transposon Tn917
insertional library) DNA] [DB:genpept-bct1] [DE:Bacillus subtilis OrfR, 3' end; OrfQ;
transcriptional terminator(rho) gene; ribosomal protein L31; thymidine kinase (tdk)
gene,complete cds.] [NT:Incorrect sequence given in Quirk et al. citation,] [LE:3334]
[RE:3921] [DI:direct] >gp:[GI:g853771] [LN:BSDNA320D] [AC:Z49782] [PN:thymidine kinase]
[GN:tdk] [OR:Bacillus subtilis] [DB:genpept-bct1] [DE:B.subtilis chromosomal DNA
(region 320-321 degrees).] [SP:Q03221] [LE:18786] [RE:19373] [DI:direct]
>gp:[GI:e1184612:g2636231] [LN:BSUB0019] [AC:Z99122:AL009126] [PN:thymidine kinase]
[GN:tdk] [OR:Bacillus subtilis] [DB:genpept-bct1] [EC:2.7.1.21] [DE:Bacillus subtilis
complete genome (section 19 of 21): from 3597091to 3809700.] [SP:Q03221] [LE:204370]
[RE:204957] [DI:complement] >gp:[GI:e1186207:g2636243] [LN:BSUB0020]
[AC:Z99123:AL009126] [PN:thymidine kinase] [GN:tdk] [OR:Bacillus subtilis]
[DB:genpept-bct1] [EC:2.7.1.21] [DE:Bacillus subtilis complete genome (section 20 of
21): from 3798401to 4010550.] [SP:Q03221] [LE:3060] [RE:3647] [DI:complement]
>gp:[GI:e1184612:g2636231] [LN:BSUB0019] [AC:Z99122:AL009126] [PN:thymidine kinase]
[GN:tdk] [OR:Bacillus subtilis] [DB:genpept] [EC:2.7.1.21] [DE:Bacillus subtilis
complete genome (section 19 of 21): from 3597091to 3809700.] [SP:Q03221] [LE:204370]
[RE:204957] [DI:complement]

| ORF Name | NTID | AAID | NT Length | AA Length | score | probability |
|---|---|---|---|---|---|---|
| AI7503000979_20032527_f2_127 | 31 | 3803 | 165 | 54 | | |

Description
NO-HIT

| ORF Name | NTID | AAID | NT Length | AA Length | score | probability |
|---|---|---|---|---|---|---|
| AI7503000979_20156686_c3_498 | 32 | 3804 | 573 | 190 | 415 | 7.8e-39 |

Description
sp:[LN:YWLG_BACSU] [AC:P39157] [GN:YWLG:IPC-33D] [OR:BACILLUS SUBTILIS]
[DE:HYPOTHETICAL 19.4 KD PROTEIN IN SPOIIR-GLYC INTERGENIC REGION] [SP:P39157]
[DB:swissprot] >pir:[LN:I40482] [AC:I40482:D70062:S49362 ] [PN:hypothetical protein
ywlG:ipc-33d protein] [GN:ywlG:ipc-33d ] [OR:Bacillus subtilis] [DB:pir2]
>gp:[GI:g556885] [LN:BSSPORUPP] [AC:Z38002] [PN:Unknown] [GN:ipc-33d] [OR:Bacillus
subtilis] [DB:genpept-bct1] [DE:B.subtilis spoII-R, glyC and upp genes.] [SP:P39157]
[LE:4750] [RE:5292] [DI:direct] >gp:[GI:e1184597:g2636216] [LN:BSUB0019]
[AC:Z99122:AL009126] [GN:ywlG] [FN:unknown] [OR:Bacillus subtilis] [DB:genpept-bct1]
[DE:Bacillus subtilis complete genome (section 19 of 21): from 3597091to 3809700.]
[NT:alternate gene name: ipc-33d] [SP:P39157] [LE:192609] [RE:193151] [DI:complement]
>gp:[GI:e1184597:g2636216] [LN:BSUB0019] [AC:Z99122:AL009126] [GN:ywlG] [FN:unknown]
[OR:Bacillus subtilis] [DB:genpept] [DE:Bacillus subtilis complete genome (section 19
of 21): from 3597091to 3809700.] [NT:alternate gene name: ipc-33d] [SP:P39157]
[LE:192609] [RE:193151] [DI:complement]

| ORF Name | NTID | AAID | NT Length | AA Length | score | probability |
|---|---|---|---|---|---|---|
| AI7503000979_20348453_c3_518 | 33 | 3805 | 1587 | 528 | 1226 | 9.0e-125 |

Description
gp:[GI:g4409804] [LN:AF091502] [AC:AF091502] [PN:autoaggregation-mediating protein] [GN:aggH] [OR:Lactobacillus reuteri] [DB:genpept-bct2] [DE:Lactobacillus reuteri autoaggregation-mediating protein (aggH)gene, complete cds.] [NT:AggH; putative extracellular DEAD-box RNA helicase] [LE:181] [RE:1674] [DI:direct]

| ORF Name | NTID | AAID | NT Length | AA Length | score | probability |
|---|---|---|---|---|---|---|
| AI7503000979_20360687_c3_516 | 34 | 3806 | 141 | 46 | | |

Description
NO-HIT

| ORF Name | NTID | AAID | NT Length | AA Length | score | probability |
|---|---|---|---|---|---|---|
| AI7503000979_20569052_c2_457 | 35 | 3807 | 327 | 108 | 198 | 7.8e-16 |

Description
pir:[LN:G70041] [AC:G70041 ] [PN:conserved hypothetical protein yvgZ] [GN:yvgZ ] [OR:Bacillus subtilis] [DB:pir2] >gp:[GI:e1186040:g2635865] [LN:BSUB0018] [AC:Z99121:AL009126] [GN:yvgZ] [FN:unknown] [OR:Bacillus subtilis] [DB:genpept-bct1] [DE:Bacillus subtilis complete genome (section 18 of 21): from 3399551to 3609060.] [NT:similar to hypothetical proteins] [LE:43408] [RE:43713] [DI:complement]

| ORF Name | NTID | AAID | NT Length | AA Length | score | probability |
|---|---|---|---|---|---|---|
| AI7503000979_20572255_f1_34 | 36 | 3808 | 207 | 68 | | |

Description
NO-HIT

| ORF Name | NTID | AAID | NT Length | AA Length | score | probability |
|---|---|---|---|---|---|---|
| AI7503000979_20900062_f2_215 | 37 | 3809 | 147 | 48 | 53 | 0.045 |

Description
gp:[GI:g1086838] [LN:CELF10E7] [AC:U41264] [GN:F10E7.2] [OR:Caenorhabditis elegans] [SR:Caenorhabditis elegans strain=Bristol N2] [DB:genpept-inv1] [DE:Caenorhabditis elegans cosmid F10E7.] [NT:also contains weak similarity to a C2H2-type zinc] [LE:21609:21709:23024:23277] [RE:21661:21796:23149:23753] [DI:directJoin]

| ORF Name | NTID | AAID | NT Length | AA Length | score | probability |
|---|---|---|---|---|---|---|
| AI7503000979_2117125_c2_432 | 38 | 3810 | 129 | 42 | | |

Description
NO-HIT

| ORF Name | NTID | AAID | NT Length | AA Length | score | probability |
|---|---|---|---|---|---|---|
| AI7503000979_2125637_f3_335 | 39 | 3811 | 150 | 49 | | |

Description
NO-HIT

| ORF Name | NTID | AAID | NT Length | AA Length | score | probability |
|---|---|---|---|---|---|---|
| AI7503000979_21517182_f3_322 | 40 | 3812 | 375 | 124 | 396 | 8.1e-37 |

Description gp:[GI:d1037674:g4126673] [LN:AB016431] [AC:AB016431] [GN:CzrA] [FN:repressor]
[OR:Staphylococcus aureus] [SR:Staphylococcus aureus (strain:912) DNA]
[DB:genpept-bct1] [DE:Staphylococcus aureus, zinc responsible operon czr genes,
completeand partial cds.] [LE:1703] [RE:2023] [DI:complement] >gp:[GI:g3445566]
[LN:AF044951] [AC:AF044951] [PN:repressor protein] [GN:rzcA] [FN:zinc and cobalt
transport repressor] [OR:Staphylococcus aureus] [DB:genpept-bct2] [DE:Staphylococcus
aureus repressor protein (rzcA) and transportprotein (rzcB) genes, complete cds.]
[LE:193] [RE:513] [DI:direct]

| ORF Name | NTID | AAID | NT Length | AA Length | score | probability |
|---|---|---|---|---|---|---|
| AI7503000979_21562827_f3_306 | 41 | 3813 | 132 | 43 | | |

Description

NO-HIT

| ORF Name | NTID | AAID | NT Length | AA Length | score | probability |
|---|---|---|---|---|---|---|
| AI7503000979_21756937_c1_379 | 42 | 3814 | 672 | 223 | 401 | 2.4e-37 |

Description sp:[LN:THIE_BACSU] [AC:P39594] [GN:THIE:THIC:IPA-26D] [OR:BACILLUS SUBTILIS]
[EC:2.5.1.3] [DE:PYROPHOSPHORYLASE) (TMP-PPASE) (THIAMIN-PHOSPHATE SYNTHASE)]
[SP:P39594] [DB:swissprot] >pir:[LN:S39681] [AC:S39681:E69722 ] [PN:thiamin-phosphate
pyrophosphorylase, thiC:protein ipa-26d] [GN:thiC ] [CL:thiE protein:thiamin-phosphate
pyrophosphorylase homology] [OR:Bacillus subtilis] [EC:2.5.1.3] [DB:pir2]
>gp:[GI:g413950] [LN:BSGENR] [AC:X73124] [GN:ipa-26d] [OR:Bacillus subtilis]
[DB:genpept-bct1] [DE:B.subtilis genomic region (325 to 333).] [SP:P39594] [LE:26188]
[RE:26856] [DI:direct] >gp:[GI:e1186328:g2636364] [LN:BSUB0020] [AC:Z99123:AL009126]
[PN:thiamine-phosphate pyrophosphorylase] [GN:thiC] [FN:substitution of the
pyrophosphate of] [OR:Bacillus subtilis] [DB:genpept-bct1] [EC:2.5.1.3] [DE:Bacillus
subtilis complete genome (section 20 of 21): from 3798401to 4010550.] [NT:alternate
gene name: ipa-26d, ywbK] [SP:P39594] [LE:131103] [RE:131771] [DI:complement]

| ORF Name | NTID | AAID | NT Length | AA Length | score | probability |
|---|---|---|---|---|---|---|
| AI7503000979_2230303_f3_265 | 43 | 3815 | 669 | 222 | 346 | 1.6e-31 |

Description sp:[LN:YPGQ_BACSU] [AC:P54168] [GN:YPGQ] [OR:BACILLUS SUBTILIS] [DE:HYPOTHETICAL 23.1
KD PROTEIN IN BSAA-ILVD INTERGENIC REGION] [SP:P54168] [DB:swissprot] >pir:[LN:E69935]
[AC:E69935 ] [PN:conserved hypothetical protein ypgQ] [GN:ypgQ ] [CL:conserved
hypothetical protein AF0994] [OR:Bacillus subtilis] [DB:pir2] >gp:[GI:g1256633]
[LN:BACYACA] [AC:L77246] [GN:ypgQ] [OR:Bacillus subtilis] [DB:genpept-bct1]
[DE:Bacillus subtilis (YAC10-9 clone) DNA region between the serA andkdg loci.]
[NT:putative] [LE:16914] [RE:17531] [DI:direct] >gp:[GI:e1183636:g2634609]
[LN:BSUB0012] [AC:Z99115:AL009126] [GN:ypgQ] [FN:unknown] [OR:Bacillus subtilis]
[DB:genpept-bct1] [DE:Bacillus subtilis complete genome (section 12 of 21): from
2195541to 2409220.] [NT:similar to hypothetical proteins] [SP:P54168] [LE:107621]
[RE:108238] [DI:complement]

| ORF Name | NTID | AAID | NT Length | AA Length | score | probability |
|---|---|---|---|---|---|---|
| AI7503000979_22460882_c3_482 | 44 | 3816 | 687 | 228 | 612 | 1.0e-59 |

Description
gp:[GI:e1191863:g809660] [LN:BSDNPOP] [AC:X82174] [PN:deoxyribose-phosphate aldolase] [GN:dra] [OR:Bacillus subtilis] [DB:genpept-bct1] [EC:4.1.2.4] [DE:B.subtilis operon contg. dra, nupC and pdp genes.] [SP:P39121] [LE:1462] [RE:2106] [DI:direct]

| ORF Name | NTID | AAID | NT Length | AA Length | score | probability |
|---|---|---|---|---|---|---|
| AI7503000979_22692137_c2_464 | 45 | 3817 | 486 | 161 | 688 | 9.2e-68 |

Description
gp:[GI:e279934:g1934990] [LN:SASIGFACB] [AC:Y07645] [GN:rsbW] [OR:Staphylococcus aureus] [DB:genpept-bct1] [DE:S.aureus sigB gene.] [LE:2220] [RE:2699] [DI:direct]
>gp:[GI:e284999:g1729796] [LN:SAUSIGB] [AC:Y09929] [GN:rsbW] [OR:Staphylococcus aureus] [DB:genpept-bct1] [DE:S.aureus rsbU, rsbV, rsbW & sigB genes.] [LE:2233] [RE:2712] [DI:direct]

| ORF Name | NTID | AAID | NT Length | AA Length | score | probability |
|---|---|---|---|---|---|---|
| AI7503000979_23437803_c3_523 | 46 | 3818 | 2187 | 728 | 1827 | 1.9e-188 |

Description
gp:[GI:e279936:g1934992] [LN:SASIGFACB] [AC:Y07645] [GN:ORF6] [OR:Staphylococcus aureus] [DB:genpept-bct1] [DE:S.aureus sigB gene.] [LE:3878] [RE:>5272] [DI:direct]

| ORF Name | NTID | AAID | NT Length | AA Length | score | probability |
|---|---|---|---|---|---|---|
| AI7503000979_23439002_c2_417 | 47 | 3819 | 1404 | 467 | | |

Description
NO-HIT

| ORF Name | NTID | AAID | NT Length | AA Length | score | probability |
|---|---|---|---|---|---|---|
| AI7503000979_23446887_f3_323 | 48 | 3820 | 1155 | 384 | 548 | 6.3e-53 |

Description
gp:[GI:g4097757] [LN:SAU67965] [AC:U67965] [PN:lytic regulatory protein] [OR:Staphylococcus aureus] [DB:genpept-bct2] [DE:Staphylococcus aureus lytic regulatory protein gene, complete cds.] [LE:712] [RE:1824] [DI:direct]

| ORF Name | NTID | AAID | NT Length | AA Length | score | probability |
|---|---|---|---|---|---|---|
| AI7503000979_23594057_c1_362 | 49 | 3821 | 183 | 60 | | |

Description
NO-HIT

| ORF_Name | NTID | AAID | NT Length | AA Length | score | probability |
|---|---|---|---|---|---|---|
| AI7503000979_23595137_c3_480 | 50 | 3822 | 501 | 166 | 423 | 1.1e-39 |

Description
pir:[LN:H69618] [AC:H69618 ] [PN:stress- and starvation-induced gene controlled by sigma-B dps ] [GN:dps ] [CL:hypothetical protein HI1349] [OR:Bacillus subtilis] [DB:pir2] >gp:[GI:e1185938:g2635549] [LN:BSUB0016] [AC:Z99119:AL009126] [GN:dps] [OR:Bacillus subtilis] [DB:genpept-bct1] [DE:Bacillus subtilis complete genome (section 16 of 21): from 2997771to 3213410.] [NT:alternate gene name: ytkB; stress- and] [SP:P80879] [LE:137548] [RE:137985] [DI:complement] >gp:[GI:g2293159] [LN:AF008220] [AC:AF008220] [GN:ytkB] [OR:Bacillus subtilis] [DB:genpept-bct2] [DE:Bacillus subtilis rrnB-dnaB genomic region.] [NT:similarity to HI1349 from H. influenzae] [LE:42442] [RE:42879] [DI:direct]

| ORF_Name | NTID | AAID | NT Length | AA Length | score | probability |
|---|---|---|---|---|---|---|
| AI7503000979_23625008_c1_347 | 51 | 3823 | 963 | 320 | 749 | 3.2e-74 |

Description
gp:[GI:d1039089:g4512388] [LN:AB011838] [AC:AB011838] [PN:mannnose-6 phospate isomelase] [GN:ydhS] [OR:Bacillus halodurans] [SR:Bacillus halodurans (strain:C-125) DNA, clone_lib:lambda no.] [DB:genpept-bct1] [EC:5.3.1.8] [DE:Bacillus halodurans C-125 genomic DNA, 6A fragment, clone ALBAC004.] [NT:similar to B.subtilis ydhS gene(53-69% identity)] [LE:7672] [RE:8619] [DI:direct]

| ORF_Name | NTID | AAID | NT Length | AA Length | score | probability |
|---|---|---|---|---|---|---|
| AI7503000979_23625387_c1_402 | 52 | 3824 | 219 | 72 | | |

Description
NO-HIT

| ORF_Name | NTID | AAID | NT Length | AA Length | score | probability |
|---|---|---|---|---|---|---|
| AI7503000979_23634678_c2_424 | 53 | 3825 | 1194 | 397 | | |

Description
NO-HIT

| ORF_Name | NTID | AAID | NT Length | AA Length | score | probability |
|---|---|---|---|---|---|---|
| AI7503000979_23634702_c2_453 | 54 | 3826 | 792 | 263 | 498 | 1.3e-47 |

Description
sp:[LN:THIM_BACSU] [AC:P39593] [GN:THIM:THIK:IPA-25D] [OR:BACILLUS SUBTILIS] [EC:2.7.1.50] [DE:HYDROXYETHYLTHIAZOLE KINASE] (THZ KINASE) (TH KINASE)] [SP:P39593] [DB:swissprot] >pir:[LN:S39680] [AC:S39680:G69722 ] [PN:hydroxyethylthiazole kinase, thiK:protein ipa-25d] [GN:thiK ] [CL:hydroxyethylthiazole kinase: hydroxyethylthiazole kinase homology] [OR:Bacillus subtilis] [EC:2.7.1.50] [DB:pir2] >gp:[GI:g413949] [LN:BSGENR] [AC:X73124] [GN:ipa-25d] [OR:Bacillus subtilis] [DB:genpept-bct1] [DE:B.subtilis genomic region (325 to 333).] [SP:P39593] [LE:25373] [RE:26191] [DI:direct] >gp:[GI:e1186329:g2636365] [LN:BSUB0020] [AC:Z99123:AL009126] [PN:hydroxyethylthiazole kinase] [GN:thiK] [FN:phosphorylation of] [OR:Bacillus subtilis] [DB:genpept-bct1] [EC:2.7.1.50] [DE:Bacillus subtilis complete genome (section 20 of 21): from 3798401to 4010550.] [NT:alternate gene name: ipa-25d, ywbJ] [SP:P39593] [LE:131768] [RE:132586] [DI:complement]

| ORF Name | NTID | AAID | NT Length | AA Length | score | probability |
|---|---|---|---|---|---|---|
| AI7503000979_23651702_c1_343 | 55 | 3827 | 870 | 289 | 255 | 7.1e-22 |

Description
pir:[LN:C70070] [AC:C70070 ] [PN:conserved hypothetical protein ywtE] [GN:ywtE ]
[CL:hypothetical protein ywpJ] [OR:Bacillus subtilis] [DB:pir2]
>gp:[GI:e1184491:g2636110] [LN:BSUB0019] [AC:Z99122:AL009126] [GN:ywtE] [FN:unknown]
[OR:Bacillus subtilis] [DB:genpept-bct1] [DE:Bacillus subtilis complete genome (section
19 of 21): from 3597091to 3809700.] [NT:similar to hypothetical proteins] [LE:97330]
[RE:98190] [DI:direct] >gp:[GI:e308093:g1894770] [LN:BSZ92954] [AC:Z92954] [GN:ywtE]
[OR:Bacillus subtilis] [DB:genpept-bct1] [DE:B.subtilis yws[A,B,C,D,E,F,G] and gerBC
genes.] [NT:product similar to Bacillus subtilis YxeH and YcsE] [LE:4292] [RE:5152]
[DI:complement] >gp:[GI:e1184491:g2636110] [LN:BSUB0019] [AC:Z99122:AL009126] [GN:ywtE]
[FN:unknown] [OR:Bacillus subtilis] [DB:genpept] [DE:Bacillus subtilis complete genome
(section 19 of 21): from 3597091to 3809700.] [NT:similar to hypothetical proteins]
[LE:97330] [RE:98190] [DI:direct]

| ORF Name | NTID | AAID | NT Length | AA Length | score | probability |
|---|---|---|---|---|---|---|
| AI7503000979_23711642_c1_397 | 56 | 3828 | 1026 | 341 | 1445 | 5.6e-148 |

Description
gp:[GI:e284997:g1729794] [LN:SAUSIGB] [AC:Y09929] [GN:rsbU] [OR:Staphylococcus aureus]
[DB:genpept-bct1] [DE:S.aureus rsbU, rsbV, rsbW & sigB genes.] [LE:784] [RE:1785]
[DI:direct]

| ORF Name | NTID | AAID | NT Length | AA Length | score | probability |
|---|---|---|---|---|---|---|
| AI7503000979_2379658_f2_237 | 57 | 3829 | 225 | 74 | | |

Description
NO-HIT

| ORF Name | NTID | AAID | NT Length | AA Length | score | probability |
|---|---|---|---|---|---|---|
| AI7503000979_2383253_c2_405 | 58 | 3830 | 399 | 132 | | |

Description
NO-HIT

| ORF Name | NTID | AAID | NT Length | AA Length | score | probability |
|---|---|---|---|---|---|---|
| AI7503000979_24015687_c2_438 | 59 | 3831 | 465 | 154 | 119 | 1.8e-07 |

Description
sp:[LN:ATPZ_BACP3] [AC:P09354] [OR:BACILLUS PS3] [SR:,THERMOPHILIC BACTERIUM PS-3]
[DE:ATP SYNTHASE PROTEIN I] [SP:P09354] [DB:swissprot] >pir:[LN:S01397] [AC:S01397 ]
[PN:H+-transporting ATP synthase, chain I] [CL:Bacillus H+-transporting ATP synthase
chain I] [OR:thermophilic bacterium PS-3] [EC:3.6.1.34] [DB:pir2] >gp:[GI:g45809]
[LN:PS3TF0F1] [AC:X07804:X07374] [OR:thermophilic bacterium PS3] [DB:genpept-bct1]
[DE:Thermophilic bacterium PS3 TF0F-1 operon for ATP synthase complex.] [NT:I protein
(AA 1 - 127)] [SP:P09354] [LE:433] [RE:816] [DI:direct]

| ORF Name | NTID | AAID | NT Length | AA Length | score | probability |
|---|---|---|---|---|---|---|
| AI7503000979_24074137_c3_492 | 60 | 3832 | 1332 | 443 | 1360 | 5.7e-139 |

Description
gp:[GI:g143434] [LN:BACRHOTDKX] [AC:M97678] [PN:Rho Factor] [GN:rho]
[FN:transcriptional terminator] [OR:Bacillus subtilis] [SR:Bacillus subtilis
(Transposon Tn917 insertional library) DNA] [DB:genpept-bct1] [DE:Bacillus subtilis
OrfR, 3' end; OrfQ; transcriptional terminator(rho) gene; ribosomal protein L31;
thymidine kinase (tdk) gene,complete cds.] [LE:1643] [RE:2926] [DI:direct]

| ORF Name | NTID | AAID | NT Length | AA Length | score | probability |
|---|---|---|---|---|---|---|
| AI7503000979_24228411_c1_375 | 61 | 3833 | 399 | 132 | 358 | 8.6e-33 |

Description
gp:[GI:g2735512] [LN:SCU96108] [AC:U96108] [PN:single-strand binding protein homolog] [GN:ssb] [OR:Staphylococcus carnosus] [DB:genpept-bct2] [DE:Staphylococcus carnosus (3R)-hydroxymyristoyl acyl carrier proteindehydrase homolog (fabZ) gene, partial cds, YwpF homolog,single-strand binding protein homolog (ssb), SceD precursor (sceD),SceA precursor (sceA) and SceE precursor (sceE) genes, completecds, and TenA homolog (tenA) gene, partial cds.] [NT:SSB] [LE:857] [RE:1294] [DI:direct]

| ORF Name | NTID | AAID | NT Length | AA Length | score | probability |
|---|---|---|---|---|---|---|
| AI7503000979_24235952_c1_398 | 62 | 3834 | 327 | 108 | 501 | 6.0e-48 |

Description
gp:[GI:e284998:g1729795] [LN:SAUSIGB] [AC:Y09929] [GN:rsbV] [OR:Staphylococcus aureus] [DB:genpept-bct1] [DE:S.aureus rsbU, rsbV, rsbW & sigB genes.] [LE:1905] [RE:2231] [DI:direct]

| ORF Name | NTID | AAID | NT Length | AA Length | score | probability |
|---|---|---|---|---|---|---|
| AI7503000979_24245327_c1_364 | 63 | 3835 | 714 | 237 | 843 | 3.5e-84 |

Description
gp:[GI:e258331:g1765902] [LN:BCUPPGLYA] [AC:X99545] [PN:uracil phosphoribosyltransferase] [GN:upp] [OR:Bacillus caldolyticus] [DB:genpept-bct1] [DE:B.caldolyticus upp gene.] [SP:P70881] [LE:431] [RE:1060] [DI:direct]

| ORF Name | NTID | AAID | NT Length | AA Length | score | probability |
|---|---|---|---|---|---|---|
| AI7503000979_24254202_c1_368 | 64 | 3836 | 1512 | 503 | 2050 | 4.3e-212 |

Description
sp:[LN:ATPA_BACME] [AC:P17674] [GN:ATPA] [OR:BACILLUS MEGATERIUM] [EC:3.6.1.34] [DE:ATP SYNTHASE ALPHA CHAIN,] [SP:P17674] [DB:swissprot] >pir:[LN:F31482] [AC:F31482 ] [PN:H+-transporting ATP synthase, alpha chain] [CL:H+-transporting ATP synthase alpha chain: H+-transporting ATP synthase alpha chain homology] [OR:Bacillus megaterium] [EC:3.6.1.34] [DB:pir2] >gp:[GI:g142559] [LN:BACATPA] [AC:M20255:J04455:M18352:M23924] [PN:ATP synthase alpha subunit] [OR:Bacillus megaterium] [SR:B.megaterium (QM B1551) DNA, clones pWSB100, pCAH1.3, and pWPC208] [DB:genpept-bct1] [DE:B.megaterium ATP synthase i,a,c,b,delta,alpha,gamma,beta andepsilon subunit genes, complete cds, and ORF.] [LE:2853] [RE:4361] [DI:direct]

| ORF Name | NTID | AAID | NT Length | AA Length | score | probability |
|---|---|---|---|---|---|---|
| AI7503000979_24256562_c1_381 | 65 | 3837 | 126 | 41 | | |

Description
NO-HIT

| ORF Name | NTID | AAID | NT Length | AA Length | score | probability |
|---|---|---|---|---|---|---|
| AI7503000979_24350953_f1_2 | 66 | 3838 | 132 | 43 | 72 | 0.017 |

Description
pir:[LN:G71244] [AC:G71244 ] [PN:hypothetical protein PH0217] [GN:PH0217 ] [OR:Pyrococcus horikoshii] [DB:pir2] >gp:[GI:d1030229:g3256603] [LN:AP000001] [AC:AP000001:AB009465:AB009464:AB009466:AB009467:AB009468:AB009469] [PN:106aa long hypothetical protein] [GN:PH0217] [OR:Pyrococcus horikoshii] [SR:Pyrococcus horikoshii (strain:OT3) DNA] [DB:genpept-bct1] [DE:Pyrococcus horikoshii OT3 genomic DNA, 1-287000 nt. position (1/7).] [LE:191072] [RE:191392] [DI:complement]

| ORF Name | NTID | AAID | NT Length | AA Length | score | probability |
|---|---|---|---|---|---|---|
| AI7503000979_24353427_c3_503 | 67 | 3839 | 543 | 180 | 229 | 4.0e-19 |

Description sp:[LN:ATPD_BACSU] [AC:P37811] [GN:ATPH] [OR:BACILLUS SUBTILIS] [EC:3.6.1.34] [DE:ATP SYNTHASE DELTA CHAIN,] [SP:P37811] [DB:swissprot] >pir:[LN:I40365] [AC:I40365:D69592:S39253 ] [PN:H+-transporting ATP synthase, delta chain (atpH) ] [GN:atpH ] [CL:H+-transporting ATP synthase delta chain] [OR:Bacillus subtilis] [EC:3.6.1.34] [DB:pir2] >gp:[GI:g433988] [LN:BSATPASE] [AC:Z28592] [PN:ATP synthase subunit delta] [GN:atpH] [OR:Bacillus subtilis] [DB:genpept-bct1] [DE:B.subtilis (168) atpase genes for ATP synthase subunits i, a, c ,b, delta, alpha, gamma, beta, epsilon.] [SP:P37811] [LE:2484] [RE:3029] [DI:direct] >gp:[GI:e1184590:g2636209] [LN:BSUB0019] [AC:Z99122:AL009126] [PN:ATP synthase (subunit a)] [GN:atpH] [OR:Bacillus subtilis] [DB:genpept-bct1] [EC:3.6.1.34] [DE:Bacillus subtilis complete genome (section 19 of 21): from 3597091to 3809700.] [SP:P37811] [LE:187368] [RE:187913] [DI:complement] >gp:[GI:e1184590:g2636209] [LN:BSUB0019] [AC:Z99122:AL009126] [PN:ATP synthase (subunit delta)] [GN:atpH] [OR:Bacillus subtilis] [DB:genpept] [EC:3.6.1.34] [DE:Bacillus subtilis complete genome (section 19 of 21): from 3597091to 3809700.] [SP:P37811] [LE:187368] [RE:187913] [DI:complement]

| ORF Name | NTID | AAID | NT Length | AA Length | score | probability |
|---|---|---|---|---|---|---|
| AI7503000979_24392193_c1_346 | 68 | 3840 | 204 | 67 | | |

Description

NO-HIT

| ORF Name | NTID | AAID | NT Length | AA Length | score | probability |
|---|---|---|---|---|---|---|
| AI7503000979_24406260_c2_433 | 69 | 3841 | 1296 | 431 | 1258 | 3.7e-128 |

Description sp:[LN:MURA_BACSU] [AC:P19670:Q03225] [GN:MURA:MURZ] [OR:BACILLUS SUBTILIS] [EC:2.5.1.7] [DE:ENOLPYRUVYL TRANSFERASE) (EPT)] [SP:P19670:Q03225] [DB:swissprot] >pir:[LN:G32354] [AC:S55428:G32354:H69662 ] [PN:UDP-N-acetylglucosamine 1-carboxyvinyltransferase, murZ] [GN:murZ ] [CL:UDP-N-acetylglucosamine 1-carboxyvinyltransferase MurZ] [OR:Bacillus subtilis] [EC: 2.5.1.7] [DB:pir2] >gp:[GI:g853767] [LN:BSDNA320D] [AC:Z49782] [PN:UDP-N-acetylglucosamine] [GN:murZ] [OR:Bacillus subtilis] [DB:genpept-bct1] [DE:B.subtilis chromosomal DNA (region 320-321 degrees).] [SP:P19670] [LE:14403] [RE:15692] [DI:direct] >gp:[GI:e1184616:g2636235] [LN:BSUB0019] [AC:Z99122:AL009126] [PN:UDP-N-acetylglucosamine] [GN:murZ] [FN:peptidoglycan biosynthesis] [OR:Bacillus subtilis] [DB:genpept-bct1] [EC:2.5.1.7] [DE:Bacillus subtilis complete genome (section 19 of 21): from 3597091to 3809700.] [NT:alternate gene name: murZ, lssF, rev-4] [LE:208051] [RE:209340] [DI:complement] >gp:[GI:e1186211:g2636247] [LN:BSUB0020] [AC:Z99123:AL009126] [PN:UDP-N-acetylglucosamine] [GN:murZ] [FN:peptidoglycan biosynthesis] [OR:Bacillus subtilis] [DB:genpept-bct1] [EC:2.5.1.7] [DE:Bacillus subtilis complete genome (section 20 of 21): from 3798401to 4010550.] [NT:alternate gene name: murZ, lssF, rev-4] [LE:6741] [RE:8030] [DI:complement] >gp:[GI:e1184616:g2636235] [LN:BSUB0019] [AC:Z99122:AL009126] [PN:UDP-N-acetylglucosamine] [GN:murZ] [FN:peptidoglycan biosynthesis] [OR:Bacillus subtilis] [DB:genpept] [EC:2.5.1.7] [DE:Bacillus subtilis complete genome (section 19 of 21): from 3597091to 3809700.] [NT:alternate gene name: murZ, lssF, rev-4] [SP:P19670] [LE:208051] [RE:209340] [DI:complement]

| ORF Name | NTID | AAID | NT Length | AA Length | score | probability |
|---|---|---|---|---|---|---|
| AI7503000979_24407631_f3_252 | 70 | 3842 | 144 | 47 | | |

Description

NO-HIT

| ORF Name | NTID | AAID | NT Length | AA Length | score | probability |
|---|---|---|---|---|---|---|
| AI7503000979_24415933_c2_418 | 71 | 3843 | 435 | 144 | 83 | 0.026 |

Description sp:[LN:YUXK_BACSU] [AC:P40761:O05233] [GN:YUXK] [OR:BACILLUS SUBTILIS] [DE:HYPOTHETICAL 15.7 KD PROTEIN IN PBPD-COMA INTERGENIC REGION (ORF2)] [SP:P40761:O05233] [DB:swissprot] >pir:[LN:B55220] [AC:B55220:D70025 ] [PN:hypothetical protein yuxK:pbpD 3'-region hypothetical protein] [GN:yuxK ] [OR:Bacillus subtilis] [DB:pir2] >gp:[GI:g520537] [LN:BSU11882] [AC:U11882] [PN:unknown] [GN:pbpD] [OR:Bacillus subtilis] [DB:genpept-bct1] [DE:Bacillus subtilis orf1, partial cds, penicillin-binding protein 4(pbpD) gene, complete cds, and orf2, complete cds.] [NT:orf2] [LE:2760] [RE:3173] [DI:direct] >gp:[GI:e1184228:g2635646] [LN:BSUB0017] [AC:Z99120:AL009126] [GN:yuxK] [PN:unknown] [OR:Bacillus subtilis] [DB:genpept-bct1] [DE:Bacillus subtilis complete genome (section 17 of 21): from 3197001to 3414420.] [NT:alternate gene name: yugD] [SP:P40761] [LE:37885] [RE:38298] [DI:direct] >gp:[GI:e311522:g1934785] [LN:BSZ93933] [AC:Z93933] [PN:unknown] [GN:yugD] [OR:Bacillus subtilis] [DB:genpept-bct1] [DE:B.subtilis genomic DNA fragment from yugA to yugD.] [SP:P40761] [LE:7318] [RE:7731] [DI:direct]

| ORF Name | NTID | AAID | NT Length | AA Length | score | probability |
|---|---|---|---|---|---|---|
| AI7503000979_24508563_c2_436 | 72 | 3844 | 1092 | 363 | 1226 | 9.0e-125 |

Description sp:[LN:RF1_BACSU] [AC:P45872] [GN:PRFA] [OR:BACILLUS SUBTILIS] [DE:PEPTIDE CHAIN RELEASE FACTOR 1 (RF-1)] [SP:P45872] [DB:swissprot] >pir:[LN:S55437] [AC:S55437:G69681 ] [PN:translation releasing factor RF-1:peptide chain release factor 1] [GN:prfA:RF-1 ] [CL:translation releasing factor] [OR:Bacillus subtilis] [DB:pir1] >gp:[GI:g853776] [LN:BSDNA320D] [AC:Z49782] [PN:peptide chain release factor 1] [GN:prfA] [OR:Bacillus subtilis] [DB:genpept-bct1] [DE:B.subtilis chromosomal DNA (region 320-321 degrees).] [NT:gtg start codon] [SP:P45872] [LE:23623] [RE:24693] [DI:direct] >gp:[GI:e1184607:g2636226] [LN:BSUB0019] [AC:Z99122:AL009126] [PN:peptide chain release factor 1] [GN:prfA] [OR:Bacillus subtilis] [DB:genpept-bct1] [DE:Bacillus subtilis complete genome (section 19 of 21): from 3597091to 3809700.] [SP:P45872] [LE:199050] [RE:200120] [DI:complement] >gp:[GI:e1184607:g2636226] [LN:BSUB0019] [AC:Z99122:AL009126] [PN:peptide chain release factor 1] [GN:prfA] [OR:Bacillus subtilis] [DB:genpept] [DE:Bacillus subtilis complete genome (section 19 of 21): from 3597091to 3809700.] [SP:P45872] [LE:199050] [RE:200120] [DI:complement]

| ORF Name | NTID | AAID | NT Length | AA Length | score | probability |
|---|---|---|---|---|---|---|
| AI7503000979_24625216_f3_264 | 73 | 3845 | 186 | 61 | | |

Description

NO-HIT

| ORF Name | NTID | AAID | NT Length | AA Length | score | probability |
|---|---|---|---|---|---|---|
| AI7503000979_24641687_c2_437 | 74 | 3846 | 426 | 141 | 237 | 5.7e-20 |

Description
sp:[LN:YWLE_BACSU] [AC:P39155] [GN:YWLE:IPC-31D] [OR:BACILLUS SUBTILIS] [EC:3.1.3.48]
[DE:(EC 3.1.3.48)] [SP:P39155] [DB:swissprot] >pir:[LN:S49360] [AC:I40479:B70062:S49360
] [PN:protein-tyrosine-phosphatase, homolog ywlE, low molecular weight:ipc-31d protein]
[GN:ywlE:ipc-31d ] [CL:protein-tyrosine-phosphatase, low molecular weight] [OR:Bacillus
subtilis] [EC:3.1.3.48] [DB:pirl] >gp:[GI:g556883] [LN:BSSPORUPP] [AC:Z38002]
[PN:Unknown] [GN:ipc-31d] [OR:Bacillus subtilis] [DB:genpept-bct1] [DE:B.subtilis
spoII-R, glyC and upp genes.] [SP:P39155] [LE:3679] [RE:4131] [DI:direct]
>gp:[GI:e1184599:g2636218] [LN:BSUB0019] [AC:Z99122:AL009126] [GN:ywlE] [FN:unknown]
[OR:Bacillus subtilis] [DB:genpept-bct1] [DE:Bacillus subtilis complete genome (section
19 of 21): from 3597091to 3809700.] [NT:alternate gene name: ipc-31d; similar to]
[SP:P39155] [LE:193770] [RE:194222] [DI:complement] >gp:[GI:e1184599:g2636218]
[LN:BSUB0019] [AC:Z99122:AL009126] [GN:ywlE] [FN:unknown] [OR:Bacillus subtilis]
[DB:genpept] [DE:Bacillus subtilis complete genome (section 19 of 21): from 3597091to
3809700.] [NT:alternate gene name: ipc-31d; similar to] [SP:P39155] [LE:193770]
[RE:194222] [DI:complement]

| ORF Name | NTID | AAID | NT Length | AA Length | score | probability |
|---|---|---|---|---|---|---|
| AI7503000979_24642963_c2_458 | 75 | 3847 | 216 | 71 | 81 | 0.0019 |

Description
sp:[LN:COPP_HELFE] [AC:O32620] [GN:COPP] [OR:HELICOBACTER FELIS] [DE:COP ASSOCIATED
PROTEIN (COPPER ION BINDING PROTEIN)] [SP:O32620] [DB:swissprot]
>gp:[GI:e353967:g2660543] [LN:HFAJ1932] [AC:AJ001932] [GN:copP] [FN:divalent cation
binding protein] [OR:Helicobacter felis] [DB:genpept-bct1] [DE:Helicobacter felis ftsH,
copA, copP genes and two ORF's.] [SP:O32620] [LE:5306] [RE:5506] [DI:direct]

| ORF Name | NTID | AAID | NT Length | AA Length | score | probability |
|---|---|---|---|---|---|---|
| AI7503000979_24647558_c1_352 | 76 | 3848 | 357 | 118 | | |

Description
NO-HIT

| ORF Name | NTID | AAID | NT Length | AA Length | score | probability |
|---|---|---|---|---|---|---|
| AI7503000979_24665932_c3_496 | 77 | 3849 | 840 | 279 | 477 | 2.1e-45 |

Description
sp:[LN:HEMK_BACSU] [AC:P45873] [GN:YWKE] [OR:BACILLUS SUBTILIS] [DE:HEMK PROTEIN
HOMOLOG] [SP:P45873] [DB:swissprot] >pir:[LN:S55438] [AC:S55438:D70061 ]
[PN:protoporphyrinogen oxidase homolog ywkE] [GN:ywkE ] [OR:Bacillus subtilis]
[DB:pir2] >gp:[GI:g853777] [LN:BSDNA320D] [AC:Z49782] [GN:ywkE] [OR:Bacillus subtilis]
[DB:genpept-bct1] [DE:B.subtilis chromosomal DNA (region 320-321 degrees).] [NT:product
similar to E.coli PRFA2 protein] [SP:P45873] [LE:24695] [RE:25561] [DI:direct]
>gp:[GI:e1184606:g2636225] [LN:BSUB0019] [AC:Z99122:AL009126] [GN:ywkE] [FN:unknown]
[OR:Bacillus subtilis] [DB:genpept-bct1] [DE:Bacillus subtilis complete genome (section
19 of 21): from 3597091to 3809700.] [NT:similar to protoporphyrinogen oxidase]
[SP:P45873] [LE:198182] [RE:199048] [DI:complement] >gp:[GI:e1184606:g2636225]
[LN:BSUB0019] [AC:Z99122:AL009126] [GN:ywkE] [FN:unknown] [OR:Bacillus subtilis]
[DB:genpept] [DE:Bacillus subtilis complete genome (section 19 of 21): from 3597091to
3809700.] [NT:similar to protoporphyrinogen oxidase] [SP:P45873] [LE:198182]
[RE:199048] [DI:complement]

| ORF Name | NTID | AAID | NT Length | AA Length | score | probability |
|---|---|---|---|---|---|---|
| AI7503000979_2541301_c3_505 | 78 | 3850 | 351 | 116 | 180 | 6.3e-14 |

Description pir:[LN:G70070] [AC:G70070 ] [PN:hypothetical protein ywzB] [GN:ywzB ] [OR:Bacillus subtilis] [DB:pir2] >gp:[GI:e1184584:g2636203] [LN:BSUB0019] [AC:Z99122:AL009126] [GN:ywzB] [FN:unknown] [OR:Bacillus subtilis] [DB:genpept-bct1] [DE:Bacillus subtilis complete genome (section 19 of 21): from 3597091to 3809700.] [LE:182127] [RE:182357] [DI:complement] >gp:[GI:e1184584:g2636203] [LN:BSUB0019] [AC:Z99122:AL009126] [GN:ywzB] [FN:unknown] [OR:Bacillus subtilis] [DB:genpept] [DE:Bacillus subtilis complete genome (section 19 of 21): from 3597091to 3809700.] [LE:182127] [RE:182357] [DI:complement]

| ORF Name | NTID | AAID | NT Length | AA Length | score | probability |
|---|---|---|---|---|---|---|
| AI7503000979_25422081_c3_475 | 79 | 3851 | 204 | 67 | 84 | 0.014 |

Description sp:[LN:ETF1_FOWP1] [AC:P21966] [GN:FPD6] [OR:FOWLPOX VIRUS] [SR:FP-1,] [DE:EARLY TRANSCRIPTION FACTOR 70 KD SUBUNIT] [SP:P21966] [DB:swissprot] >pir:[LN:F35216] [AC:F35216 ] [PN:FPD6 protein] [CL:vaccinia virus early transcription factor 70K chain] [OR:fowlpox virus] [DB:pir2] >gp:[GI:g61229] [LN:POFPHIND] [AC:X17202] [GN:ORF FPD6] [FN:Vaccinia D6 homolog] [OR:Fowlpox virus] [DB:genpept-vrl] [DE:Fowlpox virus DNA sequence (Hind III fragment).] [SP:P21966] [LE:6614] [RE:8431] [DI:direct]

| ORF Name | NTID | AAID | NT Length | AA Length | score | probability |
|---|---|---|---|---|---|---|
| AI7503000979_26173800_c1_387 | 80 | 3852 | 186 | 61 | | |

Description

NO-HIT

| ORF Name | NTID | AAID | NT Length | AA Length | score | probability |
|---|---|---|---|---|---|---|
| AI7503000979_26182767_c2_426 | 81 | 3853 | 123 | 40 | | |

Description

NO-HIT

| ORF Name | NTID | AAID | NT Length | AA Length | score | probability |
|---|---|---|---|---|---|---|
| AI7503000979_26212756_f2_137 | 82 | 3854 | 1488 | 495 | 1477 | 2.3e-151 |

Description sp:[LN:YWNE_BACSU] [AC:P71040] [GN:YWNE] [OR:BACILLUS SUBTILIS] [DE:HYPOTHETICAL 55.8 KD PROTEIN IN SPOIIQ-MTA INTERGENIC REGION] [SP:P71040] [DB:swissprot] >pir:[LN:G70063] [AC:G70063 ] [PN:cardiolipin synthase homolog ywnE] [GN:ywnE ] [CL:Bacillus probable cardiolipin synthetase] [OR:Bacillus subtilis] [DB:pir2] >gp:[GI:e1184565:g2636184] [LN:BSUB0019] [AC:Z99122:AL009126] [GN:ywnE] [FN:unknown] [OR:Bacillus subtilis] [DB:genpept-bct1] [DE:Bacillus subtilis complete genome (section 19 of 21): from 3597091to 3809700.] [NT:similar to cardiolipin synthase] [SP:P71040] [LE:164628] [RE:166076] [DI:direct] >gp:[GI:e269549:g1592701] [LN:BSUEROP] [AC:Y08559] [PN:Unknown] [GN:ywnE] [OR:Bacillus subtilis] [DB:genpept-bct1] [DE:B.subtilis urease operon and downstream DNA.] [NT:Product similar to Escherichia coli cardiolipin] [SP:P71040] [LE:5155] [RE:6603] [DI:complement] >gp:[GI:e1184565:g2636184] [LN:BSUB0019] [AC:Z99122:AL009126] [GN:ywnE] [FN:unknown] [OR:Bacillus subtilis] [DB:genpept] [DE:Bacillus subtilis complete genome (section 19 of 21): from 3597091to 3809700.] [NT:similar to cardiolipin synthase] [SP:P71040] [LE:164628] [RE:166076] [DI:direct]

| ORF Name | NTID | AAID | NT Length | AA Length | score | probability |
|---|---|---|---|---|---|---|
| AI7503000979_26360260_c3_520 | 83 | 3855 | 375 | 124 | 416 | 6.1e-39 |

Description
gp:[GI:e1340260:g3850850] [LN:SAU16431] [AC:Y16431] [PN:dpj protein] [GN:dpj]
[OR:Staphylococcus aureus] [DB:genpept-bct1] [DE:Staphylococcus aureus dpj, alr genes,
partial kdpC gene and 4ORF's.] [LE:2975] [RE:3334] [DI:direct]

| ORF Name | NTID | AAID | NT Length | AA Length | score | probability |
|---|---|---|---|---|---|---|
| AI7503000979_26751542_f1_73 | 84 | 3856 | 492 | 163 | 577 | 5.3e-56 |

Description
pir:[LN:A64533] [AC:A64533 ] [PN:conserved hypothetical protein HP0105] [CL:conserved
hypothetical protein HI0491] [OR:Helicobacter pylori] [DB:pir2] >gp:[GI:g2313188]
[LN:AE000532] [AC:AE000532:AE000511] [PN:conserved hypothetical protein] [GN:HP0105]
[OR:Helicobacter pylori 26695] [DB:genpept-bct2] [DE:Helicobacter pylori 26695 section
10 of 134 of the complete genome.] [NT:similar to GB:L42023 SP:P44007 PID:1003866]
[LE:5494] [RE:5961] [DI:complement]

| ORF Name | NTID | AAID | NT Length | AA Length | score | probability |
|---|---|---|---|---|---|---|
| AI7503000979_26757677_c2_408 | 85 | 3857 | 1377 | 458 | 2163 | 4.6e-224 |

Description
gp:[GI:e1352473:g3892895] [LN:SAARGFEMD] [AC:Y15477] [PN:phosphoglucosamine-mutase]
[GN:glmM] [OR:Staphylococcus aureus] [DB:genpept-bct1] [DE:Staphylococcus aureus argI,
glmM genes and ORF1 and ORF2.] [LE:2968] [RE:4323] [DI:direct]
>gp:[GI:e283110:g1684749] [LN:SAFEMD] [AC:Y09570] [GN:femD] [OR:Staphylococcus aureus]
[DB:genpept-bct1] [DE:S.aureus femD gene.] [LE:511] [RE:1866] [DI:direct]

| ORF Name | NTID | AAID | NT Length | AA Length | score | probability |
|---|---|---|---|---|---|---|
| AI7503000979_2775462_c1_394 | 86 | 3858 | 522 | 173 | 331 | 6.2e-30 |

Description
gp:[GI:e1340259:g3850849] [LN:SAU16431] [AC:Y16431] [PN:hypothetical protein] [GN:ORF4]
[OR:Staphylococcus aureus] [DB:genpept-bct1] [DE:Staphylococcus aureus dpj, alr genes,
partial kdpC gene and 4ORF's.] [LE:2477] [RE:2971] [DI:direct]

| ORF Name | NTID | AAID | NT Length | AA Length | score | probability |
|---|---|---|---|---|---|---|
| AI7503000979_2925275_f1_20 | 87 | 3859 | 141 | 46 | | |

Description
NO-HIT

| ORF Name | NTID | AAID | NT Length | AA Length | score | probability |
|---|---|---|---|---|---|---|
| AI7503000979_29307312_c3_470 | 88 | 3860 | 165 | 54 | | |

Description
NO-HIT

| ORF Name | NTID | AAID | NT Length | AA Length | score | probability |
|---|---|---|---|---|---|---|
| AI7503000979_29695252_c3_497 | 89 | 3861 | 1098 | 365 | 665 | 2.5e-65 |

Description sp:[LN:YWLC_BACSU] [AC:P39153] [GN:YWLC:IPC-29D] [OR:BACILLUS SUBTILIS] [DE:HYPOTHETICAL 37.0 KD PROTEIN IN SPOIIR-GLYC INTERGENIC REGION] [SP:P39153] [DB:swissprot] >pir:[LN:I40476] [AC:I40476:H70061:S49358 ] [PN:conserved hypothetical protein ywlC:SUA5 homolog ipc-29d] [GN:ywlC:ipc-29d ] [CL:Bacillus subtilis conserved hypothetical protein ywlC] [OR:Bacillus subtilis] [DB:pir2] >gp:[GI:g556881] [LN:BSSPORUPP] [AC:Z38002] [PN:Similar to Saccharomyces cerevisiae SUA5] [GN:ipc-29d] [OR:Bacillus subtilis] [DB:genpept-bct1] [DE:B.subtilis spoII-R, glyC and upp genes.] [SP:P39153] [LE:1927] [RE:2967] [DI:direct] >gp:[GI:e1184601:g2636220] [LN:BSUB0019] [AC:Z99122:AL009126] [GN:ywlC] [FN:unknown] [OR:Bacillus subtilis] [DB:genpept-bct1] [DE:Bacillus subtilis complete genome (section 19 of 21): from 3597091to 3809700.] [NT:alternate gene name: ipc-29d; similar to] [SP:P39153] [LE:194934] [RE:195974] [DI:complement] >gp:[GI:e1184601:g2636220] [LN:BSUB0019] [AC:Z99122:AL009126] [GN:ywlC] [FN:unknown] [OR:Bacillus subtilis] [DB:genpept] [DE:Bacillus subtilis complete genome (section 19 of 21): from 3597091to 3809700.] [NT:alternate gene name: ipc-29d; similar to] [SP:P39153] [LE:194934] [RE:195974] [DI:complement]

| ORF Name | NTID | AAID | NT Length | AA Length | score | probability |
|---|---|---|---|---|---|---|
| AI7503000979_29879407_c2_410 | 90 | 3862 | 189 | 62 | | |

Description

NO-HIT

| ORF Name | NTID | AAID | NT Length | AA Length | score | probability |
|---|---|---|---|---|---|---|
| AI7503000979_30682816_c1_367 | 91 | 3863 | 537 | 178 | 376 | 1.1e-34 |

Description sp:[LN:ATPF_BACME] [AC:P20601] [GN:ATPF] [OR:BACILLUS MEGATERIUM] [EC:3.6.1.34] [DE:ATP SYNTHASE B CHAIN,] [SP:P20601] [DB:swissprot] >pir:[LN:D31482] [AC:D31482 ] [PN:H+-transporting ATP synthase, chain b] [CL:H+-transporting ATP synthase chain I] [OR:Bacillus megaterium] [EC:3.6.1.34] [DB:pir2] >gp:[GI:g142557] [LN:BACATPA] [AC:M20255:J04455:M18352:M23924] [PN:ATP synthase b subunit] [OR:Bacillus megaterium] [SR:B.megaterium (QM B1551) DNA, clones pWSB100, pCAH1.3, and pWPC208] [DB:genpept-bct1] [DE:B.megaterium ATP synthase i,a,c,b,delta,alpha,gamma,beta andepsilon subunit genes, complete cds, and ORF.] [LE:1777] [RE:2295] [DI:direct]

| ORF Name | NTID | AAID | NT Length | AA Length | score | probability |
|---|---|---|---|---|---|---|
| AI7503000979_31637_c2_406 | 92 | 3864 | 891 | 296 | 1229 | 4.3e-125 |

Description gp:[GI:e1352471:g3892893] [LN:SAARGFEMD] [AC:Y15477] [PN:hypothetical protein] [OR:Staphylococcus aureus] [DB:genpept-bct1] [DE:Staphylococcus aureus argI, glmM genes and ORF1 and ORF2.] [NT:orf1] [LE:1198] [RE:2007] [DI:direct]

| ORF_Name | NTID | AAID | NT Length | AA Length | score | probability |
|---|---|---|---|---|---|---|
| AI7503000979_33412800_c2_429 | 93 | 3865 | 882 | 293 | 135 | 1.2e-08 |

Description
pir:[LN:B69595] [AC:B69595 ] [PN:spermine/spermidine acetyltransferase bltD] [GN:bltD ] [OR:Bacillus subtilis] [DB:pir2] >gp:[GI:d1013033:g1303698] [LN:BACJH642] [AC:D84432:D82370] [PN:BltD] [OR:Bacillus subtilis] [SR:Bacillus subtilis (strain:JH642(trpC2 PheA1)) DNA] [DB:genpept-bct1] [DE:Bacillus subtilis DNA, 283 Kb region containing skin element.] [LE:811] [RE:1269] [DI:complement] >gp:[GI:e1183889:g2635105] [LN:BSUB0014] [AC:Z99117:AL009126] [PN:spermine/spermidine acetyltransferase] [GN:bltD] [OR:Bacillus subtilis] [DB:genpept-bct1] [EC:2.3.1.-] [DE:Bacillus subtilis complete genome (section 14 of 21): from 2599451to 2812870.] [NT:alternate gene name: bmr2D, bmtD] [SP:P39909] [LE:118163] [RE:118621] [DI:direct]

| ORF_Name | NTID | AAID | NT Length | AA Length | score | probability |
|---|---|---|---|---|---|---|
| AI7503000979_3361326_c2_403 | 94 | 3866 | 207 | 68 | | |

Description
NO-HIT

| ORF_Name | NTID | AAID | NT Length | AA Length | score | probability |
|---|---|---|---|---|---|---|
| AI7503000979_33673776_c2_435 | 95 | 3867 | 297 | 98 | 312 | 6.4e-28 |

Description
gp:[GI:g4193373] [LN:AF072894] [AC:AF072894] [PN:ribosomal protein L31] [GN:rpmE] [OR:Listeria monocytogenes] [DB:genpept-bct2] [DE:Listeria monocytogenes 4b1 putative transcription terminator Rho(rho) gene, partial cds; and wall teichoic acid glycosylationprotein GtcA (gtcA) and ribosomal protein L31 (rpmE) genes,complete cds.] [LE:848] [RE:1093] [DI:direct]

| ORF_Name | NTID | AAID | NT Length | AA Length | score | probability |
|---|---|---|---|---|---|---|
| AI7503000979_33751260_c1_372 | 96 | 3868 | 471 | 156 | 448 | 2.5e-42 |

Description
pir:[LN:D70065] [AC:D70065 ] [PN:(3R)-hydroxymyristoyl-[acyl carrier protein] dehydratase, ywpB] [GN:ywpB ] [CL:(3R)-hydroxymyristoyl-[acyl carrier protein] dehydratase] [OR:Bacillus subtilis] [EC: 4.2.1.-] [DB:pir2] >gp:[GI:e1184543:g2636162] [LN:BSUB0019] [AC:Z99122:AL009126] [GN:ywpB] [FN:unknown] [OR:Bacillus subtilis] [DB:genpept-bct1] [DE:Bacillus subtilis complete genome (section 19 of 21): from 3597091to 3809700.] [NT:similar to hydroxymyristoyl-(acyl carrier protein)] [LE:145724] [RE:146122] [DI:complement] >gp:[GI:e289141:g1763703] [LN:BSZ83337] [AC:Z83337] [GN:ywpB] [OR:Bacillus subtilis] [DB:genpept-bct1] [DE:B.subtilis mbl, flh[O,P], rapD, ywp[B,C,D,E,F,G,H,I,J] and ywqAgenes.] [NT:similar to hydroxymyristoyl-(acyl carrier protein)] [LE:3199] [RE:3597] [DI:direct] >gp:[GI:e1184543:g2636162] [LN:BSUB0019] [AC:Z99122:AL009126] [GN:ywpB] [FN:unknown] [OR:Bacillus subtilis] [DB:genpept] [DE:Bacillus subtilis complete genome (section 19 of 21): from 3597091to 3809700.] [NT:similar to hydroxymyristoyl-(acyl carrier protein)] [LE:145724] [RE:146122] [DI:complement]

| ORF_Name | NTID | AAID | NT Length | AA Length | score | probability |
|---|---|---|---|---|---|---|
| AI7503000979_33870312_c3_522 | 97 | 3869 | 792 | 263 | 1213 | 2.1e-123 |

Description
gp:[GI:e279935:g1934991] [LN:SASIGFACB] [AC:Y07645] [PN:sigma factor B] [GN:sigB] [OR:Staphylococcus aureus] [DB:genpept-bct1] [DE:S.aureus sigB gene.] [LE:2674] [RE:3444] [DI:direct] >gp:[GI:e285000:g1729797] [LN:SAUSIGB] [AC:Y09929] [PN:sigma-B] [GN:sigB] [OR:Staphylococcus aureus] [DB:genpept-bct1] [DE:S.aureus rsbU, rsbV, rsbW & sigB genes.] [LE:2687] [RE:3457] [DI:direct]

| ORF_Name | NTID | AAID | NT Length | AA Length | score | probability |
|---|---|---|---|---|---|---|
| AI7503000979_34062928_c3_521 | 98 | 3870 | 1083 | 360 | 1321 | 7.7e-135 |

Description
gp:[GI:e1340261:g3850851] [LN:SAU16431] [AC:Y16431] [PN:alr protein] [GN:alr]
[OR:Staphylococcus aureus] [DB:genpept-bct1] [DE:Staphylococcus aureus dpj, alr genes, partial kdpC gene and 4ORF's.] [LE:3400] [RE:4548] [DI:direct]

| ORF_Name | NTID | AAID | NT Length | AA Length | score | probability |
|---|---|---|---|---|---|---|
| AI7503000979_34181277_c2_461 | 99 | 3871 | 501 | 166 | 299 | 1.5e-26 |

Description
gp:[GI:e1340257:g3850847] [LN:SAU16431] [AC:Y16431] [PN:hypothetical protein] [GN:ORF2]
[OR:Staphylococcus aureus] [DB:genpept-bct1] [DE:Staphylococcus aureus dpj, alr genes, partial kdpC gene and 4ORF's.] [LE:438] [RE:917] [DI:direct]

| ORF_Name | NTID | AAID | NT Length | AA Length | score | probability |
|---|---|---|---|---|---|---|
| AI7503000979_34187702_c2_407 | 100 | 3872 | 936 | 311 | 1173 | 3.7e-119 |

Description
gp:[GI:e1352472:g3892894] [LN:SAARGFEMD] [AC:Y15477] [PN:hypothetical protein]
[GN:orf2] [OR:Staphylococcus aureus] [DB:genpept-bct1] [DE:Staphylococcus aureus argI, glmM genes and ORF1 and ORF2.] [LE:2009] [RE:2941] [DI:direct]

| ORF_Name | NTID | AAID | NT Length | AA Length | score | probability |
|---|---|---|---|---|---|---|
| AI7503000979_34197275_f2_176 | 101 | 3873 | 126 | 41 | | |

Description
NO-HIT

| ORF_Name | NTID | AAID | NT Length | AA Length | score | probability |
|---|---|---|---|---|---|---|
| AI7503000979_34250327_c1_396 | 102 | 3874 | 363 | 120 | 540 | 4.5e-52 |

Description
gp:[GI:e279931:g1934987] [LN:SASIGFACB] [AC:Y07645] [GN:ORF1] [OR:Staphylococcus aureus] [DB:genpept-bct1] [DE:S.aureus sigB gene.] [LE:72] [RE:434] [DI:direct]

| ORF_Name | NTID | AAID | NT Length | AA Length | score | probability |
|---|---|---|---|---|---|---|
| AI7503000979_34589010_c1_348 | 103 | 3875 | 246 | 81 | | |

Description
NO-HIT

| ORF Name | NTID | AAID | NT Length | AA Length | score | probability |
|---|---|---|---|---|---|---|
| AI7503000979_34611067_f3_302 | 104 | 3876 | 540 | 179 | 145 | 3.2e-10 |

Description
sp:[LN:YWJG_BACSU] [AC:P06629] [GN:YWJG] [OR:BACILLUS SUBTILIS] [DE:HYPOTHETICAL 19.1 KD PROTEIN IN SPO0F-PYRG INTERGENIC REGION (ORFS)] [SP:P06629] [DB:swissprot] >pir:[LN:I40471] [AC:I40471:S55424:E70060 ] [PN:hypothetical protein ywjG:spoOF protein] [GN:ywjG:spoOF ] [OR:Bacillus subtilis] [DB:pir2] >gp:[GI:g853763] [LN:BSDNA320D] [AC:Z49782] [GN:ywjG] [OR:Bacillus subtilis] [DB:genpept-bct1] [DE:B.subtilis chromosomal DNA (region 320-321 degrees).] [SP:P06629] [LE:11169] [RE:11690] [DI:complement] >gp:[GI:g40177] [LN:BSSPOO] [AC:V00105:J01549] [GN:spoOF] [OR:Bacillus subtilis] [DB:genpept-bct1] [DE:Bacillus subtilis gene required at an early stage of sporulation.(gene code spoOF).] [SP:P06629] [LE:541] [RE:1062] [DI:direct] >gp:[GI:e1184620:g2636239] [LN:BSUB0019] [AC:Z99122:AL009126] [GN:ywjG] [FN:unknown] [OR:Bacillus subtilis] [DB:genpept-bct1] [DE:Bacillus subtilis complete genome (section 19 of 21): from 3597091to 3809700.] [SP:P06629] [LE:212053] [RE:212574] [DI:direct] >gp:[GI:e1186215:g2636251] [LN:BSUB0020] [AC:Z99123:AL009126] [GN:ywjG] [FN:unknown] [OR:Bacillus subtilis] [DB:genpept-bct1] [DE:Bacillus subtilis complete genome (section 20 of 21): from 3798401to 4010550.] [SP:P06629] [LE:10743] [RE:11264] [DI:direct] >gp:[GI:e1184620:g2636239] [LN:BSUB0019] [AC:Z99122:AL009126] [GN:ywjG] [FN:unknown] [OR:Bacillus subtilis] [DB:genpept] [DE:Bacillus subtilis complete genome (section 19 of 21): from 3597091to 3809700.] [SP:P06629] [LE:212053] [RE:212574] [DI:direct]

| ORF Name | NTID | AAID | NT Length | AA Length | score | probability |
|---|---|---|---|---|---|---|
| AI7503000979_34615700_f2_193 | 105 | 3877 | 819 | 272 | 155 | 2.8e-08 |

Description
gp:[GI:g1293846] [LN:CELC42D8] [AC:U56966] [GN:C42D8.3] [OR:Caenorhabditis elegans] [SR:Caenorhabditis elegans strain=Bristol N2] [DB:genpept-inv1] [DE:Caenorhabditis elegans cosmid C42D8.] [NT:coded for by C. elegans cDNA yk30b3.5; coded for by] [LE:8907:9377:9844:10820] [RE:9056:9564:10206:10976] [DI:directJoin]

| ORF Name | NTID | AAID | NT Length | AA Length | score | probability |
|---|---|---|---|---|---|---|
| AI7503000979_34646926_f2_206 | 106 | 3878 | 732 | 243 | 585 | 7.6e-57 |

Description
sp:[LN:DEOD_ACTPL] [AC:P94164] [GN:DEOD] [OR:ACTINOBACILLUS PLEUROPNEUMONIAE] [SR:,HAEMOPHILUS PLEUROPNEUMONIAE] [EC:2.4.2.1] [DE:(PNP)] [SP:P94164] [DB:swissprot] >gp:[GI:g1732037] [LN:APU55016] [AC:U55016] [PN:purine nucleoside phosphorylase] [GN:deoD] [FN:cleavage of guanosine or inosine to respective] [OR:Actinobacillus pleuropneumoniae] [DB:genpept-bct1] [EC:2.4.2.1] [DE:Actinobacillus pleuropneumoniae heat-shock 10 protein GroES (mopB),heat-shock 60 protein GroEL (mopA), purine nucleoside phosphorylase(deoD) genes, complete cds, alcohol dehydrogenase (adhE) gene,partial cds.] [LE:176] [RE:898] [DI:direct]

| ORF Name | NTID | AAID | NT Length | AA Length | score | probability |
|---|---|---|---|---|---|---|
| AI7503000979_35354656_f1_108 | 107 | 3879 | 228 | 75 | | |

Description
NO-HIT

| ORF Name | NTID | AAID | NT Length | AA Length | score | probability |
|---|---|---|---|---|---|---|
| AI7503000979_35647783_f1_103 | 108 | 3880 | 690 | 229 | 181 | 4.9e-14 |

Description
pir:[LN:F71082] [AC:F71082 ] [PN:hypothetical protein PH0924] [GN:PH0924 ]
[OR:Pyrococcus horikoshii] [DB:pir2] >gp:[GI:d1030963:g3257337] [LN:AP000004]
[AC:AP000004:AB009494:AB009495:AB009496:AB009497:AB009498:AB009499] [PN:128aa long
hypothetical protein] [GN:PH0924] [OR:Pyrococcus horikoshii] [SR:Pyrococcus horikoshii
(strain:OT3) DNA] [DB:genpept-bct1] [DE:Pyrococcus horikoshii OT3 genomic DNA,
777001-994000 nt. position(4/7).] [LE:55768] [RE:56154] [DI:direct]

| ORF Name | NTID | AAID | NT Length | AA Length | score | probability |
|---|---|---|---|---|---|---|
| AI7503000979_36128785_c1_369 | 109 | 3881 | 888 | 295 | 796 | 3.3e-79 |

Description
sp:[LN:ATPG_BACME] [AC:P20602] [GN:ATPG] [OR:BACILLUS MEGATERIUM] [EC:3.6.1.34] [DE:ATP
SYNTHASE GAMMA CHAIN,] [SP:P20602] [DB:swissprot] >pir:[LN:G31482] [AC:G31482 ]
[PN:H+-transporting ATP synthase, gamma chain] [CL:H+-transporting ATP synthase gamma
chain] [OR:Bacillus megaterium] [EC:3.6.1.34] [DB:pir2] >gp:[GI:g142560] [LN:BACATPA]
[AC:M20255:J04455:M18352:M23924] [PN:ATP synthase gamma subunit] [OR:Bacillus
megaterium] [SR:B.megaterium (QM B1551) DNA, clones pWSB100, pCAH1.3, and pWPC208]
[DB:genpept-bct1] [DE:B.megaterium ATP synthase i,a,c,b,delta,alpha,gamma,beta
andepsilon subunit genes, complete cds, and ORF.] [LE:4467] [RE:5324] [DI:direct]

| ORF Name | NTID | AAID | NT Length | AA Length | score | probability |
|---|---|---|---|---|---|---|
| AI7503000979_36225052_c3_502 | 110 | 3882 | 234 | 77 | 270 | 1.8e-23 |

Description
pir:[LN:I39786] [AC:I39786 ] [PN:H+-transporting ATP synthase, C chain] [GN:atpE ]
[CL:H+-transporting ATP synthase lipid-binding protein] [OR:Bacillus firmus]
[EC:3.6.1.34] [DB:pir2] >gp:[GI:g142570] [LN:BACATPSYNB] [AC:M84713] [PN:ATP synthase c
subunit] [GN:atpE] [FN:proton translocation] [OR:Bacillus firmus] [SR:Bacillus firmus
DNA] [DB:genpept-bct1] [DE:Bacillus firmus ATP synthase a and c subunit genes, 3' end
andcomplete cds.] [NT:putative] [LE:299] [RE:511] [DI:direct]

| ORF Name | NTID | AAID | NT Length | AA Length | score | probability |
|---|---|---|---|---|---|---|
| AI7503000979_36363432_f1_85 | 111 | 3883 | 132 | 43 | | |

Description
NO-HIT

| ORF Name | NTID | AAID | NT Length | AA Length | score | probability |
|---|---|---|---|---|---|---|
| AI7503000979_4039012_c3_514 | 112 | 3884 | 168 | 55 | 59 | 0.036 |

Description
gp:[GI:g5410434] [LN:AF134170] [AC:AF134170] [PN:gag] [OR:Dictyostelium discoideum]
[DB:genpept] [DE:Dictyostelium discoideum retrotransposon TRE3-B, complete sequence.]
[LE:139] [RE:1347] [DI:direct]

| ORF_Name | NTID | AAID | NT Length | AA Length | score | probability |
|---|---|---|---|---|---|---|
| AI7503000979_4063202_c3_499 | 113 | 3885 | 1239 | 412 | 1563 | 1.8e-160 |

Description sp:[LN:GLYA_BACSU] [AC:P39148] [GN:GLYA:GLYC:IPC-34D] [OR:BACILLUS SUBTILIS] [EC:2.1.2.1] [DE:(SHMT)] [SP:P39148] [DB:swissprot] >pir:[LN:I40483] [AC:I40483:H69635:S49363 ] [PN:glycine hydroxymethyltransferase, glyA:serine hydroxymethyltransferase] [GN:glyA:glyC ] [CL:glycine hydroxymethyltransferase] [OR:Bacillus subtilis] [EC:2.1.2.1] [DB:pir2] >gp:[GI:g556886] [LN:BSSPORUPP] [AC:Z38002] [PN:serine hydroxymethyltransferase] [GN:glyC] [OR:Bacillus subtilis] [DB:genpept-bct1] [DE:B.subtilis spoII-R, glyC and upp genes.] [SP:P39148] [LE:5499] [RE:6746] [DI:direct] >gp:[GI:e1184596:g2636215] [LN:BSUB0019] [AC:Z99122:AL009126] [PN:serine hydroxymethyltransferase] [GN:glyA] [FN:glycine/serine/threonine metabolism] [OR:Bacillus subtilis] [DB:genpept-bct1] [EC:2.1.2.1] [DE:Bacillus subtilis complete genome (section 19 of 21): from 3597091to 3809700.] [NT:alternate gene name: glyC, ipc-34d] [SP:P39148] [LE:191155] [RE:192402] [DI:complement] >gp:[GI:e1184596:g2636215] [LN:BSUB0019] [AC:Z99122:AL009126] [PN:serine hydroxymethyltransferase] [GN:glyA] [FN:glycine/serine/threonine metabolism] [OR:Bacillus subtilis] [DB:genpept] [EC:2.1.2.1] [DE:Bacillus subtilis complete genome (section 19 of 21): from 3597091to 3809700.] [NT:alternate gene name: glyC, ipc-34d] [SP:P39148] [LE:191155] [RE:192402] [DI:complement]

| ORF_Name | NTID | AAID | NT Length | AA Length | score | probability |
|---|---|---|---|---|---|---|
| AI7503000979_40712_f2_210 | 114 | 3886 | 216 | 71 | | |

Description

NO-HIT

| ORF_Name | NTID | AAID | NT Length | AA Length | score | probability |
|---|---|---|---|---|---|---|
| AI7503000979_4072135_c3_490 | 115 | 3887 | 1467 | 488 | 870 | 4.8e-87 |

Description pir:[LN:E70961] [AC:E70961 ] [PN:hypothetical protein Rv0223c] [GN:Rv0223c ] [OR:Mycobacterium tuberculosis] [DB:pir2] >gp:[GI:e304956:g1871596] [LN:MTCY8D5] [AC:Z92669:AL123456] [PN:hypothetical protein Rv0223c] [GN:Rv0223c] [OR:Mycobacterium tuberculosis] [DB:genpept-bct1] [DE:Mycobacterium tuberculosis H37Rv complete genome; segment 12/162.] [NT:Rv0223c, (MTCY08D5.18), aldehyde dehydrogenase,] [LE:18979] [RE:20442] [DI:complement]

| ORF_Name | NTID | AAID | NT Length | AA Length | score | probability |
|---|---|---|---|---|---|---|
| AI7503000979_4079511_f1_3 | 116 | 3888 | 147 | 48 | | |

Description

NO-HIT

| ORF_Name | NTID | AAID | NT Length | AA Length | score | probability |
|---|---|---|---|---|---|---|
| AI7503000979_409556_f1_111 | 117 | 3889 | 135 | 44 | 112 | 2.5e-06 |

Description pir:[LN:D71245] [AC:D71245 ] [PN:hypothetical protein PH0221] [GN:PH0221 ] [OR:Pyrococcus horikoshii] [DB:pir2] >gp:[GI:d1030234:g3256608] [LN:AP000001] [AC:AP000001:AB009465:AB009464:AB009466:AB009467:AB009468:AB009469] [PN:235aa long hypothetical protein] [GN:PH0221] [OR:Pyrococcus horikoshii] [SR:Pyrococcus horikoshii (strain:OT3) DNA] [DB:genpept-bct1] [DE:Pyrococcus horikoshii OT3 genomic DNA, 1-287000 nt. position (1/7).] [LE:194212] [RE:194919] [DI:complement]

| ORF Name | NTID | AAID | NT Length | AA Length | score | probability |
|---|---|---|---|---|---|---|
| AI7503000979_4178218_c1_353 | 118 | 3890 | 675 | 224 | 81 | 0.0066 |

Description
gp:[GI:g1131502] [LN:PBU42580] [AC:U42580:U17055:U32570] [GN:A158L] [OR:Paramecium bursaria Chlorella virus 1] [DB:genpept-vrl] [DE:Paramecium bursaria Chlorella virus 1, complete genome.] [LE:80789] [RE:81103] [DI:complement]

| ORF Name | NTID | AAID | NT Length | AA Length | score | probability |
|---|---|---|---|---|---|---|
| AI7503000979_4346926_c2_450 | 119 | 3891 | 123 | 40 | | |

Description
NO-HIT

| ORF Name | NTID | AAID | NT Length | AA Length | score | probability |
|---|---|---|---|---|---|---|
| AI7503000979_4728558_c2_409 | 120 | 3892 | 1860 | 619 | 2088 | 4.1e-216 |

Description
pir:[LN:B69633] [AC:B69633 ] [PN:L-glutamine-D-fructose-6-phosphate amidotransferase glmS] [GN:glmS ] [CL:glutamine--fructose-6-phosphate aminotransferase (isomerizing)] [OR:Bacillus subtilis] [DB:pir2] >gp:[GI:d1034037:g3599596] [LN:AB006424] [AC:AB006424] [PN:L-GLUTAMINE-D-FRUCTOSE-6-PHOSPHATE AMIDO] [GN:gcaA] [OR:Bacillus subtilis] [SR:Bacillus subtilis (strain:168) DNA] [DB:genpept-bct1] [DE:Bacillus subtilis genomic DNA, 70 kb region between 17 and 23degree.] [LE:3246] [RE:5048] [DI:direct] >gp:[GI:g726480] [LN:BSU21932] [AC:U21932:D21198] [PN:L-glutamine-D-fructose-6-phosphate] [GN:gcaA] [OR:Bacillus subtilis] [DB:genpept-bct1] [DE:Bacillus subtilis L-glutamine-D-fructose-6-phosphateamidotransferase (gcaA) gene, complete cds.] [LE:312] [RE:2114] [DI:direct] >gp:[GI:e1182111:g2632445] [LN:BSUB0001] [AC:Z99104:AL009126] [PN:L-glutamine-D-fructose-6-phosphate] [GN:glmS] [OR:Bacillus subtilis] [DB:genpept-bct1] [EC:2.6.1.16] [DE:Bacillus subtilis complete genome (section 1 of 21): from 1 to213080.] [NT:alternate gene name: gcaA, ybxD] [SP:P39754] [LE:200263] [RE:202065] [DI:direct] >gp:[GI:e1182129:g2632463] [LN:BSUB0002] [AC:Z99105:AL009126] [PN:L-glutamine-D-fructose-6-phosphate] [GN:glmS] [OR:Bacillus subtilis] [DB:genpept-bct1] [EC:2.6.1.16] [DE:Bacillus subtilis complete genome (section 2 of 21): from 194651 to415810.] [NT:alternate gene name: gcaA, ybxD] [SP:P39754] [LE:5613] [RE:7415] [DI:direct]

| ORF Name | NTID | AAID | NT Length | AA Length | score | probability |
|---|---|---|---|---|---|---|
| AI7503000979_476567_c1_355 | 121 | 3893 | 567 | 188 | 292 | 8.5e-26 |

Description
sp:[LN:RPOE_BACSU] [AC:P12464] [GN:RPOE] [OR:BACILLUS SUBTILIS] [EC:2.7.7.6] [DE:DNA-DIRECTED RNA POLYMERASE DELTA SUBUNIT,] [SP:P12464] [DB:swissprot] >pir:[LN:JT0302] [AC:JT0302:H32354:S55422:H69698 ] [PN:DNA-directed RNA polymerase, delta chain rpoE] [GN:rpoE ] [CL:DNA-directed RNA polymerase delta chain] [OR:Bacillus subtilis] [EC:2.7.7.6] [DB:pir1] >gp:[GI:g143456] [LN:BACRPOE] [AC:M21677] [OR:Bacillus subtilis] [SR:B.subtilis (strain 168) DNA, clone mML11] [DB:genpept-bct1] [DE:B.subtilis RNA polymerase delta subunit (rpoE) gene, complete cds.] [NT:rpoE protein (ttg start codon)] [LE:101] [RE:622] [DI:direct] >gp:[GI:g853761] [LN:BSDNA320D] [AC:Z49782] [PN:RNA polymerase delta subunit] [GN:rpoE] [OR:Bacillus subtilis] [DB:genpept-bct1] [DE:B.subtilis chromosomal DNA (region 320-321 degrees).] [NT:ttg start codon] [SP:P12464] [LE:8717] [RE:9238] [DI:direct] >gp:[GI:e1186217:g2636253] [LN:BSUB0020] [AC:Z99123:AL009126] [PN:RNA polymerase (delta subunit)] [GN:rpoE] [OR:Bacillus subtilis] [DB:genpept-bct1] [EC:2.7.7.6] [DE:Bacillus subtilis complete genome (section 20 of 21): from 3798401to 4010550.] [SP:P12464] [LE:13195] [RE:13716] [DI:complement]

| ORF Name | NTID | AAID | NT Length | AA Length | score | probability |
|---|---|---|---|---|---|---|
| AI7503000979_4869213_c3_519 | 122 | 3894 | 1521 | 506 | 811 | 3.4e-128 |

Description
gp:[GI:e1340258:g3850848] [LN:SAU16431] [AC:Y16431] [PN:hypothetical protein] [GN:ORF3] [OR:Staphylococcus aureus] [DB:genpept-bct1] [DE:Staphylococcus aureus dpj, alr genes, partial kdpC gene and 4ORF's.] [LE:910] [RE:2493] [DI:direct]

| ORF Name | NTID | AAID | NT Length | AA Length | score | probability |
|---|---|---|---|---|---|---|
| AI7503000979_4881262_f3_293 | 123 | 3895 | 171 | 56 | | |

Description
NO-HIT

| ORF Name | NTID | AAID | NT Length | AA Length | score | probability |
|---|---|---|---|---|---|---|
| AI7503000979_4881302_f2_191 | 124 | 3896 | 150 | 49 | | |

Description
NO-HIT

| ORF Name | NTID | AAID | NT Length | AA Length | score | probability |
|---|---|---|---|---|---|---|
| AI7503000979_4901712_c1_370 | 125 | 3897 | 1428 | 475 | 1999 | 1.1e-206 |

Description
sp:[LN:ATPB_BACSU] [AC:P37809] [GN:ATPD] [OR:BACILLUS SUBTILIS] [EC:3.6.1.34]
[DE:(VEG31)] [SP:P37809] [DB:swissprot] >pir:[LN:I40368] [AC:I40368:H69591:S39256 ]
[PN:H+-transporting ATP synthase, beta chain (atpD) ] [GN:atpD ] [CL:H+-transporting
ATP synthase alpha chain: H+-transporting ATP synthase alpha chain homology]
[OR:Bacillus subtilis] [EC:3.6.1.34] [DB:pir2] >gp:[GI:g433991] [LN:BSATPASE]
[AC:Z28592] [PN:ATP synthase subunit beta] [GN:atpD] [OR:Bacillus subtilis]
[DB:genpept-bct1] [DE:B.subtilis (168) atpase genes for ATP synthase subunits i, a, c
,b, delta, alpha, gamma, beta, epsilon.] [SP:P37809] [LE:5520] [RE:6941] [DI:direct]
>gp:[GI:e1184587:g2636206] [LN:BSUB0019] [AC:Z99122:AL009126] [PN:ATP synthase (subunit
beta)] [GN:atpD] [OR:Bacillus subtilis] [DB:genpept-bct1] [EC:3.6.1.34] [DE:Bacillus
subtilis complete genome (section 19 of 21): from 3597091to 3809700.] [SP:P37809]
[LE:183456] [RE:184877] [DI:complement] >gp:[GI:e1184587:g2636206] [LN:BSUB0019]
[AC:Z99122:AL009126] [PN:ATP synthase (subunit beta)] [GN:atpD] [OR:Bacillus subtilis]
[DB:genpept] [EC:3.6.1.34] [DE:Bacillus subtilis complete genome (section 19 of 21):
from 3597091to 3809700.] [SP:P37809] [LE:183456] [RE:184877] [DI:complement]

| ORF Name | NTID | AAID | NT Length | AA Length | score | probability |
|---|---|---|---|---|---|---|
| AI7503000979_4962802_c2_421 | 126 | 3898 | 1305 | 434 | 1591 | 1.9e-163 |

Description
gp:[GI:g4336793] [LN:AF105341] [AC:AF105341] [PN:pyrimidine nucleoside phosphorylase]
[GN:pdp1] [OR:Listeria monocytogenes] [DB:genpept-bct2] [DE:Listeria monocytogenes
threonine dehydratase (thd1) gene, partialcds; alpha acetolactate decarboxylase gene,
complete cds; andpyrimidine nucleoside phosphorylase (pdp1) gene, partial cds.]
[LE:1749] [RE:>3010] [DI:complement]

| ORF Name | NTID | AAID | NT Length | AA Length | score | probability |
|---|---|---|---|---|---|---|
| AI7503000979_5078177_c1_365 | 127 | 3899 | 1062 | 353 | 1169 | 9.9e-119 |

Description
gp:[GI:g1773355] [LN:SAU81973] [AC:U81973] [PN:Cap5P] [GN:cap5P] [OR:Staphylococcus
aureus] [DB:genpept-bct2] [DE:Staphylococcus aureus capsule gene cluster Cap5A through
Cap5Pgenes, complete cds.] [NT:putative N-acetylglucosamine 2-epimerase] [LE:15769]
[RE:16944] [DI:direct]

| ORF_Name | NTID | AAID | NT Length | AA Length | score | probability |
|---|---|---|---|---|---|---|
| AI7503000979_5111502_c2_454 | 128 | 3900 | 924 | 307 | 417 | 4.8e-39 |

Description
sp:[LN:YQJG_BACSU] [AC:P54544] [GN:YQJG] [OR:BACILLUS SUBTILIS] [DE:PRECURSOR]
[SP:P54544] [DB:swissprot] >pir:[LN:G69963] [AC:G69963 ] [PN:lipoprotein SpoIIIJ-like homolog yqjG] [GN:yqjG ] [CL:stage III sporulation protein:stage III sporulation protein homology] [OR:Bacillus subtilis] [DB:pir2] >gp:[GI:d1013293:g1303958]
[LN:BACJH642] [AC:D84432:D82370] [PN:YqjG] [OR:Bacillus subtilis] [SR:Bacillus subtilis (strain:JH642(trpC2 PheA1)) DNA] [DB:genpept-bct1] [DE:Bacillus subtilis DNA, 283 Kb region containing skin element.] [LE:234919] [RE:235746] [DI:complement]
>gp:[GI:e1185657:g2634823] [LN:BSUB0013] [AC:Z99116:AL009126] [GN:yqjG] [FN:unknown]
[OR:Bacillus subtilis] [DB:genpept-bct1] [DE:Bacillus subtilis complete genome (section 13 of 21): from 2395261to 2613730.] [NT:similar to lipoprotein SpoIIIJ-like]
[SP:P54544] [LE:87873] [RE:88700] [DI:direct]

| ORF_Name | NTID | AAID | NT Length | AA Length | score | probability |
|---|---|---|---|---|---|---|
| AI7503000979_5131927_f1_93 | 129 | 3901 | 210 | 69 | | |

Description
NO-HIT

| ORF_Name | NTID | AAID | NT Length | AA Length | score | probability |
|---|---|---|---|---|---|---|
| AI7503000979_5318785_c1_395 | 130 | 3902 | 156 | 51 | | |

Description
NO-HIT

| ORF_Name | NTID | AAID | NT Length | AA Length | score | probability |
|---|---|---|---|---|---|---|
| AI7503000979_5319213_c2_442 | 131 | 3903 | 417 | 138 | 312 | 6.4e-28 |

Description
sp:[LN:ATPE_BACSU] [AC:P37812] [GN:ATPC] [OR:BACILLUS SUBTILIS] [EC:3.6.1.34] [DE:ATP SYNTHASE EPSILON CHAIN,] [SP:P37812] [DB:swissprot] >pir:[LN:I40369]
[AC:I40369:G69591:S39257 ] [PN:H+-transporting ATP synthase, epsilon chain (atpC)]
[GN:atpC ] [CL:H+-transporting ATP synthase epsilon chain] [OR:Bacillus subtilis]
[EC:3.6.1.34] [DB:pir2] >gp:[GI:g433992] [LN:BSATPASE] [AC:Z28592] [PN:ATP synthase subunit epsilon] [GN:atpC] [OR:Bacillus subtilis] [DB:genpept-bct1] [DE:B.subtilis (168) atpase genes for ATP synthase subunits i, a, c ,b, delta, alpha, gamma, beta, epsilon.] [SP:P37812] [LE:6965] [RE:7363] [DI:direct] >gp:[GI:e1184586:g2636205]
[LN:BSUB0019] [AC:Z99122:AL009126] [PN:ATP synthase (subunit epsilon)] [GN:atpC]
[OR:Bacillus subtilis] [DB:genpept-bct1] [EC:3.6.1.34] [DE:Bacillus subtilis complete genome (section 19 of 21): from 3597091to 3809700.] [SP:P37812] [LE:183034] [RE:183432]
[DI:complement] >gp:[GI:e1184586:g2636205] [LN:BSUB0019] [AC:Z99122:AL009126] [PN:ATP synthase (subunit epsilon)] [GN:atpC] [OR:Bacillus subtilis] [DB:genpept] [EC:3.6.1.34]
[DE:Bacillus subtilis complete genome (section 19 of 21): from 3597091to 3809700.]
[SP:P37812] [LE:183034] [RE:183432] [DI:complement]

| ORF_Name | NTID | AAID | NT Length | AA Length | score | probability |
|---|---|---|---|---|---|---|
| AI7503000979_582760_c2_463 | 132 | 3904 | 207 | 68 | 150 | 9.5e-11 |

Description
gp:[GI:e1340262:g3850852] [LN:SAU16431] [AC:Y16431] [PN:hypothetical protein] [GN:ORF7]
[OR:Staphylococcus aureus] [DB:genpept-bct1] [DE:Staphylococcus aureus dpj, alr genes, partial kdpC gene and 4ORF's.] [LE:4633] [RE:>4735] [DI:direct]

| ORF Name | NTID | AAID | NT Length | AA Length | score | probability |
|---|---|---|---|---|---|---|
| AI7503000979_5895301_c1_378 | 133 | 3905 | 948 | 315 | 603 | 9.4e-59 |

Description sp:[LN:THID_HAEIN] [AC:P44697] [GN:THID:HI0416] [OR:HAEMOPHILUS INFLUENZAE]
[EC:2.7.4.7] [DE:(HMP-P KINASE)] [SP:P44697] [DB:swissprot] >pir:[LN:I64151] [AC:I64151
] [PN:hypothetical protein HI0416] [CL:phosphomethylpyrimidine phosphate kinase]
[OR:Haemophilus influenzae] [DB:pir2] >gp:[GI:g1573390] [LN:U32725] [AC:U32725:L42023]
[PN:phosphomethylpyrimidine kinase (thiD)] [GN:HI0416] [OR:Haemophilus influenzae Rd]
[DB:genpept-bct2] [DE:Haemophilus influenzae Rd section 40 of 163 of the complete
genome.] [NT:similar to GB:AE000511 PID:2313975 percent] [LE:1472] [RE:2281]
[DI:direct]

| ORF Name | NTID | AAID | NT Length | AA Length | score | probability |
|---|---|---|---|---|---|---|
| AI7503000979_6442192_f2_181 | 134 | 3906 | 132 | 43 | | |

Description

NO-HIT

| ORF Name | NTID | AAID | NT Length | AA Length | score | probability |
|---|---|---|---|---|---|---|
| AI7503000979_6454635_c2_431 | 135 | 3907 | 912 | 303 | 1173 | 3.7e-119 |

Description sp:[LN:ALF1_BACSU] [AC:P13243] [GN:FBAA:FBA:FBA1:TSR] [OR:BACILLUS SUBTILIS]
[EC:4.1.2.13] [DE:PROBABLE FRUCTOSE-BISPHOSPHATE ALDOLASE 1,] [SP:P13243]
[DB:swissprot] >pir:[LN:D32354] [AC:S55426:D32354:E32354:D41835:B69621 ]
[PN:fructose-bisphosphate aldolase, fbaA:30K phosphoprotein
orfY-tsr:fructose-1,6-bisphosphate aldolase] [GN:fbaA ] [CL:fructose-bisphosphate
aldolase II] [OR:Bacillus subtilis] [EC:4.1.2.13] [DB:pir1] >gp:[GI:g460911]
[LN:BACSPO0FA] [AC:M22039] [PN:fructose-bisphosphate aldolase] [GN:orfY-tsr]
[OR:Bacillus subtilis] [SR:Bacillus subtilis (strains JH642 and UOT0550) DNA]
[DB:genpept-bct1] [EC:4.1.2.13] [DE:Bacillus subtillis spo0F, CTP synthetase (ctrA),
andfructose-bisphosphate aldolase (orfY-tsr) genes, complete cds.] [LE:3270] [RE:4127]
[DI:direct] >gp:[GI:g853765] [LN:BSDNA320D] [AC:Z49782] [PN:fructose biphosphate
aldolase] [GN:tsr] [OR:Bacillus subtilis] [DB:genpept-bct1] [DE:B.subtilis chromosomal
DNA (region 320-321 degrees).] [SP:P13243] [LE:12411] [RE:13268] [DI:direct]
>gp:[GI:e1184618:g2636237] [LN:BSUB0019] [AC:Z99122:AL009126]
[PN:fructose-1,6-bisphosphate aldolase] [GN:fbaA] [FN:glycolysis] [OR:Bacillus
subtilis] [DB:genpept-bct1] [EC:4.1.2.13] [DE:Bacillus subtilis complete genome
(section 19 of 21): from 3597091to 3809700.] [NT:alternate gene name: tsr, fba]
[SP:P13243] [LE:210475] [RE:211332] [DI:complement] >gp:[GI:e1186213:g2636249]
[LN:BSUB0020] [AC:Z99123:AL009126] [PN:fructose-1,6-bisphosphate aldolase] [GN:fbaA]
[FN:glycolysis] [OR:Bacillus subtilis] [DB:genpept-bct1] [EC:4.1.2.13] [DE:Bacillus
subtilis complete genome (section 20 of 21): from 3798401to 4010550.] [NT:alternate
gene name: tsr, fba] [SP:P13243] [LE:9165] [RE:10022] [DI:complement]
>gp:[GI:e1184618:g2636237] [LN:BSUB0019] [AC:Z99122:AL009126]
[PN:fructose-1,6-bisphosphate aldolase] [GN:fbaA] [FN:glycolysis] [OR:Bacillus
subtilis] [DB:genpept] [EC:4.1.2.13] [DE:Bacillus subtilis complete genome (section 19
of 21): from 3597091to 3809700.] [NT:alternate gene name: tsr, fba] [SP:P13243]
[LE:210475] [RE:211332] [DI:complement]

| ORF Name | NTID | AAID | NT Length | AA Length | score | probability |
|---|---|---|---|---|---|---|
| AI7503000979_6645393_c1_342 | 136 | 3908 | 165 | 54 | | |

Description

NO-HIT

| ORF Name | NTID | AAID | NT Length | AA Length | score | probability |
|---|---|---|---|---|---|---|
| AI7503000979_6681316_f2_197 | 137 | 3909 | 135 | 44 | | |

Description
NO-HIT

| ORF Name | NTID | AAID | NT Length | AA Length | score | probability |
|---|---|---|---|---|---|---|
| AI7503000979_6721877_f2_194 | 138 | 3910 | 153 | 50 | | |

Description
NO-HIT

| ORF Name | NTID | AAID | NT Length | AA Length | score | probability |
|---|---|---|---|---|---|---|
| AI7503000979_6906576_c1_371 | 139 | 3911 | 1296 | 431 | 1429 | 2.8e-146 |

Description
pir:[LN:A69662] [AC:A69662 ] [PN:UDP-N-acetylglucosamine 1-carboxyvinyltransferase murA] [GN:murA ] [CL:UDP-N-acetylglucosamine 1-carboxyvinyltransferase MurZ] [OR:Bacillus subtilis] [DB:pir2] >gp:[GI:e276830:g1648861] [LN:BSATPC] [AC:Z81356] [PN:UDP-N-acetylglucosamine] [GN:murA] [OR:Bacillus subtilis] [DB:genpept-bct1] [DE:B.subtilis atpC gene.] [LE:1943] [RE:3253] [DI:direct] >gp:[GI:e1184582:g2636201] [LN:BSUB0019] [AC:Z99122:AL009126] [PN:UDP-N-acetylglucosamine] [GN:murA] [FN:peptidoglycan biosynthesis] [OR:Bacillus subtilis] [DB:genpept-bct1] [EC:2.5.1.7] [DE:Bacillus subtilis complete genome (section 19 of 21): from 3597091to 3809700.] [LE:179914] [RE:181224] [DI:complement] >gp:[GI:e1184582:g2636201] [LN:BSUB0019] [AC:Z99122:AL009126] [PN:UDP-N-acetylglucosamine] [GN:murA] [FN:peptidoglycan biosynthesis] [OR:Bacillus subtilis] [DB:genpept] [EC:2.5.1.7] [DE:Bacillus subtilis complete genome (section 19 of 21): from 3597091to 3809700.] [LE:179914] [RE:181224] [DI:complement]

| ORF Name | NTID | AAID | NT Length | AA Length | score | probability |
|---|---|---|---|---|---|---|
| AI7503000979_7240675_c2_460 | 140 | 3912 | 1374 | 457 | 976 | 2.8e-98 |

Description
sp:[LN:MURF_BACSU] [AC:P96613] [GN:MURF] [OR:BACILLUS SUBTILIS] [EC:6.3.2.15] [DE:(D-ALANYL-D-ALANINE-ADDING ENZYME)] [SP:P96613] [DB:swissprot] >pir:[LN:F69662] [AC:F69662 ] [PN:UDP-N-acetylmuramoylalanyl-D-glutamyl-2, 6-diaminopimelate-D-al murF] [GN:murF ] [OR:Bacillus subtilis] [DB:pir2] >gp:[GI:d1020047:g1881267] [LN:AB001488] [AC:AB001488] [GN:ydbQ] [OR:Bacillus subtilis] [SR:Bacillus subtilis (strain:168) DNA] [DB:genpept-bct1] [DE:Bacillus subtilis genome sequence, 148 kb sequence of the regionbetween 35 and 47 degree.] [NT:PROBABLE UDP-N-ACETYLMURAMOYLALANYL-D-GLUTAMYL-2,] [LE:42447] [RE:43820] [DI:direct] >gp:[GI:e1182423:g2632757] [LN:BSUB0003] [AC:Z99106:AL009126] [PN:UDP-N-acetylmuramoylalanyl-D-glutamyl-2,6-] [GN:murF] [FN:peptidoglycan biosynthesis] [OR:Bacillus subtilis] [DB:genpept-bct1] [EC:6.3.2.15] [DE:Bacillus subtilis complete genome (section 3 of 21): from 402751 to611850.] [NT:alternate gene name: ydbQ] [SP:P96613] [LE:106191] [RE:107564] [DI:direct]

| ORF Name | NTID | AAID | NT Length | AA Length | score | probability |
|---|---|---|---|---|---|---|
| AI7503000979_7292200_c1_351 | 141 | 3913 | 126 | 41 | | |

Description
NO-HIT

| ORF Name | NTID | AAID | NT Length | AA Length | score | probability |
|---|---|---|---|---|---|---|
| AI7503000979_9784625_c3_507 | 142 | 3914 | 141 | 46 | | |

Description
NO-HIT

| ORF Name | NTID | AAID | NT Length | AA Length | score | probability |
|---|---|---|---|---|---|---|
| AI7503000979_9800787_f2_216 | 143 | 3915 | 129 | 42 | | |

Description
NO-HIT

| ORF Name | NTID | AAID | NT Length | AA Length | score | probability |
|---|---|---|---|---|---|---|
| AI7503000980_10006507_f3_164 | 144 | 3916 | 153 | 50 | | |

Description
NO-HIT

| ORF Name | NTID | AAID | NT Length | AA Length | score | probability |
|---|---|---|---|---|---|---|
| AI7503000980_10736002_c1_211 | 145 | 3917 | 1521 | 506 | 2313 | 5.9e-240 |

Description
sp:[LN:SYK_STAAU] [AC:Q53638] [GN:LYSS] [OR:STAPHYLOCOCCUS AUREUS] [EC:6.1.1.6]
[DE:LYSYL-TRNA SYNTHETASE, (LYSINE--TRNA LIGASE) (LYSRS)] [SP:Q53638] [DB:swissprot]
>gp:[GI:g567884] [LN:STA5SRR] [AC:L36472] [PN:lysyl-tRNA synthetase] [OR:Staphylococcus
aureus] [SR:Staphylococcus aureus (clone library: ATCC 12600) DNA] [DB:genpept-bct1]
[DE:Staphylococcus aureus lysyl-tRNA sythetase gene, complete cds,transfer RNA (tRNA)
genes, 5S ribosomal RNA (5S rRNA) gene, 16Sribosomal RNA (16S rRNA) gene, 23S ribosomal
RNA (23S rRNA) gene.] [LE:176] [RE:1663] [DI:direct]

| ORF Name | NTID | AAID | NT Length | AA Length | score | probability |
|---|---|---|---|---|---|---|
| AI7503000980_11210316_c1_203 | 146 | 3918 | 195 | 64 | 166 | 1.9e-12 |

Description
sp:[LN:YABO_BACSU] [AC:P37557] [GN:YABO] [OR:BACILLUS SUBTILIS] [DE:HYPOTHETICAL 9.7 KD
PROTEIN IN MFD-DIVIC INTERGENIC REGION] [SP:P37557] [DB:swissprot] >pir:[LN:S66089]
[AC:S66089:F69739 ] [PN:conserved hypothetical protein yabO] [GN:yabO ] [OR:Bacillus
subtilis] [DB:pir2] >gp:[GI:d1005836:g467448] [LN:BAC180K] [AC:D26185] [PN:unknown]
[OR:Bacillus subtilis] [SR:Bacillus subtilis (sub_species:Marburg, strain:168) DNA]
[DB:genpept-bct1] [DE:B. subtilis DNA, 180 kilobase region of replication origin.]
[LE:131477] [RE:131737] [DI:direct] >gp:[GI:e1181992:g2632326] [LN:BSUB0001]
[AC:Z99104:AL009126] [GN:yabO] [FN:unknown] [OR:Bacillus subtilis] [DB:genpept-bct1]
[DE:Bacillus subtilis complete genome (section 1 of 21): from 1 to213080.] [NT:similar
to hypothetical proteins] [SP:P37557] [LE:67875] [RE:68135] [DI:direct]

| ORF Name | NTID | AAID | NT Length | AA Length | score | probability |
|---|---|---|---|---|---|---|
| AI7503000980_1292767_c3_243 | 147 | 3919 | 138 | 45 | | |

Description
NO-HIT

| ORF_Name | NTID | AAID | NT Length | AA Length | score | probability |
|---|---|---|---|---|---|---|
| AI7503000980_12929625_c1_186 | 148 | 3920 | 810 | 269 | 819 | 1.2e-81 |

Description sp:[LN:YAAT_BACSU] [AC:P37541] [GN:YAAT] [OR:BACILLUS SUBTILIS] [DE:HYPOTHETICAL 31.2 KD PROTEIN IN XPAC-ABRB INTERGENIC REGION] [SP:P37541] [DB:swissprot] >pir:[LN:S66062] [AC:S66062:A69738 ] [PN:signal peptidase II homolog yaaT] [GN:yaaT ] [OR:Bacillus subtilis] [DB:pir2] >gp:[GI:d1005810:g467422] [LN:BAC180K] [AC:D26185] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:105257] [RE:106084] [DI:direct] >gp:[GI:e1181965:g2632299] [LN:BSUB0001] [AC:Z99104:AL009126] [GN:yaaT] [FN:unknown] [OR:Bacillus subtilis] [DB:genpept-bct1] [DE:Bacillus subtilis complete genome (section 1 of 21): from 1 to213080.] [NT:similar to signal peptidase II] [SP:P37541] [LE:41655] [RE:42482] [DI:direct]

| ORF_Name | NTID | AAID | NT Length | AA Length | score | probability |
|---|---|---|---|---|---|---|
| AI7503000980_13759688_c1_184 | 149 | 3921 | 615 | 204 | 527 | 1.1e-50 |

Description sp:[LN:KTHY_BACSU] [AC:P37537] [GN:TMK] [OR:BACILLUS SUBTILIS] [EC:2.7.4.9] [DE:THYMIDYLATE KINASE, (DTMP KINASE)] [SP:P37537] [DB:swissprot] >pir:[LN:S66058] [AC:S66058:D69724 ] [PN:thymidylate kinase tmk] [GN:tmk ] [CL:dTMP kinase] [OR:Bacillus subtilis] [DB:pir2] >gp:[GI:d1005806:g467418] [LN:BAC180K] [AC:D26185] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:102759] [RE:103397] [DI:direct] >gp:[GI:e1181961:g2632295] [LN:BSUB0001] [AC:Z99104:AL009126] [PN:thymidylate kinase] [GN:tmk] [OR:Bacillus subtilis] [DB:genpept-bct1] [EC:2.7.4.9] [DE:Bacillus subtilis complete genome (section 1 of 21): from 1 to213080.] [NT:alternate gene name: yaaP] [SP:P37537] [LE:39157] [RE:39795] [DI:direct]

| ORF_Name | NTID | AAID | NT Length | AA Length | score | probability |
|---|---|---|---|---|---|---|
| AI7503000980_14460015_f1_55 | 150 | 3922 | 141 | 46 | | |

Description
NO-HIT

| ORF_Name | NTID | AAID | NT Length | AA Length | score | probability |
|---|---|---|---|---|---|---|
| AI7503000980_16484577_f2_119 | 151 | 3923 | 153 | 50 | | |

Description
NO-HIT

| ORF_Name | NTID | AAID | NT Length | AA Length | score | probability |
|---|---|---|---|---|---|---|
| AI7503000980_16522641_f2_76 | 152 | 3924 | 597 | 198 | 207 | 1.9e-16 |

Description gp:[GI:d1045277:g5106180] [LN:AP000064] [AC:AP000064] [PN:353aa long hypothetical protein] [GN:APE2475] [OR:Aeropyrum pernix] [SR:Aeropyrum pernix (strain:K1) DNA] [DB:genpept] [DE:Aeropyrum pernix genomic DNA, section 7/7.] [NT:similar to OWL:AP00000385 percent identity:66.667] [LE:151512] [RE:152573] [DI:direct]

| ORF Name | NTID | AAID | NT Length | AA Length | score | probability |
|---|---|---|---|---|---|---|
| AI7503000980_16594202_c2_237 | 153 | 3925 | 480 | 159 | 383 | 1.9e-35 |

Description
sp:[LN:HPPK_BACSU] [AC:P29252] [GN:FOLK] [OR:BACILLUS SUBTILIS] [EC:2.7.6.3] [DE:(HPPK) (6-HYDROXYMETHYL-7,8-DIHYDROPTERIN PYROPHOSPHOKINASE) (PPPK)] [SP:P29252] [DB:swissprot] >pir:[LN:S66109] [AC:S66109:F37854:F69626 ] [PN:2-amino-4-hydroxy-6-hydroxymethyldihydropteridine pyrophosphokinase,:6-hydroxymethyl-7,8-dihydropterin pyrophosphokinase:7, 8-dihydro-6-hydroxymethylpterin pyrophosphokinase] [GN:folK ] [CL:2-amino-4-hydroxy-6-hydroxymethyldihydropteridine pyrophosphokinase:2-amino-4-hydroxy-6-hydroxymethyldihydropteridine pyrophosphokinase homology] [OR:Bacillus subtilis] [EC:2.7.6.3] [DB:pir2] >gp:[GI:d1005856:g467468] [LN:BAC180K] [AC:D26185] [PN:7,8-dihydro-6-hydroxymethylpterin-pyrophosphokin] [GN:folk] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:150545] [RE:151048] [DI:direct] >gp:[GI:e1182012:g2632346] [LN:BSUB0001] [AC:Z99104:AL009126] [PN:7,8-dihydro-6-hydroxymethylpterin] [GN:folK] [FN:dihydrofolate biosynthesis] [OR:Bacillus subtilis] [DB:genpept-bct1] [EC:2.7.6.3] [DE:Bacillus subtilis complete genome (section 1 of 21): from 1 to213080.] [LE:86943] [RE:87446] [DI:direct]

| ORF Name | NTID | AAID | NT Length | AA Length | score | probability |
|---|---|---|---|---|---|---|
| AI7503000980_190875_f1_6 | 154 | 3926 | 210 | 69 | 70 | 0.028 |

Description
pir:[LN:S69873] [AC:S69873 ] [PN:hypothetical protein YML009w-a] [OR:Saccharomyces cerevisiae] [DB:pir2] [MP:13L ]

| ORF Name | NTID | AAID | NT Length | AA Length | score | probability |
|---|---|---|---|---|---|---|
| AI7503000980_194142_c1_194 | 155 | 3927 | 1386 | 461 | 1339 | 9.6e-137 |

Description
pir:[LN:S66080] [AC:S66080:I40018:C69629:S05371:S18903 ] [PN:UDP-N-acetylglucosamine pyrophosphorylase gcaD:cell division protein tms26:tms protein] [GN:gcaD:tms26 ] [CL:N-acetylglucosamine-1-phosphate uridyltransferase] [OR:Bacillus subtilis] [DB:pir2] >gp:[GI:d1005827:g467439] [LN:BAC180K] [AC:D26185] [PN:temperature sensitive cell division] [GN:tms26] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:119952] [RE:121322] [DI:direct] >gp:[GI:e1181983:g2632317] [LN:BSUB0001] [AC:Z99104:AL009126] [PN:UDP-N-acetylglucosamine pyrophosphorylase] [GN:gcaD] [FN:peptidoglycan and lipopolysaccharide] [OR:Bacillus subtilis] [DB:genpept-bct1] [EC:2.7.7.23] [DE:Bacillus subtilis complete genome (section 1 of 21): from 1 to213080.] [NT:alternate gene name: tms, tms26] [SP:P14192] [LE:56350] [RE:57720] [DI:direct]

| ORF Name | NTID | AAID | NT Length | AA Length | score | probability |
|---|---|---|---|---|---|---|
| AI7503000980_20335927_f2_69 | 156 | 3928 | 153 | 50 | | |

Description
NO-HIT

| ORF_Name | NTID | AAID | NT Length | AA Length | score | probability |
|---|---|---|---|---|---|---|
| AI7503000980_211687_c3_261 | 157 | 3929 | 897 | 298 | 985 | 3.1e-99 |

Description
sp:[LN:YACC_BACSU] [AC:P37565] [GN:YACC] [OR:BACILLUS SUBTILIS] [DE:HYPOTHETICAL 31.8 KD PROTEIN IN FTSH-CYSK INTERGENIC REGION] [SP:P37565] [DB:swissprot] >pir:[LN:S66101] [AC:S66101:F69740 ] [PN:conserved hypothetical protein yacC] [GN:yacC ] [CL:conserved hypothetical protein sll1988] [OR:Bacillus subtilis] [DB:pir2] >gp:[GI:d1005848:g467460] [LN:BAC180K] [AC:D26185] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:143479] [RE:144354] [DI:direct] >gp:[GI:e1182004:g2632338] [LN:BSUB0001] [AC:Z99104:AL009126] [GN:yacC] [FN:unknown] [OR:Bacillus subtilis] [DB:genpept-bct1] [DE:Bacillus subtilis complete genome (section 1 of 21): from 1 to213080.] [NT:similar to hypothetical proteins] [SP:P37565] [LE:79877] [RE:80752] [DI:direct]

| ORF_Name | NTID | AAID | NT Length | AA Length | score | probability |
|---|---|---|---|---|---|---|
| AI7503000980_21579131_f3_157 | 158 | 3930 | 123 | 40 | | |

Description
NO-HIT

| ORF_Name | NTID | AAID | NT Length | AA Length | score | probability |
|---|---|---|---|---|---|---|
| AI7503000980_22694002_c3_258 | 159 | 3931 | 546 | 181 | 544 | 1.7e-52 |

Description
sp:[LN:HPRT_BACSU] [AC:P37472] [GN:HPRT:HPT] [OR:BACILLUS SUBTILIS] [EC:2.4.2.8] [DE:(HGPRTASE)] [SP:P37472] [DB:swissprot] >pir:[LN:S66098] [AC:S66098:E69642 ] [PN:hypoxanthine phosphoribosyltransferase, hprT:hypoxanthine-guanine phosphoribosyltransferase hprT] [GN:hprT ] [CL:hypoxanthine phosphoribosyltransferase] [OR:Bacillus subtilis] [EC:2.4.2.8] [DB:pir2] >gp:[GI:d1005845:g467457] [LN:BAC180K] [AC:D26185] [PN:hypoxanthine-guanine phosphoribosyltransferase] [GN:hprt] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:139944] [RE:140486] [DI:direct] >gp:[GI:e1182001:g2632335] [LN:BSUB0001] [AC:Z99104:AL009126] [PN:hypoxanthine-guanine phosphoribosyltransferase] [GN:hprT] [FN:purine salvage] [OR:Bacillus subtilis] [DB:genpept-bct1] [EC:2.4.2.8] [DE:Bacillus subtilis complete genome (section 1 of 21): from 1 to213080.] [SP:P37472] [LE:76342] [RE:76884] [DI:direct]

| ORF_Name | NTID | AAID | NT Length | AA Length | score | probability |
|---|---|---|---|---|---|---|
| AI7503000980_23445130_c1_207 | 160 | 3932 | 417 | 138 | 134 | 4.1e-08 |

Description
gp:[GI:e1182000:g2632334] [LN:BSUB0001] [AC:Z99104:AL009126] [GN:yacA] [FN:unknown] [OR:Bacillus subtilis] [DB:genpept-bct1] [DE:Bacillus subtilis complete genome (section 1 of 21): from 1 to213080.] [NT:similar to cell-cycle protein] [LE:74927] [RE:76345] [DI:direct]

| ORF Name | NTID | AAID | NT Length | AA Length | score | probability |
|---|---|---|---|---|---|---|
| AI7503000980_23601702_c1_190 | 161 | 3933 | 891 | 296 | 919 | 3.1e-92 |

Description
sp:[LN:KSGA_BACSU] [AC:P37468] [GN:KSGA] [OR:BACILLUS SUBTILIS] [EC:2.1.1.-]
[DE:DIMETHYLTRANSFERASE)] [SP:P37468] [DB:swissprot] >pir:[LN:S66071] [AC:S66071:A69649
] [PN:dimethyladenosine transferase ksgA:high level kasgamycin resistance protein ksgA]
[GN:ksgA ] [CL:rRNA (adenine-N6-)-methyltransferase] [OR:Bacillus subtilis] [DB:pir2]
>gp:[GI:d1005819:g467431] [LN:BAC180K] [AC:D26185] [PN:high level kasgamycin
resistance] [GN:ksgA] [OR:Bacillus subtilis] [SR:Bacillus subtilis
(sub_species:Marburg, strain:168) DNA] [DB:genpept-bct1] [DE:B. subtilis DNA, 180
kilobase region of replication origin.] [LE:114240] [RE:115118] [DI:direct]
>gp:[GI:e1181975:g2632309] [LN:BSUB0001] [AC:Z99104:AL009126] [PN:dimethyladenosine
transferase] [GN:ksgA] [FN:high level kasugamycin resistance] [OR:Bacillus subtilis]
[DB:genpept-bct1] [EC:2.1.1.-] [DE:Bacillus subtilis complete genome (section 1 of 21):
from 1 to213080.] [SP:P37468] [LE:50638] [RE:51516] [DI:direct]

| ORF Name | NTID | AAID | NT Length | AA Length | score | probability |
|---|---|---|---|---|---|---|
| AI7503000980_23605438_c2_238 | 162 | 3934 | 144 | 47 | | |

Description
NO-HIT

| ORF Name | NTID | AAID | NT Length | AA Length | score | probability |
|---|---|---|---|---|---|---|
| AI7503000980_23631327_c3_250 | 163 | 3935 | 966 | 321 | 1225 | 1.1e-124 |

Description
gp:[GI:g2289093] [LN:CAU76387] [AC:U76387] [PN:PRPP synthetase] [GN:prs]
[OR:Corynebacterium ammoniagenes] [DB:genpept-bct1] [EC:2.7.6.1] [DE:Corynebacterium
ammoniagenes N-acetyl glucoseamine 1-phosphateuridyltransferase (glmU) gene, partial
cds, and PRPP-synthetase(prs) gene, complete cds.] [LE:321] [RE:1274] [DI:direct]

| ORF Name | NTID | AAID | NT Length | AA Length | score | probability |
|---|---|---|---|---|---|---|
| AI7503000980_23642135_c1_185 | 164 | 3936 | 357 | 118 | 389 | 4.5e-36 |

Description
sp:[LN:YAAQ_BACSU] [AC:P37538] [GN:YAAQ] [OR:BACILLUS SUBTILIS] [DE:HYPOTHETICAL 12.0
KD PROTEIN IN XPAC-ABRB INTERGENIC REGION] [SP:P37538] [DB:swissprot] >pir:[LN:S66059]
[AC:S66059:G69737 ] [PN:conserved hypothetical protein yaaQ] [GN:yaaQ ] [OR:Bacillus
subtilis] [DB:pir2] >gp:[GI:d1005807:g467419] [LN:BAC180K] [AC:D26185] [PN:unknown]
[OR:Bacillus subtilis] [SR:Bacillus subtilis (sub_species:Marburg, strain:168) DNA]
[DB:genpept-bct1] [DE:B. subtilis DNA, 180 kilobase region of replication origin.]
[LE:103471] [RE:103800] [DI:direct] >gp:[GI:e1181962:g2632296] [LN:BSUB0001]
[AC:Z99104:AL009126] [GN:yaaQ] [FN:unknown] [OR:Bacillus subtilis] [DB:genpept-bct1]
[DE:Bacillus subtilis complete genome (section 1 of 21): from 1 to213080.] [NT:similar
to hypothetical proteins] [SP:P37538] [LE:39869] [RE:40198] [DI:direct]

| ORF Name | NTID | AAID | NT Length | AA Length | score | probability |
|---|---|---|---|---|---|---|
| AI7503000980_23860952_c1_206 | 165 | 3937 | 882 | 293 | 304 | 4.5e-27 |

Description
gp:[GI:g4981097] [LN:AE001733] [AC:AE001733:AE000512] [PN:conserved hypothetical
protein] [GN:TM0579] [OR:Thermotoga maritima] [DB:genpept-bct2] [DE:Thermotoga maritima
section 45 of 136 of the complete genome.] [NT:similar to GB:AE000657 percent identity:
59.32;] [LE:230] [RE:1474] [DI:direct]

| ORF Name | NTID | AAID | NT Length | AA Length | score | probability |
|---|---|---|---|---|---|---|
| AI7503000980_24350953_f3_120 | 166 | 3938 | 132 | 43 | 72 | 0.017 |

Description pir:[LN:G71244] [AC:G71244 ] [PN:hypothetical protein PH0217] [GN:PH0217 ]
[OR:Pyrococcus horikoshii] [DB:pir2] >gp:[GI:d1030229:g3256603] [LN:AP000001]
[AC:AP000001:AB009465:AB009464:AB009466:AB009467:AB009468:AB009469] [PN:106aa long
hypothetical protein] [GN:PH0217] [OR:Pyrococcus horikoshii] [SR:Pyrococcus horikoshii
(strain:OT3) DNA] [DB:genpept-bct1] [DE:Pyrococcus horikoshii OT3 genomic DNA, 1-287000
nt. position (1/7).] [LE:191072] [RE:191392] [DI:complement]

| ORF Name | NTID | AAID | NT Length | AA Length | score | probability |
|---|---|---|---|---|---|---|
| AI7503000980_24647936_c3_256 | 167 | 3939 | 408 | 135 | 172 | 4.4e-13 |

Description gp:[GI:g4090866] [LN:AF023181] [AC:AF023181] [PN:DivIC homolog] [GN:divL] [OR:Listeria
monocytogenes] [DB:genpept-bct2] [DE:Listeria monocytogenes transcription-repair
coupling factor (mfdL),low temperature requirement B protein (ltrB), and DivIC
homolog(divL) genes, complete cds.] [LE:6077] [RE:6463] [DI:direct]

| ORF Name | NTID | AAID | NT Length | AA Length | score | probability |
|---|---|---|---|---|---|---|
| AI7503000980_24649092_c2_236 | 168 | 3940 | 378 | 125 | 351 | 4.7e-32 |

Description sp:[LN:FOLB_STAHA] [AC:Q59920] [GN:FOLB:FOLQ] [OR:STAPHYLOCOCCUS HAEMOLYTICUS]
[EC:4.1.2.25] [DE:DIHYDRONEOPTERIN ALDOLASE, (DHNA) (FRAGMENT)] [SP:Q59920]
[DB:swissprot] >gp:[GI:g1118003] [LN:SHU40768] [AC:U40768] [PN:dihydroneopterin
aldolase] [GN:folQ] [OR:Staphylococcus haemolyticus] [DB:genpept-bct2] [EC:4.1.2.25]
[DE:Staphylococcus haemolyticus cysteine synthase A (cysK) anddihydroneopterin aldolase
(folQ) genes, partial cds, anddihydropteroate synthase (folP) gene, complete cds.]
[NT:DHNA] [LE:1467] [RE:>1724] [DI:direct]

| ORF Name | NTID | AAID | NT Length | AA Length | score | probability |
|---|---|---|---|---|---|---|
| AI7503000980_24663892_c3_251 | 169 | 3941 | 1881 | 626 | 1224 | 1.5e-124 |

Description sp:[LN:MFD_BACSU] [AC:P37474] [GN:MFD] [OR:BACILLUS SUBTILIS] [DE:TRANSCRIPTION-REPAIR
COUPLING FACTOR (TRCF)] [SP:P37474] [DB:swissprot] >pir:[LN:S66085] [AC:S66085:F69657 ]
[PN:transcription-repair coupling factor mfd] [GN:mfd ] [CL:transcription-repair
coupling protein:DEAD/H box helicase homology] [OR:Bacillus subtilis] [DB:pir2]
>gp:[GI:d1005832:g467444] [LN:BAC180K] [AC:D26185] [PN:transcription-repair coupling
factor] [GN:mfd] [OR:Bacillus subtilis] [SR:Bacillus subtilis (sub_species:Marburg,
strain:168) DNA] [DB:genpept-bct1] [DE:B. subtilis DNA, 180 kilobase region of
replication origin.] [LE:124030] [RE:127563] [DI:direct] >gp:[GI:e1181988:g2632322]
[LN:BSUB0001] [AC:Z99104:AL009126] [PN:transcription-repair coupling factor] [GN:mfd]
[FN:probably involved in homologous DNA] [OR:Bacillus subtilis] [DB:genpept-bct1]
[DE:Bacillus subtilis complete genome (section 1 of 21): from 1 to213080.] [SP:P37474]
[LE:60428] [RE:63961] [DI:direct]

| ORF Name | NTID | AAID | NT Length | AA Length | score | probability |
|---|---|---|---|---|---|---|
| AI7503000980_24734661_f1_13 | 170 | 3942 | 138 | 45 | | |

Description

NO-HIT

| ORF Name | NTID | AAID | NT Length | AA Length | score | probability |
|---|---|---|---|---|---|---|
| AI7503000980_24790916_c1_208 | 171 | 3943 | 2106 | 701 | 2133 | 6.9e-221 |

Description
sp:[LN:FTSH_BACSU] [AC:P37476] [GN:FTSH] [OR:BACILLUS SUBTILIS] [EC:3.4.24.-] [DE:CELL DIVISION PROTEIN FTSH HOMOLOG,] [SP:P37476] [DB:swissprot] >pir:[LN:E69627] [AC:E69627:S66099 ] [PN:cell-division protein / general stress protein ftsH:class III heat shock protein ftsH] [GN:ftsH ] [CL:cell division protein ftsH: FtsH/SEC18/CDC48-type ATP-binding domain homology] [OR:Bacillus subtilis] [DB:pir2] >gp:[GI:d1005846:g467458] [LN:BAC180K] [AC:D26185] [PN:cell division protein] [GN:ftsH] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:140584] [RE:142497] [DI:direct] >gp:[GI:e1182002:g2632336] [LN:BSUB0001] [AC:Z99104:AL009126] [PN:cell-division protein and general stress protein] [GN:ftsH] [FN:involved in major cellular processes such as] [OR:Bacillus subtilis] [DB:genpept-bct1] [EC:3.4.24.-] [DE:Bacillus subtilis complete genome (section 1 of 21): from 1 to213080.] [SP:P37476] [LE:76982] [RE:78895] [DI:direct]

| ORF Name | NTID | AAID | NT Length | AA Length | score | probability |
|---|---|---|---|---|---|---|
| AI7503000980_25662965_c1_195 | 172 | 3944 | 729 | 242 | 463 | 6.4e-44 |

Description
sp:[LN:CTC_BACSU] [AC:P14194] [GN:CTC] [OR:BACILLUS SUBTILIS] [DE:GENERAL STRESS PROTEIN CTC] [SP:P14194] [DB:swissprot]

| ORF Name | NTID | AAID | NT Length | AA Length | score | probability |
|---|---|---|---|---|---|---|
| AI7503000980_26210061_f2_99 | 173 | 3945 | 144 | 47 | | |

Description
NO-HIT

| ORF Name | NTID | AAID | NT Length | AA Length | score | probability |
|---|---|---|---|---|---|---|
| AI7503000980_26839660_c3_246 | 174 | 3946 | 855 | 284 | 842 | 4.4e-84 |

Description
gp:[GI:e1386912:g4454322] [LN:SAU132803] [AC:AJ132803] [PN:hypothetical protein] [OR:Staphylococcus aureus] [DB:genpept-bct1] [DE:Staphylococcus aureus ORF1 and ORF2 (partial).] [NT:ORF2] [LE:1402] [RE:>2052] [DI:direct]

| ORF Name | NTID | AAID | NT Length | AA Length | score | probability |
|---|---|---|---|---|---|---|
| AI7503000980_2928502_c3_262 | 175 | 3947 | 960 | 319 | 1166 | 2.1e-118 |

Description
sp:[LN:CYSK_BACSU] [AC:P37887] [GN:CYSK] [OR:BACILLUS SUBTILIS] [EC:4.2.99.8] [DE:PROTEIN 11) (SOI11)] [SP:P37887] [DB:swissprot]

| ORF Name | NTID | AAID | NT Length | AA Length | score | probability |
|---|---|---|---|---|---|---|
| AI7503000980_29298162_f2_118 | 176 | 3948 | 123 | 40 | | |

Description
NO-HIT

| ORF Name | NTID | AAID | NT Length | AA Length | score | probability |
|---|---|---|---|---|---|---|
| AI7503000980_29307187_c2_213 | 177 | 3949 | 165 | 54 | | |

Description
NO-HIT

| ORF Name | NTID | AAID | NT Length | AA Length | score | probability |
|---|---|---|---|---|---|---|
| AI7503000980_31446881_c2_215 | 178 | 3950 | 351 | 116 | 194 | 2.1e-15 |

Description
sp:[LN:YABA_BACSU] [AC:P37542] [GN:YABA] [OR:BACILLUS SUBTILIS] [DE:HYPOTHETICAL 14.1 KD PROTEIN IN XPAC-ABRB INTERGENIC REGION] [SP:P37542] [DB:swissprot] >pir:[LN:S66063] [AC:S66063;B69738 ] [PN:hypothetical protein yabA] [GN:yabA ] [OR:Bacillus subtilis] [DB:pir2] >gp:[GI:d1005811;g467423] [LN:BAC180K] [AC:D26185] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:106099] [RE:106458] [DI:direct] >gp:[GI:e1181966;g2632300] [LN:BSUB0001] [AC:Z99104;AL009126] [GN:yabA] [FN:unknown] [OR:Bacillus subtilis] [DB:genpept-bct1] [DE:Bacillus subtilis complete genome (section 1 of 21): from 1 to213080.] [SP:P37542] [LE:42497] [RE:42856] [DI:direct]

| ORF Name | NTID | AAID | NT Length | AA Length | score | probability |
|---|---|---|---|---|---|---|
| AI7503000980_32615811_f3_166 | 179 | 3951 | 189 | 62 | | |

Description
NO-HIT

| ORF Name | NTID | AAID | NT Length | AA Length | score | probability |
|---|---|---|---|---|---|---|
| AI7503000980_33225017_c2_222 | 180 | 3952 | 867 | 288 | 792 | 8.8e-79 |

Description
sp:[LN:PURR_BACSU] [AC:P37551] [GN:PURR] [OR:BACILLUS SUBTILIS] [DE:PUR OPERON REPRESSOR] [SP:P37551] [DB:swissprot] >pir:[LN:S66076] [AC:S66076;D69685 ] [PN:transcription repressor of purine operon purR] [GN:purR ] [OR:Bacillus subtilis] [DB:pir2] >gp:[GI:d1005824;g467436] [LN:BAC180K] [AC:D26185] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:118041] [RE:118898] [DI:direct] >gp:[GI:e1181980;g2632314] [LN:BSUB0001] [AC:Z99104;AL009126] [PN:transcriptional regulator] [GN:purR] [FN:negative regulation of the purine operon] [OR:Bacillus subtilis] [DB:genpept-bct1] [DE:Bacillus subtilis complete genome (section 1 of 21): from 1 to213080.] [NT:alternate gene name: yabI] [SP:P37551] [LE:54439] [RE:55296] [DI:direct]

| ORF Name | NTID | AAID | NT Length | AA Length | score | probability |
|---|---|---|---|---|---|---|
| AI7503000980_33313817_c1_192 | 181 | 3953 | 333 | 110 | 323 | 4.4e-29 |

Description
sp:[LN:SP5G_BACME] [AC:P28016] [GN:SPOVG] [OR:BACILLUS MEGATERIUM] [DE:STAGE V SPORULATION PROTEIN G] [SP:P28016] [DB:swissprot] >pir:[LN:S18900] [AC:S18900 ] [PN:spoVG protein] [CL:stage V sporulation protein spoVG] [OR:Bacillus megaterium] [DB:pir2] >gp:[GI:g39656] [LN:BMSPOVG] [AC:X62377] [GN:spoVG] [OR:Bacillus megaterium] [DB:genpept-bct1] [DE:B.megaterium spoVG and tms genes.] [SP:P28016] [LE:31] [RE:321] [DI:direct]

| ORF Name | NTID | AAID | NT Length | AA Length | score | probability |
|---|---|---|---|---|---|---|
| AI7503000980_34001510_c2_218 | 182 | 3954 | 798 | 265 | 916 | 6.4e-92 |

Description
sp:[LN:YABD_BACSU] [AC:P37545] [GN:YABD] [OR:BACILLUS SUBTILIS] [DE:HYPOTHETICAL 29.2 KD PROTEIN IN METS-KSGA INTERGENIC REGION] [SP:P37545] [DB:swissprot] >pir:[LN:S66068] [AC:S66068:E69738 ] [PN:conserved hypothetical protein yabD] [GN:yabD ] [CL:hypothetical protein HI0454] [OR:Bacillus subtilis] [DB:pir2] >gp:[GI:d1005816:g467428] [LN:BAC180K] [AC:D26185] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:111306] [RE:112073] [DI:direct] >gp:[GI:e1181972:g2632306] [LN:BSUB0001] [AC:Z99104:AL009126] [GN:yabD] [FN:unknown] [OR:Bacillus subtilis] [DB:genpept-bct1] [DE:Bacillus subtilis complete genome (section 1 of 21): from 1 to213080.] [NT:similar to hypothetical proteins] [SP:P37545] [LE:47704] [RE:48471] [DI:direct]

| ORF Name | NTID | AAID | NT Length | AA Length | score | probability |
|---|---|---|---|---|---|---|
| AI7503000980_34428515_c1_191 | 183 | 3955 | 285 | 94 | 284 | 6.0e-25 |

Description
sp:[LN:VEG_BACSU] [AC:P37466] [GN:VEG] [OR:BACILLUS SUBTILIS] [DE:VEG PROTEIN] [SP:P37466] [DB:swissprot] >pir:[LN:S66073] [AC:S66073:C69730 ] [PN:hypothetical protein veg] [GN:veg ] [OR:Bacillus subtilis] [DB:pir2] >gp:[GI:d1005821:g467433] [LN:BAC180K] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:116363] [RE:116623] [DI:direct] >gp:[GI:e1181977:g2632311] [LN:BSUB0001] [AC:Z99104:AL009126] [GN:veg] [FN:unknown] [OR:Bacillus subtilis] [DB:genpept-bct1] [DE:Bacillus subtilis complete genome (section 1 of 21): from 1 to213080.] [SP:P37466] [LE:52761] [RE:53021] [DI:direct]

| ORF Name | NTID | AAID | NT Length | AA Length | score | probability |
|---|---|---|---|---|---|---|
| AI7503000980_34571011_c3_252 | 184 | 3956 | 1608 | 535 | 1712 | 2.8e-176 |

Description
sp:[LN:MFD_BACSU] [AC:P37474] [GN:MFD] [OR:BACILLUS SUBTILIS] [DE:TRANSCRIPTION-REPAIR COUPLING FACTOR (TRCF)] [SP:P37474] [DB:swissprot] >pir:[LN:S66085] [AC:S66085:F69657 ] [PN:transcription-repair coupling factor mfd] [GN:mfd ] [CL:transcription-repair coupling protein:DEAD/H box helicase homology] [OR:Bacillus subtilis] [DB:pir2] >gp:[GI:d1005832:g467444] [LN:BAC180K] [AC:D26185] [PN:transcription-repair coupling factor] [GN:mfd] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:124030] [RE:127563] [DI:direct] >gp:[GI:e1181988:g2632322] [LN:BSUB0001] [AC:Z99104:AL009126] [PN:transcription-repair coupling factor] [GN:mfd] [FN:probably involved in homologous DNA] [OR:Bacillus subtilis] [DB:genpept-bct1] [DE:Bacillus subtilis complete genome (section 1 of 21): from 1 to213080.] [SP:P37474] [LE:60428] [RE:63961] [DI:direct]

| ORF Name | NTID | AAID | NT Length | AA Length | score | probability |
|---|---|---|---|---|---|---|
| AI7503000980_35260887_c1_193 | 185 | 3957 | 141 | 46 | | |

Description
NO-HIT

| ORF Name | NTID | AAID | NT Length | AA Length | score | probability |
|---|---|---|---|---|---|---|
| AI7503000980_3553_c3_245 | 186 | 3958 | 972 | 323 | 382 | 2.5e-35 |

Description
sp:[LN:HOLB_BACSU] [AC:P37540] [GN:HOLB] [OR:BACILLUS SUBTILIS] [EC:2.7.7.7] [DE:DNA POLYMERASE III, DELTA' SUBUNIT,] [SP:P37540] [DB:swissprot] >pir:[LN:S66061] [AC:S66061;C69642 ] [PN:DNA polymerase III (delta' subunit) holB:dnaH homolog holB] [GN:holB ] [OR:Bacillus subtilis] [DB:pir2] >gp:[GI:d1005809:g467421] [LN:BAC180K] [AC:D26185] [PN:similar to B. subtilis DnaH] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:104265] [RE:105254] [DI:direct] >gp:[GI:e1181964:g2632298] [LN:BSUB0001] [AC:Z99104:AL009126] [PN:DNA polymerase III (delta' subunit)] [GN:holB] [OR:Bacillus subtilis] [DB:genpept-bct1] [EC:2.7.7.7] [DE:Bacillus subtilis complete genome (section 1 of 21): from 1 to213080.] [NT:alternate gene name: yaaS] [SP:P37540] [LE:40663] [RE:41652] [DI:direct]

| ORF Name | NTID | AAID | NT Length | AA Length | score | probability |
|---|---|---|---|---|---|---|
| AI7503000980_3916087_c2_216 | 187 | 3959 | 261 | 86 | 243 | 1.3e-20 |

Description
pir:[LN:A69742] [AC:A69742 ] [PN:conserved hypothetical protein yazA] [GN:yazA ] [CL:hypothetical protein 312] [OR:Bacillus subtilis] [DB:pir2] >gp:[GI:e1181968:g2632302] [LN:BSUB0001] [AC:Z99104:AL009126] [GN:yazA] [FN:unknown] [OR:Bacillus subtilis] [DB:genpept-bct1] [DE:Bacillus subtilis complete genome (section 1 of 21): from 1 to213080.] [NT:similar to hypothetical proteins] [LE:43645] [RE:43944] [DI:direct]

| ORF Name | NTID | AAID | NT Length | AA Length | score | probability |
|---|---|---|---|---|---|---|
| AI7503000980_3937950_f2_71 | 188 | 3960 | 186 | 61 | | |

Description
NO-HIT

| ORF Name | NTID | AAID | NT Length | AA Length | score | probability |
|---|---|---|---|---|---|---|
| AI7503000980_3938838_c1_210 | 189 | 3961 | 846 | 281 | 1087 | 4.8e-110 |

Description
sp:[LN:DHPS_STAHA] [AC:Q59919] [GN:FOLP] [OR:STAPHYLOCOCCUS HAEMOLYTICUS] [EC:2.5.1.15] [DE:PYROPHOSPHORYLASE) (DHPS)] [SP:Q59919] [DB:swissprot] >gp:[GI:g1118002] [LN:SHU40768] [AC:U40768] [PN:dihydropteroate synthase] [GN:folP] [OR:Staphylococcus haemolyticus] [DB:genpept-bct2] [EC:2.5.1.15] [DE:Staphylococcus haemolyticus cysteine synthase A (cysK) anddihydroneopterin aldolase (folQ) genes, partial cds, anddihydropteroate synthase (folP) gene, complete cds.] [NT:DHPS] [LE:692] [RE:1495] [DI:direct]

| ORF Name | NTID | AAID | NT Length | AA Length | score | probability |
|---|---|---|---|---|---|---|
| AI7503000980_4034707_f2_114 | 190 | 3962 | 144 | 47 | | |

Description
NO-HIT

| ORF Name | NTID | AAID | NT Length | AA Length | score | probability |
|---|---|---|---|---|---|---|
| AI7503000980_4723192_c1_196 | 191 | 3963 | 606 | 201 | 539 | 5.7e-52 |

Description sp:[LN:SP5C_BACSU] [AC:P37470] [GN:SPOVC:PTH] [OR:BACILLUS SUBTILIS] [EC:3.1.1.29] [DE:SPORULATION PROTEIN C)] [SP:P37470] [DB:swissprot] >pir:[LN:C69715] [AC:C69715:S66083 ] [PN:stage V sporulation protein spoVC:spore coat formation protein spoVC] [GN:spoVC ] [CL:peptidyl-tRNA hydrolase] [OR:Bacillus subtilis] [DB:pir2] >gp:[GI:d1005830:g467442] [LN:BAC180K] [AC:D26185] [PN:stage V sporulation] [GN:spoVC] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:123104] [RE:123670] [DI:direct] >gp:[GI:e1181986:g2632320] [LN:BSUB0001] [AC:Z99104:AL009126] [GN:spoVC] [OR:Bacillus subtilis] [DB:genpept-bct1] [DE:Bacillus subtilis complete genome (section 1 of 21): from 1 to213080.] [NT:thermosensitive mutant blocks spore coat formation] [SP:P37470] [LE:59502] [RE:60068] [DI:direct]

| ORF Name | NTID | AAID | NT Length | AA Length | score | probability |
|---|---|---|---|---|---|---|
| AI7503000980_4775312_c3_257 | 192 | 3964 | 405 | 134 | 436 | 4.7e-41 |

Description sp:[LN:YABR_BACSU] [AC:P37560] [GN:YABR] [OR:BACILLUS SUBTILIS] [DE:HYPOTHETICAL 14.2 KD PROTEIN IN DIVIC-SPOIIE INTERGENIC REGION] [SP:P37560] [DB:swissprot] >pir:[LN:C53380] [AC:C53380:S66093:A69740 ] [PN:polyribonucleotide nucleotidyltransferase homolog yabR:divIC 3'-region hypothetical protein] [GN:yabR ] [CL:polyribonucleotide nucleotidyltransferase homolog yabR] [OR:Bacillus subtilis] [DB:pir2] >gp:[GI:d1005840:g467452] [LN:BAC180K] [AC:D26185] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:133226] [RE:133612] [DI:direct] >gp:[GI:g385178] [LN:BACDIVIC] [AC:L23497] [PN:unknown] [OR:Bacillus subtilis] [DB:genpept-bct1] [DE:Bacillus subtilis cell division protein (divIC) gene, complete cds,transfer RNA genes, complete sequence and sporulation protein(spoIIE) gene, 5' end of cds.] [NT:orf128; homologous to RNA binding domain of E. coli] [LE:914] [RE:1300] [DI:direct] >gp:[GI:e1181996:g2632330] [LN:BSUB0001] [AC:Z99104:AL009126] [GN:yabR] [FN:unknown] [OR:Bacillus subtilis] [DB:genpept-bct1] [DE:Bacillus subtilis complete genome (section 1 of 21): from 1 to213080.] [NT:similar to polyribonucleotide] [SP:P37560] [LE:69624] [RE:70010] [DI:direct]

| ORF Name | NTID | AAID | NT Length | AA Length | score | probability |
|---|---|---|---|---|---|---|
| AI7503000980_4884625_c1_189 | 193 | 3965 | 549 | 182 | 445 | 5.2e-42 |

Description sp:[LN:YABF_BACSU] [AC:P37547] [GN:YABF] [OR:BACILLUS SUBTILIS] [DE:HYPOTHETICAL 20.7 KD PROTEIN IN METS-KSGA INTERGENIC REGION] [SP:P37547] [DB:swissprot] >pir:[LN:S66070] [AC:S66070:G69738 ] [PN:conserved hypothetical protein yabF] [GN:yabF ] [OR:Bacillus subtilis] [DB:pir2] >gp:[GI:d1005818:g467430] [LN:BAC180K] [AC:D26185] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:113687] [RE:114247] [DI:direct] >gp:[GI:e1181974:g2632308] [LN:BSUB0001] [AC:Z99104:AL009126] [GN:yabF] [FN:unknown] [OR:Bacillus subtilis] [DB:genpept-bct1] [DE:Bacillus subtilis complete genome (section 1 of 21): from 1 to213080.] [NT:similar to hypothetical proteins] [SP:P37547] [LE:50085] [RE:50645] [DI:direct]

| ORF Name | NTID | AAID | NT Length | AA Length | score | probability |
|---|---|---|---|---|---|---|
| AI7503000980_5317151_c3_264 | 194 | 3966 | 177 | 58 | | |

Description

NO-HIT

---

| ORF Name | NTID | AAID | NT Length | AA Length | score | probability |
|---|---|---|---|---|---|---|
| AI7503000980_5344015_c3_255 | 195 | 3967 | 1281 | 426 | 849 | 8.0e-85 |

Description sp:[LN:YABN_BACSU] [AC:P37556] [GN:YABN] [OR:BACILLUS SUBTILIS] [DE:HYPOTHETICAL 56.1 KD PROTEIN IN MFD-DIVIC INTERGENIC REGION] [SP:P37556] [DB:swissprot] >pir:[LN:S66088] [AC:S66088:E69739 ] [PN:conserved hypothetical protein yabN:beta-lactamase regulatory protein homolog yabN] [GN:yabN ] [CL:beta-lactamase regulatory protein homolog: beta-lactamase regulatory protein homology] [OR:Bacillus subtilis] [DB:pir2] >gp:[GI:d1005835:g467447] [LN:BAC180K] [AC:D26185] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:130005] [RE:131474] [DI:direct] >gp:[GI:e1181991:g2632325] [LN:BSUB0001] [AC:Z99104:AL009126] [GN:yabN] [FN:unknown] [OR:Bacillus subtilis] [DB:genpept-bct1] [DE:Bacillus subtilis complete genome (section 1 of 21): from 1 to213080.] [NT:similar to hypothetical proteins] [SP:P37556] [LE:66403] [RE:67872] [DI:direct]

| ORF Name | NTID | AAID | NT Length | AA Length | score | probability |
|---|---|---|---|---|---|---|
| AI7503000980_5367813_c3_244 | 196 | 3968 | 543 | 180 | 432 | 1.2e-40 |

Description sp:[LN:ATDA_ECOLI] [AC:P37354] [GN:SPEG] [OR:ESCHERICHIA COLI] [EC:2.3.1.57] [DE:ACETYLTRANSFERASE) (SAT)] [SP:P37354] [DB:swissprot] >gp:[GI:d1016007:g1742583] [LN:D90799] [AC:D90799:AB001340] [PN:Spermidine N1-acetyltransferase (EC 2.3.1.57)] [GN:speG] [OR:Escherichia coli] [SR:Escherichia coli (strain:K12) DNA, clone_lib:Kohara lambda minise] [DB:genpept-bct1] [DE:E.coli genomic DNA, Kohara clone #308(35.3-35.7 min.).] [NT:ORF_ID:o309#16; similar to [SwissProt Accession] [LE:<18154] [RE:18711] [DI:direct] >gp:[GI:d1016029:g1742606] [LN:D90800] [AC:D90800:AB001340] [PN:Spermidine N1-acetyltransferase (EC 2.3.1.57)] [GN:speG] [OR:Escherichia coli] [SR:Escherichia coli (strain:K12) DNA, clone_lib:Kohara lambda minise] [DB:genpept-bct1] [DE:E.coli genomic DNA, Kohara clone #309(35.4-35.7 min.).] [NT:ORF_ID:o309#16; similar to [SwissProt Accession] [LE:<14930] [RE:15487] [DI:direct] >gp:[GI:d1016031:g1742609] [LN:D90801] [AC:D90801:AB001340] [PN:Spermidine N1-acetyltransferase (EC 2.3.1.57)] [GN:speG] [OR:Escherichia coli] [SR:Escherichia coli (strain:K12) DNA, clone_lib:Kohara lambda minise] [DB:genpept-bct1] [DE:E.coli genomic DNA, Kohara clone #310(35.7-36.0 min.).] [NT:ORF_ID:o309#16; similar to [SwissProt Accession] [LE:<814] [RE:1371] [DI:direct]

| ORF Name | NTID | AAID | NT Length | AA Length | score | probability |
|---|---|---|---|---|---|---|
| AI7503000980_581260_f3_137 | 197 | 3969 | 183 | 60 | | |

Description

NO-HIT

| ORF Name | NTID | AAID | NT Length | AA Length | score | probability |
|---|---|---|---|---|---|---|
| AI7503000980_6015842_c3_249 | 198 | 3970 | 900 | 299 | 750 | 2.5e-74 |

Description sp:[LN:YABH_BACSU] [AC:P37550] [GN:YABH] [OR:BACILLUS SUBTILIS] [DE:HYPOTHETICAL 31.7 KD PROTEIN IN SSPF-PURR INTERGENIC REGION (ORF1)] [SP:P37550] [DB:swissprot] >pir:[LN:S66075] [AC:S66075:A69739 ] [PN:conserved hypothetical protein yabH] [GN:yabH ] [OR:Bacillus subtilis] [DB:pir2] >gp:[GI:d1005823:g467435] [LN:BAC180K] [AC:D26185] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:117116] [RE:117985] [DI:direct] >gp:[GI:e1181979:g2632313] [LN:BSUB0001] [AC:Z99104:AL009126] [GN:yabH] [FN:unknown] [OR:Bacillus subtilis] [DB:genpept-bct1] [DE:Bacillus subtilis complete genome (section 1 of 21): from 1 to213080.] [NT:similar to hypothetical proteins] [SP:P37550] [LE:53514] [RE:54383] [DI:direct]

| ORF Name | NTID | AAID | NT Length | AA Length | score | probability |
|---|---|---|---|---|---|---|
| AI7503000980_6136562_c2_223 | 199 | 3971 | 402 | 133 | 361 | 4.1e-33 |

Description sp:[LN:YABJ_BACSU] [AC:P37552] [GN:YABJ] [OR:BACILLUS SUBTILIS] [DE:HYPOTHETICAL 13.7 KD PROTEIN IN PURR-SPOVG INTERGENIC REGION (ORF2)] [SP:P37552] [DB:swissprot] >pir:[LN:S66077] [AC:S66077:B69739 ] [PN:conserved hypothetical protein yabJ] [GN:yabJ ] [CL:hypothetical protein HI0719] [OR:Bacillus subtilis] [DB:pir2] >gp:[GI:d1005825:g467437] [LN:BAC180K] [AC:D26185] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:118895] [RE:119272] [DI:direct] >gp:[GI:e1181981:g2632315] [LN:BSUB0001] [AC:Z99104:AL009126] [GN:yabJ] [FN:unknown] [OR:Bacillus subtilis] [DB:genpept-bct1] [DE:Bacillus subtilis complete genome (section 1 of 21): from 1 to213080.] [NT:similar to hypothetical proteins] [SP:P37552] [LE:55293] [RE:55670] [DI:direct]

| ORF Name | NTID | AAID | NT Length | AA Length | score | probability |
|---|---|---|---|---|---|---|
| AI7503000980_6742943_c2_217 | 200 | 3972 | 1983 | 660 | 2292 | 9.8e-238 |

Description sp:[LN:SYM_BACSU] [AC:P37465] [GN:METS] [OR:BACILLUS SUBTILIS] [EC:6.1.1.10] [DE:(METRS)] [SP:P37465] [DB:swissprot] >pir:[LN:S66067] [AC:S66067:E69657 ] [PN:methionine--tRNA ligase, metS:methionyl-tRNA synthetase metS] [GN:metS ] [CL:methionine--tRNA ligase] [OR:Bacillus subtilis] [EC:6.1.1.10] [DB:pir2] >gp:[GI:d1005815:g467427] [LN:BAC180K] [AC:D26185] [PN:methionyl-tRNA synthetase] [GN:metS] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:109233] [RE:111227] [DI:direct] >gp:[GI:e1181971:g2632305] [LN:BSUB0001] [AC:Z99104:AL009126] [PN:methionyl-tRNA synthetase] [GN:metS] [OR:Bacillus subtilis] [DB:genpept-bct1] [EC:6.1.1.10] [DE:Bacillus subtilis complete genome (section 1 of 21): from 1 to213080.] [SP:P37465] [LE:45631] [RE:47625] [DI:direct]

| ORF Name | NTID | AAID | NT Length | AA Length | score | probability |
|---|---|---|---|---|---|---|
| AI7503000980_6834427_c2_227 | 201 | 3973 | 150 | 49 | 93 | 0.00010 |

Description
sp:[LN:YABO_BACSU] [AC:P37557] [GN:YABO] [OR:BACILLUS SUBTILIS] [DE:HYPOTHETICAL 9.7 KD PROTEIN IN MFD-DIVIC INTERGENIC REGION] [SP:P37557] [DB:swissprot] >pir:[LN:S66089] [AC:S66089:F69739 ] [PN:conserved hypothetical protein yabO] [GN:yabO ] [OR:Bacillus subtilis] [DB:pir2] >gp:[GI:d1005836:g467448] [LN:BAC180K] [AC:D26185] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:131477] [RE:131737] [DI:direct] >gp:[GI:e1181992:g2632326] [LN:BSUB0001] [AC:Z99104:AL009126] [GN:yabO] [FN:unknown] [OR:Bacillus subtilis] [DB:genpept-bct1] [DE:Bacillus subtilis complete genome (section 1 of 21): from 1 to213080.] [NT:similar to hypothetical proteins] [SP:P37557] [LE:67875] [RE:68135] [DI:direct]

| ORF Name | NTID | AAID | NT Length | AA Length | score | probability |
|---|---|---|---|---|---|---|
| AI7503000980_7036526_c1_212 | 202 | 3974 | 159 | 52 | 86 | 0.00057 |

Description
pir:[LN:C64571] [AC:C64571 ] [PN:hypothetical protein HP0411] [OR:Helicobacter pylori] [DB:pir2] >gp:[GI:g2313526] [LN:AE000557] [AC:AE000557:AE000511] [PN:H. pylori predicted coding region HP0411] [GN:HP0411] [OR:Helicobacter pylori 26695] [DB:genpept-bct2] [DE:Helicobacter pylori 26695 section 35 of 134 of the complete genome.] [NT:hypothetical protein; identified by GeneMark;] [LE:3068] [RE:3385] [DI:direct]

| ORF Name | NTID | AAID | NT Length | AA Length | score | probability |
|---|---|---|---|---|---|---|
| AI7503000980_761_c1_187 | 203 | 3975 | 750 | 249 | 919 | 3.1e-92 |

Description
gp:[GI:e1386911:g4454321] [LN:SAU132803] [AC:AJ132803] [PN:hypothetical protein] [OR:Staphylococcus aureus] [DB:genpept-bct1] [DE:Staphylococcus aureus ORF1 and ORF2 (partial).] [NT:ORF1] [LE:434] [RE:1159] [DI:direct]

| ORF Name | NTID | AAID | NT Length | AA Length | score | probability |
|---|---|---|---|---|---|---|
| AI7503000980_829800_c1_201 | 204 | 3976 | 1575 | 524 | 700 | 4.9e-69 |

Description
gp:[GI:g4090864] [LN:AF023181] [AC:AF023181] [PN:low temperature requirement B protein] [GN:ltrB] [OR:Listeria monocytogenes] [DB:genpept-bct2] [DE:Listeria monocytogenes transcription-repair coupling factor (mfdL),low temperature requirement B protein (ltrB), and DivIC homolog(divL) genes, complete cds.] [LE:3972] [RE:5546] [DI:direct]

| ORF Name | NTID | AAID | NT Length | AA Length | score | probability |
|---|---|---|---|---|---|---|
| AI7503000980_976638_c1_183 | 205 | 3977 | 1371 | 456 | 556 | 9.0e-54 |

Description
sp:[LN:YAAO_BACSU] [AC:P37536] [GN:YAAO] [OR:BACILLUS SUBTILIS] [DE:HYPOTHETICAL 53.2 KD PROTEIN IN XPAC-ABRB INTERGENIC REGION] [SP:P37536] [DB:swissprot] >pir:[LN:S66057] [AC:S66057:F69737 ] [PN:lysine decarboxylase homolog yaaO] [GN:yaaO ] [OR:Bacillus subtilis] [DB:pir2] >gp:[GI:d1005805:g467417] [LN:BAC180K] [AC:D26185] [PN:similar to lysine decarboxylase] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:101320] [RE:102762] [DI:direct] >gp:[GI:e1181960:g2632294] [LN:BSUB0001] [AC:Z99104:AL009126] [GN:yaaO] [FN:unknown] [OR:Bacillus subtilis] [DB:genpept-bct1] [DE:Bacillus subtilis complete genome (section 1 of 21): from 1 to213080.] [NT:similar to lysine decarboxylase] [SP:P37536] [LE:37718] [RE:39160] [DI:direct]

| ORF_Name | NTID | AAID | NT Length | AA Length | score | probability |
|---|---|---|---|---|---|---|
| AI7503000980_9876005_f3_159 | 206 | 3978 | 126 | 41 | | |

Description
NO-HIT

| ORF_Name | NTID | AAID | NT Length | AA Length | score | probability |
|---|---|---|---|---|---|---|
| AI7503000981_10392555_f3_17 | 207 | 3979 | 180 | 59 | | |

Description
NO-HIT

| ORF_Name | NTID | AAID | NT Length | AA Length | score | probability |
|---|---|---|---|---|---|---|
| AI7503000981_134392_f3_23 | 208 | 3980 | 153 | 50 | | |

Description
NO-HIT

| ORF_Name | NTID | AAID | NT Length | AA Length | score | probability |
|---|---|---|---|---|---|---|
| AI7503000981_1385927_f3_22 | 209 | 3981 | 369 | 122 | 85 | 0.039 |

Description
gp:[GI:e1332543:g3763999] [LN:PFMAL3P4] [AC:AL008970] [GN:MAL3P4.1] [OR:Plasmodium falciparum] [SR:malaria parasite P. falciparum] [DB:genpept-inv1] [DE:Plasmodium falciparum MAL3P4, complete sequence.] [NT:predicted using hexExon; MAL3P4.1 (PFC0570c),] [LE:106887:107747] [RE:107641:108206] [DI:complementJoin]

| ORF_Name | NTID | AAID | NT Length | AA Length | score | probability |
|---|---|---|---|---|---|---|
| AI7503000981_14882135_f2_11 | 210 | 3982 | 2112 | 703 | 167 | 1.6e-09 |

Description
sp:[LN:MELR_ECOLI] [AC:P10411] [GN:MELR] [OR:ESCHERICHIA COLI] [DE:MELIBIOSE OPERON REGULATORY PROTEIN] [SP:P10411] [DB:swissprot] >pir:[LN:RGECMB] [AC:A29625:S56347:E65221 ] [PN:melibiose operon regulatory protein] [GN:melR ] [CL:arabinose operon regulatory protein] [OR:Escherichia coli] [DB:pir1] [MP:93 min ] >gp:[GI:g536963] [LN:ECOUW93] [AC:U14003] [GN:melR] [FN:regulatory gene] [OR:Escherichia coli] [DB:genpept-bct1] [DE:Escherichia coli K-12 chromosomal region from 92.8 to 00.1 minutes.] [NT:CG Site No. 18166] [LE:31548] [RE:32456] [DI:complement] >gp:[GI:g1790559] [LN:AE000484] [AC:AE000484:U00096] [PN:regulator of melibiose operon] [GN:melR] [FN:regulator; Degradation of small molecules:] [OR:Escherichia coli] [DB:genpept-bct2] [DE:Escherichia coli K-12 MG1655 section 374 of 400 of the completegenome.] [NT:f302; CG Site No. 18166] [LE:5093] [RE:6001] [DI:complement]

| ORF_Name | NTID | AAID | NT Length | AA Length | score | probability |
|---|---|---|---|---|---|---|
| AI7503000981_23634578_f3_18 | 211 | 3983 | 150 | 49 | | |

Description
NO-HIT

| ORF_Name | NTID | AAID | NT Length | AA Length | score | probability |
|---|---|---|---|---|---|---|
| AI7503000981_23860887_f2_13 | 212 | 3984 | 141 | 46 | | |

Description
NO-HIT

| ORF Name | NTID | AAID | NT Length | AA Length | score | probability |
|---|---|---|---|---|---|---|
| AI7503000981_25634627_f2_12 | 213 | 3985 | 468 | 155 | 290 | 1.4e-25 |

Description
sp:[LN:GS26_BACSU] [AC:P80238:P96580] [GN:YDAG] [OR:BACILLUS SUBTILIS] [DE:GENERAL STRESS PROTEIN 26 (GSP26)] [SP:P80238:P96580] [DB:swissprot] >pir:[LN:G69768] [AC:G69768 ] [PN:general stress protein homolog ydaG] [GN:ydaG ] [OR:Bacillus subtilis] [DB:pir2] >gp:[GI:d1020013:g1881233] [LN:AB001488] [AC:AB001488] [GN:ydaG] [OR:Bacillus subtilis] [SR:Bacillus subtilis (strain:168) DNA] [DB:genpept-bct1] [DE:Bacillus subtilis genome sequence, 148 kb sequence of the regionbetween 35 and 47 degree.] [NT:FUNCTION UNKNOWN.] [LE:6862] [RE:7284] [DI:direct] >gp:[GI:e1182388:g2632722] [LN:BSUB0003] [AC:Z99106:AL009126] [GN:ydaG] [FN:unknown] [OR:Bacillus subtilis] [DB:genpept-bct1] [DE:Bacillus subtilis complete genome (section 3 of 21): from 402751 to611850.] [NT:alternate gene name: yzzA; similar to general] [SP:P80238] [LE:70606] [RE:71028] [DI:direct]

| ORF Name | NTID | AAID | NT Length | AA Length | score | probability |
|---|---|---|---|---|---|---|
| AI7503000981_2584538_c1_29 | 214 | 3986 | 132 | 43 | | |

Description
NO-HIT

| ORF Name | NTID | AAID | NT Length | AA Length | score | probability |
|---|---|---|---|---|---|---|
| AI7503000981_29352342_c2_36 | 215 | 3987 | 1296 | 431 | 1218 | 6.3e-124 |

Description
sp:[LN:GLTT_BACST] [AC:P24943] [GN:GLTT] [OR:BACILLUS STEAROTHERMOPHILUS] [DE:PROTEIN)] [SP:P24943] [DB:swissprot] >pir:[LN:S26247] [AC:S26247 ] [PN:glutamate/aspartate transport protein:sodium/proton-glutamate symport protein] [GN:gltP ] [OR:Bacillus stearothermophilus] [DB:pir2] >gp:[GI:g143000] [LN:BACGLTPA] [AC:M86508] [PN:proton glutamate symport protein] [GN:gltP] [OR:Bacillus stearothermophilus] [SR:Bacillus stearothermophilus (library: ATCC 7954) DNA] [DB:genpept-bct1] [DE:Bacillus stearothermophilus proton glutamate symport protein (gltP)gene, complete cds.] [LE:110] [RE:1375] [DI:direct]

| ORF Name | NTID | AAID | NT Length | AA Length | score | probability |
|---|---|---|---|---|---|---|
| AI7503000981_30081465_c2_37 | 216 | 3988 | 147 | 48 | | |

Description
NO-HIT

| ORF Name | NTID | AAID | NT Length | AA Length | score | probability |
|---|---|---|---|---|---|---|
| AI7503000981_32242200_f1_2 | 217 | 3989 | 378 | 125 | | |

Description
NO-HIT

| ORF Name | NTID | AAID | NT Length | AA Length | score | probability |
|---|---|---|---|---|---|---|
| AI7503000981_3396042_c1_34 | 218 | 3990 | 315 | 104 | | |

Description
NO-HIT

| ORF Name | NTID | AAID | NT Length | AA Length | score | probability |
|---|---|---|---|---|---|---|
| AI7503000981_34179828_c2_35 | 219 | 3991 | 129 | 42 | | |

Description
NO-HIT

| ORF Name | NTID | AAID | NT Length | AA Length | score | probability |
|---|---|---|---|---|---|---|
| AI7503000981_4100336_f2_10 | 220 | 3992 | 153 | 50 | | |

Description
NO-HIT

| ORF Name | NTID | AAID | NT Length | AA Length | score | probability |
|---|---|---|---|---|---|---|
| AI7503000981_6511652_c3_51 | 221 | 3993 | 138 | 45 | | |

Description
NO-HIT

| ORF Name | NTID | AAID | NT Length | AA Length | score | probability |
|---|---|---|---|---|---|---|
| AI7503000981_822786_c1_33 | 222 | 3994 | 132 | 43 | | |

Description
NO-HIT

| ORF Name | NTID | AAID | NT Length | AA Length | score | probability |
|---|---|---|---|---|---|---|
| AI7503000982_10031712_c1_1057 | 223 | 3995 | 990 | 329 | 597 | 4.1e-58 |

Description
sp:[LN:YQJA_BACSU] [AC:P54538] [GN:YQJA] [OR:BACILLUS SUBTILIS] [DE:HYPOTHETICAL 37.1 KD PROTEIN IN BMRU-ANSR INTERGENIC REGION] [SP:P54538] [DB:swissprot] >pir:[LN:A69963] [AC:A69963 ] [PN:hypothetical protein yqjA] [GN:yqjA ] [OR:Bacillus subtilis] [DB:pir2] >gp:[GI:d1013287:g1303952] [LN:BACJH642] [AC:D84432:D82370] [PN:YqjA] [OR:Bacillus subtilis] [SR:Bacillus subtilis (strain:JH642(trpC2 PheA1)) DNA] [DB:genpept-bct1] [DE:Bacillus subtilis DNA, 283 Kb region containing skin element.] [LE:229147] [RE:230115] [DI:direct] >gp:[GI:e1185663:g2634829] [LN:BSUB0013] [AC:Z99116:AL009126] [GN:yqjA] [FN:unknown] [OR:Bacillus subtilis] [DB:genpept-bct1] [DE:Bacillus subtilis complete genome (section 13 of 21): from 2395261to 2613730.] [SP:P54538] [LE:93504] [RE:94472] [DI:complement]

| ORF Name | NTID | AAID | NT Length | AA Length | score | probability |
|---|---|---|---|---|---|---|
| AI7503000982_10312561_c3_1455 | 224 | 3996 | 1236 | 411 | 996 | 2.1e-100 |

Description sp:[LN:RS1H_BACSU] [AC:P38494] [GN:YPFD:JOFD] [OR:BACILLUS SUBTILIS] [DE:30S RIBOSOMAL PROTEIN S1 HOMOLOG] [SP:P38494] [DB:swissprot] >pir:[LN:B69935] [AC:B69935 ] [PN:ribosomal protein S1 homolog homolog ypfD] [GN:ypfD ] [CL:Synechocystis ribosomal protein S1] [OR:Bacillus subtilis] [DB:pir2] >gp:[GI:g533106] [LN:BSU11687] [AC:U11687] [PN:unknown] [GN:jofD] [OR:Bacillus subtilis] [DB:genpept-bct1] [DE:Bacillus subtilis 168 jofA, jofB, MssA homolog (jofC) and ribosomalprotein S1 homolog (jofD) genes, complete cds, and joeB gene,partial cds.] [NT:similar to the Escherichia coli S1 ribosomal] [LE:2651] [RE:3799] [DI:direct] >gp:[GI:e1183733:g2634706] [LN:BSUB0012] [AC:Z99115:AL009126] [GN:ypfD] [FN:unknown] [OR:Bacillus subtilis] [DB:genpept-bct1] [DE:Bacillus subtilis complete genome (section 12 of 21): from 2195541to 2409220.] [NT:alternate gene name: jofD; similar to ribosomal] [SP:P38494] [LE:198361] [RE:199509] [DI:complement] >gp:[GI:g1146215] [LN:BACSERA] [AC:L47648] [GN:ypfD] [OR:Bacillus subtilis] [DB:genpept-bct2] [DE:Bacillus subtilis phosphoglycerate dehydrogenase (serA), ypaA,ferredoxin (fer), ypbB, recS, ypbD, ypbE, ypbF, ypbG, ypbH,glutamate dehydrogenase (ypcA), ypdA, ypdB, ypdC, spore cortexlytic enzyme (sleB), ypeB, ypfA, ypfB, cytidine monophosphatekinase (cmk), ypfD, ypgA, yphA, yphB, yphC, NAD+ dependentglycerol-3-phosphate dehydrogenase (glyc), yphE and yphF genes,complete cds.] [NT:similar to Escherichia coli S1 ribosomal protein;] [LE:16888] [RE:18036] [DI:direct]

| ORF Name | NTID | AAID | NT Length | AA Length | score | probability |
|---|---|---|---|---|---|---|
| AI7503000982_10334752_f1_178 | 225 | 3997 | 192 | 63 | | |

Description

NO-HIT

| ORF Name | NTID | AAID | NT Length | AA Length | score | probability |
|---|---|---|---|---|---|---|
| AI7503000982_10588877_f3_947 | 226 | 3998 | 162 | 53 | | |

Description

NO-HIT

| ORF Name | NTID | AAID | NT Length | AA Length | score | probability |
|---|---|---|---|---|---|---|
| AI7503000982_10635918_c2_1290 | 227 | 3999 | 123 | 40 | | |

Description

NO-HIT

| ORF Name | NTID | AAID | NT Length | AA Length | score | probability |
|---|---|---|---|---|---|---|
| AI7503000982_10642180_c3_1513 | 228 | 4000 | 186 | 61 | | |

Description

NO-HIT

| ORF Name | NTID | AAID | NT Length | AA Length | score | probability |
|---|---|---|---|---|---|---|
| AI7503000982_10666068_c2_1228 | 229 | 4001 | 330 | 109 | 196 | 1.3e-15 |

Description sp:[LN:CMG3_BACSU] [AC:P25955] [GN:COMGC:COMG3] [OR:BACILLUS SUBTILIS] [DE:COMG OPERON PROTEIN 3 PRECURSOR] [SP:P25955] [DB:swissprot] >pir:[LN:D30338] [AC:D30338:A35133:D69603 ] [PN:exogenous DNA-binding protein comGC:comG operon protein 3] [GN:comGC ] [OR:Bacillus subtilis] [DB:pir2] >gp:[GI:g142708] [LN:BACCOMGA] [AC:M29691:M22854] [GN:comG3] [OR:Bacillus subtilis] [SR:Bacillus subtilis (strain 168) (clone: pED4) DNA] [DB:genpept-bct1] [DE:Bacillus subtilis (clone pED4) comG-(1,2,3,4,5,6,and 7) proteins incomG operon, complete cds.] [LE:3405] [RE:3701] [DI:direct] >gp:[GI:d1013214:g1303879] [LN:BACJH642] [AC:D84432:D82370] [PN:ComGC] [OR:Bacillus subtilis] [SR:Bacillus subtilis (strain:JH642(trpC2 PheA1)) DNA] [DB:genpept-bct1] [DE:Bacillus subtilis DNA, 283 Kb region containing skin element.] [LE:161635] [RE:161931] [DI:direct] >gp:[GI:e1185739:g2634905] [LN:BSUB0013] [AC:Z99116:AL009126] [GN:comGC] [FN:exogenous DNA-binding (competence)] [OR:Bacillus subtilis] [DB:genpept-bct1] [DE:Bacillus subtilis complete genome (section 13 of 21): from 2395261to 2613730.] [SP:P25955] [LE:161690] [RE:161986] [DI:complement]

| ORF Name | NTID | AAID | NT Length | AA Length | score | probability |
|---|---|---|---|---|---|---|
| AI7503000982_1070437_c3_1482 | 230 | 4002 | 894 | 297 | 727 | 6.8e-72 |

Description sp:[LN:YPCP_BACSU] [AC:P54161] [GN:YPCP] [OR:BACILLUS SUBTILIS] [EC:3.1.11.-] [DE:POTENTIAL 5'-3' EXONUCLEASE,] [SP:P54161] [DB:swissprot] >pir:[LN:H69933] [AC:H69933 ] [PN:5'-3' exonuclease homolog ypcP] [GN:ypcP ] [OR:Bacillus subtilis] [DB:pir2] >gp:[GI:g1256623] [LN:BACYACA] [AC:L77246] [PN:exodeoxyribonuclease] [GN:ypcP] [OR:Bacillus subtilis] [DB:genpept-bct1] [DE:Bacillus subtilis (YAC10-9 clone) DNA region between the serA andkdg loci.] [NT:36.1% identity with 219 aa at the 5' end of the] [LE:9565] [RE:10455] [DI:direct] >gp:[GI:e1183647:g2634620] [LN:BSUB0012] [AC:Z99115:AL009126] [GN:ypcP] [FN:unknown] [OR:Bacillus subtilis] [DB:genpept-bct1] [DE:Bacillus subtilis complete genome (section 12 of 21): from 2195541to 2409220.] [NT:similar to 5'-3' exonuclease] [SP:P54161] [LE:114697] [RE:115587] [DI:complement]

| ORF Name | NTID | AAID | NT Length | AA Length | score | probability |
|---|---|---|---|---|---|---|
| AI7503000982_10938927_f2_492 | 231 | 4003 | 132 | 43 | | |

Description
NO-HIT

| ORF Name | NTID | AAID | NT Length | AA Length | score | probability |
|---|---|---|---|---|---|---|
| AI7503000982_10969050_c2_1193 | 232 | 4004 | 1596 | 531 | 1815 | 3.5e-187 |

Description sp:[LN:LEPA_BACSU] [AC:P37949] [GN:LEPA] [OR:BACILLUS SUBTILIS] [DE:GTP-BINDING PROTEIN LEPA] [SP:P37949] [DB:swissprot] >pir:[LN:G69649] [AC:G69649 ] [PN:GTP-binding protein lepA] [GN:lepA ] [CL:GTP-binding membrane protein lepA:translation elongation factor Tu homology] [OR:Bacillus subtilis] [DB:pir2] >gp:[GI:d1013139:g1303804] [LN:BACJH642] [AC:D84432:D82370] [PN:YqeQ] [OR:Bacillus subtilis] [SR:Bacillus subtilis (strain:JH642(trpC2 PheA1)) DNA] [DB:genpept-bct1] [DE:Bacillus subtilis DNA, 283 Kb region containing skin element.] [LE:86866] [RE:88704] [DI:direct] >gp:[GI:e200671:g1122398] [LN:BSLEPORF] [AC:X91655] [GN:lepA] [OR:Bacillus subtilis] [DB:genpept-bct1] [DE:B.subtilis lepA and hemN genes.] [SP:P37949] [LE:128] [RE:1966] [DI:direct] >gp:[GI:e1183781:g2634997] [LN:BSUB0014] [AC:Z99117:AL009126] [PN:GTP-binding protein] [GN:lepA] [OR:Bacillus subtilis] [DB:genpept-bct1] [DE:Bacillus subtilis complete genome (section 14 of 21): from 2599451to 2812870.] [NT:alternate gene name: yqxB, yqeQ] [SP:P37949] [LE:30726] [RE:32564] [DI:complement]

| ORF Name | NTID | AAID | NT Length | AA Length | score | probability |
|---|---|---|---|---|---|---|
| AI7503000982_11194067_c3_1378 | 233 | 4005 | 747 | 248 | 431 | 1.6e-40 |

Description sp:[LN:YQEM_BACSU] [AC:P54458] [GN:YQEM] [OR:BACILLUS SUBTILIS] [DE:HYPOTHETICAL 28.3 KD PROTEIN IN AROD-COMER INTERGENIC REGION] [SP:P54458] [DB:swissprot] >pir:[LN:A69952] [AC:A69952 ] [PN:conserved hypothetical protein yqeM] [GN:yqeM ] [CL:bioC homology] [OR:Bacillus subtilis] [DB:pir2] >gp:[GI:d1013129:g1303794] [LN:BACJH642] [AC:D84432:D82370] [PN:YqeM] [OR:Bacillus subtilis] [SR:Bacillus subtilis (strain:JH642(trpC2 PheA1)) DNA] [DB:genpept-bct1] [DE:Bacillus subtilis DNA, 283 Kb region containing skin element.] [LE:76770] [RE:77513] [DI:direct] >gp:[GI:e1183791:g2635007] [LN:BSUB0014] [AC:Z99117:AL009126] [GN:yqeM] [FN:unknown] [OR:Bacillus subtilis] [DB:genpept-bct1] [DE:Bacillus subtilis complete genome (section 14 of 21): from 2599451to 2812870.] [NT:similar to hypothetical proteins] [LE:41917] [RE:42660] [DI:complement]

| ORF Name | NTID | AAID | NT Length | AA Length | score | probability |
|---|---|---|---|---|---|---|
| AI7503000982_11203763_c1_985 | 234 | 4006 | 132 | 43 | | |

Description

NO-HIT

| ORF Name | NTID | AAID | NT Length | AA Length | score | probability |
|---|---|---|---|---|---|---|
| AI7503000982_11881313_f1_285 | 235 | 4007 | 174 | 57 | | |

Description

NO-HIT

| ORF Name | NTID | AAID | NT Length | AA Length | score | probability |
|---|---|---|---|---|---|---|
| AI7503000982_12116562_f2_354 | 236 | 4008 | 123 | 40 | | |

Description

NO-HIT

| ORF Name | NTID | AAID | NT Length | AA Length | score | probability |
|---|---|---|---|---|---|---|
| AI7503000982_1218750_c1_996 | 237 | 4009 | 681 | 226 | 336 | 1.8e-30 |

Description gp:[GI:g3211753] [LN:AF052208] [AC:AF052208] [PN:competence protein] [GN:celA] [OR:Streptococcus pneumoniae] [DB:genpept-bct2] [DE:Streptococcus pneumoniae competence protein (celA) and competenceprotein (celB) genes, complete cds; and unknown gene.] [LE:266] [RE:916] [DI:direct]

| ORF Name | NTID | AAID | NT Length | AA Length | score | probability |
|---|---|---|---|---|---|---|
| AI7503000982_1226553_c2_1270 | 238 | 4010 | 141 | 46 | | |

Description

NO-HIT

| ORF Name | NTID | AAID | NT Length | AA Length | score | probability |
|---|---|---|---|---|---|---|
| AI7503000982_1229750_c3_1419 | 239 | 4011 | 468 | 155 | 505 | 2.3e-48 |

Description gp:[GI:e1363305:g4127534] [LN:BSAJ10954] [AC:AJ010954] [PN:arginine repressor] [GN:argR] [FN:ADN binding protein] [OR:Bacillus stearothermophilus] [DB:genpept-bct1] [DE:Bacillus stearothermophilus argR gene and partial recN gene.] [LE:196] [RE:645] [DI:direct]

| ORF Name | NTID | AAID | NT Length | AA Length | score | probability |
|---|---|---|---|---|---|---|
| AI7503000982_1345752_f3_780 | 240 | 4012 | 945 | 314 | 720 | 3.8e-71 |

Description
sp:[LN:YQKF_BACSU] [AC:P54569] [GN:YQKF] [OR:BACILLUS SUBTILIS] [DE:HYPOTHETICAL
OXIDOREDUCTASE IN ANSR-BMRU INTERGENIC REGION] [SP:P54569] [DB:swissprot]
>pir:[LN:H69966] [AC:H69966 ] [PN:conserved hypothetical protein yqkF] [GN:yqkF ]
[OR:Bacillus subtilis] [DB:pir2] >gp:[GI:d1013318:g1303983] [LN:BACJH642]
[AC:D84432:D82370] [PN:YqkF] [OR:Bacillus subtilis] [SR:Bacillus subtilis
(strain:JH642(trpC2 PheA1)) DNA] [DB:genpept-bct1] [DE:Bacillus subtilis DNA, 283 Kb
region containing skin element.] [LE:259404] [RE:260324] [DI:complement]
>gp:[GI:e1185631:g2634797] [LN:BSUB0013] [AC:Z99116:AL009126] [GN:yqkF] [FN:unknown]
[OR:Bacillus subtilis] [DB:genpept-bct1] [DE:Bacillus subtilis complete genome (section
13 of 21): from 2395261to 2613730.] [NT:similar to hypothetical proteins] [SP:P54569]
[LE:63295] [RE:64215] [DI:direct]

| ORF Name | NTID | AAID | NT Length | AA Length | score | probability |
|---|---|---|---|---|---|---|
| AI7503000982_1359450_f2_544 | 241 | 4013 | 144 | 47 | | |

Description
NO-HIT

| ORF Name | NTID | AAID | NT Length | AA Length | score | probability |
|---|---|---|---|---|---|---|
| AI7503000982_136068_f1_227 | 242 | 4014 | 1404 | 467 | 1201 | 4.0e-122 |

Description
pir:[LN:D70585] [AC:D70585 ] [PN:probable glyS protein] [GN:glyS ] [CL:Mycoplasma
genitalium glycine--tRNA ligase] [OR:Mycobacterium tuberculosis] [DB:pir2]
>gp:[GI:e315164:g2078043] [LN:MTCY27] [AC:Z95208:AL123456] [PN:glyS] [GN:glyS]
[OR:Mycobacterium tuberculosis] [DB:genpept-bct1] [DE:Mycobacterium tuberculosis H37Rv
complete genome; segment 104/162.] [NT:Rv2357c, (MTCY27.23-MTCY98.26), len: 463 aa.
glyS,] [LE:19] [RE:1410] [DI:complement]

| ORF Name | NTID | AAID | NT Length | AA Length | score | probability |
|---|---|---|---|---|---|---|
| AI7503000982_13674130_f3_703 | 243 | 4015 | 129 | 42 | | |

Description
NO-HIT

| ORF Name | NTID | AAID | NT Length | AA Length | score | probability |
|---|---|---|---|---|---|---|
| AI7503000982_13853500_f2_374 | 244 | 4016 | 246 | 81 | | |

Description
NO-HIT

| ORF Name | NTID | AAID | NT Length | AA Length | score | probability |
|---|---|---|---|---|---|---|
| AI7503000982_13876943_c1_1122 | 245 | 4017 | 1488 | 495 | 882 | 2.6e-88 |

Description pir:[LN:B69610] [AC:B69610:JC5744 ] [PN:carboxy-terminal processing proteinase ctpA,:tail-specific endopeptidase Prc] [GN:ctpA ] [CL:carboxyl-terminal processing proteinase] [OR:Bacillus subtilis] [EC:3.4.99.-] [DB:pir2] >gp:[GI:g2529476] [LN:AF006665] [AC:AF006665] [PN:OrfRM1] [GN:orfRM1] [FN:unknown] [OR:Bacillus subtilis] [DB:genpept-bct1] [DE:Bacillus subtilis 168 region at 182 min containing the cge genecluster.] [NT:similar to the E. coli Prc and carboxyl-terminal] [LE:22886] [RE:24286] [DI:direct] >gp:[GI:g2415395] [LN:AF015775] [AC:AF015775] [PN:proteinase] [GN:ctpA] [OR:Bacillus subtilis] [DB:genpept-bct1] [DE:Bacillus subtilis YodA (yodA), YodB (yodB), YodC (yodC), YodD(yodD), ABC-transporter (yodE), permease (yodF), proteinase (ctpA),YodH (yodH), YodI (yodI), carboxypeptidase (yodJ), purinenucleoside phosphorylase (deoD), YodL (yodL), YodM (yodM), YodN(yodN), YodO (yodO), YodP (yodP), acetylornitine deacetylase(argE), butirate-acetoacetate CoA transferase (yodR), butyrateacetoacetate-CoA transferase (yodS), YodT (yodT), CgeE (cgeE), CgeD(cgeD), CgeC (cgeC), CgeA (cgeA), CgeB (cgeB), YzxA (yzxA),UDP-glucose epimerase (yodU), YodV (yodV), and YodW (yodW) genes,complete cds; and YodZ (yodZ) gene, partial cds.] [NT:similar to Synechocystis sp. PCC6803] [LE:5846] [RE:7246] [DI:complement] >gp:[GI:e1185430:g2634351] [LN:BSUB0011] [AC:Z99114:AL009126] [PN:carboxy-terminal processing protease] [GN:ctpA] [OR:Bacillus subtilis] [DB:genpept-bct1] [DE:Bacillus subtilis complete genome (section 11 of 21): from 2000171to 2207900.] [NT:alternate gene name: yzbD] [LE:130976] [RE:132376] [DI:complement]

| ORF Name | NTID | AAID | NT Length | AA Length | score | probability |
|---|---|---|---|---|---|---|
| AI7503000982_14097011_c3_1411 | 246 | 4018 | 612 | 203 | 522 | 3.6e-50 |

Description sp:[LN:ARGJ_BACST] [AC:Q07908] [GN:ARGJ] [OR:BACILLUS STEAROTHERMOPHILUS] [EC:2.3.1.35:2.3.1.1] [DE:ACETYLTRANSFERASE, (N-ACETYLGLUTAMATE SYNTHASE) (AGS)] [SP:Q07908] [DB:swissprot] >pir:[LN:I39766] [AC:I39766 ] [PN:glutamate N-acetyltransferase,] [GN:argJ ] [CL:glutamate N-acetyltransferase argJ] [OR:Bacillus stearothermophilus] [EC:2.3.1.35] [DB:pir2] >gp:[GI:g304135] [LN:BACACETYL] [AC:L06036] [PN:ornithine acetyltransferase] [GN:argJ] [OR:Bacillus stearothermophilus] [SR:Bacillus stearothermophilus (strain NCIB 8224) DNA] [DB:genpept-bct1] [EC:2.3.1.35] [DE:Bacillus stearothermophilus ornithine acetyltransferase (argJ) andacetylglutamate kinase (argB) genes, complete cds's, argC gene, 3'end, and argD gene, 5' end.] [NT:also bears acetyl-CoA:L-glutamate] [LE:902] [RE:2134] [DI:direct]

| ORF Name | NTID | AAID | NT Length | AA Length | score | probability |
|---|---|---|---|---|---|---|
| AI7503000982_14259631_c1_967 | 247 | 4019 | 1068 | 355 | 1207 | 9.3e-123 |

Description sp:[LN:QUEA_BACSU] [AC:O32054] [GN:QUEA] [OR:BACILLUS SUBTILIS] [EC:5.-.-.-] [DE:(QUEUOSINE BIOSYNTHESIS PROTEIN QUEA)] [SP:O32054] [DB:swissprot] >pir:[LN:A69688] [AC:A69688 ] [PN:S-adenosylmethionine:tRNA ribosyltransferase-isomerase,:queuosine biosynthesis-related protein queA] [GN:queA ] [CL:S-adenosylmethionine:tRNA ribosyltransferase-isomerase] [OR:Bacillus subtilis] [EC: 5.-.-.-] [DB:pir2] >gp:[GI:e1184021:g2635237] [LN:BSUB0015] [AC:Z99118:AL009126] [PN:S-adenosylmethionine tRNA ribosyltransferase] [GN:queA] [FN:queuosine biosynthesis] [OR:Bacillus subtilis] [DB:genpept-bct1] [DE:Bacillus subtilis complete genome (section 15 of 21): from 2795131to 3013540.] [SP:O32054] [LE:38030] [RE:39058] [DI:complement]

| ORF Name | NTID | AAID | NT Length | AA Length | score | probability |
|---|---|---|---|---|---|---|
| AI7503000982_14460932_f1_322 | 248 | 4020 | 177 | 58 | 226 | 8.4e-19 |

Description gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF Name | NTID | AAID | NT Length | AA Length | score | probability |
|---|---|---|---|---|---|---|
| AI7503000982_14507827_f1_87 | 249 | 4021 | 150 | 49 | | |

Description

NO-HIT

| ORF Name | NTID | AAID | NT Length | AA Length | score | probability |
|---|---|---|---|---|---|---|
| AI7503000982_14508567_c3_1357 | 250 | 4022 | 276 | 91 | 184 | 2.4e-14 |

Description pir:[LN:E69972] [AC:E69972 ] [PN:conserved hypothetical protein yrbF] [GN:yrbF ] [CL:yajC protein] [OR:Bacillus subtilis] [DB:pir2] >gp:[GI:e1184019:g2635235] [LN:BSUB0015] [AC:Z99118:AL009126] [GN:yrbF] [FN:unknown] [OR:Bacillus subtilis] [DB:genpept-bct1] [DE:Bacillus subtilis complete genome (section 15 of 21): from 2795131to 3013540.] [NT:similar to hypothetical proteins] [LE:36555] [RE:36824] [DI:complement]

| ORF Name | NTID | AAID | NT Length | AA Length | score | probability |
|---|---|---|---|---|---|---|
| AI7503000982_14881687_c2_1226 | 251 | 4023 | 993 | 330 | 1448 | 2.7e-148 |

Description sp:[LN:GLK_STAXY] [AC:Q56198] [GN:GLKA] [OR:STAPHYLOCOCCUS XYLOSUS] [EC:2.7.1.2] [DE:GLUCOKINASE, (GLUCOSE KINASE)] [SP:Q56198] [DB:swissprot] >pir:[LN:S52352] [AC:S52352 ] [PN:glucose kinase] [CL:glucose kinase:glucose kinase homology] [OR:Staphylococcus xylosus] [DB:pir2] >gp:[GI:g666116] [LN:SXGKG2] [AC:X84332] [PN:glucose kinase] [GN:glkA] [OR:Staphylococcus xylosus] [DB:genpept-bct1] [DE:S.xylosus glucose kinase gene.] [SP:Q56198] [LE:973] [RE:1959] [DI:direct]

| ORF Name | NTID | AAID | NT Length | AA Length | score | probability |
|---|---|---|---|---|---|---|
| AI7503000982_15031535_f2_658 | 252 | 4024 | 156 | 51 | | |

Description

NO-HIT

| ORF Name | NTID | AAID | NT Length | AA Length | score | probability |
|---|---|---|---|---|---|---|
| AI7503000982_15728386_c3_1356 | 253 | 4025 | 1143 | 380 | 1542 | 2.9e-158 |

Description sp:[LN:TGT_BACSU] [AC:O32053] [GN:TGT] [OR:BACILLUS SUBTILIS] [EC:2.4.2.29] [DE:TRANSGLYCOSYLASE (GUANINE INSERTION ENZYME)] [SP:O32053] [DB:swissprot] >pir:[LN:B69722] [AC:B69722 ] [PN:queuine tRNA-ribosyltransferase,] [GN:tgt ] [CL:queuine tRNA-ribosyltransferase] [OR:Bacillus subtilis] [EC:2.4.2.29] [DB:pir2] >gp:[GI:e1184020:g2635236] [LN:BSUB0015] [AC:Z99118:AL009126] [PN:tRNA-guanine transglycosylase] [GN:tgt] [FN:queuosine biosynthesis] [OR:Bacillus subtilis] [DB:genpept-bct1] [EC:2.4.2.29] [DE:Bacillus subtilis complete genome (section 15 of 21): from 2795131to 3013540.] [SP:O32053] [LE:36858] [RE:38003] [DI:complement]

| ORF Name | NTID | AAID | NT Length | AA Length | score | probability |
|---|---|---|---|---|---|---|
| AI7503000982_16205035_c1_1036 | 254 | 4026 | 135 | 44 | | |

Description
NO-HIT

| ORF Name | NTID | AAID | NT Length | AA Length | score | probability |
|---|---|---|---|---|---|---|
| AI7503000982_16610088_c2_1261 | 255 | 4027 | 645 | 214 | 405 | 9.0e-38 |

Description
sp:[LN:YPAA_BACSU] [AC:P50726] [GN:YPAA] [OR:BACILLUS SUBTILIS] [DE:HYPOTHETICAL 20.5 KD PROTEIN IN SERA-FER INTERGENIC REGION] [SP:P50726] [DB:swissprot] >pir:[LN:E69932] [AC:E69932 ] [PN:hypothetical protein ypaA] [GN:ypaA ] [OR:Bacillus subtilis] [DB:pir2] >gp:[GI:e1185574:g2634740] [LN:BSUB0013] [AC:Z99116:AL009126] [GN:ypaA] [FN:unknown] [OR:Bacillus subtilis] [DB:genpept-bct1] [DE:Bacillus subtilis complete genome (section 13 of 21): from 2395261to 2613730.] [SP:P50726] [LE:13991] [RE:14563] [DI:complement] >gp:[GI:g1146197] [LN:BACSERA] [AC:L47648] [GN:ypaA] [OR:Bacillus subtilis] [DB:genpept-bct2] [DE:Bacillus subtilis phosphoglycerate dehydrogenase (serA), ypaA,ferredoxin (fer), ypbB, recS, ypbD, ypbE, ypbF, ypbG, ypbH,glutamate dehydrogenase (ypcA), ypdA, ypdB, ypdC, spore cortexlytic enzyme (sleB), ypeB, ypfA, ypfB, cytidine monophosphatekinase (cmk), ypfD, ypgA, yphA, yphB, yphC, NAD+ dependentglycerol-3-phosphate dehydrogenase (glyc), yphE and yphF genes,complete cds.] [NT:putative] [LE:2114] [RE:2686] [DI:direct]

| ORF Name | NTID | AAID | NT Length | AA Length | score | probability |
|---|---|---|---|---|---|---|
| AI7503000982_16828175_c3_1395 | 256 | 4028 | 606 | 201 | 1021 | 4.8e-103 |

Description
gp:[GI:g4325247] [LN:AF121672] [AC:AF121672] [PN:superoxide dismutase SodA] [GN:sodA] [OR:Staphylococcus aureus] [DB:genpept-bct2] [DE:Staphylococcus aureus superoxide dismutase SodA (sodA) gene,complete cds.] [NT:manganese-dependent] [LE:246] [RE:845] [DI:direct]

| ORF Name | NTID | AAID | NT Length | AA Length | score | probability |
|---|---|---|---|---|---|---|
| AI7503000982_16923383_c2_1252 | 257 | 4029 | 339 | 112 | 156 | 3.1e-11 |

Description
sp:[LN:YQJQ_BACSU] [AC:P54554] [GN:YQJQ] [OR:BACILLUS SUBTILIS] [EC:1.-.-.-] [DE:(EC 1.-.-.-)] [SP:P54554] [DB:swissprot] >pir:[LN:A69965] [AC:A69965 ] [PN:ketoacyl reductase homolog yqjQ] [GN:yqjQ ] [CL:short-chain alcohol dehydrogenase homology] [OR:Bacillus subtilis] [DB:pir2] >gp:[GI:d1013303:g1303968] [LN:BACJH642] [AC:D84432:D82370] [PN:YqjQ] [OR:Bacillus subtilis] [SR:Bacillus subtilis (strain:JH642(trpC2 PheA1)) DNA] [DB:genpept-bct1] [DE:Bacillus subtilis DNA, 283 Kb region containing skin element.] [LE:247869] [RE:248648] [DI:direct] >gp:[GI:e1185647:g2634813] [LN:BSUB0013] [AC:Z99116:AL009126] [GN:yqjQ] [FN:unknown] [OR:Bacillus subtilis] [DB:genpept-bct1] [DE:Bacillus subtilis complete genome (section 13 of 21): from 2395261to 2613730.] [NT:similar to ketoacyl reductase] [SP:P54554] [LE:74971] [RE:75750] [DI:complement]

| ORF Name | NTID | AAID | NT Length | AA Length | score | probability |
|---|---|---|---|---|---|---|
| AI7503000982_17002217_c2_1254 | 258 | 4030 | 465 | 154 | 587 | 4.7e-57 |

Description sp:[LN:FUR2_BACSU] [AC:P54574] [GN:YQKL] [OR:BACILLUS SUBTILIS] [DE:FERRIC UPTAKE
REGULATION PROTEIN HOMOLOG 2] [SP:P54574] [DB:swissprot] >pir:[LN:E69967] [AC:E69967 ]
[PN:transcription regulator Fur family homolog yqkL] [GN:yqkL ] [CL:ferric uptake
regulator] [OR:Bacillus subtilis] [DB:pir2] >gp:[GI:d1013328:g1303993] [LN:BACJH642]
[AC:D84432:D82370] [PN:YqkL] [OR:Bacillus subtilis] [SR:Bacillus subtilis
(strain:JH642(trpC2 PheA1)) DNA] [DB:genpept-bct1] [DE:Bacillus subtilis DNA, 283 Kb
region containing skin element.] [LE:269361] [RE:269810] [DI:direct]
>gp:[GI:e1185621:g2634787] [LN:BSUB0013] [AC:Z99116:AL009126] [GN:yqkL] [FN:unknown]
[OR:Bacillus subtilis] [DB:genpept-bct1] [DE:Bacillus subtilis complete genome (section
13 of 21): from 2395261to 2613730.] [NT:similar to transcriptional regulator (Fur
family)] [SP:P54574] [LE:53809] [RE:54258] [DI:complement]

| ORF Name | NTID | AAID | NT Length | AA Length | score | probability |
|---|---|---|---|---|---|---|
| AI7503000982_187593_c1_1074 | 259 | 4031 | 972 | 323 | 177 | 3.8e-12 |

Description sp:[LN:YPBB_BACSU] [AC:P50728] [GN:YPBB] [OR:BACILLUS SUBTILIS] [DE:HYPOTHETICAL 40.7
KD PROTEIN IN FER-RECQ INTERGENIC REGION] [SP:P50728] [DB:swissprot] >pir:[LN:F69932]
[AC:F69932 ] [PN:hypothetical protein ypbB] [GN:ypbB ] [OR:Bacillus subtilis] [DB:pir2]
>gp:[GI:e1183748:g2634721] [LN:BSUB0012] [AC:Z99115:AL009126] [GN:ypbB] [FN:unknown]
[OR:Bacillus subtilis] [DB:genpept-bct1] [DE:Bacillus subtilis complete genome (section
12 of 21): from 2195541to 2409220.] [SP:P50728] [LE:212099] [RE:213157] [DI:complement]
>gp:[GI:e1185572:g2634738] [LN:BSUB0013] [AC:Z99116:AL009126] [GN:ypbB] [FN:unknown]
[OR:Bacillus subtilis] [DB:genpept-bct1] [DE:Bacillus subtilis complete genome (section
13 of 21): from 2395261to 2613730.] [SP:P50728] [LE:12379] [RE:13437] [DI:complement]
>gp:[GI:g1146199] [LN:BACSERA] [AC:L47648] [GN:ypbB] [OR:Bacillus subtilis]
[DB:genpept-bct2] [DE:Bacillus subtilis phosphoglycerate dehydrogenase (serA),
ypaA,ferredoxin (fer), ypbB, recS, ypbD, ypbE, ypbF, ypbG, ypbH,glutamate dehydrogenase
(ypcA), ypdA, ypdB, ypdC, spore cortexlytic enzyme (sleB), ypeB, ypfA, ypfB, cytidine
monophosphatekinase (cmk), ypfD, ypgA, yphA, yphB, yphC, NAD+
dependentglycerol-3-phosphate dehydrogenase (glyc), yphE and yphF genes,complete cds.]
[NT:putative] [LE:3240] [RE:4298] [DI:direct]

| ORF Name | NTID | AAID | NT Length | AA Length | score | probability |
|---|---|---|---|---|---|---|
| AI7503000982_189203_c2_1199 | 260 | 4032 | 762 | 253 | 550 | 3.9e-53 |

Description sp:[LN:YQEU_BACSU] [AC:P54461] [GN:YQEU] [OR:BACILLUS SUBTILIS] [DE:HYPOTHETICAL 28.8
KD PROTEIN IN DNAJ-RPSU INTEREGENIC REGION] [SP:P54461] [DB:swissprot] >pir:[LN:D69952]
[AC:D69952 ] [PN:conserved hypothetical protein yqeU] [GN:yqeU ] [OR:Bacillus subtilis]
[DB:pir2] >gp:[GI:d1013146:g1303811] [LN:BACJH642] [AC:D84432:D82370] [PN:YqeU]
[OR:Bacillus subtilis] [SR:Bacillus subtilis (strain:JH642(trpC2 PheA1)) DNA]
[DB:genpept-bct1] [DE:Bacillus subtilis DNA, 283 Kb region containing skin element.]
[LE:95803] [RE:96573] [DI:direct] >gp:[GI:e1183774:g2634990] [LN:BSUB0014]
[AC:Z99117:AL009126] [GN:yqeU] [FN:unknown] [OR:Bacillus subtilis] [DB:genpept-bct1]
[DE:Bacillus subtilis complete genome (section 14 of 21): from 2599451to 2812870.]
[NT:similar to hypothetical proteins] [SP:P54461] [LE:22857] [RE:23627] [DI:complement]
>gp:[GI:d1012752:g1890060] [LN:D83717] [AC:D83717] [PN:YqeU] [OR:Bacillus subtilis]
[SR:Bacillus subtilis (strain:JH642 (trpC2 pheA1)) DNA] [DB:genpept-bct1] [DE:Bacillus
subtilis DNA for DnaJ, YqeT, YqeU, YqeV, YqeW, YqeX, YqeY,complete and partial cds.]
[NT:Similar to 26.9 kDa protein (YggJ) of E. coli] [LE:1334] [RE:2104] [DI:direct]

| ORF Name | NTID | AAID | NT Length | AA Length | score | probability |
|---|---|---|---|---|---|---|
| AI7503000982_19540931_c2_1191 | 261 | 4033 | 2220 | 739 | 647 | 2.0e-63 |

Description sp:[LN:CME3_BACSU] [AC:P39695] [GN:COMEC:COME3] [OR:BACILLUS SUBTILIS] [DE:COME OPERON PROTEIN 3] [SP:P39695] [DB:swissprot] >pir:[LN:S39865] [AC:S39865:E69602 ] [PN:late competence protein 3 (comE operon)] [GN:comEC ] [OR:Bacillus subtilis] [DB:pir2] >gp:[GI:g289262] [LN:BACCOME] [AC:L15202] [OR:Bacillus subtilis] [SR:Bacillus subtilis DNA] [DB:genpept-bct2] [DE:Bacillus subtilis comE operon encoding ORF1, ORF2, ORF3 andReverse-ORF genes, complete cds.] [LE:2603] [RE:4933] [DI:direct]

| ORF Name | NTID | AAID | NT Length | AA Length | score | probability |
|---|---|---|---|---|---|---|
| AI7503000982_19567588_c3_1496 | 262 | 4034 | 513 | 170 | 443 | 8.5e-42 |

Description sp:[LN:PTGA_BACST] [AC:P42015] [GN:PTSG] [OR:BACILLUS STEAROTHERMOPHILUS] [EC:2.7.1.69] [DE:COMPONENT), (EII-GLC / EIII-GLC) (FRAGMENT)] [SP:P42015] [DB:swissprot] >gp:[GI:g529001] [LN:BSU12340] [AC:U12340] [PN:PTS glucose-specific permease] [GN:ptsG'] [OR:Bacillus stearothermophilus] [DB:genpept-bct1] [DE:Bacillus stearothermophilus XL-65-6 phosphoenolpyruvate-dependentphosphotransferase system glucose-specific permease (ptsG') gene,partial cds, HPr (ptsH), enzyme I (ptsI), and PtsT (ptsT) genes,complete cds, and wall associated protein precursor (wapA') gene,complete cds.] [NT:thermophilic, cytoplasmic protein] [LE:<1] [RE:976] [DI:direct]

| ORF Name | NTID | AAID | NT Length | AA Length | score | probability |
|---|---|---|---|---|---|---|
| AI7503000982_19567812_c3_1495 | 263 | 4035 | 465 | 154 | 478 | 1.7e-45 |

Description sp:[LN:YPPQ_BACSU] [AC:P54155] [GN:YPPQ] [OR:BACILLUS SUBTILIS] [DE:HYPOTHETICAL 16.6 KD PROTEIN IN ILVA 3'REGION] [SP:P54155] [DB:swissprot] >pir:[LN:F69940] [AC:F69940 ] [PN:transcription regulator PilB family homolog yppQ] [GN:yppQ ] [CL:hypthetical protein YCL033c] [OR:Bacillus subtilis] [DB:pir2] >gp:[GI:g1256654] [LN:BACYACA] [AC:L77246] [GN:yppQ] [OR:Bacillus subtilis] [DB:genpept-bct1] [DE:Bacillus subtilis (YAC10-9 clone) DNA region between the serA andkdg loci.] [NT:54.8% identity with Neisseria gonorrhoeae] [LE:33923] [RE:34354] [DI:direct] >gp:[GI:e1183615:g2634588] [LN:BSUB0012] [AC:Z99115:AL009126] [GN:yppQ] [FN:unknown] [OR:Bacillus subtilis] [DB:genpept-bct1] [DE:Bacillus subtilis complete genome (section 12 of 21): from 2195541to 2409220.] [NT:similar to transcriptional regulator (PilB family)] [SP:P54155] [LE:90798] [RE:91229] [DI:complement]

| ORF Name | NTID | AAID | NT Length | AA Length | score | probability |
|---|---|---|---|---|---|---|
| AI7503000982_1960017_f3_809 | 264 | 4036 | 135 | 44 | | |

Description

NO-HIT

| ORF Name | NTID | AAID | NT Length | AA Length | score | probability |
|---|---|---|---|---|---|---|
| AI7503000982_19804838_f2_385 | 265 | 4037 | 717 | 238 | 549 | 5.0e-53 |

Description sp:[LN:YPDP_BACSU] [AC:P54163] [GN:YPDP] [OR:BACILLUS SUBTILIS] [DE:HYPOTHETICAL 25.7 KD PROTEIN IN BCSA-DEGR INTERGENIC REGION] [SP:P54163] [DB:swissprot] >pir:[LN:C69934] [AC:C69934 ] [PN:conserved hypothetical protein ypdP] [GN:ypdP ] [CL:Archaeoglobus fulgidus conserved hypothetical protein AF2110] [OR:Bacillus subtilis] [DB:pir2] >gp:[GI:g1256625] [LN:BACYACA] [AC:L77246] [GN:ypdP] [OR:Bacillus subtilis] [DB:genpept-bct1] [DE:Bacillus subtilis (YAC10-9 clone) DNA region between the serA andkdg loci.] [NT:putative] [LE:11031] [RE:11720] [DI:complement] >gp:[GI:e1183645:g2634618] [LN:BSUB0012] [AC:Z99115:AL009126] [GN:ypdP] [FN:unknown] [OR:Bacillus subtilis] [DB:genpept-bct1] [DE:Bacillus subtilis complete genome (section 12 of 21): from 2195541to 2409220.] [NT:similar to hypothetical proteins] [SP:P54163] [LE:113432] [RE:114121] [DI:direct]

| ORF Name | NTID | AAID | NT Length | AA Length | score | probability |
|---|---|---|---|---|---|---|
| AI7503000982_20006377_c3_1392 | 266 | 4038 | 732 | 243 | 432 | 1.2e-40 |

Description sp:[LN:YQFN_BACSU] [AC:P54471] [GN:YQFN] [OR:BACILLUS SUBTILIS] [DE:HYPOTHETICAL 23.7 KD PROTEIN IN CCCA-SODA INTERGENIC REGION] [SP:P54471] [DB:swissprot] >pir:[LN:H69953] [AC:H69953 ] [PN:conserved hypothetical protein yqfN] [GN:yqfN ] [OR:Bacillus subtilis] [DB:pir2] >gp:[GI:d1013170:g1303835] [LN:BACJH642] [AC:D84432:D82370] [PN:YqfN] [OR:Bacillus subtilis] [SR:Bacillus subtilis (strain:JH642(trpC2 PheA1)) DNA] [DB:genpept-bct1] [DE:Bacillus subtilis DNA, 283 Kb region containing skin element.] [LE:120338] [RE:120988] [DI:direct] >gp:[GI:e1185785:g2634951] [LN:BSUB0013] [AC:Z99116:AL009126] [GN:yqfN] [FN:unknown] [OR:Bacillus subtilis] [DB:genpept-bct1] [DE:Bacillus subtilis complete genome (section 13 of 21): from 2395261to 2613730.] [NT:similar to hypothetical proteins] [SP:P54471] [LE:202632] [RE:203282] [DI:complement]

| ORF Name | NTID | AAID | NT Length | AA Length | score | probability |
|---|---|---|---|---|---|---|
| AI7503000982_20035967_c1_1082 | 267 | 4039 | 1059 | 352 | 922 | 1.5e-92 |

Description pir:[LN:H69636] [AC:H69636 ] [PN:glycerol-3-phosphate dehydrogenase (NAD+), gpsA] [GN:gpsA ] [CL:glycerol-3-phosphate dehydrogenase] [OR:Bacillus subtilis] [EC:1.1.1.8] [DB:pir2] >gp:[GI:e1183728:g2634701] [LN:BSUB0012] [AC:Z99115:AL009126] [PN:NAD(P)H-dependent glycerol-3-phosphate] [GN:gpsA] [FN:synthesis of the sn-glycerol 3-phosphate] [OR:Bacillus subtilis] [DB:genpept-bct1] [EC:1.1.1.94] [DE:Bacillus subtilis complete genome (section 12 of 21): from 2195541to 2409220.] [SP:P46919] [LE:192848] [RE:193885] [DI:complement] >gp:[GI:g1146220] [LN:BACSERA] [AC:L47648] [PN:NAD+ dependent glycerol-3-phosphate] [GN:glyC] [OR:Bacillus subtilis] [DB:genpept-bct2] [EC:1.1.1.94] [DE:Bacillus subtilis phosphoglycerate dehydrogenase (serA), ypaA,ferredoxin (fer), ypbB, recS, ypbD, ypbE, ypbF, ypbG, ypbH,glutamate dehydrogenase (ypcA), ypdA, ypdB, ypdC, spore cortexlytic enzyme (sleB), ypeB, ypfA, ypfB, cytidine monophosphatekinase (cmk), ypfD, ypgA, yphA, yphB, yphC, NAD+ dependentglycerol-3-phosphate dehydrogenase (glyc), yphE and yphF genes,complete cds.] [LE:22512] [RE:23549] [DI:direct]

| ORF Name | NTID | AAID | NT Length | AA Length | score | probability |
|---|---|---|---|---|---|---|
| AI7503000982_20054642_f2_341 | 268 | 4040 | 138 | 45 | | |

Description

NO-HIT

| ORF_Name | NTID | AAID | NT Length | AA Length | score | probability |
|---|---|---|---|---|---|---|
| AI7503000982_2038325_f2_381 | 269 | 4041 | 180 | 59 | | |

Description
NO-HIT

| ORF_Name | NTID | AAID | NT Length | AA Length | score | probability |
|---|---|---|---|---|---|---|
| AI7503000982_20485712_c3_1498 | 270 | 4042 | 573 | 190 | | |

Description
NO-HIT

| ORF_Name | NTID | AAID | NT Length | AA Length | score | probability |
|---|---|---|---|---|---|---|
| AI7503000982_20503437_c3_1456 | 271 | 4043 | 123 | 40 | | |

Description
NO-HIT

| ORF_Name | NTID | AAID | NT Length | AA Length | score | probability |
|---|---|---|---|---|---|---|
| AI7503000982_20507937_c2_1280 | 272 | 4044 | 1317 | 438 | 1823 | 4.9e-188 |

Description
sp:[LN:SYN_BACSU] [AC:P39772] [GN:ASNS] [OR:BACILLUS SUBTILIS] [EC:6.1.1.22]
[DE:(ASNRS)] [SP:P39772] [DB:swissprot] >pir:[LN:B69591] [AC:B69591:I40523 ]
[PN:asparagine--tRNA ligase, asnS:asparaginyl-tRNA synthetase asnS] [GN:asnS ]
[CL:lysine--tRNA ligase] [OR:Bacillus subtilis] [EC:6.1.1.22] [DB:pir2]
>gp:[GI:g1146247] [LN:BACYPIA] [AC:L47709] [PN:asparaginyl-tRNA synthetase] [GN:asnS]
[OR:Bacillus subtilis] [DB:genpept-bct1] [EC:6.1.1.22] [DE:Bacillus subtilis (clone
YAC15-6B) ypiABF genes, qcrABC genes,ypjABCDEFGHI genes, birA gene, panBCD genes, dinG
gene, ypmB gene,aspB gene, asnS gene, dnaD gene, nth gene and ypoC gene,
completecds's.] [NT:41.1% of identity to the Escherichia coli] [LE:20449] [RE:21741]
[DI:direct] >gp:[GI:e1183681:g2634654] [LN:BSUB0012] [AC:Z99115:AL009126]
[PN:asparaginyl-tRNA synthetase] [GN:asnS] [OR:Bacillus subtilis] [DB:genpept-bct1]
[EC:6.1.1.22] [DE:Bacillus subtilis complete genome (section 12 of 21): from 2195541to
2409220.] [SP:P39772] [LE:149926] [RE:151218] [DI:complement]

| ORF Name | NTID | AAID | NT Length | AA Length | score | probability |
|---|---|---|---|---|---|---|
| AI7503000982_20517135_c3_1457 | 273 | 4045 | 315 | 104 | 361 | 4.1e-33 |

Description sp:[LN:DBH_BACST] [AC:P02346:P08822] [GN:HBS:HBSU] [OR:BACILLUS
STEAROTHERMOPHILUS:BACILLUS CALDOLYTICUS:BACILLUS CALDOTENAX] [DE:DNA-BINDING PROTEIN
II (HB) (HU)] [SP:P02346:P08822] [DB:swissprot] >pir:[LN:DNBS2F]
[AC:JC1205:A02690:JC2509 ] [PN:DNA-binding protein HU:DNA-binding protein II] [GN:hup ]
[CL:bacterial DNA-binding protein] [OR:Bacillus stearothermophilus] [DB:pir1]
>pir:[LN:JC1207] [AC:JC1207 ] [PN:DNA-binding protein HU] [GN:hup ] [CL:bacterial
DNA-binding protein] [OR:Bacillus caldolyticus] [DB:pir2] >pir:[LN:JC1206] [AC:JC1206 ]
[PN:DNA-binding protein HU] [GN:hup ] [CL:bacterial DNA-binding protein] [OR:Bacillus
caldotenax] [DB:pir2] >gp:[GI:d1007851:g1065992] [LN:BACDBPHU] [AC:D38080] [PN:DNA
binding protein HU] [OR:Bacillus stearothermophilus] [SR:Bacillus stearothermophilus
(strain:1503) DNA] [DB:genpept-bct1] [DE:Bacillus stearothermophilus gene for DNA
binding protein HU,complete cds.] [LE:13] [RE:285] [DI:direct] >gp:[GI:g143065]
[LN:BACHUB1] [AC:M73500] [PN:hubst] [GN:hubst] [OR:Bacillus stearothermophilus]
[SR:Bacillus stearothermophilus DNA] [DB:genpept-bct1] [DE:B.stearothermophilus hubst
gene, complete cds.] [LE:1] [RE:>270] [DI:direct] >gp:[GI:g143067] [LN:BACHUB2]
[AC:M73501] [PN:hubcalx] [GN:hubcalx] [OR:Bacillus caldotenax] [SR:Bacillus caldotenax
DNA] [DB:genpept-bct1] [DE:B.caldotenax hubcalx gene, 5' end.] [LE:1] [RE:>270]
[DI:direct] >gp:[GI:g143069] [LN:BACHUB3] [AC:M73502] [PN:hubcald] [GN:hubcald]
[OR:Bacillus caldolyticus] [SR:Bacillus caldolyticus DNA] [DB:genpept-bct1]
[DE:B.caldolyticus hubcald gene, 5' end.] [LE:1] [RE:>270] [DI:direct]

| ORF Name | NTID | AAID | NT Length | AA Length | score | probability |
|---|---|---|---|---|---|---|
| AI7503000982_20587536_f1_4 | 274 | 4046 | 630 | 209 | 241 | 2.2e-20 |

Description sp:[LN:XPAC_BACSU] [AC:P37467] [GN:XPAC] [OR:BACILLUS SUBTILIS] [DE:XPAC PROTEIN]
[SP:P37467] [DB:swissprot] >pir:[LN:S27526] [AC:S27526:S66055:C69734 ]
[PN:5-bromo-4-chloroindolyl phosphate hydrolysis protein xpaC:xpaC protein] [GN:xpaC ]
[OR:Bacillus subtilis] [DB:pir2] >gp:[GI:d1005803:g467415] [LN:BAC180K] [AC:D26185]
[PN:hydrolysis of 5-bromo-4-chloroindolyl phosphate] [GN:xpaC] [OR:Bacillus subtilis]
[SR:Bacillus subtilis (sub_species:Marburg, strain:168) DNA] [DB:genpept-bct1] [DE:B.
subtilis DNA, 180 kilobase region of replication origin.] [LE:99445] [RE:100059]
[DI:direct] >gp:[GI:g143830] [LN:BACXPAC] [AC:M96156] [GN:xpaC] [OR:Bacillus subtilis]
[SR:Bacillus subtilis (strain W168) DNA] [DB:genpept-bct1] [DE:Bacillus subtilis ORF1
and xpaC gene, complete cds's; ssrRNA gene,3' end; ORF3C 5' end.] [LE:532] [RE:1146]
[DI:direct] >gp:[GI:e1181958:g2632292] [LN:BSUB0001] [AC:Z99104:AL009126] [GN:xpaC]
[FN:hydrolysis of 5-bromo 4-chloroindolyl phosphate] [OR:Bacillus subtilis]
[DB:genpept-bct1] [DE:Bacillus subtilis complete genome (section 1 of 21): from 1
to213080.] [SP:P37467] [LE:35843] [RE:36457] [DI:direct]

| ORF Name | NTID | AAID | NT Length | AA Length | score | probability |
|---|---|---|---|---|---|---|
| AI7503000982_20594688_c2_1331 | 275 | 4047 | 1725 | 574 | 126 | 6.2e-08 |

Description sp:[LN:LPLA_BACSU] [AC:P37966] [GN:LPLA] [OR:BACILLUS SUBTILIS] [DE:LIPOPROTEIN LPLA
PRECURSOR] [SP:P37966] [DB:swissprot] >pir:[LN:I39876] [AC:I39876:H69652 ]
[PN:lipoprotein lplA:lysis protein lplA] [GN:lplA ] [CL:Bacillus subtilis lipoprotein
lplA] [OR:Bacillus subtilis] [DB:pir2] >gp:[GI:e1182689:g2633023] [LN:BSUB0004]
[AC:Z99107:AL009126] [PN:lipoprotein] [GN:lplA] [OR:Bacillus subtilis]
[DB:genpept-bct1] [DE:Bacillus subtilis complete genome (section 4 of 21): from 600701
to813890.] [SP:P37966] [LE:178337] [RE:179845] [DI:direct] >gp:[GI:g431272]
[LN:BACLPLA] [AC:L03376] [PN:lysis protein] [GN:lplA] [OR:Bacillus subtilis]
[SR:Bacillus subtilis (strain Marburg 168) DNA] [DB:genpept-bct2] [DE:Bacillus subtilis
lysis protein (lplA) gene, complete cds.] [LE:482] [RE:1990] [DI:direct]

| ORF Name | NTID | AAID | NT Length | AA Length | score | probability |
|---|---|---|---|---|---|---|
| AI7503000982_20734677_c1_1135 | 276 | 4048 | 774 | 257 | 297 | 2.5e-26 |

Description
gp:[GI:g4981613] [LN:AE001767] [AC:AE001767:AE000512] [PN:transcriptional regulator, DeoR family] [GN:TM1069] [OR:Thermotoga maritima] [DB:genpept-bct2] [DE:Thermotoga maritima section 79 of 136 of the complete genome.] [NT:similar to GB:AL009126 percent identity: 55.02;] [LE:1578] [RE:2336] [DI:complement]

| ORF Name | NTID | AAID | NT Length | AA Length | score | probability |
|---|---|---|---|---|---|---|
| AI7503000982_20791068_c3_1370 | 277 | 4049 | 273 | 90 | 71 | 0.041 |

Description
gp:[GI:g294060] [LN:PAPMPL146A] [AC:L06467] [PN:major latex protein] [GN:MLP146] [OR:Papaver somniferum] [SR:Papaver somniferum (strain UNL186) (library: EMBL) DNA] [DB:genpept-pln1] [DE:Papaver somniferum major latex protein (MLP146) gene, complete cds.] [LE:963:1290] [RE:1167:1564] [DI:directJoin]

| ORF Name | NTID | AAID | NT Length | AA Length | score | probability |
|---|---|---|---|---|---|---|
| AI7503000982_20876263_f1_159 | 278 | 4050 | 171 | 56 | | |

Description
NO-HIT

| ORF Name | NTID | AAID | NT Length | AA Length | score | probability |
|---|---|---|---|---|---|---|
| AI7503000982_2148387_c1_1089 | 279 | 4051 | 1278 | 425 | 1794 | 5.8e-185 |

Description
sp:[LN:AROC_STAAU] [AC:Q59803] [GN:AROC] [OR:STAPHYLOCOCCUS AUREUS] [EC:4.6.1.4] [DE:PHOSPHOLYASE)] [SP:Q59803] [DB:swissprot] >gp:[GI:g987498] [LN:SAU31979] [AC:U31979] [PN:chorismate synthase] [GN:aroC] [OR:Staphylococcus aureus] [DB:genpept-bct1] [EC:4.6.1.4] [DE:Staphylococcus aureus chorismate synthase (aroC) and nucleosidediphosphate kinase (ndk) genes, complete cds, dehydroauinatesynthase (aroB) and geranylgeranyl pyrophosphate synthetase homolog(gerCC) genes, partial cds.] [NT:5-enolpyruvylshikimate 3-phosphate phospho-lyase] [LE:1142] [RE:2308] [DI:direct]

| ORF Name | NTID | AAID | NT Length | AA Length | score | probability |
|---|---|---|---|---|---|---|
| AI7503000982_21501550_c1_1127 | 280 | 4052 | 1116 | 371 | 999 | 1.0e-100 |

Description
gp:[GI:g3688811] [LN:AF084104] [AC:AF084104] [PN:maltose transportor ATP-binding protein] [GN:malK] [OR:Bacillus firmus] [DB:genpept-bct2] [DE:Bacillus firmus AcsA (acsA) gene, partial cds; SspA (sspA),hypothetical protein, maltose transportor ATP-binding protein(malK), leucine-rich protein transcriptional regulator (lrpR),hypothetical proteins, ABC transporter ATP-binding protein (natC),NatA (natA), NatB (natB), and hypothetical protein genes, completecds; and SpoIIIJ (spoIIIJ) gene, partial cds.] [NT:MalK; Orf4; similar to MsmX from Bacillus subtilis,] [LE:2390] [RE:3490] [DI:complement]

| ORF Name | NTID | AAID | NT Length | AA Length | score | probability |
|---|---|---|---|---|---|---|
| AI7503000982_21526562_c2_1206 | 281 | 4053 | 138 | 45 | | |

Description
NO-HIT

| ORF_Name | NTID | AAID | NT Length | AA Length | score | probability |
|---|---|---|---|---|---|---|
| AI7503000982_21531627_c3_1483 | 282 | 4054 | 132 | 43 | | |

Description
NO-HIT

| ORF_Name | NTID | AAID | NT Length | AA Length | score | probability |
|---|---|---|---|---|---|---|
| AI7503000982_21537962_c1_1093 | 283 | 4055 | 612 | 203 | 357 | 1.1e-32 |

Description
sp:[LN:YPJA_BACSU] [AC:P54392] [GN:YPJA] [OR:BACILLUS SUBTILIS] [DE:HYPOTHETICAL 21.3
KD PROTEIN IN QCRC-DAPB INTERGENIC REGION] [SP:P54392] [DB:swissprot] >pir:[LN:A69937]
[AC:A69937 ] [PN:hypothetical protein ypjA] [GN:ypjA ] [OR:Bacillus subtilis] [DB:pir2]
>gp:[GI:g1146230] [LN:BACYPIA] [AC:L47709] [GN:ypjA] [FN:hypothetical] [OR:Bacillus
subtilis] [DB:genpept-bct1] [DE:Bacillus subtilis (clone YAC15-6B) ypiABF genes, qcrABC
genes,ypjABCDEFGHI genes, birA gene, panBCD genes, dinG gene, ypmB gene,aspB gene, asnS
gene, dnaD gene, nth gene and ypoC gene, completecds's.] [NT:putative] [LE:5002]
[RE:5559] [DI:direct] >gp:[GI:e1183698:g2634671] [LN:BSUB0012] [AC:Z99115:AL009126]
[GN:ypjA] [FN:unknown] [OR:Bacillus subtilis] [DB:genpept-bct1] [DE:Bacillus subtilis
complete genome (section 12 of 21): from 2195541to 2409220.] [SP:P54392] [LE:166108]
[RE:166665] [DI:complement]

| ORF_Name | NTID | AAID | NT Length | AA Length | score | probability |
|---|---|---|---|---|---|---|
| AI7503000982_21568762_c1_1013 | 284 | 4056 | 1005 | 334 | 992 | 5.6e-100 |

Description
gp:[GI:e1356351:g3947511] [LN:BMAJ4829] [AC:AJ224829] [GN:ORF4] [OR:Bacillus
megaterium] [DB:genpept-bct1] [DE:Bacillus megaterium DSM319 spoIV operon, 5' flanking
region, 3'flanking region.] [LE:3056] [RE:4030] [DI:direct]

| ORF_Name | NTID | AAID | NT Length | AA Length | score | probability |
|---|---|---|---|---|---|---|
| AI7503000982_21600325_f1_228 | 285 | 4057 | 141 | 46 | | |

Description
NO-HIT

| ORF_Name | NTID | AAID | NT Length | AA Length | score | probability |
|---|---|---|---|---|---|---|
| AI7503000982_21640636_f1_136 | 286 | 4058 | 276 | 91 | 366 | 1.2e-33 |

Description
pir:[LN:D69621] [AC:D69621 ] [PN:ferredoxin fer] [GN:fer ] [CL:ferredoxin
2[4Fe-4S]:ferredoxin 2[4Fe-4S] homology] [OR:Bacillus subtilis] [DB:pir2]
>gp:[GI:e1183749:g2634722] [LN:BSUB0012] [AC:Z99115:AL009126] [PN:ferredoxin] [GN:fer]
[OR:Bacillus subtilis] [DB:genpept-bct1] [DE:Bacillus subtilis complete genome (section
12 of 21): from 2195541to 2409220.] [NT:alternate gene name: ypbA] [SP:P50727]
[LE:213423] [RE:213671] [DI:direct] >gp:[GI:e1185573:g2634739] [LN:BSUB0013]
[AC:Z99116:AL009126] [PN:ferredoxin] [GN:fer] [OR:Bacillus subtilis] [DB:genpept-bct1]
[DE:Bacillus subtilis complete genome (section 13 of 21): from 2395261to 2613730.]
[NT:alternate gene name: ypbA] [SP:P50727] [LE:13703] [RE:13951] [DI:direct]
>gp:[GI:g1146198] [LN:BACSERA] [AC:L47648] [PN:ferredoxin] [GN:fer] [OR:Bacillus
subtilis] [DB:genpept-bct2] [DE:Bacillus subtilis phosphoglycerate dehydrogenase
(serA), ypaA,ferredoxin (fer), ypbB, recS, ypbD, ypbE, ypbF, ypbG, ypbH,glutamate
dehydrogenase (ypcA), ypdA, ypdB, ypdC, spore cortexlytic enzyme (sleB), ypeB, ypfA,
ypfB, cytidine monophosphatekinase (cmk), ypfD, ypgA, yphA, yphB, yphC, NAD+
dependentglycerol-3-phosphate dehydrogenase (glyc), yphE and yphF genes,complete cds.]
[NT:ypbA; similar to B.stearothermophilus ferredoxin;] [LE:2726] [RE:2974]
[DI:complement]

| ORF_Name | NTID | AAID | NT Length | AA Length | score | probability |
|---|---|---|---|---|---|---|
| AI7503000982_21667676_c1_975 | 287 | 4059 | 888 | 295 | 590 | 2.2e-57 |

Description pir:[LN:C69981] [AC:C69981 ] [PN:conserved hypothetical protein yrvM] [GN:yrvM ]
[OR:Bacillus subtilis] [DB:pir2] >gp:[GI:e1184002:g2635218] [LN:BSUB0015]
[AC:Z99118:AL009126] [GN:yrvM] [FN:unknown] [OR:Bacillus subtilis] [DB:genpept-bct1]
[DE:Bacillus subtilis complete genome (section 15 of 21): from 2795131to 3013540.]
[NT:similar to hypothetical proteins] [LE:17779] [RE:18264] [DI:complement]

| ORF_Name | NTID | AAID | NT Length | AA Length | score | probability |
|---|---|---|---|---|---|---|
| AI7503000982_21674067_f1_8 | 288 | 4060 | 198 | 65 | | |

Description

NO-HIT

| ORF_Name | NTID | AAID | NT Length | AA Length | score | probability |
|---|---|---|---|---|---|---|
| AI7503000982_21678187_c3_1486 | 289 | 4061 | 240 | 79 | | |

Description

NO-HIT

| ORF_Name | NTID | AAID | NT Length | AA Length | score | probability |
|---|---|---|---|---|---|---|
| AI7503000982_21730443_c1_1055 | 290 | 4062 | 1332 | 443 | 904 | 1.2e-90 |

Description sp:[LN:ODB2_BACSU] [AC:P37942] [GN:BFMBB:BFMB2:BFMB] [OR:BACILLUS SUBTILIS]
[EC:2.3.1.-] [DE:CHAIN TRANSACYLASE)] [SP:P37942] [DB:swissprot] >pir:[LN:S32488]
[AC:S32488:E69593 ] [PN:dihydrolipoamide S-acyltransferase,, alpha-oxo acid
dehydrogenase complex (bfmBB):branched-chain alpha-oxo acid dehydrogenase complex E2
component:dihydrolipoyl acyltransferase] [GN:bfmBB ] [CL:dihydrolipoamide
acetyltransferase: lipoyl/biotin-binding homology] [OR:Bacillus subtilis] [EC:2.3.1.-]
[DB:pir2] >gp:[GI:g142613] [LN:BACBRANCH] [AC:M97391:M96937] [PN:branched chain
alpha-keto acid dehydrogenase E2] [OR:Bacillus subtilis] [SR:Bacillus subtilis DNA]
[DB:genpept-bct1] [DE:Bacillus subtilis branched chain alpha-keto acid
dehydrogenaseE1-alpha, branched chain alpha-keto acid dehydrogenase E1-beta,
andbranched chain alpha-keto acid dehydrogenase E2, complete cds.] [LE:2228] [RE:3502]
[DI:direct] >gp:[GI:d1013279:g1303944] [LN:BACJH642] [AC:D84432:D82370] [PN:BfmBB]
[OR:Bacillus subtilis] [SR:Bacillus subtilis (strain:JH642(trpC2 PheA1)) DNA]
[DB:genpept-bct1] [DE:Bacillus subtilis DNA, 283 Kb region containing skin element.]
[LE:221574] [RE:222848] [DI:direct] >gp:[GI:e1185671:g2634837] [LN:BSUB0013]
[AC:Z99116:AL009126] [PN:branched-chain alpha-keto acid dehydrogenase E2] [GN:bfmBB]
[OR:Bacillus subtilis] [DB:genpept-bct1] [EC:2.3.1.-] [DE:Bacillus subtilis complete
genome (section 13 of 21): from 2395261to 2613730.] [NT:alternate gene name: bfmB2]
[SP:P37942] [LE:100771] [RE:102045] [DI:complement]

| ORF Name | NTID | AAID | NT Length | AA Length | score | probability |
|---|---|---|---|---|---|---|
| AI7503000982_21756562_c2_1289 | 291 | 4063 | 696 | 231 | 162 | 5.1e-12 |

Description pir:[LN:G69828] [AC:G69828 ] [PN:calcium-binding protein homolog yheG] [GN:yheG ]
[OR:Bacillus subtilis] [DB:pir2] >gp:[GI:e1182974:g2633308] [LN:BSUB0006]
[AC:Z99109:AL009126] [GN:yheG] [FN:unknown] [OR:Bacillus subtilis] [DB:genpept-bct1]
[DE:Bacillus subtilis complete genome (section 6 of 21): from 999501 to1209940.]
[NT:similar to calcium-binding protein] [LE:49122] [RE:49742] [DI:complement]
>gp:[GI:e325187:g2226164] [LN:BSY14080] [AC:Y14080] [PN:hypothetical protein] [GN:yheG]
[OR:Bacillus subtilis] [DB:genpept-bct1] [DE:Bacillus subtilis chromosomal DNA, region
75 degrees: sspB upstreamof glyB.] [NT:similarity to bovine flavin reductase (PID =]
[LE:11988] [RE:12608] [DI:direct]

| ORF Name | NTID | AAID | NT Length | AA Length | score | probability |
|---|---|---|---|---|---|---|
| AI7503000982_21759427_c3_1407 | 292 | 4064 | 1350 | 449 | 1396 | 8.7e-143 |

Description sp:[LN:GCS1_BACSU] [AC:P54376] [GN:YQHJ] [OR:BACILLUS SUBTILIS] [EC:1.4.4.2]
[DE:PROTEIN)] [SP:P54376] [DB:swissprot] >pir:[LN:A69959] [AC:A69959 ] [PN:glycine
dehydrogenase homolog yqhJ] [GN:yqhJ ] [OR:Bacillus subtilis] [DB:pir2]
>gp:[GI:d1013226:g1303891] [LN:BACJH642] [AC:D84432:D82370] [PN:YqhJ] [OR:Bacillus
subtilis] [SR:Bacillus subtilis (strain:JH642(trpC2 PheA1)) DNA] [DB:genpept-bct1]
[DE:Bacillus subtilis DNA, 283 Kb region containing skin element.] [LE:171390]
[RE:172736] [DI:direct] >gp:[GI:e1185724:g2634890] [LN:BSUB0013] [AC:Z99116:AL009126]
[GN:yqhJ] [FN:unknown] [OR:Bacillus subtilis] [DB:genpept-bct1] [DE:Bacillus subtilis
complete genome (section 13 of 21): from 2395261to 2613730.] [NT:similar to glycine
dehydrogenase] [SP:P54376] [LE:150885] [RE:152231] [DI:complement]

| ORF Name | NTID | AAID | NT Length | AA Length | score | probability |
|---|---|---|---|---|---|---|
| AI7503000982_21914067_c3_1512 | 293 | 4065 | 1416 | 471 | 532 | 3.1e-51 |

Description gp:[GI:g2182835] [LN:LLU81166] [AC:U81166] [PN:histidine kinase LlkinA] [GN:llkinA]
[OR:Lactococcus lactis subsp. cremoris] [DB:genpept-bct2] [DE:Lactococcus lactis subsp.
cremoris MG1363 histidine kinase (llkinA)gene, complete cds.] [LE:1] [RE:1473]
[DI:direct]

| ORF Name | NTID | AAID | NT Length | AA Length | score | probability |
|---|---|---|---|---|---|---|
| AI7503000982_2195307_c3_1402 | 294 | 4066 | 1095 | 364 | 348 | 9.9e-32 |

Description sp:[LN:CMG2_BACSU] [AC:P25954] [GN:COMGB:COMG2] [OR:BACILLUS SUBTILIS] [DE:COMG OPERON
PROTEIN 2] [SP:P25954] [DB:swissprot] >pir:[LN:C30338] [AC:C30338:C69603 ] [PN:DNA
transport machinery protein comGB:comG operon protein 2] [GN:comGB ] [OR:Bacillus
subtilis] [DB:pir2] >gp:[GI:g142707] [LN:BACCOMGA] [AC:M29691:M22854] [GN:comG2]
[OR:Bacillus subtilis] [SR:Bacillus subtilis (strain 168) (clone: pED4) DNA]
[DB:genpept-bct1] [DE:Bacillus subtilis (clone pED4) comG-(1,2,3,4,5,6,and 7) proteins
incomG operon, complete cds.] [LE:2420] [RE:3391] [DI:direct]
>gp:[GI:d1013213:g1303878] [LN:BACJH642] [AC:D84432:D82370] [PN:ComGB] [OR:Bacillus
subtilis] [SR:Bacillus subtilis (strain:JH642(trpC2 PheA1)) DNA] [DB:genpept-bct1]
[DE:Bacillus subtilis DNA, 283 Kb region containing skin element.] [LE:160650]
[RE:161621] [DI:direct] >gp:[GI:e1185740:g2634906] [LN:BSUB0013] [AC:Z99116:AL009126]
[PN:probably part of the DNA transport machinery] [GN:comGB] [FN:competence]
[OR:Bacillus subtilis] [DB:genpept-bct1] [DE:Bacillus subtilis complete genome (section
13 of 21): from 2395261to 2613730.] [SP:P25954] [LE:162000] [RE:162971] [DI:complement]

| ORF Name | NTID | AAID | NT Length | AA Length | score | probability |
|---|---|---|---|---|---|---|
| AI7503000982_21962762_c1_1139 | 295 | 4067 | 732 | 243 | 615 | 5.0e-60 |

Description
gp:[GI:g143267] [LN:BACODHAB] [AC:M27141] [OR:Bacillus subtilis] [SR:B.subtilis (strain 3G18) DNA] [DB:genpept-bct1] [DE:B.subtilis 2-oxoglutarate dehydrogenase (odhA) gene 3' end, anddihydrolipoamide transsuccinylase (odhB) gene, complete cds.] [NT:2-oxoglutarate dehydrogenase (odhA; EC 1.2.4.2)] [LE:<1] [RE:883] [DI:direct]

| ORF Name | NTID | AAID | NT Length | AA Length | score | probability |
|---|---|---|---|---|---|---|
| AI7503000982_22031307_f3_906 | 296 | 4068 | 150 | 49 | | |

Description
NO-HIT

| ORF Name | NTID | AAID | NT Length | AA Length | score | probability |
|---|---|---|---|---|---|---|
| AI7503000982_2227312_c1_974 | 297 | 4069 | 1782 | 593 | 2019 | 8.4e-209 |

Description
sp:[LN:SYD_BACSU] [AC:O32038] [GN:ASPS] [OR:BACILLUS SUBTILIS] [EC:6.1.1.12] [DE:(ASPRS)] [SP:O32038] [DB:swissprot] >pir:[LN:D69591] [AC:D69591 ] [PN:aspartate--tRNA ligase, aspS:aspartyl-tRNA synthetase] [GN:aspS ] [CL:lysine--tRNA ligase] [OR:Bacillus subtilis] [EC:6.1.1.12] [DB:pir2] >gp:[GI:e1184003:g2635219] [LN:BSUB0015] [AC:Z99118:AL009126] [PN:aspartyl-tRNA synthetase] [GN:aspS] [OR:Bacillus subtilis] [DB:genpept-bct1] [EC:6.1.1.12] [DE:Bacillus subtilis complete genome (section 15 of 21): from 2795131to 3013540.] [SP:O32038] [LE:18878] [RE:20656] [DI:complement]

| ORF Name | NTID | AAID | NT Length | AA Length | score | probability |
|---|---|---|---|---|---|---|
| AI7503000982_22459462_c2_1275 | 298 | 4070 | 138 | 45 | | |

Description
NO-HIT

| ORF Name | NTID | AAID | NT Length | AA Length | score | probability |
|---|---|---|---|---|---|---|
| AI7503000982_22661088_c3_1363 | 299 | 4071 | 150 | 49 | | |

Description
NO-HIT

| ORF Name | NTID | AAID | NT Length | AA Length | score | probability |
|---|---|---|---|---|---|---|
| AI7503000982_23392_f2_366 | 300 | 4072 | 147 | 48 | | |

Description
NO-HIT

| ORF Name | NTID | AAID | NT Length | AA Length | score | probability |
|---|---|---|---|---|---|---|
| AI7503000982_23445266_c1_1120 | 301 | 4073 | 567 | 188 | 579 | 3.3e-56 |

Description
sp:[LN:PMSR_BACSU] [AC:P54154] [GN:YPPP] [OR:BACILLUS SUBTILIS] [DE:REDUCTASE)]
[SP:P54154] [DB:swissprot] >pir:[LN:E69940] [AC:E69940 ] [PN:peptide methionine
sulfoxide reductase homolog yppP] [GN:yppP ] [CL:peptide methionine sulfoxide
reductase] [OR:Bacillus subtilis] [DB:pir2] >gp:[GI:g1256653] [LN:BACYACA] [AC:L77246]
[PN:DNA-binding protein] [GN:yppP] [OR:Bacillus subtilis] [DB:genpept-bct1]
[DE:Bacillus subtilis (YAC10-9 clone) DNA region between the serA andkdg loci.]
[NT:42.4% identity with the Lycopersicon esculentum] [LE:33389] [RE:33922] [DI:direct]
>gp:[GI:e1183616:g2634589] [LN:BSUB0012] [AC:Z99115:AL009126] [GN:yppP] [FN:unknown]
[OR:Bacillus subtilis] [DB:genpept-bct1] [DE:Bacillus subtilis complete genome (section
12 of 21): from 2195541to 2409220.] [NT:similar to peptide methionine sulfoxide
reductase] [SP:P54154] [LE:91230] [RE:91763] [DI:complement]

| ORF Name | NTID | AAID | NT Length | AA Length | score | probability |
|---|---|---|---|---|---|---|
| AI7503000982_23445762_c3_1397 | 302 | 4074 | 144 | 47 | | |

Description
NO-HIT

| ORF Name | NTID | AAID | NT Length | AA Length | score | probability |
|---|---|---|---|---|---|---|
| AI7503000982_23468938_f1_258 | 303 | 4075 | 168 | 55 | | |

Description
NO-HIT

| ORF Name | NTID | AAID | NT Length | AA Length | score | probability |
|---|---|---|---|---|---|---|
| AI7503000982_23470327_c2_1225 | 304 | 4076 | 1461 | 486 | 446 | 4.1e-42 |

Description
pir:[LN:S52351] [AC:S52351 ] [PN:hypothetical protein 1] [OR:Staphylococcus xylosus]
[DB:pir2] >gp:[GI:g666115] [LN:SXGKG2] [AC:X84332] [GN:ug1] [OR:Staphylococcus xylosus]
[DB:genpept-bct1] [DE:S.xylosus glucose kinase gene.] [NT:orf1 upstream of glucose
kinase] [LE:<1] [RE:406] [DI:direct]

| ORF Name | NTID | AAID | NT Length | AA Length | score | probability |
|---|---|---|---|---|---|---|
| AI7503000982_23470452_c2_1183 | 305 | 4077 | 441 | 146 | 214 | 1.6e-17 |

Description
pir:[LN:F71860] [AC:F71860 ] [PN:biotin carboxyl carrier protein] [GN:accB ] [CL:biotin
carboxyl carrier protein: lipoyl/biotin-binding homology] [OR:Helicobacter pylori]
[SR:strain J99, , strain J99] [SR:strain J99, ] [DB:pir2] >gp:[GI:g4155592]
[LN:AE001529] [AC:AE001529:AE001439] [PN:BIOTIN CARBOXYL CARRIER PROTEIN] [GN:accB]
[OR:Helicobacter pylori J99] [DB:genpept-bct2] [DE:Helicobacter pylori, strain J99
section 90 of 132 of the completegenome.] [NT:similar to H. pylori 26695 gene HP0371]
[LE:5447] [RE:5932] [DI:direct]

| ORF Name | NTID | AAID | NT Length | AA Length | score | probability |
|---|---|---|---|---|---|---|
| AI7503000982_23476676_c2_1204 | 306 | 4078 | 369 | 122 | 227 | 6.6e-19 |

Description
gp:[GI:g902055] [LN:BSU29177] [AC:U29177] [PN:diacylglycerol kinase] [GN:dgk]
[OR:Bacillus subtilis] [DB:genpept-bct1] [DE:Bacillus subtilis PhoH (phoH) gene,
partial cds, diacylglycerolkinase (dgk) gene, complete cds, and cytidine deaminase
(cdd) gene,partial cds.] [LE:2793] [RE:3197] [DI:direct]

| ORF Name | NTID | AAID | NT Length | AA Length | score | probability |
|---|---|---|---|---|---|---|
| AI7503000982_23595137_c2_1185 | 307 | 4079 | 558 | 185 | 522 | 3.6e-50 |

Description
sp:[LN:YQEG_BACSU] [AC:P54452] [GN:YQEG] [OR:BACILLUS SUBTILIS] [DE:HYPOTHETICAL 20.1 KD PROTEIN IN NUCB-AROD INTERGENIC REGION] [SP:P54452] [DB:swissprot] >pir:[LN:C69951] [AC:C69951 ] [PN:conserved hypothetical protein yqeG] [GN:yqeG ] [OR:Bacillus subtilis] [DB:pir2] >gp:[GI:d1013122:g1303787] [LN:BACJH642] [AC:D84432:D82370] [PN:YqeG] [OR:Bacillus subtilis] [SR:Bacillus subtilis (strain:JH642(trpC2 PheA1)) DNA] [DB:genpept-bct1] [DE:Bacillus subtilis DNA, 283 Kb region containing skin element.] [LE:72502] [RE:73020] [DI:direct] >gp:[GI:e1183798:g2635014] [LN:BSUB0014] [AC:Z99117:AL009126] [GN:yqeG] [FN:unknown] [OR:Bacillus subtilis] [DB:genpept-bct1] [DE:Bacillus subtilis complete genome (section 14 of 21): from 2599451to 2812870.] [NT:similar to hypothetical proteins] [SP:P54452] [LE:46410] [RE:46928] [DI:complement]

| ORF Name | NTID | AAID | NT Length | AA Length | score | probability |
|---|---|---|---|---|---|---|
| AI7503000982_23597252_f2_557 | 308 | 4080 | 168 | 55 | | |

Description
NO-HIT

| ORF Name | NTID | AAID | NT Length | AA Length | score | probability |
|---|---|---|---|---|---|---|
| AI7503000982_23620205_f2_640 | 309 | 4081 | 138 | 45 | | |

Description
NO-HIT

| ORF Name | NTID | AAID | NT Length | AA Length | score | probability |
|---|---|---|---|---|---|---|
| AI7503000982_23625000_c2_1246 | 310 | 4082 | 1683 | 560 | 2374 | 2.0e-246 |

Description
pir:[LN:S44188] [AC:S44188 ] [PN:alpha-glucosidase,] [CL:alpha-glucosidase:alpha-amylase core homology] [OR:Staphylococcus xylosus] [EC:3.2.1.20] [DB:pir2] >gp:[GI:g474177] [LN:SXMALRAG] [AC:X78853] [PN:alpha-D-1,4-glucosidase] [GN:malA] [OR:Staphylococcus xylosus] [DB:genpept-bct1] [EC:3.2.1.20] [DE:S.xylosus malR gene and malA gene.] [LE:1454] [RE:3103] [DI:direct]

| ORF Name | NTID | AAID | NT Length | AA Length | score | probability |
|---|---|---|---|---|---|---|
| AI7503000982_23626383_f3_761 | 311 | 4083 | 132 | 43 | | |

Description
NO-HIT

| ORF Name | NTID | AAID | NT Length | AA Length | score | probability |
|---|---|---|---|---|---|---|
| AI7503000982_23626425_c1_1042 | 312 | 4084 | 1056 | 351 | 763 | 1.0e-75 |

Description
pir:[LN:S72490] [AC:S72490:I39765 ] [PN:N-acetyl-gamma-glutamyl-phosphate reductase,] [GN:argC ] [CL:N-acetyl-gamma-glutamyl-phosphate reductase] [OR:Bacillus stearothermophilus] [EC:1.2.1.38] [DB:pir2]

| ORF_Name | NTID | AAID | NT Length | AA Length | score | probability |
|---|---|---|---|---|---|---|
| AI7503000982_23642942_c1_1012 | 313 | 4085 | 696 | 231 | 142 | 3.6e-07 |

Description
pir:[LN:B71609] [AC:B71609 ] [PN:hypothetical protein PFB0680w] [GN:PFB0680w ] [OR:Plasmodium falciparum] [DB:pir2] >gp:[GI:g3845248] [LN:AE001410] [AC:AE001410:AE001362] [PN:hypothetical protein] [GN:PFB0680w] [OR:Plasmodium falciparum] [SR:malaria parasite P. falciparum] [DB:genpept-inv2] [DE:Plasmodium falciparum chromosome 2, section 47 of 73 of thecomplete sequence.] [NT:predicted by GlimmerM] [LE:10507:10754:12646] [RE:10567:12528:12807] [DI:directJoin]

| ORF_Name | NTID | AAID | NT Length | AA Length | score | probability |
|---|---|---|---|---|---|---|
| AI7503000982_23703452_c1_1037 | 314 | 4086 | 1509 | 502 | 1808 | 1.9e-186 |

Description
sp:[LN:GCS2_BACSU] [AC:P54377] [GN:YQHK] [OR:BACILLUS SUBTILIS] [EC:1.4.4.2] [DE:PROTEIN)] [SP:P54377] [DB:swissprot] >pir:[LN:B69959] [AC:B69959 ] [PN:glycine dehydrogenase homolog yqhK] [GN:yqhK ] [OR:Bacillus subtilis] [DB:pir2] >gp:[GI:d1013227:g1303892] [LN:BACJH642] [AC:D84432:D82370] [PN:YqhK] [OR:Bacillus subtilis] [SR:Bacillus subtilis (strain:JH642(trpC2 PheA1)) DNA] [DB:genpept-bct1] [DE:Bacillus subtilis DNA, 283 Kb region containing skin element.] [LE:172729] [RE:174195] [DI:direct] >gp:[GI:e1185723:g2634889] [LN:BSUB0013] [AC:Z99116:AL009126] [GN:yqhK] [FN:unknown] [OR:Bacillus subtilis] [DB:genpept-bct1] [DE:Bacillus subtilis complete genome (section 13 of 21): from 2395261to 2613730.] [NT:similar to glycine dehydrogenase] [SP:P54377] [LE:149426] [RE:150892] [DI:complement]

| ORF_Name | NTID | AAID | NT Length | AA Length | score | probability |
|---|---|---|---|---|---|---|
| AI7503000982_23707890_c2_1322 | 315 | 4087 | 240 | 79 | 123 | 6.9e-08 |

Description
pir:[LN:A69931] [AC:A69931 ] [PN:hypothetical protein yozE] [GN:yozE ] [OR:Bacillus subtilis] [DB:pir2] >gp:[GI:e1185439:g2634360] [LN:BSUB0011] [AC:Z99114:AL009126] [GN:yozE] [FN:unknown] [OR:Bacillus subtilis] [DB:genpept-bct1] [DE:Bacillus subtilis complete genome (section 11 of 21): from 2000171to 2207900.] [LE:137942] [RE:138166] [DI:complement]

| ORF_Name | NTID | AAID | NT Length | AA Length | score | probability |
|---|---|---|---|---|---|---|
| AI7503000982_2381885_c1_988 | 316 | 4088 | 1272 | 423 | 1066 | 8.1e-108 |

Description
pir:[LN:E69765] [AC:E69765:I39896:I39895 ] [PN:branched chain amino acids transporter homolog ycsG] [GN:ycsG ] [OR:Bacillus subtilis] [DB:pir2] >gp:[GI:e1182373:g2632707] [LN:BSUB0003] [AC:Z99106:AL009126] [GN:ycsG] [FN:unknown] [OR:Bacillus subtilis] [DB:genpept-bct1] [DE:Bacillus subtilis complete genome (section 3 of 21): from 402751 to611850.] [NT:alternate gene name: ycsH; similar to branched] [LE:54666] [RE:55826] [DI:direct]

| ORF Name | NTID | AAID | NT Length | AA Length | score | probability |
|---|---|---|---|---|---|---|
| AI7503000982_23836052_f2_497 | 317 | 4089 | 849 | 282 | 392 | 2.1e-36 |

Description
sp:[LN:PROI_BACSU] [AC:P54552] [GN:YQJO] [OR:BACILLUS SUBTILIS]
[DE:PYRROLINE-5-CARBOXYLATE REDUCTASE HOMOLOG 2] [SP:P54552] [DB:swissprot]
>pir:[LN:G69964] [AC:G69964 ] [PN:pyrroline-5-carboxylate reductase homolog yqjO]
[GN:yqjO ] [CL:pyrroline-5-carboxylate reductase] [OR:Bacillus subtilis] [DB:pir2]
>gp:[GI:d1013301:g1303966] [LN:BACJH642] [AC:D84432:D82370] [PN:YqjO] [OR:Bacillus
subtilis] [SR:Bacillus subtilis (strain:JH642(trpC2 PheA1)) DNA] [DB:genpept-bct1]
[DE:Bacillus subtilis DNA, 283 Kb region containing skin element.] [LE:245663]
[RE:246499] [DI:complement] >gp:[GI:e1185649:g2634815] [LN:BSUB0013]
[AC:Z99116:AL009126] [GN:yqjO] [FN:unknown] [OR:Bacillus subtilis] [DB:genpept-bct1]
[DE:Bacillus subtilis complete genome (section 13 of 21): from 2395261to 2613730.]
[NT:similar to pyrroline-5-carboxylate reductase] [SP:P54552] [LE:77120] [RE:77956]
[DI:direct]

| ORF Name | NTID | AAID | NT Length | AA Length | score | probability |
|---|---|---|---|---|---|---|
| AI7503000982_23850302_c3_1369 | 318 | 4090 | 2694 | 897 | 2695 | 1.9e-280 |

Description
sp:[LN:SYA_BACSU] [AC:O34526] [GN:ALAS] [OR:BACILLUS SUBTILIS] [EC:6.1.1.7]
[DE:ALANYL-TRNA SYNTHETASE, (ALANINE--TRNA LIGASE) (ALARS)] [SP:O34526] [DB:swissprot]
>pir:[LN:A69584] [AC:A69584 ] [PN:alanine--tRNA ligase, alaS:alanyl-tRNA synthetase]
[GN:alaS ] [CL:alanine--tRNA ligase] [OR:Bacillus subtilis] [EC:6.1.1.7] [DB:pir2]
>gp:[GI:e1183970:g2635186] [LN:BSUB0014] [AC:Z99117:AL009126] [PN:alanyl-tRNA
synthetase] [GN:alaS] [OR:Bacillus subtilis] [DB:genpept-bct1] [EC:6.1.1.7]
[DE:Bacillus subtilis complete genome (section 14 of 21): from 2599451to 2812870.]
[SP:O34526] [LE:197994] [RE:200630] [DI:complement] >gp:[GI:e1183988:g2635204]
[LN:BSUB0015] [AC:Z99118:AL009126] [PN:alanyl-tRNA synthetase] [GN:alaS] [OR:Bacillus
subtilis] [DB:genpept-bct1] [EC:6.1.1.7] [DE:Bacillus subtilis complete genome (section
15 of 21): from 2795131to 3013540.] [SP:O34526] [LE:2314] [RE:4950] [DI:complement]

| ORF Name | NTID | AAID | NT Length | AA Length | score | probability |
|---|---|---|---|---|---|---|
| AI7503000982_23884692_c3_1415 | 319 | 4091 | 366 | 121 | 217 | 7.5e-18 |

Description
sp:[LN:YQHY_BACSU] [AC:P54519] [GN:YQHY] [OR:BACILLUS SUBTILIS] [DE:HYPOTHETICAL 14.7
KD PROTEIN IN ACCC-FOLD INTERGENIC REGION] [SP:P54519] [DB:swissprot] >pir:[LN:E69960]
[AC:E69960 ] [PN:conserved hypothetical protein yqhY] [GN:yqhY ] [OR:Bacillus subtilis]
[DB:pir2] >gp:[GI:d1013249:g1303914] [LN:BACJH642] [AC:D84432:D82370] [PN:YqhY]
[OR:Bacillus subtilis] [SR:Bacillus subtilis (strain:JH642(trpC2 PheA1)) DNA]
[DB:genpept-bct1] [DE:Bacillus subtilis DNA, 283 Kb region containing skin element.]
[LE:189273] [RE:189680] [DI:direct] >gp:[GI:e1185701:g2634867] [LN:BSUB0013]
[AC:Z99116:AL009126] [GN:yqhY] [FN:unknown] [OR:Bacillus subtilis] [DB:genpept-bct1]
[DE:Bacillus subtilis complete genome (section 13 of 21): from 2395261to 2613730.]
[NT:similar to hypothetical proteins from B. subtilis] [SP:P54519] [LE:133941]
[RE:134348] [DI:complement]

| ORF Name | NTID | AAID | NT Length | AA Length | score | probability |
|---|---|---|---|---|---|---|
| AI7503000982_23912502_f2_605 | 320 | 4092 | 138 | 45 | | |

Description
NO-HIT

| ORF_Name | NTID | AAID | NT Length | AA Length | score | probability |
|---|---|---|---|---|---|---|
| AI7503000982_23964011_f2_352 | 321 | 4093 | 195 | 64 | | |

Description
NO-HIT

| ORF_Name | NTID | AAID | NT Length | AA Length | score | probability |
|---|---|---|---|---|---|---|
| AI7503000982_24042212_c3_1403 | 322 | 4094 | 498 | 165 | 72 | 0.034 |

Description
sp:[LN:CMG3_BACSU] [AC:P25955] [GN:COMGC:COMG3] [OR:BACILLUS SUBTILIS] [DE:COMG OPERON
PROTEIN 3 PRECURSOR] [SP:P25955] [DB:swissprot] >pir:[LN:D30338]
[AC:D30338:A35133:D69603 ] [PN:exogenous DNA-binding protein comGC:comG operon protein
3] [GN:comGC ] [OR:Bacillus subtilis] [DB:pir2] >gp:[GI:g142708] [LN:BACCOMGA]
[AC:M29691:M22854] [GN:comG3] [OR:Bacillus subtilis] [SR:Bacillus subtilis (strain 168)
(clone: pED4) DNA] [DB:genpept-bct1] [DE:Bacillus subtilis (clone pED4)
comG-(1,2,3,4,5,6,and 7) proteins incomG operon, complete cds.] [LE:3405] [RE:3701]
[DI:direct] >gp:[GI:d1013214:g1303879] [LN:BACJH642] [AC:D84432:D82370] [PN:ComGC]
[OR:Bacillus subtilis] [SR:Bacillus subtilis (strain:JH642(trpC2 PheA1)) DNA]
[DB:genpept-bct1] [DE:Bacillus subtilis DNA, 283 Kb region containing skin element.]
[LE:161635] [RE:161931] [DI:direct] >gp:[GI:e1185739:g2634905] [LN:BSUB0013]
[AC:Z99116:AL009126] [GN:comGC] [FN:exogenous DNA-binding (competence)] [OR:Bacillus
subtilis] [DB:genpept-bct1] [DE:Bacillus subtilis complete genome (section 13 of 21):
from 2395261to 2613730.] [SP:P25955] [LE:161690] [RE:161986] [DI:complement]

| ORF_Name | NTID | AAID | NT Length | AA Length | score | probability |
|---|---|---|---|---|---|---|
| AI7503000982_24071068_f1_186 | 323 | 4095 | 399 | 132 | 308 | 1.7e-27 |

Description
sp:[LN:YQHL_BACSU] [AC:P54510] [GN:YQHL] [OR:BACILLUS SUBTILIS] [DE:HYPOTHETICAL 14.6
KD PROTEIN IN GCVT-SPOIIIAA INTERGENIC REGION] [SP:P54510] [DB:swissprot]
>pir:[LN:C69959] [AC:C69959 ] [PN:glpE protein homolog yqhL] [GN:yqhL ] [CL:glpE
protein] [OR:Bacillus subtilis] [DB:pir2] >gp:[GI:d1013228:g1303893] [LN:BACJH642]
[AC:D84432:D82370] [PN:YqhL] [OR:Bacillus subtilis] [SR:Bacillus subtilis
(strain:JH642(trpC2 PheA1)) DNA] [DB:genpept-bct1] [DE:Bacillus subtilis DNA, 283 Kb
region containing skin element.] [LE:174230] [RE:174610] [DI:complement]
>gp:[GI:e1185722:g2634888] [LN:BSUB0013] [AC:Z99116:AL009126] [GN:yqhL] [FN:unknown]
[OR:Bacillus subtilis] [DB:genpept-bct1] [DE:Bacillus subtilis complete genome (section
13 of 21): from 2395261to 2613730.] [NT:similar to hypothetical proteins] [SP:P54510]
[LE:149011] [RE:149391] [DI:direct]

| ORF_Name | NTID | AAID | NT Length | AA Length | score | probability |
|---|---|---|---|---|---|---|
| AI7503000982_24094090_c1_986 | 324 | 4096 | 957 | 318 | 927 | 4.4e-93 |

Description
pir:[LN:G69979] [AC:G69979 ] [PN:proteinase homolog yrrN] [GN:yrrN ] [OR:Bacillus
subtilis] [DB:pir2] >gp:[GI:e1183965:g2635181] [LN:BSUB0014] [AC:Z99117:AL009126]
[GN:yrrN] [FN:unknown] [OR:Bacillus subtilis] [DB:genpept-bct1] [DE:Bacillus subtilis
complete genome (section 14 of 21): from 2599451to 2812870.] [NT:similar to protease]
[LE:193967] [RE:194896] [DI:complement]

| ORF Name | NTID | AAID | NT Length | AA Length | score | probability |
|---|---|---|---|---|---|---|
| AI7503000982_24100715_c3_1422 | 325 | 4097 | 1035 | 344 | 888 | 5.9e-89 |

Description sp:[LN:ODBA_BACSU] [AC:P37940] [GN:BFMBAA:BFMB1A] [OR:BACILLUS SUBTILIS] [EC:1.2.4.4] [DE:(BCKDH E1-ALPHA)] [SP:P37940] [DB:swissprot] >pir:[LN:C69593] [AC:C69593:S32486 ] [PN:3-methyl-2-oxobutanoate dehydrogenase (lipoamide), E1 alpha chain bfmBAA:branched-chain alpha-oxo acid dehydrogenase E1 alpha chain] [GN:bfmBAA ] [CL:pyruvate dehydrogenase (lipoamide) alpha chain: thiamine pyrophosphate-binding domain homology] [OR:Bacillus subtilis] [EC: 1.2.4.4] [DB:pir2] >gp:[GI:g142611] [LN:BACBRANCH] [AC:M97391:M96937] [PN:branched chain alpha-keto acid dehydrogenase] [OR:Bacillus subtilis] [SR:Bacillus subtilis DNA] [DB:genpept-bct1] [DE:Bacillus subtilis branched chain alpha-keto acid dehydrogenaseE1-alpha, branched chain alpha-keto acid dehydrogenase E1-beta, andbranched chain alpha-keto acid dehydrogenase E2, complete cds.] [LE:216] [RE:1208] [DI:direct] >gp:[GI:d1013277:g1303942] [LN:BACJH642] [AC:D84432:D82370] [PN:BfmBAA] [OR:Bacillus subtilis] [SR:Bacillus subtilis (strain:JH642(trpC2 PheA1)) DNA] [DB:genpept-bct1] [DE:Bacillus subtilis DNA, 283 Kb region containing skin element.] [LE:219562] [RE:220554] [DI:direct] >gp:[GI:e1185673:g2634839] [LN:BSUB0013] [AC:Z99116:AL009126] [PN:branched-chain alpha-keto acid dehydrogenase E1] [GN:bfmBAA] [OR:Bacillus subtilis] [DB:genpept-bct1] [EC:1.2.4.4] [DE:Bacillus subtilis complete genome (section 13 of 21): from 2395261to 2613730.] [NT:alternate gene name: bfmB1a] [SP:P37940] [LE:103065] [RE:104057] [DI:complement]

| ORF Name | NTID | AAID | NT Length | AA Length | score | probability |
|---|---|---|---|---|---|---|
| AI7503000982_24104702_c1_1109 | 326 | 4098 | 3061 | 10,20 | 618 | 1.1e-54 |

Description gp:[GI:g1041785] [LN:PYU36927] [AC:U36927] [PN:rhoptry protein] [FN:erythrocyte invasion and possible binding] [OR:Plasmodium yoelii] [DB:genpept-inv1] [DE:Plasmodium yoelii rhoptry protein gene, partial cds.] [LE:<1] [RE:7206] [DI:direct]

| ORF Name | NTID | AAID | NT Length | AA Length | score | probability |
|---|---|---|---|---|---|---|
| AI7503000982_24117777_f3_858 | 327 | 4099 | 174 | 57 | | |

Description

NO-HIT

| ORF Name | NTID | AAID | NT Length | AA Length | score | probability |
|---|---|---|---|---|---|---|
| AI7503000982_24225000_c1_1152 | 328 | 4100 | 651 | 216 | 365 | 1.6e-33 |

Description gp:[GI:g2194195] [LN:SGU61158] [AC:U61158] [PN:GdmF] [GN:gdmF] [OR:Staphylococcus gallinarum] [DB:genpept-bct1] [DE:Staphylococcus gallinarum Tue3928 GdmF (gdmF), putative membraneprotein (gdmH), ABC transporter (gdmT), and antibiotic galliderminprecursor (gdmA) genes, complete cds, putative membrane protein(gdmE) and modifying enzyme (gdmB) genes, partial cds.] [NT:proposed ABC transporter subunit (ATP-binding] [LE:179] [RE:874] [DI:complement]

| ORF Name | NTID | AAID | NT Length | AA Length | score | probability |
|---|---|---|---|---|---|---|
| AI7503000982_24226412_c3_1436 | 329 | 4101 | 570 | 189 | 437 | 3.7e-41 |

Description
sp:[LN:YQKG_BACSU] [AC:P54570] [GN:YQKG] [OR:BACILLUS SUBTILIS] [DE:HYPOTHETICAL 21.0 KD PROTEIN IN GLNQ-ANSR INTERGENIC REGION] [SP:P54570] [DB:swissprot] >pir:[LN:A69967] [AC:A69967 ] [PN:conserved hypothetical protein yqkG] [GN:yqkG ] [CL:yffH protein:mutT domain homology] [OR:Bacillus subtilis] [DB:pir2] >gp:[GI:d1013319:g1303984] [LN:BACJH642] [AC:D84432:D82370] [PN:YqkG] [OR:Bacillus subtilis] [SR:Bacillus subtilis (strain:JH642(trpC2 PheA1)) DNA] [DB:genpept-bct1] [DE:Bacillus subtilis DNA, 283 Kb region containing skin element.] [LE:260584] [RE:261141] [DI:direct] >gp:[GI:e1185630:g2634796] [LN:BSUB0013] [AC:Z99116:AL009126] [GN:yqkG] [FN:unknown] [OR:Bacillus subtilis] [DB:genpept-bct1] [DE:Bacillus subtilis complete genome (section 13 of 21): from 2395261to 2613730.] [NT:similar to hypothetical proteins] [SP:P54570] [LE:62478] [RE:63035] [DI:complement]

| ORF Name | NTID | AAID | NT Length | AA Length | score | probability |
|---|---|---|---|---|---|---|
| AI7503000982_24226635_f2_499 | 330 | 4102 | 156 | 51 | | |

Description
NO-HIT

| ORF Name | NTID | AAID | NT Length | AA Length | score | probability |
|---|---|---|---|---|---|---|
| AI7503000982_24228452_f3_942 | 331 | 4103 | 138 | 45 | | |

Description
NO-HIT

| ORF Name | NTID | AAID | NT Length | AA Length | score | probability |
|---|---|---|---|---|---|---|
| AI7503000982_24229515_c3_1423 | 332 | 4104 | 1170 | 389 | 980 | 1.1e-98 |

Description
sp:[LN:YQJE_BACSU] [AC:P54542] [GN:YQJE] [OR:BACILLUS SUBTILIS] [DE:HYPOTHETICAL 39.7 KD PROTEIN IN GLNQ-ANSR INTERGENIC REGION] [SP:P54542] [DB:swissprot] >pir:[LN:E69963] [AC:E69963 ] [PN:tripeptidase homolog yqjE] [GN:yqjE ] [OR:Bacillus subtilis] [DB:pir2] >gp:[GI:d1013291:g1303956] [LN:BACJH642] [AC:D84432:D82370] [PN:YqjE] [OR:Bacillus subtilis] [SR:Bacillus subtilis (strain:JH642(trpC2 PheA1)) DNA] [DB:genpept-bct1] [DE:Bacillus subtilis DNA, 283 Kb region containing skin element.] [LE:232856] [RE:233971] [DI:direct] >gp:[GI:e1185659:g2634825] [LN:BSUB0013] [AC:Z99116:AL009126] [GN:yqjE] [FN:unknown] [OR:Bacillus subtilis] [DB:genpept-bct1] [DE:Bacillus subtilis complete genome (section 13 of 21): from 2395261to 2613730.] [NT:similar to tripeptidase] [SP:P54542] [LE:89648] [RE:90763] [DI:complement]

| ORF Name | NTID | AAID | NT Length | AA Length | score | probability |
|---|---|---|---|---|---|---|
| AI7503000982_24229805_c3_1376 | 333 | 4105 | 1386 | 461 | 1133 | 6.4e-115 |

Description
pir:[LN:A69581] [AC:A69581 ] [PN:acetyl-CoA carboxylase (biotin carboxylase subunit) accC] [GN:accC ] [CL:biotin carboxylase:biotin carboxylase homology] [OR:Bacillus subtilis] [DB:pir2] >gp:[GI:d1013248:g1303913] [LN:BACJH642] [AC:D84432:D82370] [PN:YqhX] [OR:Bacillus subtilis] [SR:Bacillus subtilis (strain:JH642(trpC2 PheA1)) DNA] [DB:genpept-bct1] [DE:Bacillus subtilis DNA, 283 Kb region containing skin element.] [LE:187900] [RE:189252] [DI:direct] >gp:[GI:e1185702:g2634868] [LN:BSUB0013] [AC:Z99116:AL009126] [PN:acetyl-CoA carboxylase subunit (biotin] [GN:accC] [FN:long-chain fatty acid biosynthesis] [OR:Bacillus subtilis] [DB:genpept-bct1] [EC:6.4.1.2] [DE:Bacillus subtilis complete genome (section 13 of 21): from 2395261to 2613730.] [NT:alternate gene name: yqhX] [SP:P49787] [LE:134369] [RE:135721] [DI:complement]

| ORF Name | NTID | AAID | NT Length | AA Length | score | probability |
|---|---|---|---|---|---|---|
| AI7503000982_24257658_f1_309 | 334 | 4106 | 162 | 53 | | |

Description
NO-HIT

| ORF Name | NTID | AAID | NT Length | AA Length | score | probability |
|---|---|---|---|---|---|---|
| AI7503000982_24260061_c3_1353 | 335 | 4107 | 348 | 115 | 214 | 1.6e-17 |

Description
sp:[LN:YSXB_BACSU] [AC:P26942:Q45629] [GN:YSXB] [OR:BACILLUS SUBTILIS] [DE:HYPOTHETICAL 12.3 KD PROTEIN IN RPLU-RPMA INTERGENIC REGION (ORF X)] [SP:P26942:Q45629] [DB:swissprot] >pir:[LN:S18440] [AC:S18440:D21895:B69987 ] [PN:conserved hypothetical protein ysxB] [GN:ysxB ] [OR:Bacillus subtilis] [DB:pir2] >gp:[GI:g40174] [LN:BSSPOIVFO] [AC:X59528:S61796] [OR:Bacillus subtilis] [DB:genpept-bct1] [DE:B.subtilis spoIVFA, spoIVFB, L20, orfX and L24 genes.] [NT:ORF X] [SP:P26942] [LE:2270] [RE:2608] [DI:direct] >gp:[GI:e1184044:g2635260] [LN:BSUB0015] [AC:Z99118:AL009126] [GN:ysxB] [FN:unknown] [OR:Bacillus subtilis] [DB:genpept-bct1] [DE:Bacillus subtilis complete genome (section 15 of 21): from 2795131to 3013540.] [NT:similar to hypothetical proteins] [SP:P26942] [LE:59308] [RE:59646] [DI:complement]

| ORF Name | NTID | AAID | NT Length | AA Length | score | probability |
|---|---|---|---|---|---|---|
| AI7503000982_24261692_c3_1518 | 336 | 4108 | 1902 | 633 | 995 | 2.7e-100 |

Description
pir:[LN:D69907] [AC:D69907 ] [PN:hypothetical protein yojO] [GN:yojO ] [OR:Bacillus subtilis] [DB:pir2] >gp:[GI:e1185410:g2634331] [LN:BSUB0011] [AC:Z99114:AL009126] [GN:yojO] [FN:unknown] [OR:Bacillus subtilis] [DB:genpept-bct1] [DE:Bacillus subtilis complete genome (section 11 of 21): from 2000171to 2207900.] [LE:110914] [RE:112899] [DI:complement] >gp:[GI:g3169331] [LN:AF026147] [AC:AF026147] [PN:YojO] [GN:yojO] [FN:unknown] [OR:Bacillus subtilis] [DB:genpept-bct2] [DE:Bacillus subtilis YojA (yojA), YojB (yojB), YojC (yojC), YojD(yojD), YojE (yojE), YojF (yojF), YojG (yojG), YojH (yojH), YojI(yojI), YojJ (yojJ), YojK (yojK), YojL (yojL), YojM (yojM), YojN(yojN), and YojO (yojO) genes, complete cds; and OdhA (odhA) gene,partial cds.] [LE:12366] [RE:14351] [DI:direct]

| ORF Name | NTID | AAID | NT Length | AA Length | score | probability |
|---|---|---|---|---|---|---|
| AI7503000982_24266502_f3_675 | 337 | 4109 | 180 | 59 | | |

Description
NO-HIT

| ORF Name | NTID | AAID | NT Length | AA Length | score | probability |
|---|---|---|---|---|---|---|
| AI7503000982_24274192_f2_386 | 338 | 4110 | 411 | 136 | 233 | 1.5e-19 |

Description
sp:[LN:EBSB_ENTFA] [AC:P36921] [OR:ENTEROCOCCUS FAECALIS] [SR:,STREPTOCOCCUS FAECALIS] [DE:CELL WALL ENZYME EBSB] [SP:P36921] [DB:swissprot] >pir:[LN:B49939] [AC:B49939 ] [PN:ebsB protein] [CL:Enterococcus faecalis ebsB protein] [OR:Enterococcus faecalis] [DB:pir2] >gp:[GI:g388108] [LN:ENEEBSA] [AC:L23802] [PN:cell wall enzyme] [GN:ebsB] [OR:Enterococcus faecalis] [SR:Enterococcus faecalis (strain OG1SSp) DNA] [DB:genpept-bct2] [DE:Enterococcus faecalis pore forming, cell wall enzyme, regulatory,and dehydroquinase homologue proteins (ebsA,ebsB,ebsC,and ebsD)genes, complete cds with repeat region.] [NT:putative] [LE:734] [RE:1141] [DI:direct]

| ORF Name | NTID | AAID | NT Length | AA Length | score | probability |
|---|---|---|---|---|---|---|
| AI7503000982_24275927_f2_622 | 339 | 4111 | 189 | 62 | | |

Description
NO-HIT

| ORF Name | NTID | AAID | NT Length | AA Length | score | probability |
|---|---|---|---|---|---|---|
| AI7503000982_24306263_c1_1034 | 340 | 4112 | 297 | 98 | | |

Description
NO-HIT

| ORF Name | NTID | AAID | NT Length | AA Length | score | probability |
|---|---|---|---|---|---|---|
| AI7503000982_24410300_c3_1439 | 341 | 4113 | 759 | 252 | 686 | 1.5e-67 |

Description
sp:[LN:RLUB_BACSU] [AC:P35159] [GN:RLUB] [OR:BACILLUS SUBTILIS] [EC:4.2.1.70]
[DE:(PSEUDOURIDYLATE SYNTHASE) (URACIL HYDROLYASE)] [SP:P35159] [DB:swissprot]
>pir:[LN:S45555] [AC:S45555:A69943 ] [PN:conserved hypothetical protein ypuL] [GN:ypuL
] [CL:conserved hypothetical protein HI1243] [OR:Bacillus subtilis] [DB:pir2]
>gp:[GI:g410137] [LN:BACDIA] [AC:L09228] [OR:Bacillus subtilis] [SR:Bacillus subtilis
(strain 168, sub_species Marburg) DNA] [DB:genpept-bct1] [DE:Bacillus subtilis spoVA to
serA region.] [NT:ORFX13] [LE:17440] [RE:18129] [DI:direct] >gp:[GI:e1185585:g2634751]
[LN:BSUB0013] [AC:Z99116:AL009126] [GN:ypuL] [FN:unknown] [OR:Bacillus subtilis]
[DB:genpept-bct1] [DE:Bacillus subtilis complete genome (section 13 of 21): from
2395261to 2613730.] [NT:similar to hypothetical proteins] [SP:P35159] [LE:25454]
[RE:26143] [DI:complement]

| ORF Name | NTID | AAID | NT Length | AA Length | score | probability |
|---|---|---|---|---|---|---|
| AI7503000982_24470317_c1_1011 | 342 | 4114 | 1020 | 339 | 1246 | 6.8e-127 |

Description
sp:[LN:YQFA_BACSU] [AC:P54466] [GN:YQFA] [OR:BACILLUS SUBTILIS] [DE:HYPOTHETICAL 35.6
KD PROTEIN IN RPSU-PHOH INTEREGENIC REGION] [SP:P54466] [DB:swissprot] >pir:[LN:A69953]
[AC:A69953 ] [PN:hypothetical protein yqfA] [GN:yqfA ] [OR:Bacillus subtilis] [DB:pir2]
>gp:[GI:d1013152:g1303817] [LN:BACJH642] [AC:D84432:D82370] [PN:YqfA] [OR:Bacillus
subtilis] [SR:Bacillus subtilis (strain:JH642(trpC2 PheA1)) DNA] [DB:genpept-bct1]
[DE:Bacillus subtilis DNA, 283 Kb region containing skin element.] [LE:101161]
[RE:102156] [DI:direct] >gp:[GI:e1183768:g2634984] [LN:BSUB0014] [AC:Z99117:AL009126]
[GN:yqfA] [FN:unknown] [OR:Bacillus subtilis] [DB:genpept-bct1] [DE:Bacillus subtilis
complete genome (section 14 of 21): from 2599451to 2812870.] [SP:P54466] [LE:17274]
[RE:18269] [DI:complement]

| ORF Name | NTID | AAID | NT Length | AA Length | score | probability |
|---|---|---|---|---|---|---|
| AI7503000982_24480275_c3_1499 | 343 | 4115 | 990 | 329 | 602 | 1.2e-58 |

Description
pir:[LN:A69653] [AC:A69653 ] [PN:transmembrane lipoprotein lplB] [GN:lplB ]
[OR:Bacillus subtilis] [DB:pir2] >gp:[GI:e1182690:g2633024] [LN:BSUB0004]
[AC:Z99107:AL009126] [PN:transmembrane lipoprotein] [GN:lplB] [OR:Bacillus subtilis]
[DB:genpept-bct1] [DE:Bacillus subtilis complete genome (section 4 of 21): from 600701
to813890.] [LE:179900] [RE:180856] [DI:direct]

| ORF_Name | NTID | AAID | NT Length | AA Length | score | probability |
|---|---|---|---|---|---|---|
| AI7503000982_24486330_c1_980 | 344 | 4116 | 693 | 230 | 321 | 7.2e-29 |

Description
pir:[LN:H69978] [AC:H69978 ] [PN:conserved hypothetical protein yrrB] [GN:yrrB ]
[CL:tetratricopeptide repeat homology] [OR:Bacillus subtilis] [DB:pir2]
>gp:[GI:e1183978:g2635194] [LN:BSUB0014] [AC:Z99117:AL009126] [GN:yrrB] [FN:unknown]
[OR:Bacillus subtilis] [DB:genpept-bct1] [DE:Bacillus subtilis complete genome (section
14 of 21): from 2599451to 2812870.] [NT:similar to hypothetical proteins] [LE:208527]
[RE:209147] [DI:complement] >gp:[GI:e1183996:g2635212] [LN:BSUB0015]
[AC:Z99118:AL009126] [GN:yrrB] [FN:unknown] [OR:Bacillus subtilis] [DB:genpept-bct1]
[DE:Bacillus subtilis complete genome (section 15 of 21): from 2795131to 3013540.]
[NT:similar to hypothetical proteins] [LE:12847] [RE:13467] [DI:complement]

| ORF_Name | NTID | AAID | NT Length | AA Length | score | probability |
|---|---|---|---|---|---|---|
| AI7503000982_24489062_f1_1 | 345 | 4117 | 126 | 41 | 72 | 0.017 |

Description
pir:[LN:D70083] [AC:D70083 ] [PN:hypothetical protein yxzC] [GN:yxzC ] [OR:Bacillus
subtilis] [DB:pir2] >gp:[GI:e1184645:g2636466] [LN:BSUB0021] [AC:Z99124:AL009126]
[GN:yxzC] [FN:unknown] [OR:Bacillus subtilis] [DB:genpept-bct1] [DE:Bacillus subtilis
complete genome (section 21 of 21): from 3999281to 4214814.] [LE:21405] [RE:21773]
[DI:complement]

| ORF_Name | NTID | AAID | NT Length | AA Length | score | probability |
|---|---|---|---|---|---|---|
| AI7503000982_24511676_c1_1140 | 346 | 4118 | 246 | 81 | 251 | 4.3e-21 |

Description
sp:[LN:ODO2_BACSU] [AC:P16263] [GN:ODHB:CITM] [OR:BACILLUS SUBTILIS] [EC:2.3.1.61]
[DE:DEHYDROGENASE COMPLEX, (E2)] [SP:P16263] [DB:swissprot] >pir:[LN:B32879]
[AC:B32879:F69668 ] [PN:dihydrolipoamide S-succinyltransferase, odhB:2-oxoglutarate
dehydrogenase complex E2 component odhB: dihydrolipoamide transsuccinylase odhB]
[GN:odhB ] [CL:dihydrolipoamide acetyltransferase: lipoyl/biotin-binding homology]
[OR:Bacillus subtilis] [EC:2.3.1.61] [DB:pir2] >gp:[GI:g143268] [LN:BACODHAB]
[AC:M27141] [OR:Bacillus subtilis] [SR:B.subtilis (strain 3G18) DNA] [DB:genpept-bct1]
[DE:B.subtilis 2-oxoglutarate dehydrogenase (odhA) gene 3' end, anddihydrolipoamide
transsuccinylase (odhB) gene, complete cds.] [NT:dihydrolipoamide transsuccinylase
(odhB; EC] [LE:899] [RE:2152] [DI:direct] >gp:[GI:e1185408:g2634329] [LN:BSUB0011]
[AC:Z99114:AL009126] [PN:2-oxoglutarate dehydrogenase complex] [GN:odhB] [OR:Bacillus
subtilis] [DB:genpept-bct1] [EC:2.3.1.61] [DE:Bacillus subtilis complete genome
(section 11 of 21): from 2000171to 2207900.] [NT:alternate gene name: citM] [SP:P16263]
[LE:106590] [RE:107843] [DI:complement]

| ORF_Name | NTID | AAID | NT Length | AA Length | score | probability |
|---|---|---|---|---|---|---|
| AI7503000982_24610877_c1_1035 | 347 | 4119 | 519 | 172 | 226 | 8.4e-19 |

Description
sp:[LN:AROK_LACLA] [AC:P43906] [GN:AROK] [OR:LACTOCOCCUS LACTIS]
[SR:,SUBSPLACTIS:STREPTOCOCCUS LACTIS] [EC:2.7.1.71] [DE:SHIKIMATE KINASE, (SK)]
[SP:P43906] [DB:swissprot] >pir:[LN:S52581] [AC:S52581 ] [PN:shikimate kinase,]
[CL:shikimate kinase:shikimate kinase homology] [OR:Lactococcus lactis] [EC:2.7.1.71]
[DB:pir2] >gp:[GI:g683584] [LN:LLTYRAPH] [AC:X78413] [PN:shikimate kinase] [GN:aroK]
[OR:Lactococcus lactis] [DB:genpept-bct1] [EC:2.7.1.71] [DE:L.lactis tyrA, aroA, aroK
and pheA genes.] [SP:P43906] [LE:2605] [RE:3093] [DI:direct]

| ORF Name | NTID | AAID | NT Length | AA Length | score | probability |
|---|---|---|---|---|---|---|
| AI7503000982_24615915_c3_1522 | 348 | 4120 | 240 | 79 | 275 | 5.4e-24 |

Description
gp:[GI:g2226349] [LN:AF003593] [AC:AF003593] [PN:CspC] [GN:cspC] [OR:Staphylococcus aureus] [DB:genpept-bct1] [DE:Staphylococcus aureus CspC (cspC) gene, complete cds.] [NT:similar to major cold-shock protein] [LE:444] [RE:644] [DI:direct]

| ORF Name | NTID | AAID | NT Length | AA Length | score | probability |
|---|---|---|---|---|---|---|
| AI7503000982_24617177_c3_1433 | 349 | 4121 | 129 | 42 | | |

Description
NO-HIT

| ORF Name | NTID | AAID | NT Length | AA Length | score | probability |
|---|---|---|---|---|---|---|
| AI7503000982_24640937_c2_1229 | 350 | 4122 | 498 | 165 | | |

Description
NO-HIT

| ORF Name | NTID | AAID | NT Length | AA Length | score | probability |
|---|---|---|---|---|---|---|
| AI7503000982_24647187_c1_1038 | 351 | 4123 | 126 | 41 | 98 | 8.8e-05 |

Description
gp:[GI:g1022725] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF2] [LE:394] [RE:1083] [DI:complement] >gp:[GI:g295162] [LN:STAMECRA] [AC:L14017] [OR:Staphylococcus aureus] [SR:Staphylococcus aureus (strain COL) DNA] [DB:genpept-bct1] [DE:Staphylococcus aureus methicillin-resistance protein (mecR) geneand unknown ORF, complete cds.] [NT:unknown ORF1; putative] [LE:1492] [RE:2181] [DI:complement]

| ORF Name | NTID | AAID | NT Length | AA Length | score | probability |
|---|---|---|---|---|---|---|
| AI7503000982_24650016_c3_1478 | 352 | 4124 | 417 | 138 | 155 | 2.8e-11 |

Description
sp:[LN:YPSB_BACSU] [AC:P50839] [GN:YPSB] [OR:BACILLUS SUBTILIS] [DE:HYPOTHETICAL 11.6 KD PROTEIN IN COTD-KDUD INTERGENIC REGION] [SP:P50839] [DB:swissprot] >pir:[LN:E69941] [AC:E69941 ] [PN:hypothetical protein ypsB] [GN:ypsB ] [OR:Bacillus subtilis] [DB:pir2] >gp:[GI:g1146182] [LN:BACPONAYPP] [AC:L47838] [GN:ypsB] [FN:hypothetical] [OR:Bacillus subtilis] [DB:genpept-bct1] [DE:Bacillus subtilis (clone YAC15-6B) ponA gene, yppBCDEFG genes,ypqAE genes, yprAB genes, cotD gene, ypsABC genes, rnaP gene, yptAgene, ypuA gene, kduDI genes, kdgRKAT genes, ypwA gene, completecds's.] [NT:putative] [LE:12192] [RE:12488] [DI:direct] >gp:[GI:e1183664:g2634637] [LN:BSUB0012] [AC:Z99115:AL009126] [GN:ypsB] [FN:unknown] [OR:Bacillus subtilis] [DB:genpept-bct1] [DE:Bacillus subtilis complete genome (section 12 of 21): from 2195541to 2409220.] [SP:P50839] [LE:135481] [RE:135777] [DI:complement]

| ORF Name | NTID | AAID | NT Length | AA Length | score | probability |
|---|---|---|---|---|---|---|
| AI7503000982_24650252_f3_731 | 353 | 4125 | 633 | 210 | 970 | 1.2e-97 |

Description
gp:[GI:e1357086:g3955030] [LN:SAU17795] [AC:Y17795] [PN:unknown] [GN:prfA] [OR:Staphylococcus aureus] [DB:genpept-bct1] [DE:Staphylococcus aureus prfA, pbp2 genes.] [LE:731] [RE:1357] [DI:direct]

| ORF Name | NTID | AAID | NT Length | AA Length | score | probability |
|---|---|---|---|---|---|---|
| AI7503000982_24658562_f3_926 | 354 | 4126 | 1287 | 428 | 1475 | 3.7e-151 |

Description pir:[LN:D69981] [AC:D69981 ] [PN:conserved hypothetical protein yrvN] [GN:yrvN ] [CL:Haemophilus influenzae conserved hypothetical protein HI1590] [OR:Bacillus subtilis] [DB:pir2] >gp:[GI:e1183983:g2635199] [LN:BSUB0014] [AC:Z99117:AL009126] [GN:yrvN] [FN:unknown] [OR:Bacillus subtilis] [DB:genpept-bct1] [DE:Bacillus subtilis complete genome (section 14 of 21): from 2599451to 2812870.] [NT:similar to hypothetical proteins] [LE:212152] [RE:213417] [DI:direct] >gp:[GI:e1184001:g2635217] [LN:BSUB0015] [AC:Z99118:AL009126] [GN:yrvN] [FN:unknown] [OR:Bacillus subtilis] [DB:genpept-bct1] [DE:Bacillus subtilis complete genome (section 15 of 21): from 2795131to 3013540.] [NT:similar to hypothetical proteins] [LE:16472] [RE:17737] [DI:direct]

| ORF Name | NTID | AAID | NT Length | AA Length | score | probability |
|---|---|---|---|---|---|---|
| AI7503000982_24797827_c3_1514 | 355 | 4127 | 1857 | 618 | 1242 | 1.8e-126 |

Description sp:[LN:ODO1_BACSU] [AC:P23129] [GN:ODHA:CITK] [OR:BACILLUS SUBTILIS] [EC:1.2.4.2] [DE:KETOGLUTARATE DEHYDROGENASE)] [SP:P23129] [DB:swissprot] >pir:[LN:A32879] [AC:S25295:A32879:E69668:S14544 ] [PN:oxoglutarate dehydrogenase (lipoamide),] [GN:odhA ] [CL:oxoglutarate dehydrogenase (lipoamide):thiamine pyrophosphate-binding domain homology] [OR:Bacillus subtilis] [EC:1.2.4.2] [DB:pir2] >gp:[GI:g40003] [LN:BSODHA] [AC:X54805:S43328] [PN:oxoglutarate dehydrogenase (NADP+)] [GN:odhA] [OR:Bacillus subtilis] [DB:genpept-bct1] [DE:B. subtilis odhA gene for 2-oxoglutarate dehydrogenase.] [SP:P23129] [LE:291] [RE:3104] [DI:direct] >gp:[GI:e1185409:g2634330] [LN:BSUB0011] [AC:Z99114:AL009126] [PN:2-oxoglutarate dehydrogenase (E1 subunit)] [GN:odhA] [OR:Bacillus subtilis] [DB:genpept-bct1] [EC:1.2.4.2] [DE:Bacillus subtilis complete genome (section 11 of 21): from 2000171to 2207900.] [NT:alternate gene name: citK] [SP:P23129] [LE:107873] [RE:110686] [DI:complement]

| ORF Name | NTID | AAID | NT Length | AA Length | score | probability |
|---|---|---|---|---|---|---|
| AI7503000982_24800461_c1_1138 | 356 | 4128 | 231 | 76 | 235 | 1.7e-18 |

Description sp:[LN:ODO1_BACSU] [AC:P23129] [GN:ODHA:CITK] [OR:BACILLUS SUBTILIS] [EC:1.2.4.2] [DE:KETOGLUTARATE DEHYDROGENASE)] [SP:P23129] [DB:swissprot] >pir:[LN:A32879] [AC:S25295:A32879:E69668:S14544 ] [PN:oxoglutarate dehydrogenase (lipoamide),] [GN:odhA ] [CL:oxoglutarate dehydrogenase (lipoamide):thiamine pyrophosphate-binding domain homology] [OR:Bacillus subtilis] [EC:1.2.4.2] [DB:pir2] >gp:[GI:g40003] [LN:BSODHA] [AC:X54805:S43328] [PN:oxoglutarate dehydrogenase (NADP+)] [GN:odhA] [OR:Bacillus subtilis] [DB:genpept-bct1] [DE:B. subtilis odhA gene for 2-oxoglutarate dehydrogenase.] [SP:P23129] [LE:291] [RE:3104] [DI:direct] >gp:[GI:e1185409:g2634330] [LN:BSUB0011] [AC:Z99114:AL009126] [PN:2-oxoglutarate dehydrogenase (E1 subunit)] [GN:odhA] [OR:Bacillus subtilis] [DB:genpept-bct1] [EC:1.2.4.2] [DE:Bacillus subtilis complete genome (section 11 of 21): from 2000171to 2207900.] [NT:alternate gene name: citK] [SP:P23129] [LE:107873] [RE:110686] [DI:complement]

| ORF Name | NTID | AAID | NT Length | AA Length | score | probability |
|---|---|---|---|---|---|---|
| AI7503000982_24807790_c1_1048 | 357 | 4129 | 909 | 302 | 687 | 1.2e-67 |

Description sp:[LN:ISPA_BACST] [AC:Q08291] [OR:BACILLUS STEAROTHERMOPHILUS] [EC:2.5.1.10] [DE:(FPP SYNTHASE)] [SP:Q08291] [DB:swissprot] >pir:[LN:JX0257] [AC:JX0257 ] [PN:geranyltranstransferase,:farnesyl-diphosphate synthase] [CL:geranyltranstransferase] [OR:Bacillus stearothermophilus] [EC:2.5.1.10] [DB:pir2] >gp:[GI:d1003054:g391610] [LN:BACFDPS] [AC:D13293] [PN:farnesyl diphosphate synthase] [OR:Bacillus stearothermophilus] [SR:Bacillus stearothermophilus (strain:ATCC10149) DNA] [DB:genpept-bct1] [EC:2.5.1.10] [DE:B. stearothermophilus DNA for farnesyl diphosphate synthase,complete cds.] [LE:85] [RE:978] [DI:direct]

| ORF Name | NTID | AAID | NT Length | AA Length | score | probability |
|---|---|---|---|---|---|---|
| AI7503000982_24823311_c3_1404 | 358 | 4130 | 210 | 69 | 76 | 0.0065 |

Description pir:[LN:B21124] [AC:B21124 ] [PN:Bkm-like sex-determining region hypothetical protein CS314] [GN:Bkm ] [OR:Drosophila melanogaster] [DB:pir2]

| ORF Name | NTID | AAID | NT Length | AA Length | score | probability |
|---|---|---|---|---|---|---|
| AI7503000982_24886562_f3_771 | 359 | 4131 | 123 | 40 | | |

Description

NO-HIT

| ORF Name | NTID | AAID | NT Length | AA Length | score | probability |
|---|---|---|---|---|---|---|
| AI7503000982_24886587_c2_1175 | 360 | 4132 | 2448 | 815 | 1981 | 2.3e-207 |

Description pir:[LN:A69979] [AC:A69979 ] [PN:conjugation transfer protein homolog yrrC] [GN:yrrC ] [OR:Bacillus subtilis] [DB:pir2] >gp:[GI:e1183977:g2635193] [LN:BSUB0014] [AC:Z99117:AL009126] [GN:yrrC] [FN:unknown] [OR:Bacillus subtilis] [DB:genpept-bct1] [DE:Bacillus subtilis complete genome (section 14 of 21): from 2599451to 2812870.] [NT:similar to conjugation transfer protein] [LE:206106] [RE:208502] [DI:complement] >gp:[GI:e1183995:g2635211] [LN:BSUB0015] [AC:Z99118:AL009126] [GN:yrrC] [FN:unknown] [OR:Bacillus subtilis] [DB:genpept-bct1] [DE:Bacillus subtilis complete genome (section 15 of 21): from 2795131to 3013540.] [NT:similar to conjugation transfer protein] [LE:10426] [RE:12822] [DI:complement]

| ORF Name | NTID | AAID | NT Length | AA Length | score | probability |
|---|---|---|---|---|---|---|
| AI7503000982_2542188_c1_1026 | 361 | 4133 | 270 | 89 | | |

Description

NO-HIT

| ORF Name | NTID | AAID | NT Length | AA Length | score | probability |
|---|---|---|---|---|---|---|
| AI7503000982_25423425_f2_337 | 362 | 4134 | 210 | 69 | | |

Description

NO-HIT

| ORF Name | NTID | AAID | NT Length | AA Length | score | probability |
|---|---|---|---|---|---|---|
| AI7503000982_25428378_f2_336 | 363 | 4135 | 228 | 75 | | |

Description

NO-HIT

| ORF Name | NTID | AAID | NT Length | AA Length | score | probability |
|---|---|---|---|---|---|---|
| AI7503000982_25502217_c2_1157 | 364 | 4136 | 615 | 204 | 410 | 2.7e-38 |

Description sp:[LN:RUVA_BACSU] [AC:O05392] [GN:RUVA] [OR:BACILLUS SUBTILIS] [DE:PROBABLE HOLLIDAY JUNCTION DNA HELICASE RUVA] [SP:O05392] [DB:swissprot] >pir:[LN:E69702] [AC:E69702 ] [PN:Holliday junction DNA helicase ruvA] [GN:ruvA ] [CL:holliday junction DNA helicase ruvA] [OR:Bacillus subtilis] [DB:pir2] >gp:[GI:e1184023:g2635239] [LN:BSUB0015] [AC:Z99118:AL009126] [PN:Holliday junction DNA helicase] [GN:ruvA] [OR:Bacillus subtilis] [DB:genpept-bct1] [DE:Bacillus subtilis complete genome (section 15 of 21): from 2795131to 3013540.] [SP:O05392] [LE:40296] [RE:40901] [DI:complement]

| ORF Name | NTID | AAID | NT Length | AA Length | score | probability |
|---|---|---|---|---|---|---|
| AI7503000982_25595186_c2_1177 | 365 | 4137 | 651 | 216 | 736 | 7.6e-73 |

Description pir:[LN:G69728] [AC:G69728 ] [PN:uridine kinase udk] [GN:udk ] [CL:uridine kinase] [OR:Bacillus subtilis] [DB:pir2] >gp:[GI:e1183963:g2635179] [LN:BSUB0014] [AC:Z99117:AL009126] [PN:uridine kinase] [GN:udk] [FN:pyrimidine salvage] [OR:Bacillus subtilis] [DB:genpept-bct1] [EC:2.7.1.48] [DE:Bacillus subtilis complete genome (section 14 of 21): from 2599451to 2812870.] [LE:192038] [RE:192673] [DI:complement]

| ORF Name | NTID | AAID | NT Length | AA Length | score | probability |
|---|---|---|---|---|---|---|
| AI7503000982_25598818_c3_1420 | 366 | 4138 | 1692 | 563 | 1195 | 1.7e-121 |

Description sp:[LN:RECN_BACSU] [AC:P17894:P19671] [GN:RECN] [OR:BACILLUS SUBTILIS] [DE:DNA REPAIR PROTEIN RECN (RECOMBINATION PROTEIN N)] [SP:P17894:P19671] [DB:swissprot] >pir:[LN:B35128] [AC:B35128:PS0054:H69690 ] [PN:DNA repair and genetic recombination protein recN] [GN:recN ] [CL:recN protein] [OR:Bacillus subtilis] [DB:pir2] >gp:[GI:d1013258:g1303923] [LN:BACJH642] [AC:D84432:D82370] [PN:RecN] [OR:Bacillus subtilis] [SR:Bacillus subtilis (strain:JH642(trpC2 PheA1)) DNA] [DB:genpept-bct1] [DE:Bacillus subtilis DNA, 283 Kb region containing skin element.] [LE:197319] [RE:199049] [DI:direct] >gp:[GI:g143402] [LN:BACRECN] [AC:M30297] [OR:Bacillus subtilis] [SR:B.subtilis (strain 168) DNA] [DB:genpept-bct1] [DE:B.subtilis recombination and sporulation protein (recN, spoIVB)genes , complete cds, arginine hydroximate resistance (ahrC) gene,3' end.] [NT:recombination protein (ttg start codon)] [LE:131] [RE:1861] [DI:direct] >gp:[GI:e1185692:g2634858] [LN:BSUB0013] [AC:Z99116:AL009126] [GN:recN] [FN:DNA repair and genetic recombination] [OR:Bacillus subtilis] [DB:genpept-bct1] [DE:Bacillus subtilis complete genome (section 13 of 21): from 2395261to 2613730.] [SP:P17894] [LE:124572] [RE:126302] [DI:complement]

| ORF Name | NTID | AAID | NT Length | AA Length | score | probability |
|---|---|---|---|---|---|---|
| AI7503000982_25652217_c3_1470 | 367 | 4139 | 348 | 115 | | |

Description
NO-HIT

| ORF Name | NTID | AAID | NT Length | AA Length | score | probability |
|---|---|---|---|---|---|---|
| AI7503000982_25672337_c1_1016 | 368 | 4140 | 780 | 259 | 371 | 3.6e-34 |

Description
sp:[LN:YQXN_BACSU] [AC:P42095] [GN:YQXN:YQFI] [OR:BACILLUS SUBTILIS] [DE:(ORF3)]
[SP:P42095] [DB:swissprot] >pir:[LN:H69968] [AC:H69968 ] [PN:conserved hypothetical
protein yqxN] [GN:YQXN ] [OR:Bacillus subtilis] [DB:pir2] >gp:[GI:d1013162:g1303827]
[LN:BACJH642] [AC:D84432:D82370] [PN:YqfI] [OR:Bacillus subtilis] [SR:Bacillus subtilis
(strain:JH642(trpC2 PheA1)) DNA] [DB:genpept-bct1] [DE:Bacillus subtilis DNA, 283 Kb
region containing skin element.] [LE:109891] [RE:110658] [DI:direct]
>gp:[GI:e1185794:g2634960] [LN:BSUB0013] [AC:Z99116:AL009126] [GN:yqxN] [FN:unknown]
[OR:Bacillus subtilis] [DB:genpept-bct1] [DE:Bacillus subtilis complete genome (section
13 of 21): from 2395261to 2613730.] [NT:alternate gene name: yqfI; similar to
hypothetical] [SP:P42095] [LE:212962] [RE:213729] [DI:complement]
>gp:[GI:e1183758:g2634974] [LN:BSUB0014] [AC:Z99117:AL009126] [GN:yqxN] [FN:unknown]
[OR:Bacillus subtilis] [DB:genpept-bct1] [DE:Bacillus subtilis complete genome (section
14 of 21): from 2599451to 2812870.] [NT:alternate gene name: yqfI; similar to
hypothetical] [SP:P42095] [LE:8772] [RE:9539] [DI:complement]

| ORF Name | NTID | AAID | NT Length | AA Length | score | probability |
|---|---|---|---|---|---|---|
| AI7503000982_25680218_c2_1201 | 369 | 4141 | 726 | 241 | 425 | 6.8e-40 |

Description
sp:[LN:YQEZ_BACSU] [AC:P54465] [GN:YQEZ] [OR:BACILLUS SUBTILIS] [DE:HYPOTHETICAL 46.5
KD PROTEIN IN RPSU-PHOH INTEREGENIC REGION] [SP:P54465] [DB:swissprot] >pir:[LN:H69952]
[AC:H69952 ] [PN:hypothetical protein yqeZ] [GN:yqeZ ] [OR:Bacillus subtilis] [DB:pir2]
>gp:[GI:d1013151:g1303816] [LN:BACJH642] [AC:D84432:D82370] [PN:YqeZ] [OR:Bacillus
subtilis] [SR:Bacillus subtilis (strain:JH642(trpC2 PheA1)) DNA] [DB:genpept-bct1]
[DE:Bacillus subtilis DNA, 283 Kb region containing skin element.] [LE:99826]
[RE:101139] [DI:direct] >gp:[GI:e1183769:g2634985] [LN:BSUB0014] [AC:Z99117:AL009126]
[GN:yqeZ] [FN:unknown] [OR:Bacillus subtilis] [DB:genpept-bct1] [DE:Bacillus subtilis
complete genome (section 14 of 21): from 2599451to 2812870.] [SP:P54465] [LE:18291]
[RE:19604] [DI:complement]

| ORF Name | NTID | AAID | NT Length | AA Length | score | probability |
|---|---|---|---|---|---|---|
| AI7503000982_26058467_c1_1064 | 370 | 4142 | 213 | 70 | 119 | 9.1e-07 |

Description
gp:[GI:g861340] [LN:CELE04F6] [AC:U28943] [GN:E04F6.7] [OR:Caenorhabditis elegans]
[SR:Caenorhabditis elegans strain=Bristol N2] [DB:genpept-inv1] [DE:Caenorhabditis
elegans cosmid E04F6.] [NT:similar to ribitol dehydrogenase] [LE:20096:20706:20893]
[RE:20659:20814:21152] [DI:complementJoin]

| ORF Name | NTID | AAID | NT Length | AA Length | score | probability |
|---|---|---|---|---|---|---|
| AI7503000982_26203942_c3_1388 | 371 | 4143 | 630 | 209 | 636 | 3.0e-62 |

Description
pir:[LN:A69969] [AC:A69969 ] [PN:conserved hypothetical protein yqzB] [GN:yqzB ]
[OR:Bacillus subtilis] [DB:pir2] >gp:[GI:e1185791:g2634957] [LN:BSUB0013]
[AC:Z99116:AL009126] [GN:yqzB] [FN:unknown] [OR:Bacillus subtilis] [DB:genpept-bct1]
[DE:Bacillus subtilis complete genome (section 13 of 21): from 2395261to 2613730.]
[NT:similar to hypothetical proteins] [LE:208975] [RE:209613] [DI:complement]
>gp:[GI:e1183755:g2634971] [LN:BSUB0014] [AC:Z99117:AL009126] [GN:yqzB] [FN:unknown]
[OR:Bacillus subtilis] [DB:genpept-bct1] [DE:Bacillus subtilis complete genome (section
14 of 21): from 2599451to 2812870.] [NT:similar to hypothetical proteins] [LE:4785]
[RE:5423] [DI:complement]

| ORF Name | NTID | AAID | NT Length | AA Length | score | probability |
|---|---|---|---|---|---|---|
| AI7503000982_26209425_c1_1022 | 372 | 4144 | 1068 | 355 | 1672 | 4.9e-172 |

Description sp:[LN:RPSD_STAAU] [AC:P26766] [GN:RPOD:PLAC] [OR:STAPHYLOCOCCUS AUREUS] [DE:RNA POLYMERASE SIGMA FACTOR RPOD] [SP:P26766] [DB:swissprot] >pir:[LN:S34442] [AC:S34442 ] [PN:transcription initiation factor sigma plaC] [GN:plaC ] [CL:transcription initiation factor sigma 43: transcription initiation factor sigma katF homology:transcription initiation factor sigma region 1 homology] [OR:Staphylococcus aureus] [DB:pir2] >gp:[GI:g153069] [LN:STAPLAC] [AC:M63177] [PN:sigma factor] [GN:plaC] [OR:Staphylococcus aureus] [SR:Staphylococcus aureus (strain SA20) DNA] [DB:genpept-bct1] [DE:S.aureus sigma factor (plaC) gene, complete cds.] [LE:820] [RE:1926] [DI:direct]

| ORF Name | NTID | AAID | NT Length | AA Length | score | probability |
|---|---|---|---|---|---|---|
| AI7503000982_26212501_c3_1394 | 373 | 4145 | 852 | 283 | 797 | 2.6e-79 |

Description gp:[GI:g5019735] [LN:AF104349] [AC:AF104349] [PN:hydrophobic membrane protein ZurM] [GN:zurM] [OR:Listeria monocytogenes] [DB:genpept-bct2] [DE:Listeria monocytogenes zinc-like uptake operon, complete sequence.] [LE:860] [RE:1747] [DI:direct]

| ORF Name | NTID | AAID | NT Length | AA Length | score | probability |
|---|---|---|---|---|---|---|
| AI7503000982_26225463_c1_1070 | 374 | 4146 | 741 | 246 | 821 | 7.4e-82 |

Description sp:[LN:RESD_BACSU] [AC:P35163] [GN:RESD] [OR:BACILLUS SUBTILIS] [DE:TRANSCRIPTIONAL REGULATORY PROTEIN RESD] [SP:P35163] [DB:swissprot] >pir:[LN:G69691] [AC:G69691:S45559 ] [PN:two-component response regulator involved in aerobic and anaer resD] [GN:resD ] [CL:ompR protein:response regulator homology] [OR:Bacillus subtilis] [DB:pir2] >gp:[GI:g410141] [LN:BACDIA] [AC:L09228] [OR:Bacillus subtilis] [SR:Bacillus subtilis (strain 168, sub_species Marburg) DNA] [DB:genpept-bct1] [DE:Bacillus subtilis spoVA to serA region.] [NT:ORFX17] [LE:21706] [RE:22428] [DI:direct] >gp:[GI:e1185581:g2634747] [LN:BSUB0013] [AC:Z99116:AL009126] [PN:two-component response regulator] [GN:resD] [FN:activation role in global regulation of aerobic] [OR:Bacillus subtilis] [DB:genpept-bct1] [DE:Bacillus subtilis complete genome (section 13 of 21): from 2395261to 2613730.] [NT:alternate gene name: ypxD] [SP:P35163] [LE:21155] [RE:21877] [DI:complement]

| ORF Name | NTID | AAID | NT Length | AA Length | score | probability |
|---|---|---|---|---|---|---|
| AI7503000982_26251577_c1_994 | 375 | 4147 | 354 | 117 | 372 | 2.8e-34 |

Description sp:[LN:YQEL_BACSU] [AC:P54457] [GN:YQEL] [OR:BACILLUS SUBTILIS] [DE:HYPOTHETICAL 13.3 KD PROTEIN IN AROD-COMER INTERGENIC REGION] [SP:P54457] [DB:swissprot] >pir:[LN:H69951] [AC:H69951 ] [PN:ybeB protein homolog yqeL] [GN:yqeL ] [CL:Escherichia coli ybeB protein] [OR:Bacillus subtilis] [DB:pir2] >gp:[GI:d1013128:g1303793] [LN:BACJH642] [AC:D84432:D82370] [PN:YqeL] [OR:Bacillus subtilis] [SR:Bacillus subtilis (strain:JH642(trpC2 PheA1)) DNA] [DB:genpept-bct1] [DE:Bacillus subtilis DNA, 283 Kb region containing skin element.] [LE:76417] [RE:76773] [DI:direct] >gp:[GI:e1183792:g2635008] [LN:BSUB0014] [AC:Z99117:AL009126] [GN:yqeL] [FN:unknown] [OR:Bacillus subtilis] [DB:genpept-bct1] [DE:Bacillus subtilis complete genome (section 14 of 21): from 2599451to 2812870.] [NT:similar to hypothetical proteins] [SP:P54457] [LE:42657] [RE:43013] [DI:complement]

| ORF Name | NTID | AAID | NT Length | AA Length | score | probability |
|---|---|---|---|---|---|---|
| AI7503000982_26259657_c1_1051 | 376 | 4148 | 1425 | 474 | 1155 | 3.0e-117 |

Description
sp:[LN:DLD2_BACSU] [AC:P54533] [GN:BFMBC] [OR:BACILLUS SUBTILIS] [EC:1.8.1.4] [DE:DEHYDROGENASE) (LPD-VAL)] [SP:P54533] [DB:swissprot]

| ORF Name | NTID | AAID | NT Length | AA Length | score | probability |
|---|---|---|---|---|---|---|
| AI7503000982_26306713_c2_1332 | 377 | 4149 | 912 | 303 | 580 | 2.6e-56 |

Description
pir:[LN:S72642] [AC:S72642 ] [PN:probable ABC-type transport protein xynB] [GN:xynB ] [OR:Thermoanaerobacterium thermosulfurigenes] [DB:pir2] >gp:[GI:g1255237] [LN:TTU50952] [AC:U50952] [PN:XynB] [GN:xynB] [OR:Thermoanaerobacterium thermosulfurigenes] [DB:genpept-bct1] [DE:Thermoanaerobacterium thermosulfurigenes endoxylanase precursor(XynA) and membrane component of an ABC transporter (XynB) genes,complete cds and XynC (xynC) gene, partial cds.] [NT:Description: membrane component of an ABC] [LE:454] [RE:1359] [DI:direct]

| ORF Name | NTID | AAID | NT Length | AA Length | score | probability |
|---|---|---|---|---|---|---|
| AI7503000982_26368950_c2_1264 | 378 | 4150 | 1380 | 459 | 744 | 4.7e-76 |

Description
sp:[LN:RECQ_BACSU] [AC:P50729] [GN:RECQ] [OR:BACILLUS SUBTILIS] [EC:3.6.1.-] [DE:ATP-DEPENDENT DNA HELICASE RECQ,] [SP:P50729] [DB:swissprot] >pir:[LN:A69691] [AC:A69691 ] [PN:ATP-dependent DNA helicase homolog:ATP-dependent DNA helicase recQ] [GN:recQ ] [CL:DEAD/H box helicase homology] [OR:Bacillus subtilis] [DB:pir2] >gp:[GI:e1183747:g2634720] [LN:BSUB0012] [AC:Z99115:AL009126] [PN:ATP-dependent DNA helicase] [GN:recQ] [OR:Bacillus subtilis] [DB:genpept-bct1] [EC:3.6.1.-] [DE:Bacillus subtilis complete genome (section 12 of 21): from 2195541to 2409220.] [SP:P50729] [LE:210616] [RE:212106] [DI:complement] >gp:[GI:e1185571:g2634737] [LN:BSUB0013] [AC:Z99116:AL009126] [PN:ATP-dependent DNA helicase] [GN:recQ] [OR:Bacillus subtilis] [DB:genpept-bct1] [EC:3.6.1.-] [DE:Bacillus subtilis complete genome (section 13 of 21): from 2395261to 2613730.] [SP:P50729] [LE:10896] [RE:12386] [DI:complement] >gp:[GI:g1146200] [LN:BACSERA] [AC:L47648] [PN:DNA or RNA helicase, DNA-dependent ATPase] [GN:recS] [FN:DNA repair and homologous recombination] [OR:Bacillus subtilis] [DB:genpept-bct2] [DE:Bacillus subtilis phosphoglycerate dehydrogenase (serA), ypaA,ferredoxin (fer), ypbB, recS, ypbD, ypbE, ypbF, ypbG, ypbH,glutamate dehydrogenase (ypcA), ypdA, ypdB, ypdC, spore cortexlytic enzyme (sleB), ypeB, ypfA, ypfB, cytidine monophosphatekinase (cmk), ypfD, ypgA, yphA, yphB, yphC, NAD+ dependentglycerol-3-phosphate dehydrogenase (glyc), yphE and yphF genes,complete cds.] [NT:similar to Escherichia coli recQ gene product;] [LE:4291] [RE:5781] [DI:direct]

| ORF Name | NTID | AAID | NT Length | AA Length | score | probability |
|---|---|---|---|---|---|---|
| AI7503000982_26384682_c1_1092 | 379 | 4151 | 1248 | 415 | 561 | 2.6e-54 |

Description
sp:[LN:YPIA_BACSU] [AC:P54389] [GN:YPIA] [OR:BACILLUS SUBTILIS] [DE:HYPOTHETICAL 48.3 KD PROTEIN IN QCRA-AROE INTERGENIC REGION] [SP:P54389] [DB:swissprot] >pir:[LN:E69936] [AC:E69936 ] [PN:conserved hypothetical protein ypiA] [GN:ypiA ] [CL:tetratricopeptide repeat homology] [OR:Bacillus subtilis] [DB:pir2] >gp:[GI:g1146224] [LN:BACYPIA] [AC:L47709] [GN:ypiA] [FN:hypothetical] [OR:Bacillus subtilis] [DB:genpept-bct1] [DE:Bacillus subtilis (clone YAC15-6B) ypiABF genes, qcrABC genes,ypjABCDEFGHI genes, birA gene, panBCD genes, dinG gene, ypmB gene,aspB gene, asnS gene, dnaD gene, nth gene and ypoC gene, completecds's.] [NT:putative] [LE:348] [RE:1619] [DI:direct] >gp:[GI:e1183704:g2634677] [LN:BSUB0012] [AC:Z99115:AL009126] [GN:ypiA] [FN:unknown] [OR:Bacillus subtilis] [DB:genpept-bct1] [DE:Bacillus subtilis complete genome (section 12 of 21): from 2195541to 2409220.] [NT:similar to hypothetical proteins] [SP:P54389] [LE:170048] [RE:171319] [DI:complement]

| ORF Name | NTID | AAID | NT Length | AA Length | score | probability |
|---|---|---|---|---|---|---|
| AI7503000982_26597186_c1_1056 | 380 | 4152 | 444 | 147 | 544 | 1.7e-52 |

Description
sp:[LN:YQIW_BACSU] [AC:P54534] [GN:YQIW] [OR:BACILLUS SUBTILIS] [DE:HYPOTHETICAL 16.2 KD PROTEIN IN BMRU-ANSR INTERGENIC REGION] [SP:P54534] [DB:swissprot] >pir:[LN:E69962] [AC:E69962 ] [PN:conserved hypothetical protein yqiW] [GN:yqiW ] [OR:Bacillus subtilis] [DB:pir2] >gp:[GI:d1013283:g1303948] [LN:BACJH642] [AC:D84432:D82370] [PN:YqiW] [OR:Bacillus subtilis] [SR:Bacillus subtilis (strain:JH642(trpC2 PheA1)) DNA] [DB:genpept-bct1] [DE:Bacillus subtilis DNA, 283 Kb region containing skin element.] [LE:226148] [RE:226585] [DI:direct] >gp:[GI:e1185667:g2634833] [LN:BSUB0013] [AC:Z99116:AL009126] [GN:yqiW] [FN:unknown] [OR:Bacillus subtilis] [DB:genpept-bct1] [DE:Bacillus subtilis complete genome (section 13 of 21): from 2395261to 2613730.] [NT:similar to hypothetical proteins from B. subtilis] [LE:97034] [RE:97471] [DI:complement]

| ORF Name | NTID | AAID | NT Length | AA Length | score | probability |
|---|---|---|---|---|---|---|
| AI7503000982_26600137_f2_493 | 381 | 4153 | 531 | 176 | 188 | 8.9e-15 |

Description
sp:[LN:YPUF_BACSU] [AC:P17617] [GN:YPUF] [OR:BACILLUS SUBTILIS] [DE:HYPOTHETICAL 21.0 KD PROTEIN IN RIBT-DACB INTERGENIC REGION (ORFX6)] [SP:P17617] [DB:swissprot] >pir:[LN:S45548] [AC:S45548:E69942 ] [PN:hypothetical protein ypuF] [GN:ypuF ] [OR:Bacillus subtilis] [DB:pir2] >gp:[GI:g410130] [LN:BACDIA] [AC:L09228] [OR:Bacillus subtilis] [SR:Bacillus subtilis (strain 168, sub_species Marburg) DNA] [DB:genpept-bct1] [DE:Bacillus subtilis spoVA to serA region.] [NT:ORFX6] [LE:12218] [RE:12742] [DI:complement] >gp:[GI:g580916] [LN:BSRIB] [AC:X51510] [OR:Bacillus subtilis] [DB:genpept-bct1] [DE:B.subtilis riboflavin biosynthesis operon ribG, ribB, ribA, ribH,and ribT genes.] [NT:ORF Y (AA 1-174)] [SP:P17617] [LE:5164] [RE:5688] [DI:complement] >gp:[GI:e1185592:g2634758] [LN:BSUB0013] [AC:Z99116:AL009126] [GN:ypuF] [FN:unknown] [OR:Bacillus subtilis] [DB:genpept-bct1] [DE:Bacillus subtilis complete genome (section 13 of 21): from 2395261to 2613730.] [SP:P17617] [LE:30841] [RE:31365] [DI:direct]

| ORF Name | NTID | AAID | NT Length | AA Length | score | probability |
|---|---|---|---|---|---|---|
| AI7503000982_26752312_c3_1396 | 382 | 4154 | 171 | 56 | 229 | 4.0e-19 |

Description sp:[LN:RL33_BACST] [AC:P23375] [GN:RPMG] [OR:BACILLUS STEAROTHERMOPHILUS] [DE:50S RIBOSOMAL PROTEIN L33] [SP:P23375] [DB:swissprot] >pir:[LN:B48396] [AC:B48396 ] [PN:ribosomal protein L33] [CL:Escherichia coli ribosomal protein L33] [OR:Bacillus stearothermophilus] [DB:pir2]

| ORF Name | NTID | AAID | NT Length | AA Length | score | probability |
|---|---|---|---|---|---|---|
| AI7503000982_26754662_c3_1454 | 383 | 4155 | 672 | 223 | 514 | 2.5e-49 |

Description sp:[LN:KCY_BACSU] [AC:P38493] [GN:CMK:JOFC] [OR:BACILLUS SUBTILIS] [EC:2.7.4.14] [DE:(CMP KINASE)] [SP:P38493] [DB:swissprot] >pir:[LN:F69601] [AC:F69601 ] [PN:cytidylate kinase cmk] [GN:cmk ] [CL:cytidylate kinase cmk] [OR:Bacillus subtilis] [DB:pir2] >gp:[GI:g533105] [LN:BSU11687] [AC:U11687] [PN:unknown] [GN:jofC] [OR:Bacillus subtilis] [DB:genpept-bct1] [DE:Bacillus subtilis 168 jofA, jofB, MssA homolog (jofC) and ribosomalprotein S1 homolog (jofD) genes, complete cds, and joeB gene,partial cds.] [NT:similar to the Escherichia coli mssA gene product] [LE:1744] [RE:2418] [DI:direct] >gp:[GI:e1183734:g2634707] [LN:BSUB0012] [AC:Z99115:AL009126] [PN:cytidylate kinase] [GN:cmk] [OR:Bacillus subtilis] [DB:genpept-bct1] [EC:2.7.4.14] [DE:Bacillus subtilis complete genome (section 12 of 21): from 2195541to 2409220.] [NT:alternate gene name: jofC, ypfC] [SP:P38493] [LE:199742] [RE:200416] [DI:complement] >gp:[GI:e1185558:g2634724] [LN:BSUB0013] [AC:Z99116:AL009126] [PN:cytidylate kinase] [GN:cmk] [OR:Bacillus subtilis] [DB:genpept-bct1] [EC:2.7.4.14] [DE:Bacillus subtilis complete genome (section 13 of 21): from 2395261to 2613730.] [NT:alternate gene name: jofC, ypfC] [SP:P38493] [LE:22] [RE:696] [DI:complement] >gp:[GI:g1146214] [LN:BACSERA] [AC:L47648] [PN:cytidine monophosphate kinase] [GN:cmk] [FN:cytidine diphosphate biosynthesis] [OR:Bacillus subtilis] [DB:genpept-bct2] [DE:Bacillus subtilis phosphoglycerate dehydrogenase (serA), ypaA,ferredoxin (fer), ypbB, recS, ypbD, ypbE, ypbF, ypbG, ypbH,glutamate dehydrogenase (ypcA), ypdA, ypdB, ypdC, spore cortexlytic enzyme (sleB), ypeB, ypfA, ypfB, cytidine monophosphatekinase (cmk), ypfD, ypgA, yphA, yphB, yphC, NAD+ dependentglycerol-3-phosphate dehydrogenase (glyc), yphE and yphF genes,complete cds.] [NT:similar to Escherichia coli smba supress; putative] [LE:15981] [RE:16655] [DI:direct]

| ORF Name | NTID | AAID | NT Length | AA Length | score | probability |
|---|---|---|---|---|---|---|
| AI7503000982_26754750_c2_1172 | 384 | 4156 | 1164 | 387 | 895 | 1.1e-89 |

Description pir:[LN:E69981] [AC:E69981 ] [PN:NifS protein homolog homolog yrvO] [GN:yrvO ] [CL:nitrogen fixation protein nifS] [OR:Bacillus subtilis] [DB:pir2] >gp:[GI:e1183981:g2635197] [LN:BSUB0014] [AC:Z99117:AL009126] [GN:yrvO] [FN:unknown] [OR:Bacillus subtilis] [DB:genpept-bct1] [DE:Bacillus subtilis complete genome (section 14 of 21): from 2599451to 2812870.] [NT:similar to NifS protein homolog] [LE:210475] [RE:211515] [DI:complement] >gp:[GI:e1183999:g2635215] [LN:BSUB0015] [AC:Z99118:AL009126] [GN:yrvO] [FN:unknown] [OR:Bacillus subtilis] [DB:genpept-bct1] [DE:Bacillus subtilis complete genome (section 15 of 21): from 2795131to 3013540.] [NT:similar to NifS protein homolog] [LE:14795] [RE:15835] [DI:complement]

| ORF Name | NTID | AAID | NT Length | AA Length | score | probability |
|---|---|---|---|---|---|---|
| AI7503000982_26772135_c1_1000 | 385 | 4157 | 996 | 331 | 555 | 1.1e-53 |

Description
sp:[LN:YQEN_BACSU] [AC:P54459] [GN:YQEN] [OR:BACILLUS SUBTILIS] [DE:HYPOTHETICAL 40.5 KD PROTEIN IN COMEC-RPST INTERGENIC REGION] [SP:P54459] [DB:swissprot] >pir:[LN:B69952] [AC:B69952 ] [PN:conserved hypothetical protein yqeN] [GN:yqeN ] [OR:Bacillus subtilis] [DB:pir2] >gp:[GI:d1013134:g1303799] [LN:BACJH642] [AC:D84432:D82370] [PN:YqeN] [OR:Bacillus subtilis] [SR:Bacillus subtilis (strain:JH642(trpC2 PheAl)) DNA] [DB:genpept-bct1] [DE:Bacillus subtilis DNA, 283 Kb region containing skin element.] [LE:82475] [RE:83518] [DI:direct] >gp:[GI:e1183786:g2635002] [LN:BSUB0014] [AC:Z99117:AL009126] [GN:yqeN] [FN:unknown] [OR:Bacillus subtilis] [DB:genpept-bct1] [DE:Bacillus subtilis complete genome (section 14 of 21): from 2599451to 2812870.] [NT:similar to hypothetical proteins] [SP:P54459] [LE:35912] [RE:36955] [DI:complement]

| ORF Name | NTID | AAID | NT Length | AA Length | score | probability |
|---|---|---|---|---|---|---|
| AI7503000982_26774062_c2_1268 | 386 | 4158 | 1332 | 443 | 1670 | 8.0e-172 |

Description
sp:[LN:YPHC_BACSU] [AC:P50743] [GN:YPHC] [OR:BACILLUS SUBTILIS] [DE:REGION] [SP:P50743] [DB:swissprot] >pir:[LN:A69936] [AC:A69936 ] [PN:conserved hypothetical protein yphC] [GN:yphC ] [CL:Mycobacterium leprae probable GTP-binding protein:translation elongation factor Tu homology] [OR:Bacillus subtilis] [DB:pir2] >gp:[GI:e1183729:g2634702] [LN:BSUB0012] [AC:Z99115:AL009126] [GN:yphC] [FN:unknown] [OR:Bacillus subtilis] [DB:genpept-bct1] [DE:Bacillus subtilis complete genome (section 12 of 21): from 2195541to 2409220.] [NT:similar to hypothetical proteins] [LE:193903] [RE:195213] [DI:complement] >gp:[GI:g1146219] [LN:BACSERA] [AC:L47648] [GN:yphC] [OR:Bacillus subtilis] [DB:genpept-bct2] [DE:Bacillus subtilis phosphoglycerate dehydrogenase (serA), ypaA,ferredoxin (fer), ypbB, recS, ypbD, ypbE, ypbF, ypbG, ypbH,glutamate dehydrogenase (ypcA), ypdA, ypdB, ypdC, spore cortexlytic enzyme (sleB), ypeB, ypfA, ypfB, cytidine monophosphatekinase (cmk), ypfD, ypgA, yphA, yphB, yphC, NAD+ dependentglycerol-3-phosphate dehydrogenase (glyc), yphE and yphF genes,complete cds.] [NT:similar to Escherichia coli GTP-binding protein] [LE:21184] [RE:22494] [DI:direct]

| ORF Name | NTID | AAID | NT Length | AA Length | score | probability |
|---|---|---|---|---|---|---|
| AI7503000982_2756288_c2_1257 | 387 | 4159 | 183 | 60 | | |

Description
NO-HIT

| ORF Name | NTID | AAID | NT Length | AA Length | score | probability |
|---|---|---|---|---|---|---|
| AI7503000983_10000128_f2_399 | 388 | 4160 | 159 | 52 | | |

Description
NO-HIT

| ORF_Name | NTID | AAID | NT Length | AA Length | score | probability |
|---|---|---|---|---|---|---|
| AI7503000983_10195942_c3_1056 | 389 | 4161 | 636 | 211 | 253 | 1.2e-21 |

Description
sp:[LN:TRPF_THEMA] [AC:Q56320] [GN:TRPF] [OR:THERMOTOGA MARITIMA] [EC:5.3.1.24] [DE:N-(5'-PHOSPHORIBOSYL)ANTHRANILATE ISOMERASE, (PRAI)] [SP:Q56320] [DB:swissprot] >pir:[LN:S59048] [AC:S59048 ] [PN:phosphoribosyl anthranilate isomerase trpF] [GN:trpF] [CL:phosphoribosylanthranilate isomerase:trpF homology] [OR:Thermotoga maritima] [DB:pir2] >gp:[GI:g1054860] [LN:TMTRABCDF] [AC:X92729] [PN:phosphoribosyl anthranilate isomerase] [GN:trpF] [OR:Thermotoga maritima] [DB:genpept-bct1] [DE:T.maritima trpD, trpC, trpF, trpB, and trpA genes.] [SP:Q56320] [LE:1012] [RE:1629] [DI:direct] >gp:[GI:g4980631] [LN:AE001699] [AC:AE001699:AE000512] [PN:phosphoribosylanthranilate isomerase] [GN:TM0139] [OR:Thermotoga maritima] [DB:genpept-bct2] [DE:Thermotoga maritima section 11 of 136 of the complete genome.] [NT:similar to PID:1054860 SP:Q56320 GB:AE000512] [LE:7969] [RE:8586] [DI:complement]

| ORF_Name | NTID | AAID | NT Length | AA Length | score | probability |
|---|---|---|---|---|---|---|
| AI7503000983_10553766_f2_397 | 390 | 4162 | 195 | 64 | | |

Description
NO-HIT

| ORF_Name | NTID | AAID | NT Length | AA Length | score | probability |
|---|---|---|---|---|---|---|
| AI7503000983_1058463_c3_978 | 391 | 4163 | 2121 | 706 | 2472 | 8.3e-257 |

Description
pir:[LN:S70691] [AC:S70691:C69680 ] [PN:polyribonucleotide nucleotidyltransferase, alpha chain pnpA:polynucleotide phosphorylase pnpA] [GN:pnpA ] [CL:polyribonucleotide nucleotidyltransferase alpha chain] [OR:Bacillus subtilis] [EC:2.7.7.8] [DB:pir2] >gp:[GI:e1185260:g2634041] [LN:BSUB0009] [AC:Z99112:AL009126] [PN:polynucleotide phosphorylase (PNPase)] [GN:pnpA] [FN:necessary for competence development] [OR:Bacillus subtilis] [DB:genpept-bct1] [EC:2.7.7.8] [DE:Bacillus subtilis complete genome (section 9 of 21): from 1598421to 1807200.] [NT:alternate gene name: comR] [SP:P50849] [LE:140354] [RE:142471] [DI:direct] >gp:[GI:g1184680] [LN:BSU29668] [AC:U29668] [PN:polynucleotide phosphorylase] [GN:pnpA] [OR:Bacillus subtilis] [DB:genpept-bct2] [DE:Bacillus subtilis ribosomal protein RpsO (rpsO) gene, partial cds,and polynucleotide phosphorylase (pnpA) gene, complete cds.] [LE:224] [RE:2341] [DI:direct]

| ORF_Name | NTID | AAID | NT Length | AA Length | score | probability |
|---|---|---|---|---|---|---|
| AI7503000983_10657925_c3_1017 | 392 | 4164 | 948 | 315 | 573 | 1.4e-55 |

Description
pir:[LN:H69722] [AC:H69722:B25364 ] [PN:homoserine kinase,] [GN:thrB ] [CL:homoserine kinase thrB] [OR:Bacillus subtilis] [EC:2.7.1.39] [DB:pir2] >gp:[GI:e1184303:g2635721] [LN:BSUB0017] [AC:Z99120:AL009126] [PN:homoserine kinase] [GN:thrB] [FN:threonine biosynthesis] [OR:Bacillus subtilis] [DB:genpept-bct1] [EC:2.7.1.39] [DE:Bacillus subtilis complete genome (section 17 of 21): from 3197001to 3414420.] [NT:alternate gene name: thrA] [LE:114902] [RE:115831] [DI:complement]

| ORF_Name | NTID | AAID | NT Length | AA Length | score | probability |
|---|---|---|---|---|---|---|
| AI7503000983_10667002_f2_278 | 393 | 4165 | 189 | 62 | | |

Description
NO-HIT

| ORF Name | NTID | AAID | NT Length | AA Length | score | probability |
|---|---|---|---|---|---|---|
| AI7503000983_1074090_c1_728 | 394 | 4166 | 906 | 301 | 697 | 1.0e-68 |

Description sp:[LN:CODV_BACSU] [AC:P39776] [GN:CODV] [OR:BACILLUS SUBTILIS] [DE:PROBABLE INTEGRASE/RECOMBINASE CODV] [SP:P39776] [DB:swissprot] >pir:[LN:G69601] [AC:G69601:S61493:S72309 ] [PN:integrase/recombinase codV] [GN:codV ] [CL:probable site-specific integrase/recombinase XerC] [OR:Bacillus subtilis] [DB:pir2] >gp:[GI:g535348] [LN:BSU13634] [AC:U13634] [PN:CodV] [GN:codV] [OR:Bacillus subtilis] [DB:genpept-bct1] [DE:Bacillus subtilis JH642 dipeptide permease operon regulators, codV,codW, codX, and codY genes, complete cds.] [LE:293] [RE:1207] [DI:direct] >gp:[GI:e1185205:g2633986] [LN:BSUB0009] [AC:Z99112:AL009126] [PN:integrase/recombinase] [GN:codV] [OR:Bacillus subtilis] [DB:genpept-bct1] [DE:Bacillus subtilis complete genome (section 9 of 21): from 1598421to 1807200.] [SP:P39776] [LE:88166] [RE:89080] [DI:direct]

| ORF Name | NTID | AAID | NT Length | AA Length | score | probability |
|---|---|---|---|---|---|---|
| AI7503000983_10975428_f2_340 | 395 | 4167 | 879 | 292 | 80 | 0.013 |

Description sp:[LN:BICD_DROME] [AC:P16568] [GN:BICD] [OR:DROSOPHILA MELANOGASTER] [SR:,FRUIT FLY] [DE:CYTOSKELETON-LIKE BICAUDAL D PROTEIN] [SP:P16568] [DB:swissprot] >pir:[LN:A33636] [AC:A33636 ] [PN:bicaudal protein D] [GN:BicD ] [OR:Drosophila melanogaster] [DB:pir2] >gp:[GI:g157006] [LN:DROBICD] [AC:M31684] [OR:Drosophila melanogaster] [SR:D.melanogaster (strain DfTW119) embryo, cDNA to mRNA] [DB:genpept-inv1] [DE:D.melanogaster cytoskeleton-like bicaudalD protein (BicD) mRNA,complete cds.] [NT:bicaudalD protein] [LE:132] [RE:2480] [DI:direct]

| ORF Name | NTID | AAID | NT Length | AA Length | score | probability |
|---|---|---|---|---|---|---|
| AI7503000983_1179775_f1_70 | 396 | 4168 | 132 | 43 | 42 | 0.029 |

Description pir:[LN:S78676] [AC:S78676:S78677 ] [PN:hypothetical protein Q0144] [OR:mitochondrion Saccharomyces cerevisiae] [DB:pir2] >gp:[GI:e1370708:g4160384] [LN:SCE011856] [AC:AJ011856] [OR:Mitochondrion Saccharomyces cerevisiae] [SR:baker's yeast] [DB:genpept-pln1] [DE:Saccharomyces cerevisiae complete mitochondrial genome.] [NT:ORF Q0144] [LE:54109] [RE:54438] [DI:direct]

| ORF Name | NTID | AAID | NT Length | AA Length | score | probability |
|---|---|---|---|---|---|---|
| AI7503000983_11817625_f1_65 | 397 | 4169 | 129 | 42 | | |

Description

NO-HIT

| ORF Name | NTID | AAID | NT Length | AA Length | score | probability |
|---|---|---|---|---|---|---|
| AI7503000983_1183337_c2_847 | 398 | 4170 | 447 | 148 | 303 | 5.8e-27 |

Description sp:[LN:NUSA_BACSU] [AC:P32727] [GN:NUSA] [OR:BACILLUS SUBTILIS] [DE:N UTILIZATION SUBSTANCE PROTEIN A HOMOLOG (NUSA PROTEIN)] [SP:P32727] [DB:swissprot] >pir:[LN:C36905] [AC:C36905:B69668:S31991 ] [PN:transcription termination-antitermination factor nusA] [GN:nusA ] [CL:Bacillus transcription termination factor nusA: transcription termination factor nusA homology] [OR:Bacillus subtilis] [DB:pir2] >gp:[GI:g49316] [LN:BSORF1T7A] [AC:Z18631] [GN:ORF2] [OR:Bacillus subtilis] [DB:genpept-bct1] [DE:B.subtilis infB-nusA operon.] [SP:P32727] [LE:961] [RE:2076] [DI:direct]

| ORF Name | NTID | AAID | NT Length | AA Length | score | probability |
|---|---|---|---|---|---|---|
| AI7503000983_11844802_c2_941 | 399 | 4171 | 327 | 108 | | |

Description
NO-HIT

| ORF Name | NTID | AAID | NT Length | AA Length | score | probability |
|---|---|---|---|---|---|---|
| AI7503000983_11926627_f3_614 | 400 | 4172 | 171 | 56 | | |

Description
NO-HIT

| ORF Name | NTID | AAID | NT Length | AA Length | score | probability |
|---|---|---|---|---|---|---|
| AI7503000983_11930317_c3_974 | 401 | 4173 | 336 | 111 | 251 | 1.9e-21 |

Description
sp:[LN:YLXQ_BACSU] [AC:P32729] [GN:YLXQ] [OR:BACILLUS SUBTILIS] [DE:PROBABLE RIBOSOMAL
PROTEIN IN NUSA-INFB INTERGENIC REGION (ORF4)] [SP:P32729] [DB:swissprot]
>pir:[LN:E36905] [AC:E36905:C69882:S31993 ] [PN:ribosomal protein L7AE family homolog
ylxQ:hypothetical protein 2 (infB 5' region)] [GN:ylxQ ] [OR:Bacillus subtilis]
[DB:pir2] >gp:[GI:g49318] [LN:BSORF1T7A] [AC:Z18631] [GN:ORF4] [OR:Bacillus subtilis]
[DB:genpept-bct1] [DE:B.subtilis infB-nusA operon.] [SP:P32729] [LE:2367] [RE:2669]
[DI:direct] >gp:[GI:e1185253:g2634034] [LN:BSUB0009] [AC:Z99112:AL009126] [GN:ylxQ]
[FN:unknown] [OR:Bacillus subtilis] [DB:genpept-bct1] [DE:Bacillus subtilis complete
genome (section 9 of 21): from 1598421to 1807200.] [NT:alternate gene name: ymxC;
similar to ribosomal] [SP:P32729] [LE:134658] [RE:134960] [DI:direct]

| ORF Name | NTID | AAID | NT Length | AA Length | score | probability |
|---|---|---|---|---|---|---|
| AI7503000983_1212785_f1_108 | 402 | 4174 | 213 | 70 | 74 | 0.048 |

Description
pir:[LN:G70047] [AC:G70047 ] [PN:conserved hypothetical protein yvrM] [GN:yvrM ]
[OR:Bacillus subtilis] [DB:pir2] >gp:[GI:e1184405:g2635823] [LN:BSUB0017]
[AC:Z99120:AL009126] [GN:yvrM] [FN:unknown] [OR:Bacillus subtilis] [DB:genpept-bct1]
[DE:Bacillus subtilis complete genome (section 17 of 21): from 3197001to 3414420.]
[NT:similar to hypothetical proteins] [LE:214190] [RE:214951] [DI:complement]
>gp:[GI:e1186014:g2635839] [LN:BSUB0018] [AC:Z99121:AL009126] [GN:yvrM] [FN:unknown]
[OR:Bacillus subtilis] [DB:genpept-bct1] [DE:Bacillus subtilis complete genome (section
18 of 21): from 3399551to 3609060.] [NT:similar to hypothetical proteins] [LE:11640]
[RE:12401] [DI:complement]

| ORF Name | NTID | AAID | NT Length | AA Length | score | probability |
|---|---|---|---|---|---|---|
| AI7503000983_12694082_c2_889 | 403 | 4175 | 192 | 63 | | |

Description
NO-HIT

| ORF Name | NTID | AAID | NT Length | AA Length | score | probability |
|---|---|---|---|---|---|---|
| AI7503000983_12703763_f3_592 | 404 | 4176 | 159 | 52 | | |

Description
NO-HIT

| ORF Name | NTID | AAID | NT Length | AA Length | score | probability |
|---|---|---|---|---|---|---|
| AI7503000983_13087513_c2_907 | 405 | 4177 | 3033 | 1010 | 417 | 4.1e-65 |

Description
pir:[LN:D71302] [AC:D71302 ] [PN:probable exonuclease (sbcC)] [GN:TP0627 ]
[OR:Treponema pallidum subsp. pallidum] [SR:, syphilis spirochete] [DB:pir2]
>gp:[GI:g3322922] [LN:AE001237] [AC:AE001237:AE000520] [PN:exonuclease (sbcC)]
[GN:TP0627] [OR:Treponema pallidum] [DB:genpept-bct2] [DE:Treponema pallidum section 53
of 87 of the complete genome.] [NT:similar to SP:P13458 GB:X15981 PID:145327 PID:42914]
[LE:12418] [RE:15561] [DI:direct]

| ORF Name | NTID | AAID | NT Length | AA Length | score | probability |
|---|---|---|---|---|---|---|
| AI7503000983_13179692_c1_724 | 406 | 4178 | 132 | 43 | | |

Description
NO-HIT

| ORF Name | NTID | AAID | NT Length | AA Length | score | probability |
|---|---|---|---|---|---|---|
| AI7503000983_1360958_c2_905 | 407 | 4179 | 270 | 89 | 109 | 2.1e-06 |

Description
pir:[LN:C69891] [AC:C69891:S57406 ] [PN:yneJ protein:protein 160] [GN:yneJ ]
[OR:Bacillus subtilis] [DB:pir2] >gp:[GI:e249647:g1405451] [LN:BC170DEGR] [AC:Z73234]
[PN:YneJ] [GN:yneJ] [OR:Bacillus subtilis] [DB:genpept-bct1] [DE:B.subtilis DNA (26.2
kb fragment; 170 degree region).] [NT:identical to yoxI (from acc. no. X87845)]
[SP:P45710] [LE:6147] [RE:6638] [DI:direct] >gp:[GI:e1183454:g2634179] [LN:BSUB0010]
[AC:Z99113:AL009126] [GN:yneJ] [FN:unknown] [OR:Bacillus subtilis] [DB:genpept-bct1]
[DE:Bacillus subtilis complete genome (section 10 of 21): from 1781201to 2014980.]
[NT:alternate gene name: yoxI] [SP:P45710] [LE:142526] [RE:143017] [DI:direct]

| ORF Name | NTID | AAID | NT Length | AA Length | score | probability |
|---|---|---|---|---|---|---|
| AI7503000983_13678135_f3_575 | 408 | 4180 | 159 | 52 | 84 | 0.00093 |

Description
pir:[LN:B71622] [AC:B71622 ] [PN:metal binding protein (DHHC domain) PFB0140w]
[GN:PFB0140w ] [OR:Plasmodium falciparum] [DB:pir2] >gp:[GI:g3845106] [LN:AE001375]
[AC:AE001375:AE001362] [PN:metal binding protein (DHHC domain)] [GN:PFB0140w]
[OR:Plasmodium falciparum] [SR:malaria parasite P. falciparum] [DB:genpept-inv2]
[DE:Plasmodium falciparum chromosome 2, section 12 of 73 of thecomplete sequence.]
[NT:identified by sequence similarity; putative] [LE:814] [RE:1050] [DI:direct]

| ORF Name | NTID | AAID | NT Length | AA Length | score | probability |
|---|---|---|---|---|---|---|
| AI7503000983_13678462_f1_15 | 409 | 4181 | 564 | 187 | 303 | 5.8e-27 |

Description
sp:[LN:SPHX_SYNP7] [AC:P39665] [GN:SPHX] [OR:SYNECHOCOCCUS SP] [SR:PCC 7942,ANACYSTIS
NIDULANS R2] [DE:SPHX PROTEIN PRECURSOR] [SP:P39665] [DB:swissprot] >pir:[LN:S54402]
[AC:S54402 ] [PN:SphX protein] [CL:sphX protein] [OR:Synechococcus sp.] [DB:pir2]
>gp:[GI:d1005689:g496319] [LN:SYOSPHX] [AC:D26161] [PN:SphX] [GN:sphX]
[OR:Synechococcus sp.] [SR:Synechococcus sp. (strain:PCC7942) DNA] [DB:genpept-bct1]
[DE:Synechococcus sp. sphX gene for phosphate regulon SphX, completecds.] [LE:317]
[RE:1330] [DI:direct]

| ORF Name | NTID | AAID | NT Length | AA Length | score | probability |
|---|---|---|---|---|---|---|
| AI7503000983_13691280_f1_42 | 410 | 4182 | 135 | 44 | | |

Description
NO-HIT

| ORF Name | NTID | AAID | NT Length | AA Length | score | probability |
|---|---|---|---|---|---|---|
| AI7503000983_13845300_f2_231 | 411 | 4183 | 309 | 102 | 79 | 0.0065 |

Description sp:[LN:YCIB_BUCAP] [AC:P42397] [OR:BUCHNERA APHIDICOLA] [DE:HYPOTHETICAL 21.4 KD PROTEIN IN TRPA 3'REGION] [SP:P42397] [DB:swissprot] >pir:[LN:F49897] [AC:F49897:S36433 ] [PN:protein VI (trpA 3'-region)] [OR:Buchnera aphidicola] [DB:pir2] >gp:[GI:g396663] [LN:BATRYOPEA] [AC:Z19055] [PN:ORF 6] [OR:Buchnera aphidicola] [DB:genpept-bct1] [DE:B.aphidicola tryptophan operon.] [NT:homologous to E. coli ORF6 located downstream of] [SP:P42397] [LE:7540] [RE:8073] [DI:direct]

| ORF Name | NTID | AAID | NT Length | AA Length | score | probability |
|---|---|---|---|---|---|---|
| AI7503000983_13875216_c3_1046 | 412 | 4184 | 1023 | 340 | 895 | 1.1e-89 |

Description gp:[GI:e1181777:g2632149] [LN:SCY14029] [AC:Y14029] [PN:antiterminator] [GN:glcT] [OR:Staphylococcus carnosus] [DB:genpept-bct1] [DE:Staphylococcus carnosus glcT gene.] [LE:213] [RE:1076] [DI:direct]

| ORF Name | NTID | AAID | NT Length | AA Length | score | probability |
|---|---|---|---|---|---|---|
| AI7503000983_14251643_f3_547 | 413 | 4185 | 309 | 102 | 143 | 5.2e-10 |

Description pir:[LN:H69891] [AC:H69891 ] [PN:hypothetical protein yneR] [GN:yneR ] [OR:Bacillus subtilis] [DB:pir2] >gp:[GI:e249654:g1405458] [LN:BC170DEGR] [AC:Z73234] [PN:YneR] [GN:yneR] [OR:Bacillus subtilis] [DB:genpept-bct1] [DE:B.subtilis DNA (26.2 kb fragment; 170 degree region).] [LE:13221] [RE:13508] [DI:complement]
>gp:[GI:e1183464:g2634189] [LN:BSUB0010] [AC:Z99113:AL009126] [GN:yneR] [FN:unknown] [OR:Bacillus subtilis] [DB:genpept-bct1] [DE:Bacillus subtilis complete genome (section 10 of 21): from 1781201to 2014980.] [LE:149600] [RE:149887] [DI:complement]

| ORF Name | NTID | AAID | NT Length | AA Length | score | probability |
|---|---|---|---|---|---|---|
| AI7503000983_14457876_f3_521 | 414 | 4186 | 135 | 44 | 194 | 2.1e-15 |

Description gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF Name | NTID | AAID | NT Length | AA Length | score | probability |
|---|---|---|---|---|---|---|
| AI7503000983_14471938_c3_1027 | 415 | 4187 | 183 | 60 | 231 | 2.5e-19 |

Description sp:[LN:RL33_BACST] [AC:P23375] [GN:RPMG] [OR:BACILLUS STEAROTHERMOPHILUS] [DE:50S RIBOSOMAL PROTEIN L33] [SP:P23375] [DB:swissprot] >pir:[LN:B48396] [AC:B48396 ] [PN:ribosomal protein L33] [CL:Escherichia coli ribosomal protein L33] [OR:Bacillus stearothermophilus] [DB:pir2]

| ORF Name | NTID | AAID | NT Length | AA Length | score | probability |
|---|---|---|---|---|---|---|
| AI7503000983_1461588_f1_16 | 416 | 4188 | 942 | 313 | 712 | 2.6e-70 |

Description pir:[LN:D69419] [AC:D69419 ] [PN:phosphate ABC transporter, permease protein (pstC) homolog] [CL:phoW protein] [OR:Archaeoglobus fulgidus] [DB:pir2] >gp:[GI:g2649218] [LN:AE001010] [AC:AE001010:AE000782] [PN:phosphate ABC transporter, permease protein] [GN:AF1357] [OR:Archaeoglobus fulgidus] [DB:genpept-bct2] [DE:Archaeoglobus fulgidus section 97 of 172 of the complete genome.] [NT:similar to SP:P46339 PID:903304 PID:1303855] [LE:5294] [RE:6187] [DI:direct]

| ORF Name | NTID | AAID | NT Length | AA Length | score | probability |
|---|---|---|---|---|---|---|
| AI7503000983_14634450_f1_1 | 417 | 4189 | 204 | 67 | | |

Description
NO-HIT

| ORF Name | NTID | AAID | NT Length | AA Length | score | probability |
|---|---|---|---|---|---|---|
| AI7503000983_14723387_c2_904 | 418 | 4190 | 282 | 93 | 250 | 2.4e-21 |

Description sp:[LN:YNEF_BACSU] [AC:P45708] [GN:YNEF] [OR:BACILLUS SUBTILIS] [DE:HYPOTHETICAL 8.3 KD PROTEIN IN TTK-CCDA INTERGENIC REGION] [SP:P45708] [DB:swissprot] >pir:[LN:S57403] [AC:S57403:A69891 ] [PN:hypothetical protein yneF] [GN:yneF ] [CL:conserved hypothetical protein yneF] [OR:Bacillus subtilis] [DB:pir2] >gp:[GI:e249644:g1405448] [LN:BC170DEGR] [AC:Z73234] [PN:YneF] [GN:yneF] [OR:Bacillus subtilis] [DB:genpept-bct1] [DE:B.subtilis DNA (26.2 kb fragment; 170 degree region).] [NT:identical to yoxG (from acc. no. X87845)] [SP:P45708] [LE:4225] [RE:4443] [DI:direct] >gp:[GI:g870924] [LN:BSTKTCCDA] [AC:X87845] [GN:orf] [OR:Bacillus subtilis] [DB:genpept-bct1] [DE:B.subtilis ORF120, ORF160, tkt and ccdA genes.] [SP:P45708] [LE:1011] [RE:1229] [DI:direct] >gp:[GI:e1183450:g2634175] [LN:BSUB0010] [AC:Z99113:AL009126] [GN:yneF] [FN:unknown] [OR:Bacillus subtilis] [DB:genpept-bct1] [DE:Bacillus subtilis complete genome (section 10 of 21): from 1781201to 2014980.] [NT:alternate gene name: yoxG] [SP:P45708] [LE:140604] [RE:140822] [DI:direct]

| ORF Name | NTID | AAID | NT Length | AA Length | score | probability |
|---|---|---|---|---|---|---|
| AI7503000983_14850082_f1_18 | 419 | 4191 | 933 | 310 | 880 | 4.2e-88 |

Description sp:[LN:YQGK_BACSU] [AC:P46342] [GN:YQGK] [OR:BACILLUS SUBTILIS] [DE:INTERGENIC REGION (ORF75)] [SP:P46342] [DB:swissprot] >pir:[LN:E69956] [AC:E69956 ] [PN:phosphate ABC transporter (ATP-binding pro) homolog yqgK] [GN:yqgK ] [CL:inner membrane protein malK:ATP-binding cassette homology] [OR:Bacillus subtilis] [DB:pir2] >gp:[GI:d1013193:g1303858] [LN:BACJH642] [AC:D84432:D82370] [PN:YqgK] [OR:Bacillus subtilis] [SR:Bacillus subtilis (strain:JH642(trpC2 PheAl)) DNA] [DB:genpept-bct1] [DE:Bacillus subtilis DNA, 283 Kb region containing skin element.] [LE:141613] [RE:142395] [DI:direct] >gp:[GI:d1010228:g903307] [LN:BACPST] [AC:D58414] [PN:ORF75] [OR:Bacillus subtilis] [SR:Bacillus subtilis (strain:JH642 (trpC2 pheAl)) DNA] [DB:genpept-bct1] [DE:Bacillus subtilis DNA for homologues of the E. coli pst geneproducts.] [NT:Similality to phosphate transport protein (PstB) of] [LE:3782] [RE:4564] [DI:direct] >gp:[GI:e1185762:g2634928] [LN:BSUB0013] [AC:Z99116:AL009126] [GN:yqgK] [FN:unknown] [OR:Bacillus subtilis] [DB:genpept-bct1] [DE:Bacillus subtilis complete genome (section 13 of 21): from 2395261to 2613730.] [NT:alternate gene name: yzmF; similar to phosphate ABC] [SP:P46342] [LE:181226] [RE:182008] [DI:complement]

| ORF Name | NTID | AAID | NT Length | AA Length | score | probability |
|---|---|---|---|---|---|---|
| AI7503000983_14876553_c2_919 | 420 | 4192 | 996 | 331 | 570 | 2.9e-55 |

Description
gp:[GI:g1147744] [LN:EHU42211] [AC:U42211] [PN:PBP 5 synthesis repressor] [GN:psr] [FN:involved in the regulation of penicillin] [OR:Enterococcus hirae] [DB:genpept-bct2] [DE:Enterococcus hirae PBP 5 synthesis repressor (psr) gene, completecds.] [LE:746] [RE:1627] [DI:direct]

| ORF Name | NTID | AAID | NT Length | AA Length | score | probability |
|---|---|---|---|---|---|---|
| AI7503000983_14901512_c3_1012 | 421 | 4193 | 552 | 183 | 500 | 7.7e-48 |

Description
sp:[LN:NUC_STAIN] [AC:P43269] [GN:NUCI:NUC] [OR:STAPHYLOCOCCUS INTERMEDIUS] [EC:3.1.31.1] [DE:(STAPHYLOCOCCAL NUCLEASE)] [SP:P43269] [DB:swissprot] >pir:[LN:S26079] [AC:S26079 ] [PN:thermonuclease] [CL:micrococcal nuclease] [OR:Staphylococcus intermedius] [DB:pir2] >gp:[GI:g47146] [LN:SINUC8] [AC:X67678] [PN:thermonuclease] [GN:nuc] [OR:Staphylococcus intermedius] [DB:genpept-bct1] [DE:S.intermedius nuc gene for thermonuclease.] [SP:P43269] [LE:495] [RE:1001] [DI:direct]

| ORF Name | NTID | AAID | NT Length | AA Length | score | probability |
|---|---|---|---|---|---|---|
| AI7503000983_15084826_c3_1034 | 422 | 4194 | 300 | 99 | 268 | 3.0e-23 |

Description
sp:[LN:CCDC_BACSU] [AC:P45710] [GN:CCDC] [OR:BACILLUS SUBTILIS] [DE:CCDC PROTEIN] [SP:P45710] [DB:swissprot] >gp:[GI:g870927] [LN:BSTKTCCDA] [AC:X87845] [GN:ORF160] [OR:Bacillus subtilis] [DB:genpept-bct1] [DE:B.subtilis ORF120, ORF160, tkt and ccdA genes.] [SP:P45710] [LE:2942] [RE:3424] [DI:direct]

| ORF Name | NTID | AAID | NT Length | AA Length | score | probability |
|---|---|---|---|---|---|---|
| AI7503000983_15757712_f1_23 | 423 | 4195 | 732 | 243 | 686 | 1.5e-67 |

Description
gp:[GI:g3800828] [LN:AF076684] [AC:AF076684] [PN:oligopeptide transporter putative ATPase domain] [GN:opp-2F] [OR:Staphylococcus aureus] [DB:genpept-bct2] [DE:Staphylococcus aureus oligopeptide transporter putative membranepermease domain (opp-2B), oligopeptide transporter putativemembrane permease domain (opp-2C), oligopeptide transporterputative ATPase domain (opp-2D), and oligopeptide transporterputative ATPase domain (opp-2F) genes, complete cds.] [LE:2735] [RE:3436] [DI:direct]

| ORF Name | NTID | AAID | NT Length | AA Length | score | probability |
|---|---|---|---|---|---|---|
| AI7503000983_15803510_c2_854 | 424 | 4196 | 132 | 43 | | |

Description
NO-HIT

| ORF Name | NTID | AAID | NT Length | AA Length | score | probability |
|---|---|---|---|---|---|---|
| AI7503000983_16205378_c1_815 | 425 | 4197 | 243 | 80 | | |

Description
NO-HIT

| ORF Name | NTID | AAID | NT Length | AA Length | score | probability |
|---|---|---|---|---|---|---|
| AI7503000983_162843_f2_330 | 426 | 4198 | 468 | 155 | 395 | 1.0e-36 |

Description
sp:[LN:LYSP_ECOLI] [AC:P25737] [GN:LYSP:CADR] [OR:ESCHERICHIA COLI] [DE:LYSINE-SPECIFIC PERMEASE] [SP:P25737] [DB:swissprot]

| ORF Name | NTID | AAID | NT Length | AA Length | score | probability |
|---|---|---|---|---|---|---|
| AI7503000983_16835388_f1_19 | 427 | 4199 | 654 | 217 | 265 | 6.2e-23 |

Description
gp:[GI:d1023735:g2547082] [LN:D89963] [AC:D89963] [PN:negative regulatory protein of pho regulon] [GN:phoU] [OR:Enterobacter cloacae] [SR:Enterobacter cloacae (strain:IFO3320) DNA] [DB:genpept-bct1] [DE:Enterobacter cloacae pstS, pstC, pstA, pstB and phoU genes,complete cds.] [NT:The phoU gene is required for chemotaxis to ward] [LE:4554] [RE:5279] [DI:direct]

| ORF Name | NTID | AAID | NT Length | AA Length | score | probability |
|---|---|---|---|---|---|---|
| AI7503000983_17040911_c1_771 | 428 | 4200 | 123 | 40 | | |

Description
NO-HIT

| ORF Name | NTID | AAID | NT Length | AA Length | score | probability |
|---|---|---|---|---|---|---|
| AI7503000983_190707_f1_81 | 429 | 4201 | 129 | 42 | | |

Description
NO-HIT

| ORF Name | NTID | AAID | NT Length | AA Length | score | probability |
|---|---|---|---|---|---|---|
| AI7503000983_194431_c3_1033 | 430 | 4202 | 132 | 43 | | |

Description
NO-HIT

| ORF Name | NTID | AAID | NT Length | AA Length | score | probability |
|---|---|---|---|---|---|---|
| AI7503000983_19540678_c1_797 | 431 | 4203 | 438 | 145 | 270 | 7.7e-23 |

Description
gp:[GI:g4835822] [LN:AF102174] [AC:AF102174] [PN:glycine betaine transporter BetL] [GN:betL] [OR:Listeria monocytogenes] [DB:genpept-bct2] [DE:Listeria monocytogenes glycine betaine transporter BetL (betL)gene, complete cds.] [LE:209] [RE:1732] [DI:direct]

| ORF Name | NTID | AAID | NT Length | AA Length | score | probability |
|---|---|---|---|---|---|---|
| AI7503000983_19730438_c2_926 | 432 | 4204 | 1272 | 423 | 2221 | 3.3e-230 |

Description
pir:[LN:JC5326] [AC:JC5326 ] [PN:methicillin resistance factor FEMB] [GN:femB ] [CL:methicillin resistance factor femA] [OR:Staphylococcus epidermidis] [DB:pir2] >gp:[GI:g1815620] [LN:SEU23714] [AC:U23714] [PN:FEMB] [GN:femB] [OR:Staphylococcus epidermidis] [DB:genpept-bct1] [DE:Staphylococcus epidermidis factor essential for methicillinresistance FEMB (femB) gene, complete cds.] [NT:Factor essential for methicillin resistance] [LE:33] [RE:1286] [DI:direct]

| ORF Name | NTID | AAID | NT Length | AA Length | score | probability |
|---|---|---|---|---|---|---|
| AI7503000983_19735887_c1_754 | 433 | 4205 | 1581 | 526 | 1924 | 9.7e-199 |

Description pir:[LN:D69884] [AC:D69884 ] [PN:conserved hypothetical protein ymcB] [GN:ymcB ] [CL:conserved hypothetical protein b0835] [OR:Bacillus subtilis] [DB:pir2] >gp:[GI:e1185292:g2634073] [LN:BSUB0009] [AC:Z99112:AL009126] [GN:ymcB] [FN:unknown] [OR:Bacillus subtilis] [DB:genpept-bct1] [DE:Bacillus subtilis complete genome (section 9 of 21): from 1598421to 1807200.] [NT:similar to hypothetical proteins] [LE:173791] [RE:175320] [DI:direct]

| ORF Name | NTID | AAID | NT Length | AA Length | score | probability |
|---|---|---|---|---|---|---|
| AI7503000983_19953281_c3_1016 | 434 | 4206 | 1347 | 448 | 822 | 5.8e-82 |

Description sp:[LN:DHOM_BACSU] [AC:P19582] [GN:HOM:TDM] [OR:BACILLUS SUBTILIS] [EC:1.1.1.3] [DE:HOMOSERINE DEHYDROGENASE, (HDH)] [SP:P19582] [DB:swissprot] >gp:[GI:g558494] [LN:BACHOM] [AC:M23217:J04034] [PN:homoserine dehydrogenase] [GN:hom] [OR:Bacillus subtilis] [SR:Bacillus subtilis DNA] [DB:genpept-bct1] [EC:1.1.1.3] [DE:Bacillus subtilis homoserine dehydrogenase (hom) gene, completecds, threonine synthase (thrC) gene, 5' end of cds.] [LE:276] [RE:1577] [DI:direct]

| ORF Name | NTID | AAID | NT Length | AA Length | score | probability |
|---|---|---|---|---|---|---|
| AI7503000983_20086512_c2_899 | 435 | 4207 | 654 | 217 | 780 | 1.6e-77 |

Description gp:[GI:g3064126] [LN:AF011784] [AC:AF011784] [PN:catalase] [GN:katA] [OR:Vibrio fischeri] [DB:genpept-bct2] [DE:Vibrio fischeri catalase (katA) gene, complete cds.] [LE:256] [RE:1704] [DI:direct]

| ORF Name | NTID | AAID | NT Length | AA Length | score | probability |
|---|---|---|---|---|---|---|
| AI7503000983_20095803_c3_994 | 436 | 4208 | 207 | 68 | | |

Description

NO-HIT

| ORF Name | NTID | AAID | NT Length | AA Length | score | probability |
|---|---|---|---|---|---|---|
| AI7503000983_20312510_f3_506 | 437 | 4209 | 1041 | 346 | 1070 | 3.1e-108 |

Description gp:[GI:g3800825] [LN:AF076684] [AC:AF076684] [PN:oligopeptide transporter putative membrane] [GN:opp-2B] [OR:Staphylococcus aureus] [DB:genpept-bct2] [DE:Staphylococcus aureus oligopeptide transporter putative membranepermease domain (opp-2B), oligopeptide transporter putativemembrane permease domain (opp-2C), oligopeptide transporterputative ATPase domain (opp-2D), and oligopeptide transporterputative ATPase domain (opp-2F) genes, complete cds.] [LE:173] [RE:1159] [DI:direct]

| ORF Name | NTID | AAID | NT Length | AA Length | score | probability |
|---|---|---|---|---|---|---|
| AI7503000983_20347165_f3_485 | 438 | 4210 | 147 | 48 | | |

Description

NO-HIT

| ORF Name | NTID | AAID | NT Length | AA Length | score | probability |
|---|---|---|---|---|---|---|
| AI7503000983_20370457_c2_884 | 439 | 4211 | 183 | 60 | | |

Description
NO-HIT

| ORF Name | NTID | AAID | NT Length | AA Length | score | probability |
|---|---|---|---|---|---|---|
| AI7503000983_20400051_f2_319 | 440 | 4212 | 810 | 269 | 691 | 4.4e-68 |

Description
sp:[LN:LEXA_BACSU] [AC:P31080] [GN:LEXA:DINR] [OR:BACILLUS SUBTILIS] [DE:SOS REGULATORY PROTEIN LEXA/DINR] [SP:P31080] [DB:swissprot] >pir:[LN:A41315] [AC:A41315:B69651 ] [PN:transcription repressor of SOS regulon lexA/dinR] [GN:lexA:dinR ] [CL:lexA protein] [OR:Bacillus subtilis] [DB:pir2] >gp:[GI:g289288] [LN:BACLEXA] [AC:M64684] [GN:lexA] [OR:Bacillus subtilis] [SR:Bacillus subtilis DNA] [DB:genpept-bct1] [DE:Bacillus subtilis lexA gene, 3' end.] [LE:390] [RE:1007] [DI:direct] >gp:[GI:e1183444:g2634169] [LN:BSUB0010] [AC:Z99113:AL009126] [PN:transcriptional regulator] [GN:lexA] [FN:negative regulation of the SOS regulon] [OR:Bacillus subtilis] [DB:genpept-bct1] [DE:Bacillus subtilis complete genome (section 10 of 21): from 1781201to 2014980.] [NT:alternate gene name: dinR] [SP:P31080] [LE:135694] [RE:136311] [DI:complement]

| ORF Name | NTID | AAID | NT Length | AA Length | score | probability |
|---|---|---|---|---|---|---|
| AI7503000983_20423127_c3_991 | 441 | 4213 | 2676 | 891 | 2302 | 8.6e-239 |

Description
pir:[LN:C69663] [AC:C69663 ] [PN:DNA mismatch repair (recognition) mutS] [GN:mutS ] [CL:DNA mismatch repair protein mutS] [OR:Bacillus subtilis] [DB:pir2] >gp:[GI:e1185295:g2634076] [LN:BSUB0009] [AC:Z99112:AL009126] [GN:mutS] [FN:DNA mismatch repair recognition] [OR:Bacillus subtilis] [DB:genpept-bct1] [DE:Bacillus subtilis complete genome (section 9 of 21): from 1598421to 1807200.] [SP:P49849] [LE:176693] [RE:179269] [DI:direct]

| ORF Name | NTID | AAID | NT Length | AA Length | score | probability |
|---|---|---|---|---|---|---|
| AI7503000983_20485875_c3_1008 | 442 | 4214 | 231 | 76 | | |

Description
NO-HIT

| ORF Name | NTID | AAID | NT Length | AA Length | score | probability |
|---|---|---|---|---|---|---|
| AI7503000983_20501250_c2_922 | 443 | 4215 | 1029 | 342 | 551 | 3.0e-53 |

Description
sp:[LN:TRPD_METJA] [AC:Q57686] [GN:TRPD:MJ0234] [OR:METHANOCOCCUS JANNASCHII] [EC:2.4.2.18] [DE:ANTHRANILATE PHOSPHORIBOSYLTRANSFERASE,] [SP:Q57686] [DB:swissprot] >pir:[LN:C64329] [AC:C64329 ] [PN:anthranilate synthase, subunit II'] [CL:anthranilate phosphoribosyltransferase:trpD homology] [OR:Methanococcus jannaschii] [EC:4.1.3.27] [DB:pir2] [MP:FOR225111-226121 ] >gp:[GI:g1590969] [LN:U67479] [AC:U67479:L77117] [PN:anthranilate synthase component II (trpD)] [GN:MJ0234] [OR:Methanococcus jannaschii] [DB:genpept-bct2] [DE:Methanococcus jannaschii section 21 of 150 of the complete genome.] [NT:similar to GB:M33814 SP:P20574 PID:151234 percent] [LE:3662] [RE:4672] [DI:direct]

| ORF Name | NTID | AAID | NT Length | AA Length | score | probability |
|---|---|---|---|---|---|---|
| AI7503000983_20504512_c2_864 | 444 | 4216 | 1758 | 585 | 808 | 1.8e-80 |

Description gp:[GI:g4981713] [LN:AE001773] [AC:AE001773:AE000512] [PN:2-oxoacid ferredoxin oxidoreductase, alpha] [GN:TM1164] [OR:Thermotoga maritima] [DB:genpept-bct2] [DE:Thermotoga maritima section 85 of 136 of the complete genome.] [NT:similar to GB:AE000666 percent identity: 68.99;] [LE:8189] [RE:9865] [DI:direct]

| ORF Name | NTID | AAID | NT Length | AA Length | score | probability |
|---|---|---|---|---|---|---|
| AI7503000983_205327_c2_836 | 445 | 4217 | 1332 | 443 | 1679 | 8.9e-173 |

Description sp:[LN:GID_BACSU] [AC:P39815] [GN:GID] [OR:BACILLUS SUBTILIS] [DE:GID PROTEIN] [SP:P39815] [DB:swissprot] >pir:[LN:A69632] [AC:A69632:S61497 ] [PN:glucose-inhibited division protein gid] [GN:gid ] [OR:Bacillus subtilis] [DB:pir2] >gp:[GI:e1185204:g2633985] [LN:BSUB0009] [AC:Z99112:AL009126] [PN:glucose-inhibited division protein] [GN:gid] [OR:Bacillus subtilis] [DB:genpept-bct1] [DE:Bacillus subtilis complete genome (section 9 of 21): from 1598421to 1807200.] [NT:alternate gene name: ylyC] [LE:86791] [RE:88098] [DI:direct] >gp:[GI:e332181:g2462971] [LN:BSYLQGCOD] [AC:AJ000975] [PN:Gid protein] [GN:gid] [OR:Bacillus subtilis] [DB:genpept-bct1] [DE:Bacillus subtilis ylqg to codV gene region.] [SP:P39815] [LE:5959] [RE:7266] [DI:direct]

| ORF Name | NTID | AAID | NT Length | AA Length | score | probability |
|---|---|---|---|---|---|---|
| AI7503000983_20745462_c1_767 | 446 | 4218 | 1257 | 418 | 862 | 3.4e-86 |

Description pir:[LN:B69888] [AC:B69888 ] [PN:GTP-binding protein proteinase modulator homolog ynbA] [GN:ynbA ] [CL:GTP-binding protein hflX] [OR:Bacillus subtilis] [DB:pir2] >gp:[GI:g1750108] [LN:BSU66480] [AC:U66480] [PN:YnbA] [GN:ynbA] [OR:Bacillus subtilis] [DB:genpept-bct1] [DE:Bacillus subtilis SpoVK (spoVK), GlnR(glnR), glutamine synthetase (glnA), YnaA (ynaA), YnaB (ynaB), YnaC(ynaC), YnaD (ynaD), YnaE (ynaE), YnaF (ynaF), YnaG (ynaG), YnaH(ynaH), YnaI (ynaI), YnaJ (ynaJ), xylan beta-1,4-xylosidase (xynB),xylose repressor (xylR), xylose isomerase (xylA), xylulose kinase(xylB), YncB (yncB), YncC (yncC), YncD (yncD) and YncE (yncE)genes, complete cds.] [LE:1382] [RE:2386] [DI:direct] >gp:[GI:e1183402:g2634127] [LN:BSUB0010] [AC:Z99113:AL009126] [GN:ynbA] [FN:unknown] [OR:Bacillus subtilis] [DB:genpept-bct1] [DE:Bacillus subtilis complete genome (section 10 of 21): from 1781201to 2014980.] [NT:similar to GTP-binding protein protease modulator] [LE:93433] [RE:94437] [DI:direct]

| ORF Name | NTID | AAID | NT Length | AA Length | score | probability |
|---|---|---|---|---|---|---|
| AI7503000983_20819512_f1_50 | 447 | 4219 | 153 | 50 | | |

Description

NO-HIT

| ORF Name | NTID | AAID | NT Length | AA Length | score | probability |
|---|---|---|---|---|---|---|
| AI7503000983_20968788_f3_579 | 448 | 4220 | 180 | 59 | | |

Description

NO-HIT

| ORF Name | NTID | AAID | NT Length | AA Length | score | probability |
|---|---|---|---|---|---|---|
| AI7503000983_21641877_f2_250 | 449 | 4221 | 954 | 317 | 687 | 1.2e-67 |

Description
pir:[LN:E69419] [AC:E69419 ] [PN:phosphate ABC transporter, permease protein (pstA) homolog] [CL:phoW protein] [OR:Archaeoglobus fulgidus] [DB:pir2] >gp:[GI:g2649217] [LN:AE001010] [AC:AE001010:AE000782] [PN:phosphate ABC transporter, permease protein] [GN:AF1358] [OR:Archaeoglobus fulgidus] [DB:genpept-bct2] [DE:Archaeoglobus fulgidus section 97 of 172 of the complete genome.] [NT:similar to GB:L10328 SP:P07654 GB:K01992 GB:X02723] [LE:6184] [RE:7035] [DI:direct]

| ORF Name | NTID | AAID | NT Length | AA Length | score | probability |
|---|---|---|---|---|---|---|
| AI7503000983_21751938_f3_601 | 450 | 4222 | 708 | 235 | 183 | 3.0e-14 |

Description
gp:[GI:g2897104] [LN:AF020798] [AC:AF020798] [PN:putative host cell surface-exposed lipoprotein] [OR:Streptococcus thermophilus bacteriophage TP-J34] [DB:genpept-phg] [DE:Streptococcus thermophilus bacteriophage lysogeny module, integrasehomolog (int), putative host cell surface-exposed lipoprotein,putative metallo-proteinase, repressor, Cro-like regulatoryprotein, and P1-antirepressor homolog genes, complete cds.] [NT:orf142] [LE:3941] [RE:4369] [DI:complement]

| ORF Name | NTID | AAID | NT Length | AA Length | score | probability |
|---|---|---|---|---|---|---|
| AI7503000983_21912535_f1_212 | 451 | 4223 | 420 | 139 | 75 | 0.018 |

Description
pir:[LN:B21124] [AC:B21124 ] [PN:Bkm-like sex-determining region hypothetical protein CS314] [GN:Bkm ] [OR:Drosophila melanogaster] [DB:pir2]

| ORF Name | NTID | AAID | NT Length | AA Length | score | probability |
|---|---|---|---|---|---|---|
| AI7503000983_2195265_f1_6 | 452 | 4224 | 147 | 48 | | |

Description
NO-HIT

| ORF Name | NTID | AAID | NT Length | AA Length | score | probability |
|---|---|---|---|---|---|---|
| AI7503000983_22304635_f1_113 | 453 | 4225 | 150 | 49 | | |

Description
NO-HIT

| ORF Name | NTID | AAID | NT Length | AA Length | score | probability |
|---|---|---|---|---|---|---|
| AI7503000983_22368803_c2_857 | 454 | 4226 | 2397 | 798 | 1659 | 1.2e-170 |

Description
sp:[LN:SP3E_BACSU] [AC:P21458:P21459] [GN:SPOIIIE] [OR:BACILLUS SUBTILIS] [DE:STAGE III SPORULATION PROTEIN E] [SP:P21458:P21459] [DB:swissprot] >pir:[LN:S09411] [AC:S09411:A32269:B32269:F69712 ] [PN:DNA translocase spoIIIE] [GN:spoIIIE ] [OR:Bacillus subtilis] [DB:pir2] >gp:[GI:e1185271:g2634052] [LN:BSUB0009] [AC:Z99112:AL009126] [PN:DNA translocase] [GN:spoIIIE] [FN:required for chromosome partitioning through] [OR:Bacillus subtilis] [DB:genpept-bct1] [DE:Bacillus subtilis complete genome (section 9 of 21): from 1598421to 1807200.] [SP:P21458] [LE:153248] [RE:155611] [DI:direct]

| ORF Name | NTID | AAID | NT Length | AA Length | score | probability |
|---|---|---|---|---|---|---|
| AI7503000983_22390917_f3_560 | 455 | 4227 | 165 | 54 | | |

Description
NO-HIT

| ORF Name | NTID | AAID | NT Length | AA Length | score | probability |
|---|---|---|---|---|---|---|
| AI7503000983_22444075_c3_959 | 456 | 4228 | 873 | 290 | 788 | 2.3e-78 |

Description
gp:[GI:d1034831:g3767595] [LN:AB015195] [AC:AB015195] [OR:Staphylococcus aureus]
[SR:Staphylococcus aureus (strain:RN450) DNA] [DB:genpept-bct1] [DE:Staphylococcus
aureus gene for LytN and Eprh, complete cds.] [NT:ORF4] [LE:3221] [RE:4024] [DI:direct]
>gp:[GI:d1034831:g3767595] [LN:AB015195] [AC:AB015195] [OR:Staphylococcus aureus]
[SR:Staphylococcus aureus (strain:RN450) DNA] [DB:genpept] [DE:Staphylococcus aureus
gene for LytN and Eprh, complete cds.] [NT:ORF4] [LE:3221] [RE:4024] [DI:direct]

| ORF Name | NTID | AAID | NT Length | AA Length | score | probability |
|---|---|---|---|---|---|---|
| AI7503000983_22453425_f1_196 | 457 | 4229 | 138 | 45 | | |

Description
NO-HIT

| ORF Name | NTID | AAID | NT Length | AA Length | score | probability |
|---|---|---|---|---|---|---|
| AI7503000983_22470463_c3_989 | 458 | 4230 | 810 | 269 | 881 | 3.3e-88 |

Description
pir:[LN:G69884] [AC:G69884 ] [PN:conserved hypothetical protein ymdB] [GN:ymdB ]
[CL:hypothetical protein ymdB] [OR:Bacillus subtilis] [DB:pir2]
>gp:[GI:e1185288:g2634069] [LN:BSUB0009] [AC:Z99112:AL009126] [GN:ymdB] [FN:unknown]
[OR:Bacillus subtilis] [DB:genpept-bct1] [DE:Bacillus subtilis complete genome (section
9 of 21): from 1598421to 1807200.] [NT:similar to hypothetical proteins] [LE:169889]
[RE:170683] [DI:direct]

| ORF Name | NTID | AAID | NT Length | AA Length | score | probability |
|---|---|---|---|---|---|---|
| AI7503000983_22539812_c1_768 | 459 | 4231 | 1254 | 417 | 1290 | 1.5e-131 |

Description
pir:[LN:C69888] [AC:C69888 ] [PN:conserved hypothetical protein ynbB] [GN:ynbB ]
[CL:hypothetical protein ynbB] [OR:Bacillus subtilis] [DB:pir2] >gp:[GI:g1750109]
[LN:BSU66480] [AC:U66480] [PN:YnbB] [GN:ynbB] [OR:Bacillus subtilis] [DB:genpept-bct1]
[DE:Bacillus subtilis SpoVK (spoVK), YnbA (ynbA), YnbB (ynbB), GlnR(glnR), glutamine
synthetase (glnA), YnaA (ynaA), YnaB (ynaB), YnaC(ynaC), YnaD (ynaD), YnaE (ynaE), YnaF
(ynaF), YnaG (ynaG), YnaH(ynaH), YnaI (ynaI), YnaJ (ynaJ), xylan beta-1,4-xylosidase
(xynB),xylose repressor (xylR), xylose isomerase (xylA), xylulose kinase(xylB), YncB
(yncB), YncC (yncC), YncD (yncD) and YncE (yncE)genes, complete cds.] [LE:2574]
[RE:3839] [DI:direct] >gp:[GI:e1183403:g2634128] [LN:BSUB0010] [AC:Z99113:AL009126]
[GN:ynbB] [FN:unknown] [OR:Bacillus subtilis] [DB:genpept-bct1] [DE:Bacillus subtilis
complete genome (section 10 of 21): from 1781201to 2014980.] [NT:similar to
hypothetical proteins] [LE:94625] [RE:95890] [DI:direct]

| ORF_Name | NTID | AAID | NT Length | AA Length | score | probability |
|---|---|---|---|---|---|---|
| AI7503000983_22663932_f1_22 | 460 | 4232 | 972 | 323 | 1021 | 4.8e-103 |

Description gp:[GI:g3800826] [LN:AF076684] [AC:AF076684] [PN:oligopeptide transporter putative membrane] [GN:opp-2C] [OR:Staphylococcus aureus] [DB:genpept-bct2] [DE:Staphylococcus aureus oligopeptide transporter putative membranepermease domain (opp-2B), oligopeptide transporter putativemembrane permease domain (opp-2C), oligopeptide transporterputative ATPase domain (opp-2D), and oligopeptide transporterputative ATPase domain (opp-2F) genes, complete cds.] [LE:1152] [RE:1982] [DI:direct]

| ORF_Name | NTID | AAID | NT Length | AA Length | score | probability |
|---|---|---|---|---|---|---|
| AI7503000983_22850885_c1_752 | 461 | 4233 | 1596 | 531 | 1799 | 1.7e-185 |

Description pir:[LN:F69884] [AC:F69884 ] [PN:conserved hypothetical protein ymdA] [GN:ymdA ] [CL:hypothetical protein ymdA] [OR:Bacillus subtilis] [DB:pir2]
>gp:[GI:e1185287:g2634068] [LN:BSUB0009] [AC:Z99112:AL009126] [GN:ymdA] [FN:unknown] [OR:Bacillus subtilis] [DB:genpept-bct1] [DE:Bacillus subtilis complete genome (section 9 of 21): from 1598421to 1807200.] [NT:similar to hypothetical proteins] [LE:168258] [RE:169820] [DI:direct]

| ORF_Name | NTID | AAID | NT Length | AA Length | score | probability |
|---|---|---|---|---|---|---|
| AI7503000983_23445463_c3_965 | 462 | 4234 | 801 | 266 | 1002 | 4.9e-101 |

Description pir:[LN:A69699] [AC:A69699:S09561 ] [PN:ribosomal protein S2 (rpsB):ribosomal protein BS1] [GN:rpsB ] [CL:Escherichia coli ribosomal protein S2] [OR:Bacillus subtilis] [DB:pir2] >gp:[GI:e1185240:g2634021] [LN:BSUB0009] [AC:Z99112:AL009126] [PN:ribosomal protein S2] [GN:rpsB] [OR:Bacillus subtilis] [DB:genpept-bct1] [DE:Bacillus subtilis complete genome (section 9 of 21): from 1598421to 1807200.] [SP:P21464] [LE:118905] [RE:119645] [DI:direct]

| ORF_Name | NTID | AAID | NT Length | AA Length | score | probability |
|---|---|---|---|---|---|---|
| AI7503000983_23472175_c3_975 | 463 | 4235 | 417 | 138 | 360 | 5.3e-33 |

Description sp:[LN:RBFA_BACSU] [AC:P32731] [GN:RBFA] [OR:BACILLUS SUBTILIS] [DE:RIBOSOME-BINDING FACTOR A (P15B PROTEIN)] [SP:P32731] [DB:swissprot] >pir:[LN:G36905] [AC:G36905:G69689:S31996 ] [PN:ribosome-binding factor A rbfA] [GN:rbfA ] [CL:Escherichia coli protein P15B] [OR:Bacillus subtilis] [DB:pir2] >gp:[GI:g580902] [LN:BSORF1T7A] [AC:Z18631] [GN:ORF6] [OR:Bacillus subtilis] [DB:genpept-bct1] [DE:B.subtilis infB-nusA operon.] [SP:P32731] [LE:5131] [RE:5484] [DI:direct]
>gp:[GI:e1185256:g2634037] [LN:BSUB0009] [AC:Z99112:AL009126] [PN:ribosome-binding factor A] [GN:rbfA] [OR:Bacillus subtilis] [DB:genpept-bct1] [DE:Bacillus subtilis complete genome (section 9 of 21): from 1598421to 1807200.] [NT:alternate gene name: ymxE, ylxO] [SP:P32731] [LE:137422] [RE:137775] [DI:direct]

| ORF_Name | NTID | AAID | NT Length | AA Length | score | probability |
|---|---|---|---|---|---|---|
| AI7503000983_23491077_c1_824 | 464 | 4236 | 1266 | 421 | 1037 | 9.6e-105 |

Description sp:[LN:DCDA_BACSU] [AC:P23630] [GN:LYSA:LYS] [OR:BACILLUS SUBTILIS] [EC:4.1.1.20] [DE:DIAMINOPIMELATE DECARBOXYLASE, (DAP DECARBOXYLASE)] [SP:P23630] [DB:swissprot] >gp:[GI:d1013342:g1304007] [LN:BACJH642] [AC:D84432:D82370] [PN:LysA] [OR:Bacillus subtilis] [SR:Bacillus subtilis (strain:JH642(trpC2 PheA1)) DNA] [DB:genpept-bct1] [DE:Bacillus subtilis DNA, 283 Kb region containing skin element.] [LE:281375] [RE:282700] [DI:direct]

| ORF Name | NTID | AAID | NT Length | AA Length | score | probability |
|---|---|---|---|---|---|---|
| AI7503000983_23554760_f3_646 | 465 | 4237 | 255 | 84 | 64 | 0.0077 |

Description
gp:[GI:g1123040] [LN:CELF44A2] [AC:U41993] [GN:F44A2.4] [OR:Caenorhabditis elegans]
[SR:Caenorhabditis elegans strain=Bristol N2] [DB:genpept-inv1] [DE:Caenorhabditis elegans cosmid F44A2.] [NT:similar to C4-type zinc finger and to C. elegans]
[LE:11552:11678:12072:12484] [RE:11632:12022:12435:12848] [DI:directJoin]

| ORF Name | NTID | AAID | NT Length | AA Length | score | probability |
|---|---|---|---|---|---|---|
| AI7503000983_23557807_f2_357 | 466 | 4238 | 534 | 177 | 506 | 1.8e-48 |

Description
gp:[GI:e1172770:g2598550] [LN:LLAJ109] [AC:AJ000109] [PN:gluthatione peroxidase]
[GN:gpo] [OR:Lactococcus lactis] [DB:genpept-bct1] [DE:Lactococcus lactis carB and gpo genes.] [LE:163] [RE:636] [DI:direct]

| ORF Name | NTID | AAID | NT Length | AA Length | score | probability |
|---|---|---|---|---|---|---|
| AI7503000983_23597802_c2_942 | 467 | 4239 | 144 | 47 | | |

Description
NO-HIT

| ORF Name | NTID | AAID | NT Length | AA Length | score | probability |
|---|---|---|---|---|---|---|
| AI7503000983_23632758_c1_723 | 468 | 4240 | 258 | 85 | 79 | 0.037 |

Description
gp:[GI:g882139] [LN:SCU17174] [AC:U17174] [PN:phase-2 flagellin structural protein]
[GN:fljB] [OR:Salmonella choleraesuis] [DB:genpept-bct2] [DE:Salmonella choleraesuis ATCC 6967 phase-2 flagellin structuralprotein (fljB) gene, complete cds.] [LE:1]
[RE:1521] [DI:direct]

| ORF Name | NTID | AAID | NT Length | AA Length | score | probability |
|---|---|---|---|---|---|---|
| AI7503000983_23633467_c2_851 | 469 | 4241 | 987 | 328 | 659 | 1.1e-64 |

Description
pir:[LN:D69692] [AC:D69692 ] [PN:riboflavin kinase / FAD synthase ribC] [GN:ribC ]
[CL:conserved hypothetical protein HI0963] [OR:Bacillus subtilis] [DB:pir2]
>gp:[GI:e269877:g1592690] [LN:BSRIBRPS] [AC:Z80835] [PN:FMN adenylyltransferase]
[GN:ribC] [OR:Bacillus subtilis] [DB:genpept-bct1] [DE:B.subtilis ribC, rps0 and pnpA genes.] [NT:riboflavin kinase] [SP:P54575] [LE:88] [RE:1038] [DI:direct]
>gp:[GI:e1185258:g2634039] [LN:BSUB0009] [AC:Z99112:AL009126] [PN:FAD synthase]
[GN:ribC] [FN:riboflavin biosynthesis] [OR:Bacillus subtilis] [DB:genpept-bct1]
[EC:2.7.1.26:2.7.7.2] [DE:Bacillus subtilis complete genome (section 9 of 21): from 1598421to 1807200.] [NT:riboflavin kinase] [SP:P54575] [LE:138805] [RE:139755]
[DI:direct]

| ORF Name | NTID | AAID | NT Length | AA Length | score | probability |
|---|---|---|---|---|---|---|
| AI7503000983_23650250_c1_729 | 470 | 4242 | 546 | 181 | 667 | 1.6e-65 |

Description
sp:[LN:HSLV_BACSU] [AC:P39070] [GN:HSLV:CLPQ:CODW] [OR:BACILLUS SUBTILIS] [EC:3.4.99.-]
[DE:HEAT SHOCK PROTEIN HSLV PRECURSOR,] [SP:P39070] [DB:swissprot] >pir:[LN:S61494]
[AC:S61494:S45024:C69601 ] [PN:20S proteasome beta-type chain clpQ:heat shock protein
codW] [GN:clpQ:codW ] [OR:Bacillus subtilis] [DB:pir2] >gp:[GI:g535349] [LN:BSU13634]
[AC:U13634] [PN:CodW] [GN:codW] [OR:Bacillus subtilis] [DB:genpept-bct1] [DE:Bacillus
subtilis JH642 dipeptide permease operon regulators, codV,codW, codX, and codY genes,
complete cds.] [LE:1220] [RE:1765] [DI:direct] >gp:[GI:e1185206:g2633987] [LN:BSUB0009]
[AC:Z99112:AL009126] [PN:beta-type subunit of the 20S proteasome] [GN:clpQ]
[OR:Bacillus subtilis] [DB:genpept-bct1] [DE:Bacillus subtilis complete genome (section
9 of 21): from 1598421to 1807200.] [NT:alternate gene name: hslV, codW] [SP:P39070]
[LE:89093] [RE:89638] [DI:direct]

| ORF Name | NTID | AAID | NT Length | AA Length | score | probability |
|---|---|---|---|---|---|---|
| AI7503000983_23650343_c2_949 | 471 | 4243 | 1167 | 388 | 527 | 1.1e-50 |

Description
pir:[LN:G71097] [AC:G71097 ] [PN:probable amidohydrolase] [GN:PH1043 ] [OR:Pyrococcus
horikoshii] [DB:pir2] >gp:[GI:d1031084:g3257458] [LN:AP000004]
[AC:AP000004:AB009494:AB009495:AB009496:AB009497:AB009498:AB009499] [PN:387aa long
hypothetical amidohydrolase] [GN:PH1043] [OR:Pyrococcus horikoshii] [SR:Pyrococcus
horikoshii (strain:OT3) DNA] [DB:genpept-bct1] [DE:Pyrococcus horikoshii OT3 genomic
DNA, 777001-994000 nt. position(4/7).] [NT:similar to Swiss_Prot:P80092 percent
identity:] [LE:172136] [RE:173299] [DI:complement]

| ORF Name | NTID | AAID | NT Length | AA Length | score | probability |
|---|---|---|---|---|---|---|
| AI7503000983_23671890_c1_807 | 472 | 4244 | 1287 | 428 | 918 | 3.9e-92 |

Description
pir:[LN:A69730] [AC:A69730 ] [PN:UV-damage repair protein uvrX] [GN:uvrX ] [CL:umuC
protein] [OR:Bacillus subtilis] [DB:pir2] >gp:[GI:e1183597:g2634570] [LN:BSUB0012]
[AC:Z99115:AL009126] [PN:UV-damage repair protein] [GN:uvrX] [OR:Bacillus subtilis]
[DB:genpept-bct1] [DE:Bacillus subtilis complete genome (section 12 of 21): from
2195541to 2409220.] [NT:alternate gene name: yolE] [LE:74108] [RE:75358]
[DI:complement] >gp:[GI:g3025495] [LN:AF020713] [AC:AF020713] [PN:IMPB/MUCB/SAMB family
protein] [GN:yolE] [OR:Bacteriophage SPBc2] [DB:genpept-phg] [DE:Bacteriophage SPBc2
complete genome.] [LE:14792] [RE:16042] [DI:direct]

| ORF Name | NTID | AAID | NT Length | AA Length | score | probability |
|---|---|---|---|---|---|---|
| AI7503000983_23673150_c3_1029 | 473 | 4245 | 1002 | 333 | 1329 | 1.1e-135 |

Description
pir:[LN:C70015] [AC:C70015 ] [PN:GMP reductase, homolog yumD] [GN:yumD ] [OR:Bacillus
subtilis] [EC:1.6.6.8] [DB:pir2] >gp:[GI:e1184292:g2635710] [LN:BSUB0017]
[AC:Z99120:AL009126] [GN:yumD] [FN:unknown] [OR:Bacillus subtilis] [DB:genpept-bct1]
[DE:Bacillus subtilis complete genome (section 17 of 21): from 3197001to 3414420.]
[NT:similar to GMP reductase] [LE:105099] [RE:106079] [DI:direct]
>gp:[GI:e311468:g1934831] [LN:BSZ93939] [AC:Z93939] [PN:unknown] [GN:yumD] [OR:Bacillus
subtilis] [DB:genpept-bct1] [DE:B.subtilis genomic DNA fragment from yumA to yulF.]
[NT:potential inosine or guanosine 5' monophosphate] [LE:3536] [RE:4516] [DI:direct]

| ORF Name | NTID | AAID | NT Length | AA Length | score | probability |
|---|---|---|---|---|---|---|
| AI7503000983_23725442_f2_230 | 474 | 4246 | 456 | 151 | 97 | 0.0028 |

Description
gp:[GI:g3582212] [LN:AE001272] [AC:AE001272] [PN:Potential membrane spanning protein] [GN:ORF00031] [OR:Lactococcus lactis] [DB:genpept-bct2] [DE:Lactococcus lactis DPC3147 plasmid pMRC01, complete plasmidsequence.] [NT:similar to GB:Z30588 PID:459257 percent identity:] [LE:25025] [RE:25804] [DI:complement]

| ORF Name | NTID | AAID | NT Length | AA Length | score | probability |
|---|---|---|---|---|---|---|
| AI7503000983_23860952_f3_526 | 475 | 4247 | 516 | 171 | 453 | 7.4e-43 |

Description
sp:[LN:PMSR_BACSU] [AC:P54154] [GN:YPPP] [OR:BACILLUS SUBTILIS] [DE:REDUCTASE)] [SP:P54154] [DB:swissprot] >pir:[LN:E69940] [AC:E69940 ] [PN:peptide methionine sulfoxide reductase homolog yppP] [GN:yppP ] [CL:peptide methionine sulfoxide reductase] [OR:Bacillus subtilis] [DB:pir2] >gp:[GI:g1256653] [LN:BACYACA] [AC:L77246] [PN:DNA-binding protein] [GN:yppP] [OR:Bacillus subtilis] [DB:genpept-bct1] [DE:Bacillus subtilis (YAC10-9 clone) DNA region between the serA andkdg loci.] [NT:42.4% identity with the Lycopersicon esculentum] [LE:33389] [RE:33922] [DI:direct] >gp:[GI:e1183616:g2634589] [LN:BSUB0012] [AC:Z99115:AL009126] [GN:yppP] [FN:unknown] [OR:Bacillus subtilis] [DB:genpept-bct1] [DE:Bacillus subtilis complete genome (section 12 of 21): from 2195541to 2409220.] [NT:similar to peptide methionine sulfoxide reductase] [SP:P54154] [LE:91230] [RE:91763] [DI:complement]

| ORF Name | NTID | AAID | NT Length | AA Length | score | probability |
|---|---|---|---|---|---|---|
| AI7503000983_23944052_c1_789 | 476 | 4248 | 378 | 125 | 248 | 1.7e-20 |

Description
sp:[LN:CATB_BACFR] [AC:P45737] [GN:KATB] [OR:BACTEROIDES FRAGILIS] [EC:1.11.1.6] [DE:CATALASE,] [SP:P45737] [DB:swissprot] >pir:[LN:A57262] [AC:A57262 ] [PN:catalase,] [GN:katB ] [CL:catalase] [OR:Bacteroides fragilis] [EC:1.11.1.6] [DB:pir2] >gp:[GI:g841192] [LN:BFU18676] [AC:U18676] [PN:catalase] [GN:katB] [FN:decomposes hydrogen peroxide in water and] [OR:Bacteroides fragilis] [DB:genpept-bct2] [EC:1.11.1.6] [DE:Bacteroides fragilis catalase (katB) gene, complete cds.] [LE:348] [RE:1808] [DI:direct]

| ORF Name | NTID | AAID | NT Length | AA Length | score | probability |
|---|---|---|---|---|---|---|
| AI7503000983_23992812_c1_793 | 477 | 4249 | 129 | 42 | | |

Description
NO-HIT

| ORF Name | NTID | AAID | NT Length | AA Length | score | probability |
|---|---|---|---|---|---|---|
| AI7503000983_24017127_c1_769 | 478 | 4250 | 405 | 134 | 537 | 9.3e-52 |

Description
gp:[GI:g468509] [LN:SAGLNAR] [AC:X76490] [PN:glutamine synthetase repressor] [GN:glnR] [OR:Staphylococcus aureus] [DB:genpept-bct1] [DE:S.aureus (bb270) glnA and glnR genes.] [LE:975] [RE:1343] [DI:direct]

| ORF Name | NTID | AAID | NT Length | AA Length | score | probability |
|---|---|---|---|---|---|---|
| AI7503000983_24033217_c2_850 | 479 | 4251 | 930 | 309 | 720 | 3.8e-71 |

Description
sp:[LN:TRUB_BACSU] [AC:P32732] [GN:TRUB] [OR:BACILLUS SUBTILIS] [EC:4.2.1.70] [DE:HYDROLYASE)] [SP:P32732] [DB:swissprot] >pir:[LN:G69726] [AC:G69726:H36905:S31997 ] [PN:tRNA pseudouridine 5S synthase truB:P35 homolog] [GN:truB ] [CL:Escherichia coli protein P35] [OR:Bacillus subtilis] [DB:pir2] >gp:[GI:e1185257:g2634038] [LN:BSUB0009] [AC:Z99112:AL009126] [PN:tRNA pseudouridine 5S synthase] [GN:truB] [OR:Bacillus subtilis] [DB:genpept-bct1] [DE:Bacillus subtilis complete genome (section 9 of 21): from 1598421to 1807200.] [NT:alternate gene name: ylxN, ymxF] [SP:P32732] [LE:137857] [RE:138786] [DI:direct]

| ORF Name | NTID | AAID | NT Length | AA Length | score | probability |
|---|---|---|---|---|---|---|
| AI7503000983_24078753_c3_999 | 480 | 4252 | 450 | 149 | 295 | 4.1e-26 |

Description
pir:[LN:G69657] [AC:G69657 ] [PN:tRNA isopentenylpyrophosphate transferase miaA] [GN:miaA ] [CL:delta(2)-isopentenylpyrophosphate transferase] [OR:Bacillus subtilis] [DB:pir2] >gp:[GI:e1183392:g2634117] [LN:BSUB0010] [AC:Z99113:AL009126] [PN:tRNA isopentenylpyrophosphate transferase] [GN:miaA] [OR:Bacillus subtilis] [DB:genpept-bct1] [DE:Bacillus subtilis complete genome (section 10 of 21): from 1781201to 2014980.] [LE:84430] [RE:85374] [DI:direct]

| ORF Name | NTID | AAID | NT Length | AA Length | score | probability |
|---|---|---|---|---|---|---|
| AI7503000983_24222137_f2_341 | 481 | 4253 | 159 | 52 | | |

Description
NO-HIT

| ORF Name | NTID | AAID | NT Length | AA Length | score | probability |
|---|---|---|---|---|---|---|
| AI7503000983_24225000_f3_475 | 482 | 4254 | 894 | 297 | 360 | 5.3e-33 |

Description
gp:[GI:g2194195] [LN:SGU61158] [AC:U61158] [PN:GdmF] [GN:gdmF] [OR:Staphylococcus gallinarum] [DB:genpept-bct1] [DE:Staphylococcus gallinarum Tue3928 GdmF (gdmF), putative membraneprotein (gdmH), ABC transporter (gdmT), and antibiotic galliderminprecursor (gdmA) genes, complete cds, putative membrane protein(gdmE) and modifying enzyme (gdmB) genes, partial cds.] [NT:proposed ABC transporter subunit (ATP-binding] [LE:179] [RE:874] [DI:complement]

| ORF Name | NTID | AAID | NT Length | AA Length | score | probability |
|---|---|---|---|---|---|---|
| AI7503000983_24225053_c3_1031 | 483 | 4255 | 318 | 105 | 202 | 2.9e-16 |

Description
pir:[LN:E69894] [AC:E69894 ] [PN:hypothetical protein ynzC] [GN:ynzC ] [OR:Bacillus subtilis] [DB:pir2] >gp:[GI:e1183447:g2634172] [LN:BSUB0010] [AC:Z99113:AL009126] [GN:ynzC] [FN:unknown] [OR:Bacillus subtilis] [DB:genpept-bct1] [DE:Bacillus subtilis complete genome (section 10 of 21): from 1781201to 2014980.] [LE:137514] [RE:137747] [DI:direct]

| ORF Name | NTID | AAID | NT Length | AA Length | score | probability |
|---|---|---|---|---|---|---|
| AI7503000983_24251466_c1_799 | 484 | 4256 | 2745 | 914 | 3437 | 0.0 |

Description
sp:[LN:ACON_BACSU] [AC:P09339:Q45059] [GN:CITB] [OR:BACILLUS SUBTILIS] [EC:4.2.1.3] [DE:ACONITATE HYDRATASE, (CITRATE HYDRO-LYASE) (ACONITASE)] [SP:P09339:Q45059] [DB:swissprot]

| ORF_Name | NTID | AAID | NT Length | AA Length | score | probability |
|---|---|---|---|---|---|---|
| AI7503000983_24257252_c1_727 | 485 | 4257 | 177 | 58 | | |

Description
NO-HIT

| ORF_Name | NTID | AAID | NT Length | AA Length | score | probability |
|---|---|---|---|---|---|---|
| AI7503000983_24267941_c1_745 | 486 | 4258 | 726 | 241 | 304 | 4.5e-27 |

Description
sp:[LN:YMFC_BACSU] [AC:O31761] [GN:YMFC] [OR:BACILLUS SUBTILIS] [DE:REGION] [SP:O31761] [DB:swissprot] >pir:[LN:B69885] [AC:B69885 ] [PN:transcription regulator GntR family homolog ymfC] [GN:ymfC ] [OR:Bacillus subtilis] [DB:pir2] >gp:[GI:e1185272:g2634053] [LN:BSUB0009] [AC:Z99112:AL009126] [GN:ymfC] [FN:unknown] [OR:Bacillus subtilis] [DB:genpept-bct1] [DE:Bacillus subtilis complete genome (section 9 of 21): from 1598421to 1807200.] [NT:similar to transcriptional regulator (GntR family)] [SP:O31761] [LE:155754] [RE:156479] [DI:direct]

| ORF_Name | NTID | AAID | NT Length | AA Length | score | probability |
|---|---|---|---|---|---|---|
| AI7503000983_24267942_c1_823 | 487 | 4259 | 1089 | 362 | 300 | 1.2e-26 |

Description
sp:[LN:ALR_BACSU] [AC:P10725:P96620] [GN:ALR:DAL] [OR:BACILLUS SUBTILIS] [EC:5.1.1.1] [DE:ALANINE RACEMASE,] [SP:P10725:P96620] [DB:swissprot] >gp:[GI:d1020054:g1881274] [LN:AB001488] [AC:AB001488] [PN:ALANINE RACEMASE] [GN:alr] [OR:Bacillus subtilis] [SR:Bacillus subtilis (strain:168) DNA] [DB:genpept-bct1] [EC:5.1.1.1] [DE:Bacillus subtilis genome sequence, 148 kb sequence of the regionbetween 35 and 47 degree.] [LE:50435] [RE:51604] [DI:direct] >gp:[GI:e1182430:g2632764] [LN:BSUB0003] [AC:Z99106:AL009126] [PN:D-alanine racemase] [GN:dal] [OR:Bacillus subtilis] [DB:genpept-bct1] [EC:5.1.1.1] [DE:Bacillus subtilis complete genome (section 3 of 21): from 402751 to611850.] [NT:alternate gene name: alr] [SP:P10725] [LE:114179] [RE:115348] [DI:direct]

| ORF_Name | NTID | AAID | NT Length | AA Length | score | probability |
|---|---|---|---|---|---|---|
| AI7503000983_24275017_c2_856 | 488 | 4260 | 144 | 47 | | |

Description
NO-HIT

| ORF_Name | NTID | AAID | NT Length | AA Length | score | probability |
|---|---|---|---|---|---|---|
| AI7503000983_24352200_f3_600 | 489 | 4261 | 1095 | 364 | 674 | 2.8e-66 |

Description
pir:[LN:T02833] [AC:T02833 ] [PN:hypothetical protein L4171.5] [OR:Leishmania major] [DB:pir2] [MP:1 ] >gp:[GI:g2266911] [LN:AE001274] [AC:AE001274:AC003011:AC002552:U60409:AF008205:AC002134:AF008206:U7 0253] [PN:L4171.5] [GN:L4171.5] [OR:Leishmania major] [DB:genpept-inv2] [DE:Leishmania major chromosome 1, complete sequence.] [NT:similar to threonine aldolase; leucine zipper] [LE:124709] [RE:125788] [DI:direct]

| ORF_Name | NTID | AAID | NT Length | AA Length | score | probability |
|---|---|---|---|---|---|---|
| AI7503000983_24407758_f3_696 | 490 | 4262 | 129 | 42 | | |

Description
NO-HIT

| ORF_Name | NTID | AAID | NT Length | AA Length | score | probability |
|---|---|---|---|---|---|---|
| AI7503000983_24412811_c3_997 | 491 | 4263 | 957 | 318 | 147 | 4.4e-11 |

Description
pir:[LN:T02661] [AC:T02661 ] [PN:lysophospholipase homolog] [GN:LPL1 ] [OR:Oryza sativa] [SR:, rice] [DB:pir2] >gp:[GI:g2801536] [LN:AF039531] [AC:AF039531] [PN:lysophospholipase homolog] [GN:LPL1] [OR:Oryza sativa] [DB:genpept-pln2] [DE:Oryza sativa lysophospholipase homolog (LPL1) mRNA, complete cds.] [LE:46] [RE:960] [DI:direct]

| ORF_Name | NTID | AAID | NT Length | AA Length | score | probability |
|---|---|---|---|---|---|---|
| AI7503000983_24414187_c3_1003 | 492 | 4264 | 396 | 131 | 74 | 0.011 |

Description
gp:[GI:g42727] [LN:ECRHAT] [AC:X60699] [GN:sodA] [OR:Escherichia coli] [DB:genpept-bct] [DE:E. coli rhaT gene for L-rhamnose permease, rhaC (3' end) and sodA(5' end) genes.] [SP:P00448] [LE:<1] [RE:288] [DI:complement]

| ORF_Name | NTID | AAID | NT Length | AA Length | score | probability |
|---|---|---|---|---|---|---|
| AI7503000983_24414818_c1_738 | 493 | 4265 | 870 | 289 | 952 | 9.8e-96 |

Description
gp:[GI:e1185251:g2634032] [LN:BSUB0009] [AC:Z99112:AL009126] [GN:nusA] [FN:transcription termination] [OR:Bacillus subtilis] [DB:genpept-bct1] [DE:Bacillus subtilis complete genome (section 9 of 21): from 1598421to 1807200.] [LE:133252] [RE:134367] [DI:direct]

| ORF_Name | NTID | AAID | NT Length | AA Length | score | probability |
|---|---|---|---|---|---|---|
| AI7503000983_24415933_c3_1078 | 494 | 4266 | 153 | 51 | | |

Description
NO-HIT

| ORF_Name | NTID | AAID | NT Length | AA Length | score | probability |
|---|---|---|---|---|---|---|
| AI7503000983_24417512_f3_505 | 495 | 4267 | 135 | 44 | | |

Description
NO-HIT

| ORF_Name | NTID | AAID | NT Length | AA Length | score | probability |
|---|---|---|---|---|---|---|
| AI7503000983_24470927_f2_358 | 496 | 4268 | 138 | 45 | | |

Description
NO-HIT

| ORF_Name | NTID | AAID | NT Length | AA Length | score | probability |
|---|---|---|---|---|---|---|
| AI7503000983_24475252_c3_1052 | 497 | 4269 | 126 | 41 | | |

Description
NO-HIT

| ORF_Name | NTID | AAID | NT Length | AA Length | score | probability |
|---|---|---|---|---|---|---|
| AI7503000983_24484683_c3_1041 | 498 | 4270 | 129 | 42 | | |

Description
NO-HIT

| ORF Name | NTID | AAID | NT Length | AA Length | score | probability |
|---|---|---|---|---|---|---|
| AI7503000983_24492827_f1_223 | 499 | 4271 | 2601 | 866 | 1069 | 3.9e-108 |

Description
pir:[LN:G69801] [AC:G69801 ] [PN:hypothetical protein yfhO] [GN:yfhO ] [OR:Bacillus subtilis] [DB:pir2] >gp:[GI:e1182850:g2633184] [LN:BSUB0005] [AC:Z99108:AL009126] [GN:yfhO] [FN:unknown] [OR:Bacillus subtilis] [DB:genpept-bct1] [DE:Bacillus subtilis complete genome (section 5 of 21): from 802821 to1011250.] [LE:128691] [RE:131150] [DI:direct] >gp:[GI:d1025397:g2804545] [LN:D85082] [AC:D85082] [PN:YfhO] [OR:Bacillus subtilis] [SR:Bacillus subtilis DNA] [DB:genpept-bct1] [DE:Bacillus subtilis DNA, genome sequence, 79 to 81 degree region.] [LE:21582] [RE:24041] [DI:direct]

| ORF Name | NTID | AAID | NT Length | AA Length | score | probability |
|---|---|---|---|---|---|---|
| AI7503000983_24495928_c1_772 | 500 | 4272 | 210 | 69 | 70 | 0.028 |

Description
pir:[LN:G69058] [AC:G69058 ] [PN:hypothetical protein MTH1440] [GN:MTH1440 ] [OR:Methanobacterium thermoautotrophicum] [DB:pir2] >gp:[GI:g2622552] [LN:AE000905] [AC:AE000905:AE000666] [PN:unknown] [GN:MTH1440] [OR:Methanobacterium thermoautotrophicum] [DB:genpept-bct2] [DE:Methanobacterium thermoautotrophicum from bases 1293944 to 1305586(section 111 of 148) of the complete genome.] [NT:Function Code:14.00 - Unknown, ; similar to,] [LE:7011] [RE:7214] [DI:direct]

| ORF Name | NTID | AAID | NT Length | AA Length | score | probability |
|---|---|---|---|---|---|---|
| AI7503000983_2459667_c1_796 | 501 | 4273 | 174 | 57 | | |

Description
NO-HIT

| ORF Name | NTID | AAID | NT Length | AA Length | score | probability |
|---|---|---|---|---|---|---|
| AI7503000983_24631637_c3_1002 | 502 | 4274 | 708 | 235 | 236 | 7.3e-20 |

Description
gp:[GI:g2444107] [LN:U88974] [AC:U88974] [PN:ORF28] [OR:Streptococcus thermophilus temperate bacteriophage 01205] [DB:genpept-phg] [DE:Streptococcus thermophilus temperate bacteriophage 01205, completegenome.] [LE:17062] [RE:17955] [DI:direct]

| ORF Name | NTID | AAID | NT Length | AA Length | score | probability |
|---|---|---|---|---|---|---|
| AI7503000983_24640925_c3_1037 | 503 | 4275 | 1272 | 423 | 1288 | 2.4e-131 |

Description
sp:[LN:OPUD_BACSU] [AC:P54417] [GN:OPUD] [OR:BACILLUS SUBTILIS] [DE:GLYCINE BETAINE TRANSPORTER OPUD] [SP:P54417] [DB:swissprot] >pir:[LN:G69670] [AC:G69670 ] [PN:glycine betaine transporter opuD] [GN:opuD ] [OR:Bacillus subtilis] [DB:pir2]
>gp:[GI:e1185880:g2635491] [LN:BSUB0016] [AC:Z99119:AL009126] [PN:glycine betaine transporter] [GN:opuD] [FN:osmoprotection] [OR:Bacillus subtilis] [DB:genpept-bct1] [DE:Bacillus subtilis complete genome (section 16 of 21): from 2997771to 3213410.] [NT:alternate gene name: ytfQ] [SP:P54417] [LE:78128] [RE:79666] [DI:direct]
>gp:[GI:g2293330] [LN:AF008220] [AC:AF008220] [PN:putative transporter] [GN:opuD] [OR:Bacillus subtilis] [DB:genpept-bct2] [DE:Bacillus subtilis rrnB-dnaB genomic region.] [LE:100760] [RE:102298] [DI:complement] >gp:[GI:g1524397] [LN:BSU50082] [AC:U50082] [PN:glycine betaine transporter OpuD] [GN:opuD] [OR:Bacillus subtilis] [DB:genpept-bct2] [DE:Bacillus subtilis glycine betaine transporter OpuD (opuD) gene,complete cds.] [LE:460] [RE:1998] [DI:direct]

| ORF Name | NTID | AAID | NT Length | AA Length | score | probability |
|---|---|---|---|---|---|---|
| AI7503000983_24647176_c2_928 | 504 | 4276 | 771 | 256 | 128 | 4.7e-06 |

Description
gp:[GI:g4981173] [LN:AE001738] [AC:AE001738:AE000512] [PN:conserved hypothetical protein] [GN:TM0651] [OR:Thermotoga maritima] [DB:genpept-bct2] [DE:Thermotoga maritima section 50 of 136 of the complete genome.] [NT:similar to PID:1653547 percent identity: 52.43;] [LE:13445] [RE:14251] [DI:complement]

| ORF Name | NTID | AAID | NT Length | AA Length | score | probability |
|---|---|---|---|---|---|---|
| AI7503000983_24647182_c1_821 | 505 | 4277 | 729 | 242 | 232 | 3.9e-33 |

Description
gp:[GI:g4982086] [LN:AE001799] [AC:AE001799:AE000512] [PN:dihydrodipicolinate reductase] [GN:TM1520] [OR:Thermotoga maritima] [DB:genpept-bct2] [DE:Thermotoga maritima section 111 of 136 of the complete genome.] [NT:similar to PID:1185002 percent identity: 62.67;] [LE:16971] [RE:17621] [DI:complement]

| ORF Name | NTID | AAID | NT Length | AA Length | score | probability |
|---|---|---|---|---|---|---|
| AI7503000983_24659382_c2_890 | 506 | 4278 | 126 | 41 | | |

Description
NO-HIT

| ORF Name | NTID | AAID | NT Length | AA Length | score | probability |
|---|---|---|---|---|---|---|
| AI7503000983_24666043_c1_803 | 507 | 4279 | 1233 | 410 | 866 | 1.3e-86 |

Description
pir:[LN:D70006] [AC:D70006 ] [PN:conserved hypothetical protein yubA] [GN:yubA ] [CL:Bacillus subtilis conserved hypothetical protein yueF] [OR:Bacillus subtilis] [DB:pir2] >gp:[GI:e1185989:g2635600] [LN:BSUB0016] [AC:Z99119:AL009126] [GN:yubA] [FN:unknown] [OR:Bacillus subtilis] [DB:genpept-bct1] [DE:Bacillus subtilis complete genome (section 16 of 21): from 2997771to 3213410.] [NT:similar to hypothetical proteins] [LE:196858] [RE:198024] [DI:complement]

| ORF Name | NTID | AAID | NT Length | AA Length | score | probability |
|---|---|---|---|---|---|---|
| AI7503000983_24744010_c3_1028 | 508 | 4280 | 273 | 90 | 347 | 1.3e-31 |

Description
pir:[LN:F69835] [AC:F69835 ] [PN:ribosomal protein S14 homolog yhzA] [GN:yhzA ] [CL:Escherichia coli ribosomal protein S14] [OR:Bacillus subtilis] [DB:pir2] >gp:[GI:e1182877:g2633211] [LN:BSUB0005] [AC:Z99108:AL009126] [GN:yhzA] [FN:unknown] [OR:Bacillus subtilis] [DB:genpept-bct1] [DE:Bacillus subtilis complete genome (section 5 of 21): from 802821 to1011250.] [NT:similar to ribosomal protein S14] [LE:162598] [RE:162867] [DI:direct]

| ORF Name | NTID | AAID | NT Length | AA Length | score | probability |
|---|---|---|---|---|---|---|
| AI7503000983_24792776_c2_846 | 509 | 4281 | 528 | 175 | 371 | 3.6e-34 |

Description
sp:[LN:YLXS_BACSU] [AC:P32726] [GN:YLXS] [OR:BACILLUS SUBTILIS] [DE:HYPOTHETICAL 17.6 KD PROTEIN IN NUSA 5'REGION (P15A) (ORF1)] [SP:P32726] [DB:swissprot] >pir:[LN:B36905] [AC:B36905:E69882:S31990 ] [PN:conserved hypothetical protein ylxS] [GN:ylxS ] [CL:nus operon 15K protein] [OR:Bacillus subtilis] [DB:pir2] >gp:[GI:g49315] [LN:BSORF1T7A] [AC:Z18631] [GN:ORF1] [OR:Bacillus subtilis] [DB:genpept-bct1] [DE:B.subtilis infB-nusA operon.] [SP:P32726] [LE:456] [RE:926] [DI:direct] >gp:[GI:e1185250:g2634031] [LN:BSUB0009] [AC:Z99112:AL009126] [GN:ylxS] [FN:unknown] [OR:Bacillus subtilis] [DB:genpept-bct1] [DE:Bacillus subtilis complete genome (section 9 of 21): from 1598421to 1807200.] [NT:alternate gene name: ymxA; similar to hypothetical] [SP:P32726] [LE:132747] [RE:133217] [DI:direct]

| ORF Name | NTID | AAID | NT Length | AA Length | score | probability |
|---|---|---|---|---|---|---|
| AI7503000983_24823377_f3_498 | 510 | 4282 | 912 | 303 | 462 | 8.2e-44 |

Description
pir:[LN:E69840] [AC:E69840 ] [PN:hypothetical protein yitL] [GN:yitL ] [OR:Bacillus subtilis] [DB:pir2] >gp:[GI:e1183105:g2633439] [LN:BSUB0006] [AC:Z99109:AL009126] [GN:yitL] [FN:unknown] [OR:Bacillus subtilis] [DB:genpept-bct1] [DE:Bacillus subtilis complete genome (section 6 of 21): from 999501 to1209940.] [LE:181473] [RE:182369] [DI:direct]

| ORF Name | NTID | AAID | NT Length | AA Length | score | probability |
|---|---|---|---|---|---|---|
| AI7503000983_24877312_f1_105 | 511 | 4283 | 1392 | 463 | 1093 | 1.1e-110 |

Description
pir:[LN:A69763] [AC:A69763 ] [PN:homoserine dehydrogenase homolog yclM] [GN:yclM ] [CL:aspartate kinase homology] [OR:Bacillus subtilis] [DB:pir2]
>gp:[GI:e1182346:g2632680] [LN:BSUB0003] [AC:Z99106:AL009126] [GN:yclM] [FN:unknown] [OR:Bacillus subtilis] [DB:genpept-bct1] [DE:Bacillus subtilis complete genome (section 3 of 21): from 402751 to611850.] [NT:similar to homoserine dehydrogenase] [LE:27453] [RE:28817] [DI:complement] >gp:[GI:d1009646:g1805449] [LN:D50453] [AC:D50453] [PN:homologue of aspartokinase 2 alpha and beta] [GN:yclM] [OR:Bacillus subtilis] [SR:Bacillus subtilis (strain:168 trpC2) DNA] [DB:genpept-bct1] [DE:Bacillus subtilis DNA for 25-36 degree region containing theamyE-srfA region, complete cds.] [LE:109856] [RE:111220] [DI:complement]

| ORF Name | NTID | AAID | NT Length | AA Length | score | probability |
|---|---|---|---|---|---|---|
| AI7503000983_24886550_c1_741 | 512 | 4284 | 288 | 95 | 350 | 6.1e-32 |

Description
pir:[LN:F69700] [AC:F69700:S11365:S70690 ] [PN:ribosomal protein S15 (rpsO):ribosomal protein BS18] [GN:rpsO ] [CL:Escherichia coli ribosomal protein S15: eubacterial ribosomal protein S15 homology] [OR:Bacillus subtilis] [DB:pir2]
>gp:[GI:e269878:g1592691] [LN:BSRIBRPS] [AC:Z80835] [PN:ribosomal protein S15] [GN:rpsO] [OR:Bacillus subtilis] [DB:genpept-bct1] [DE:B.subtilis ribC, rpsO and pnpA genes.] [SP:P21473] [LE:1195] [RE:1464] [DI:direct] >gp:[GI:e1185259:g2634040] [LN:BSUB0009] [AC:Z99112:AL009126] [PN:ribosomal protein S15 (BS18)] [GN:rpsO] [OR:Bacillus subtilis] [DB:genpept-bct1] [DE:Bacillus subtilis complete genome (section 9 of 21): from 1598421to 1807200.] [SP:P21473] [LE:139912] [RE:140181] [DI:direct]

| ORF Name | NTID | AAID | NT Length | AA Length | score | probability |
|---|---|---|---|---|---|---|
| AI7503000983_24886677_c3_971 | 513 | 4285 | 1722 | 573 | 1885 | 1.3e-194 |

Description pir:[LN:G69682] [AC:G69682 ] [PN:proline--tRNA ligase, proS:prolyl-tRNA synthetase] [GN:proS ] [CL:proline--tRNA ligase] [OR:Bacillus subtilis] [EC:6.1.1.15] [DB:pir2] >gp:[GI:e1185248:g2634029] [LN:BSUB0009] [AC:Z99112:AL009126] [PN:prolyl-tRNA synthetase] [GN:proS] [OR:Bacillus subtilis] [DB:genpept-bct1] [DE:Bacillus subtilis complete genome (section 9 of 21): from 1598421to 1807200.] [LE:126301] [RE:127995] [DI:direct]

| ORF Name | NTID | AAID | NT Length | AA Length | score | probability |
|---|---|---|---|---|---|---|
| AI7503000983_24900332_c2_870 | 514 | 4286 | 981 | 326 | 935 | 6.2e-94 |

Description sp:[LN:MUTL_BACSU] [AC:P49850] [GN:MUTL] [OR:BACILLUS SUBTILIS] [DE:DNA MISMATCH REPAIR PROTEIN MUTL] [SP:P49850] [DB:swissprot] >pir:[LN:A69663] [AC:A69663 ] [PN:DNA mismatch repair mutL] [GN:mutL ] [CL:mismatch repair protein hexB] [OR:Bacillus subtilis] [DB:pir2] >gp:[GI:g1002521] [LN:BSU27343] [AC:U27343] [PN:MutL] [GN:mutL] [FN:mismatch-repair recognition] [OR:Bacillus subtilis] [DB:genpept-bct1] [DE:Bacillus subtilis spore coat protein (cotE) gene, partial cds, andmismatch repair recognition proteins (mutS) and (mutL) genes,complete cds.] [LE:2782] [RE:4665] [DI:direct] >gp:[GI:e1185296:g2634077] [LN:BSUB0009] [AC:Z99112:AL009126] [GN:mutL] [FN:DNA mismatch repair] [OR:Bacillus subtilis] [DB:genpept-bct1] [DE:Bacillus subtilis complete genome (section 9 of 21): from 1598421to 1807200.] [SP:P49850] [LE:179285] [RE:181168] [DI:direct]

| ORF Name | NTID | AAID | NT Length | AA Length | score | probability |
|---|---|---|---|---|---|---|
| AI7503000983_25445253_c3_1039 | 515 | 4287 | 495 | 164 | 336 | 1.8e-30 |

Description pir:[LN:F69891] [AC:F69891 ] [PN:conserved hypothetical protein yneP] [GN:yneP ] [OR:Bacillus subtilis] [DB:pir2] >gp:[GI:e249652:g1405456] [LN:BC170DEGR] [AC:Z73234] [PN:YneP] [GN:yneP] [OR:Bacillus subtilis] [DB:genpept-bct1] [DE:B.subtilis DNA (26.2 kb fragment; 170 degree region).] [LE:12510] [RE:12875] [DI:direct] >gp:[GI:e1183462:g2634187] [LN:BSUB0010] [AC:Z99113:AL009126] [GN:yneP] [FN:unknown] [OR:Bacillus subtilis] [DB:genpept-bct1] [DE:Bacillus subtilis complete genome (section 10 of 21): from 1781201to 2014980.] [NT:similar to hypothetical proteins] [LE:148889] [RE:149254] [DI:direct]

| ORF Name | NTID | AAID | NT Length | AA Length | score | probability |
|---|---|---|---|---|---|---|
| AI7503000983_25449061_c1_780 | 516 | 4288 | 249 | 82 | 191 | 4.3e-15 |

Description pir:[LN:D69901] [AC:D69901 ] [PN:two-component response regulator [YocF] homolog yocG] [GN:yocG ] [CL:regulatory protein comA:response regulator homology] [OR:Bacillus subtilis] [DB:pir2] >gp:[GI:g2619014] [LN:AF027868] [AC:AF027868] [PN:sensor regulator] [GN:yocG] [OR:Bacillus subtilis] [DB:genpept-bct1] [DE:Bacillus subtilis chromosome region between terC and odhAB.] [NT:similar to B.subtilis SpoOA protein (267 aa)] [LE:71699] [RE:72298] [DI:direct] >gp:[GI:e1185392:g2634313] [LN:BSUB0011] [AC:Z99114:AL009126] [GN:yocG] [FN:unknown] [OR:Bacillus subtilis] [DB:genpept-bct1] [DE:Bacillus subtilis complete genome (section 11 of 21): from 2000171to 2207900.] [NT:similar to two-component response regulator [YocF]] [LE:90790] [RE:91389] [DI:direct]

| ORF_Name | NTID | AAID | NT Length | AA Length | score | probability |
|---|---|---|---|---|---|---|
| AI7503000983_25578140_f3_612 | 517 | 4289 | 132 | 43 | | |

Description
NO-HIT

| ORF_Name | NTID | AAID | NT Length | AA Length | score | probability |
|---|---|---|---|---|---|---|
| AI7503000983_25587942_c3_956 | 518 | 4290 | 786 | 261 | 556 | 9.0e-54 |

Description
pir:[LN:C69693] [AC:C69693 ] [PN:ribonuclease H rnh] [GN:rnh ] [CL:ribonuclease HII]
[OR:Bacillus subtilis] [DB:pir2] >gp:[GI:e1185197:g2633978] [LN:BSUB0009]
[AC:Z99112:AL009126] [PN:ribonuclease H] [GN:rnh] [OR:Bacillus subtilis]
[DB:genpept-bct1] [EC:3.1.26.4] [DE:Bacillus subtilis complete genome (section 9 of
21): from 1598421to 1807200.] [LE:78430] [RE:79197] [DI:direct]

| ORF_Name | NTID | AAID | NT Length | AA Length | score | probability |
|---|---|---|---|---|---|---|
| AI7503000983_25593925_f1_166 | 519 | 4291 | 153 | 50 | | |

Description
NO-HIT

| ORF_Name | NTID | AAID | NT Length | AA Length | score | probability |
|---|---|---|---|---|---|---|
| AI7503000983_25626625_c2_891 | 520 | 4292 | 636 | 211 | | |

Description
NO-HIT

| ORF_Name | NTID | AAID | NT Length | AA Length | score | probability |
|---|---|---|---|---|---|---|
| AI7503000983_25664512_c2_915 | 521 | 4293 | 495 | 164 | 279 | 2.0e-24 |

Description
pir:[LN:A69805] [AC:A69805 ] [PN:hypothetical protein yfiW] [GN:yfiW ] [OR:Bacillus
subtilis] [DB:pir2] >gp:[GI:e1182832:g2633166] [LN:BSUB0005] [AC:Z99108:AL009126]
[GN:yfiW] [FN:unknown] [OR:Bacillus subtilis] [DB:genpept-bct1] [DE:Bacillus subtilis
complete genome (section 5 of 21): from 802821 to1011250.] [LE:113464] [RE:114240]
[DI:direct] >gp:[GI:d1025379:g2804527] [LN:D85082] [AC:D85082] [PN:YfiW] [OR:Bacillus
subtilis] [SR:Bacillus subtilis DNA] [DB:genpept-bct1] [DE:Bacillus subtilis DNA,
genome sequence, 79 to 81 degree region.] [LE:6355] [RE:7131] [DI:direct]

| ORF_Name | NTID | AAID | NT Length | AA Length | score | probability |
|---|---|---|---|---|---|---|
| AI7503000983_25665937_c3_968 | 522 | 4294 | 558 | 185 | 841 | 5.7e-84 |

Description
sp:[LN:RRF_STAAU] [AC:O33276] [GN:FRR] [OR:STAPHYLOCOCCUS AUREUS] [DE:PROBABLE RIBOSOME
RECYCLING FACTOR (RIBOSOME RELEASING FACTOR) (RRF)] [SP:O33276] [DB:swissprot]
>gp:[GI:g2645713] [LN:AF033018] [AC:AF033018] [PN:ribosome recycling factor] [GN:frr]
[OR:Staphylococcus aureus] [DB:genpept-bct2] [DE:Staphylococcus aureus ribosome
recycling factor (frr) gene,complete cds.] [LE:1] [RE:555] [DI:direct]

| ORF Name | NTID | AAID | NT Length | AA Length | score | probability |
|---|---|---|---|---|---|---|
| AI7503000983_257837_c3_1013 | 523 | 4295 | 174 | 57 | 87 | 0.0045 |

Description
gp:[GI:g2668605] [LN:AF015453] [AC:AF015453] [PN:unknown] [OR:Lactobacillus rhamnosus] [DB:genpept-bct2] [DE:Lactobacillus rhamnosus 6-phospho-beta-glucosidase homolog gene,partial cds; GNTR transcriptional regulator homolog and surfacelocated protein genes, complete cds.] [NT:3.0E-ORF-1] [LE:2236] [RE:>3603] [DI:complement]

| ORF Name | NTID | AAID | NT Length | AA Length | score | probability |
|---|---|---|---|---|---|---|
| AI7503000983_25977318_c3_1044 | 524 | 4296 | 2415 | 804 | 3470 | 0.0 |

Description
sp:[LN:PARC_STAAU] [AC:P50073:P95682:P95683] [GN:PARC:GRLA] [OR:STAPHYLOCOCCUS AUREUS] [EC:5.99.1.-] [DE:TOPOISOMERASE IV SUBUNIT A,] [SP:P50073:P95682:P95683] [DB:swissprot] >gp:[GI:d1011747:g1777321] [LN:D67075] [AC:D67075] [PN:DNA topoisomerase IV GrlA subunit] [GN:grlA] [OR:Staphylococcus aureus] [SR:Staphylococcus aureus (isolate:RN4220) DNA] [DB:genpept-bct1] [DE:Staphylococcus aureus DNA for DNA topoisomerase IV GrlB subunit,DNA topoisomerase IV GrlA subunit, complete cds.] [LE:2376] [RE:4778] [DI:direct]

| ORF Name | NTID | AAID | NT Length | AA Length | score | probability |
|---|---|---|---|---|---|---|
| AI7503000983_26205387_f2_331 | 525 | 4297 | 336 | 111 | | |

Description
NO-HIT

| ORF Name | NTID | AAID | NT Length | AA Length | score | probability |
|---|---|---|---|---|---|---|
| AI7503000983_26210925_c3_1032 | 526 | 4298 | 2028 | 675 | 2097 | 4.5e-217 |

Description
sp:[LN:TKT_BACSU] [AC:P45694] [GN:TKT:TKTA] [OR:BACILLUS SUBTILIS] [EC:2.2.1.1] [DE:TRANSKETOLASE,] [SP:P45694] [DB:swissprot] >pir:[LN:G69723] [AC:G69723:S57401 ] [PN:transketolase, tkt] [GN:tkt] [CL:transketolase:thiamine pyrophosphate-binding domain homology] [OR:Bacillus subtilis] [EC:2.2.1.1] [DB:pir2] >gp:[GI:e249642:g1405446] [LN:BC170DEGR] [AC:Z73234] [PN:transketolase] [GN:tktA] [OR:Bacillus subtilis] [DB:genpept-bct1] [DE:B.subtilis DNA (26.2 kb fragment; 170 degree region).] [SP:P45694] [LE:1537] [RE:3540] [DI:direct] >gp:[GI:e1183448:g2634173] [LN:BSUB0010] [AC:Z99113:AL009126] [PN:transketolase] [GN:tkt] [FN:pentose phosphate] [OR:Bacillus subtilis] [DB:genpept-bct1] [EC:2.2.1.1] [DE:Bacillus subtilis complete genome (section 10 of 21): from 1781201to 2014980.] [NT:alternate gene name: tktA] [SP:P45694] [LE:137916] [RE:139919] [DI:direct]

| ORF Name | NTID | AAID | NT Length | AA Length | score | probability |
|---|---|---|---|---|---|---|
| AI7503000983_26213890_c3_1026 | 527 | 4299 | 699 | 232 | 757 | 4.5e-75 |

Description
gp:[GI:e313391:g2052219] [LN:SCDNACAT] [AC:X96981] [PN:catalase] [GN:catA] [OR:Streptomyces coelicolor] [DB:genpept-bct1] [DE:S.coelicolor catA gene.] [LE:392] [RE:1858] [DI:direct]

| ORF Name | NTID | AAID | NT Length | AA Length | score | probability |
|---|---|---|---|---|---|---|
| AI7503000983_26257806_c3_993 | 528 | 4300 | 984 | 327 | 707 | 9.0e-70 |

Description
sp:[LN:MUTL_BACSU] [AC:P49850] [GN:MUTL] [OR:BACILLUS SUBTILIS] [DE:DNA MISMATCH REPAIR PROTEIN MUTL] [SP:P49850] [DB:swissprot] >pir:[LN:A69663] [AC:A69663 ] [PN:DNA mismatch repair mutL] [GN:mutL ] [CL:mismatch repair protein hexB] [OR:Bacillus subtilis] [DB:pir2] >gp:[GI:g1002521] [LN:BSU27343] [AC:U27343] [PN:MutL] [GN:mutL] [FN:mismatch-repair recognition] [OR:Bacillus subtilis] [DB:genpept-bct1] [DE:Bacillus subtilis spore coat protein (cotE) gene, partial cds, andmismatch repair recognition proteins (mutS) and (mutL) genes,complete cds.] [LE:2782] [RE:4665] [DI:direct] >gp:[GI:e1185296:g2634077] [LN:BSUB0009] [AC:Z99112:AL009126] [GN:mutL] [FN:DNA mismatch repair] [OR:Bacillus subtilis] [DB:genpept-bct1] [DE:Bacillus subtilis complete genome (section 9 of 21): from 1598421to 1807200.] [SP:P49850] [LE:179285] [RE:181168] [DI:direct]

| ORF Name | NTID | AAID | NT Length | AA Length | score | probability |
|---|---|---|---|---|---|---|
| AI7503000983_26306257_c2_835 | 529 | 4301 | 2073 | 690 | 2490 | 1.0e-258 |

Description
sp:[LN:TOP1_BACSU] [AC:P39814] [GN:TOPA:TOPI] [OR:BACILLUS SUBTILIS] [EC:5.99.1.2] [DE:(UNTWISTING ENZYME) (SWIVELASE)] [SP:P39814] [DB:swissprot] >pir:[LN:G69724] [AC:G69724 ] [PN:DNA topoisomerase I topA] [GN:topA ] [CL:DNA topoisomerase I] [OR:Bacillus subtilis] [DB:pir2] >gp:[GI:g520753] [LN:BACSMF] [AC:L27797] [PN:DNA topoisomerase I] [FN:DNA unwinding protein: removes negative] [OR:Bacillus subtilis] [SR:Bacillus subtilis (strain 8G5) DNA] [DB:genpept-bct1] [DE:Bacillus subtilis (smf) gene, 3' end, DNA topisomase gene, completecds, (gid) gene, 5' end.] [LE:673] [RE:2748] [DI:direct] >gp:[GI:e1185203:g2633984] [LN:BSUB0009] [AC:Z99112:AL009126] [PN:DNA topoisomerase I] [GN:topA] [FN:DNA unwinding protein removing negative] [OR:Bacillus subtilis] [DB:genpept-bct1] [EC:5.99.1.2] [DE:Bacillus subtilis complete genome (section 9 of 21): from 1598421to 1807200.] [NT:alternate gene name: topI] [SP:P39814] [LE:84640] [RE:86715] [DI:direct] >gp:[GI:e332180:g2462970] [LN:BSYLQGCOD] [AC:AJ000975] [PN:DNA Topoisomerase I] [GN:topA] [OR:Bacillus subtilis] [DB:genpept-bct1] [DE:Bacillus subtilis ylqg to codV gene region.] [SP:P39814] [LE:3808] [RE:5883] [DI:direct]

| ORF Name | NTID | AAID | NT Length | AA Length | score | probability |
|---|---|---|---|---|---|---|
| AI7503000983_26353417_c1_753 | 530 | 4302 | 294 | 97 | 141 | 8.5e-10 |

Description
sp:[LN:YVI2_CLOPE] [AC:Q46213] [OR:CLOSTRIDIUM PERFRINGENS] [DE:HYPOTHETICAL 10.7 KD PROTEIN IN VIRR 5'REGION (ORF2)] [SP:Q46213] [DB:swissprot] >pir:[LN:S49553] [AC:S49553 ] [PN:hypothetical protein 2] [OR:Clostridium perfringens] [DB:pir2] >gp:[GI:g498839] [LN:CPVIRRS] [AC:U04966] [FN:unknown] [OR:Clostridium perfringens] [DB:genpept-bct1] [DE:Clostridium perfringens JIR4025 extracellular toxin productionregulatory locus ORF1 and ORF3 genes, partial cds, and ORF2,ORF10c, virR, virS, and ORF4 genes, complete cds.] [NT:ORF2] [LE:469] [RE:756] [DI:direct]

| ORF_Name | NTID | AAID | NT Length | AA Length | score | probability |
|---|---|---|---|---|---|---|
| AI7503000983_26354837_c2_946 | 531 | 4303 | 900 | 299 | 570 | 2.9e-55 |

Description
sp:[LN:DAPA_METJA] [AC:Q57695] [GN:DAPA:MJ0244] [OR:METHANOCOCCUS JANNASCHII]
[EC:4.2.1.52] [DE:DIHYDRODIPICOLINATE SYNTHASE, (DHDPS)] [SP:Q57695] [DB:swissprot]
>pir:[LN:E64330] [AC:E64330 ] [PN:dihydrodipicolinate synthase,] [OR:Methanococcus
jannaschii] [EC:4.2.1.52] [DB:pir2] [MP:REV233451-232582 ] >gp:[GI:g1590977]
[LN:U67480] [AC:U67480:L77117] [PN:dihydrodipicolinate synthase (dapA)] [GN:MJ0244]
[OR:Methanococcus jannaschii] [DB:genpept-bct2] [DE:Methanococcus jannaschii section 22
of 150 of the complete genome.] [NT:similar to GB:L08471 SP:Q04796 PID:142830] [LE:511]
[RE:1380] [DI:complement]

| ORF_Name | NTID | AAID | NT Length | AA Length | score | probability |
|---|---|---|---|---|---|---|
| AI7503000983_26369016_c1_773 | 532 | 4304 | 387 | 128 | 105 | 5.6e-06 |

Description
gp:[GI:e139437:g1369938] [LN:BTP9011] [AC:X84706] [PN:scaffolding protein] [GN:b1
(sfp)] [OR:Bacteriophage B1] [DB:genpept-phg] [DE:Bacteriophage TP901-1 genomic
region.] [NT:putative] [LE:<1] [RE:358] [DI:direct]

| ORF_Name | NTID | AAID | NT Length | AA Length | score | probability |
|---|---|---|---|---|---|---|
| AI7503000983_26460951_c2_839 | 533 | 4305 | 792 | 263 | 917 | 5.0e-92 |

Description
pir:[LN:F69708] [AC:F69708 ] [PN:uridylate kinase smbA] [GN:smbA ] [CL:uridine
5'-monophosphate kinase] [OR:Bacillus subtilis] [DB:pir2] >gp:[GI:e1185242:g2634023]
[LN:BSUB0009] [AC:Z99112:AL009126] [PN:uridylate kinase] [GN:smbA] [FN:pyrimidine
biosynthesis] [OR:Bacillus subtilis] [DB:genpept-bct1] [EC:2.7.4.-] [DE:Bacillus
subtilis complete genome (section 9 of 21): from 1598421to 1807200.] [LE:120774]
[RE:121496] [DI:direct]

| ORF_Name | NTID | AAID | NT Length | AA Length | score | probability |
|---|---|---|---|---|---|---|
| AI7503000983_26569432_f2_444 | 534 | 4306 | 168 | 55 | | |

Description
NO-HIT

| ORF_Name | NTID | AAID | NT Length | AA Length | score | probability |
|---|---|---|---|---|---|---|
| AI7503000983_26586537_f2_376 | 535 | 4307 | 156 | 51 | 70 | 0.028 |

Description
gp:[GI:d1045213:g5106116] [LN:AP000064] [AC:AP000064] [PN:125aa long hypothetical
protein] [GN:APE2412] [OR:Aeropyrum pernix] [SR:Aeropyrum pernix (strain:K1) DNA]
[DB:genpept] [DE:Aeropyrum pernix genomic DNA, section 7/7.] [LE:105148] [RE:105525]
[DI:direct]

| ORF_Name | NTID | AAID | NT Length | AA Length | score | probability |
|---|---|---|---|---|---|---|
| AI7503000983_2734778_f1_31 | 536 | 4308 | 126 | 41 | | |

Description
NO-HIT

| ORF_Name | NTID | AAID | NT Length | AA Length | score | probability |
|---|---|---|---|---|---|---|
| AI7503000983_275427_c1_744 | 537 | 4309 | 1722 | 573 | 1379 | 5.5e-141 |

Description
pir:[LN:H69884] [AC:H69884 ] [PN:conserved hypothetical protein ymfA] [GN:ymfA ]
[CL:conserved hypothetical protein MG139] [OR:Bacillus subtilis] [DB:pir2]
>gp:[GI:e1185269:g2634050] [LN:BSUB0009] [AC:Z99112:AL009126] [GN:ymfA] [FN:unknown]
[OR:Bacillus subtilis] [DB:genpept-bct1] [DE:Bacillus subtilis complete genome (section
9 of 21): from 1598421to 1807200.] [NT:similar to hypothetical proteins] [LE:150509]
[RE:152056] [DI:direct]

| ORF_Name | NTID | AAID | NT Length | AA Length | score | probability |
|---|---|---|---|---|---|---|
| AI7503000983_2931337_f2_256 | 538 | 4310 | 780 | 259 | 771 | 1.5e-76 |

Description
gp:[GI:g3800827] [LN:AF076684] [AC:AF076684] [PN:oligopeptide transporter putative
ATPase domain] [GN:opp-2D] [OR:Staphylococcus aureus] [DB:genpept-bct2]
[DE:Staphylococcus aureus oligopeptide transporter putative membranepermease domain
(opp-2B), oligopeptide transporter putativemembrane permease domain (opp-2C),
oligopeptide transporterputative ATPase domain (opp-2D), and oligopeptide
transporterputative ATPase domain (opp-2F) genes, complete cds.] [LE:1966] [RE:2742]
[DI:direct]

| ORF_Name | NTID | AAID | NT Length | AA Length | score | probability |
|---|---|---|---|---|---|---|
| AI7503000983_29781968_c3_995 | 539 | 4311 | 855 | 284 | 825 | 2.8e-82 |

Description
sp:[LN:GLPF_BACSU] [AC:P18156] [GN:GLPF] [OR:BACILLUS SUBTILIS] [DE:GLYCEROL UPTAKE
FACILITATOR PROTEIN] [SP:P18156] [DB:swissprot] >pir:[LN:C47700]
[AC:C47700:A45868:B69634:S18563 ] [PN:glycerol uptake facilitator glpF] [GN:glpF ]
[CL:glycerol facilitator protein] [OR:Bacillus subtilis] [DB:pir2] [MP:75 (degrees) ]
>gp:[GI:g142997] [LN:BACGLPPFK] [AC:M99611] [PN:glycerol uptake facilitator] [GN:glpF]
[OR:Bacillus subtilis] [SR:Bacillus subtilis DNA] [DB:genpept-bct1] [DE:Bacillus
subtilis antiterminator regulatory protein (glpP),glycerol uptake facilitator (glpF)
genes, complete cds, glycerolkinase (glpK) gene, 5' end.] [NT:putative] [LE:1085]
[RE:1909] [DI:direct] >gp:[GI:e1182917:g2633251] [LN:BSUB0005] [AC:Z99108:AL009126]
[PN:glycerol uptake facilitator] [GN:glpF] [FN:glycerol utilization] [OR:Bacillus
subtilis] [DB:genpept-bct1] [DE:Bacillus subtilis complete genome (section 5 of 21):
from 802821 to1011250.] [SP:P18156] [LE:199186] [RE:200010] [DI:direct]
>gp:[GI:e1182919:g2633263] [LN:BSUB0006] [AC:Z99109:AL009126] [PN:glycerol uptake
facilitator] [GN:glpF] [FN:glycerol utilization] [OR:Bacillus subtilis]
[DB:genpept-bct1] [DE:Bacillus subtilis complete genome (section 6 of 21): from 999501
to1209940.] [SP:P18156] [LE:2506] [RE:3330] [DI:direct] >gp:[GI:e324940:g2226136]
[LN:BSY14079] [AC:Y14079] [PN:putative glycerol uptake facilitator] [GN:glpF]
[OR:Bacillus subtilis] [DB:genpept-bct1] [DE:Bacillus subtilis chromosomal DNA, region
75 degrees: glpPFKDoperon and downstream.] [NT:see EMBL M99611 and Swiss Prot P18156.]
[SP:P18156] [LE:2154] [RE:2978] [DI:direct]

| ORF_Name | NTID | AAID | NT Length | AA Length | score | probability |
|---|---|---|---|---|---|---|
| AI7503000983_29886011_f2_248 | 540 | 4312 | 135 | 44 | | |

Description
NO-HIT

| ORF Name | NTID | AAID | NT Length | AA Length | score | probability |
|---|---|---|---|---|---|---|
| AI7503000983_30355313_c1_779 | 541 | 4313 | 1113 | 370 | 382 | 2.5e-35 |

Description pir:[LN:C69901] [AC:C69901 ] [PN:probable two-component sensor histidine kinase yocF] [GN:yocF ] [CL:probable Bacillus subtilis two-component sensor histidine kinase yocF] [OR:Bacillus subtilis] [DB:pir2] >gp:[GI:g2619013] [LN:AF027868] [AC:AF027868] [PN:sensor kinase] [GN:yocF] [OR:Bacillus subtilis] [DB:genpept-bct1] [DE:Bacillus subtilis chromosome region between terC and odhAB.] [NT:similar to B.subtilis DegS sensor kinase (385 aa)] [LE:70568] [RE:71680] [DI:direct] >gp:[GI:e1185391:g2634312] [LN:BSUB0011] [AC:Z99114:AL009126] [GN:yocF] [FN:unknown] [OR:Bacillus subtilis] [DB:genpept-bct1] [DE:Bacillus subtilis complete genome (section 11 of 21): from 2000171to 2207900.] [NT:similar to two-component sensor histidine kinase] [LE:89659] [RE:90771] [DI:direct]

| ORF Name | NTID | AAID | NT Length | AA Length | score | probability |
|---|---|---|---|---|---|---|
| AI7503000983_30656317_c2_838 | 542 | 4314 | 822 | 273 | 858 | 8.9e-86 |

Description pir:[LN:S61496] [AC:S61496:H69601 ] [PN:transcription pleiotropic repressor codY] [GN:codY ] [OR:Bacillus subtilis] [DB:pir2] >gp:[GI:g535351] [LN:BSU13634] [AC:U13634] [PN:CodY] [GN:codY] [OR:Bacillus subtilis] [DB:genpept-bct1] [DE:Bacillus subtilis JH642 dipeptide permease operon regulators, codV,codW, codX, and codY genes, complete cds.] [LE:3225] [RE:4004] [DI:direct] >gp:[GI:e1185208:g2633989] [LN:BSUB0009] [AC:Z99112:AL009126] [PN:transcriptional regulator] [GN:codY] [FN:negative regulation of srfA and comK genes (in] [OR:Bacillus subtilis] [DB:genpept-bct1] [DE:Bacillus subtilis complete genome (section 9 of 21): from 1598421to 1807200.] [SP:P39779] [LE:91098] [RE:91877] [DI:direct]

| ORF Name | NTID | AAID | NT Length | AA Length | score | probability |
|---|---|---|---|---|---|---|
| AI7503000983_31275_c2_927 | 543 | 4315 | 171 | 56 | | |

Description

NO-HIT

| ORF Name | NTID | AAID | NT Length | AA Length | score | probability |
|---|---|---|---|---|---|---|
| AI7503000983_31552_c1_755 | 544 | 4316 | 522 | 173 | 197 | 9.9e-16 |

Description gp:[GI:d1045212:g5106115] [LN:AP000064] [AC:AP000064] [PN:197aa long hypothetical protein] [GN:APE2411] [OR:Aeropyrum pernix] [SR:Aeropyrum pernix (strain:K1) DNA] [DB:genpept] [DE:Aeropyrum pernix genomic DNA, section 7/7.] [NT:motif=G-protein coupled receptors signature] [LE:104943] [RE:105536] [DI:complement]

| ORF Name | NTID | AAID | NT Length | AA Length | score | probability |
|---|---|---|---|---|---|---|
| AI7503000983_31697151_c2_826 | 545 | 4317 | 315 | 104 | 441 | 1.4e-41 |

Description sp:[LN:RL19_BACSU] [AC:O31742] [GN:RPLS] [OR:BACILLUS SUBTILIS] [DE:50S RIBOSOMAL PROTEIN L19] [SP:O31742] [DB:swissprot] >pir:[LN:E69696] [AC:E69696 ] [PN:ribosomal protein L19 rplS] [GN:rplS ] [CL:Escherichia coli ribosomal protein L19] [OR:Bacillus subtilis] [DB:pir2] >gp:[GI:e1185195:g2633976] [LN:BSUB0009] [AC:Z99112:AL009126] [PN:ribosomal protein L19] [GN:rplS] [OR:Bacillus subtilis] [DB:genpept-bct1] [DE:Bacillus subtilis complete genome (section 9 of 21): from 1598421to 1807200.] [SP:O31742] [LE:77012] [RE:77368] [DI:direct]

| ORF Name | NTID | AAID | NT Length | AA Length | score | probability |
|---|---|---|---|---|---|---|
| AI7503000983_31803760_f1_9 | 546 | 4318 | 153 | 50 | 43 | 0.031 |

Description
gp:[GI:e1347527:g3877915] [LN:CEF58G1] [AC:Z81556] [GN:F58G1.9] [OR:Caenorhabditis elegans] [DB:genpept-invl] [DE:Caenorhabditis elegans cosmid F58G1, complete sequence.] [NT:predicted using Genefinder] [LE:13299:13426:13549] [RE:13379:13500:13656] [DI:directJoin]

| ORF Name | NTID | AAID | NT Length | AA Length | score | probability |
|---|---|---|---|---|---|---|
| AI7503000983_31844658_c3_987 | 547 | 4319 | 138 | 45 | | |

Description
NO-HIT

| ORF Name | NTID | AAID | NT Length | AA Length | score | probability |
|---|---|---|---|---|---|---|
| AI7503000983_3235828_c1_798 | 548 | 4320 | 138 | 45 | | |

Description
NO-HIT

| ORF Name | NTID | AAID | NT Length | AA Length | score | probability |
|---|---|---|---|---|---|---|
| AI7503000983_3257827_c2_858 | 549 | 4321 | 705 | 234 | 356 | 1.4e-32 |

Description
pir:[LN:H69885] [AC:H69885 ] [PN:3-oxoacyl- acyl-carrier protein reductase homolog ymfI] [GN:ymfI ] [CL:short-chain alcohol dehydrogenase homology] [OR:Bacillus subtilis] [DB:pir2] >gp:[GI:e1185278:g2634059] [LN:BSUB0009] [AC:Z99112:AL009126] [GN:ymfI] [FN:unknown] [OR:Bacillus subtilis] [DB:genpept-bct1] [DE:Bacillus subtilis complete genome (section 9 of 21): from 1598421to 1807200.] [NT:similar to 3-oxoacyl-acyl-carrier protein] [LE:160607] [RE:161335] [DI:direct]

| ORF Name | NTID | AAID | NT Length | AA Length | score | probability |
|---|---|---|---|---|---|---|
| AI7503000983_32611557_c3_966 | 550 | 4322 | 294 | 97 | 316 | 2.4e-28 |

Description
sp:[LN:EFTS_BACSU] [AC:P80700:O31748] [GN:TSF] [OR:BACILLUS SUBTILIS] [DE:ELONGATION FACTOR TS (EF-TS)] [SP:P80700:O31748] [DB:swissprot]

| ORF Name | NTID | AAID | NT Length | AA Length | score | probability |
|---|---|---|---|---|---|---|
| AI7503000983_33283167_c3_983 | 551 | 4323 | 1338 | 445 | 967 | 2.5e-97 |

Description
pir:[LN:G69885] [AC:G69885 ] [PN:processing proteinase homolog ymfH] [GN:ymfH ] [OR:Bacillus subtilis] [DB:pir2] >gp:[GI:e1185277:g2634058] [LN:BSUB0009] [AC:Z99112:AL009126] [GN:ymfH] [FN:unknown] [OR:Bacillus subtilis] [DB:genpept-bct1] [DE:Bacillus subtilis complete genome (section 9 of 21): from 1598421to 1807200.] [NT:similar to processing protease] [LE:159305] [RE:160552] [DI:direct]

| ORF Name | NTID | AAID | NT Length | AA Length | score | probability |
|---|---|---|---|---|---|---|
| AI7503000983_33375260_f2_273 | 552 | 4324 | 165 | 54 | | |

Description
NO-HIT

| ORF Name | NTID | AAID | NT Length | AA Length | score | probability |
|---|---|---|---|---|---|---|
| AI7503000983_3394390_f1_48 | 553 | 4325 | 123 | 40 | | |

Description
NO-HIT

| ORF Name | NTID | AAID | NT Length | AA Length | score | probability |
|---|---|---|---|---|---|---|
| AI7503000983_34070261_c3_1010 | 554 | 4326 | 900 | 299 | 386 | 9.3e-36 |

Description
pir:[LN:A70039] [AC:A70039 ] [PN:ABC transporter (ATP-binding protein) homolog yvfR]
[GN:yvfR ] [CL:ATP-binding cassette homology] [OR:Bacillus subtilis] [DB:pir2]
>gp:[GI:e1186097:g2635922] [LN:BSUB0018] [AC:Z99121:AL009126] [GN:yvfR] [FN:unknown]
[OR:Bacillus subtilis] [DB:genpept-bct1] [DE:Bacillus subtilis complete genome (section
18 of 21): from 3399551to 3609060.] [NT:similar to ABC transporter (ATP-binding
protein)] [LE:97865] [RE:98770] [DI:complement] >gp:[GI:e313073:g1945718] [LN:BSZ94043]
[AC:Z94043] [PN:hypothetical protein] [GN:yvfR] [OR:Bacillus subtilis]
[DB:genpept-bct1] [DE:B.subtilis genomic DNA fragment (88 kb).] [NT:probable ABC
transporter] [LE:82901] [RE:83806] [DI:direct]

| ORF Name | NTID | AAID | NT Length | AA Length | score | probability |
|---|---|---|---|---|---|---|
| AI7503000983_34195135_c2_896 | 555 | 4327 | 1104 | 367 | 1236 | 7.8e-126 |

Description
sp:[LN:THRC_BACSU] [AC:P04990] [GN:THRC] [OR:BACILLUS SUBTILIS] [EC:4.2.99.2]
[DE:THREONINE SYNTHASE,] [SP:P04990] [DB:swissprot] >pir:[LN:A25364]
[AC:A25364:B31973:A69723 ] [PN:threonine synthase, thrC] [GN:thrC ] [CL:threonine
dehydratase] [OR:Bacillus subtilis] [EC:4.2.99.2] [DB:pir2] >gp:[GI:g40211]
[LN:BSTHRBC] [AC:X04603] [PN:threonine synthase] [GN:thrC] [OR:Bacillus subtilis]
[DB:genpept-bct1] [EC:4.2.99.2] [DE:B. subtilis thrB and thrC genes for homoserine
kinase and threoninesynthase (EC 2.7.1.39 and EC 4.2.99.2, respectively).] [SP:P04990]
[LE:248] [RE:1306] [DI:direct] >gp:[GI:e1184304:g2635722] [LN:BSUB0017]
[AC:Z99120:AL009126] [PN:threonine synthase] [GN:thrC] [FN:threonine biosynthesis]
[OR:Bacillus subtilis] [DB:genpept-bct1] [EC:4.2.99.2] [DE:Bacillus subtilis complete
genome (section 17 of 21): from 3197001to 3414420.] [NT:alternate gene name: thrB]
[SP:P04990] [LE:115828] [RE:116886] [DI:complement]

| ORF Name | NTID | AAID | NT Length | AA Length | score | probability |
|---|---|---|---|---|---|---|
| AI7503000983_34257817_c3_1038 | 556 | 4328 | 123 | 40 | | |

Description
NO-HIT

| ORF Name | NTID | AAID | NT Length | AA Length | score | probability |
|---|---|---|---|---|---|---|
| AI7503000983_34571877_c1_746 | 557 | 4329 | 1275 | 424 | 484 | 3.8e-46 |

Description
gp:[GI:g3426364] [LN:AF082738] [AC:AF082738] [PN:unknown] [OR:Streptococcus pyogenes]
[DB:genpept-bct2] [DE:Streptococcus pyogenes phosphotidylglycerophosphate synthase
(pgsA)and ABC transporter ATP-binding protein (stpA) genes, complete cds;and unknown
genes.] [NT:orf1] [LE:1] [RE:1245] [DI:direct]

| ORF Name | NTID | AAID | NT Length | AA Length | score | probability |
|---|---|---|---|---|---|---|
| AI7503000983_34663177_c2_860 | 558 | 4330 | 1167 | 388 | 641 | 2.1e-65 |

Description
gp:[GI:g1842440] [LN:BSU87792] [AC:U87792] [PN:CinA] [GN:cinA] [FN:putative
competence-damage inducible function] [OR:Bacillus subtilis] [DB:genpept-bct1]
[DE:Bacillus subtilis tRNA-Ala, phosphatidylglycerophosphate synthase(pgsA) and CinA
(cinA) genes, complete cds, and RecA (recA) gene,partial cds.] [LE:6007] [RE:7258]
[DI:direct]

| ORF Name | NTID | AAID | NT Length | AA Length | score | probability |
|---|---|---|---|---|---|---|
| AI7503000983_35187587_c3_1055 | 559 | 4331 | 588 | 195 | 370 | 4.6e-34 |

Description
pir:[LN:S34747] [AC:S34747 ] [PN:anthranilate synthase, component II] [CL:glutamine
amidotransferase:trpG homology] [OR:Thermotoga maritima] [EC:4.1.3.27] [DB:pir2]

| ORF Name | NTID | AAID | NT Length | AA Length | score | probability |
|---|---|---|---|---|---|---|
| AI7503000983_35370318_c2_834 | 560 | 4332 | 930 | 309 | 1274 | 7.4e-130 |

Description
pir:[LN:F69719] [AC:F69719 ] [PN:succinate--CoA ligase (ADP-forming), alpha chain ]
[GN:sucD ] [CL:succinate--CoA ligase (ADP-forming) alpha chain] [OR:Bacillus subtilis]
[EC:6.2.1.5] [DB:pir2] >gp:[GI:e1185201:g2633982] [LN:BSUB0009] [AC:Z99112:AL009126]
[PN:succinyl-CoA synthetase (alpha subunit)] [GN:sucD] [OR:Bacillus subtilis]
[DB:genpept-bct1] [EC:6.2.1.5] [DE:Bacillus subtilis complete genome (section 9 of 21):
from 1598421to 1807200.] [SP:P80865] [LE:82596] [RE:83498] [DI:direct]
>gp:[GI:e332178:g2462968] [LN:BSYLQGCOD] [AC:AJ000975] [PN:putative succinyl-coA
synthetase alpha chain] [GN:sucD] [OR:Bacillus subtilis] [DB:genpept-bct1] [DE:Bacillus
subtilis ylqg to codV gene region.] [SP:P80865] [LE:1764] [RE:2666] [DI:direct]

| ORF Name | NTID | AAID | NT Length | AA Length | score | probability |
|---|---|---|---|---|---|---|
| AI7503000983_35557787_c3_1073 | 561 | 4333 | 1275 | 424 | 842 | 4.4e-84 |

Description
gp:[GI:g4982084] [LN:AE001799] [AC:AE001799:AE000512] [PN:aspartokinase II] [GN:TM1518]
[OR:Thermotoga maritima] [DB:genpept-bct2] [DE:Thermotoga maritima section 111 of 136
of the complete genome.] [NT:similar to PID:928811 SP:P53553 percent identity:]
[LE:15047] [RE:16252] [DI:complement]

| ORF Name | NTID | AAID | NT Length | AA Length | score | probability |
|---|---|---|---|---|---|---|
| AI7503000983_36134401_c2_897 | 562 | 4334 | 831 | 276 | 315 | 3.1e-28 |

Description
sp:[LN:YXEH_BACSU] [AC:P54947] [GN:YXEH:IP1B] [OR:BACILLUS SUBTILIS] [DE:HYPOTHETICAL
30.2 KD PROTEIN IN IDH-DEOR INTERGENIC REGION] [SP:P54947] [DB:swissprot]
>pir:[LN:B70075] [AC:B70075 ] [PN:conserved hypothetical protein yxeH] [GN:yxeH ]
[CL:Methanobacterium thermoautotrophicum conserved hypothetical protein MTH1071]
[OR:Bacillus subtilis] [DB:pir2] >gp:[GI:e1184680:g2636501] [LN:BSUB0021]
[AC:Z99124:AL009126] [GN:yxeH] [FN:unknown] [OR:Bacillus subtilis] [DB:genpept-bct1]
[DE:Bacillus subtilis complete genome (section 21 of 21): from 3999281to 4214814.]
[NT:similar to hypothetical proteins] [SP:P54947] [LE:63194] [RE:64006] [DI:complement]
>gp:[GI:d1008920:g1408493] [LN:D45912] [AC:D45912] [GN:yxeH] [OR:Bacillus subtilis]
[SR:Bacillus subtilis (strain:BGSC 1A1 (Marburg 168; trpC2)) DNA] [DB:genpept-bct1]
[DE:Bacillus subtilis genome sequence between the iol and hut operon,partial and
complete cds.] [NT:homologous to SwissProt:YIDA_ECOLI hypothetical] [LE:7470] [RE:8282]
[DI:direct]

| ORF Name | NTID | AAID | NT Length | AA Length | score | probability |
|---|---|---|---|---|---|---|
| AI7503000983_36142827_c1_814 | 563 | 4335 | 1812 | 603 | 780 | 1.6e-77 |

Description
gp:[GI:d1014255:g1651216] [LN:D88209] [AC:D88209] [PN:Pz-peptidase] [OR:Bacillus licheniformis] [SR:Bacillus licheniformis (strain:N22) DNA] [DB:genpept-bct1] [DE:Bacillus licheniformis DNA for Pz-peptidase, complete cds.] [LE:238] [RE:2124] [DI:direct]

| ORF Name | NTID | AAID | NT Length | AA Length | score | probability |
|---|---|---|---|---|---|---|
| AI7503000983_36220061_c3_964 | 564 | 4336 | 1425 | 474 | 1399 | 4.2e-143 |

Description
sp:[LN:HSLU_BACSU] [AC:P39778] [GN:HSLU:CLPY:CODX] [OR:BACILLUS SUBTILIS] [DE:HEAT SHOCK PROTEIN HSLU] [SP:P39778] [DB:swissprot] >pir:[LN:E69601] [AC:E69601:S61495:S72310 ] [PN:ATP-dependent Clp proteinase-like protein clpY:codX protein] [GN:clpY:codX ] [CL:heat shock protein hslU:FtsH/SEC18/CDC48-type ATP-binding domain homology] [OR:Bacillus subtilis] [DB:pir2] >gp:[GI:g535350] [LN:BSU13634] [AC:U13634] [PN:CodX] [GN:codX] [OR:Bacillus subtilis] [DB:genpept-bct1] [DE:Bacillus subtilis JH642 dipeptide permease operon regulators, codV,codW, codX, and codY genes, complete cds.] [LE:1782] [RE:3185] [DI:direct] >gp:[GI:e1185207:g2633988] [LN:BSUB0009] [AC:Z99112:AL009126] [PN:ATP-dependent Clp protease-like] [GN:clpY] [OR:Bacillus subtilis] [DB:genpept-bct1] [DE:Bacillus subtilis complete genome (section 9 of 21): from 1598421to 1807200.] [NT:alternate gene name: hslU, codX] [SP:P39778] [LE:89655] [RE:91058] [DI:direct]

| ORF Name | NTID | AAID | NT Length | AA Length | score | probability |
|---|---|---|---|---|---|---|
| AI7503000983_36225938_c2_833 | 565 | 4337 | 1185 | 394 | 1557 | 7.6e-160 |

Description
sp:[LN:SUCC_BACSU] [AC:P80886] [GN:SUCC] [OR:BACILLUS SUBTILIS] [EC:6.2.1.5] [DE:(VEGETATIVE PROTEIN 63) (VEG63)] [SP:P80886] [DB:swissprot] >pir:[LN:E69719] [AC:E69719 ] [PN:succinate--CoA ligase (ADP-forming), beta chain] [GN:sucC ] [CL:succinate--CoA ligase (ADP-forming) beta chain] [OR:Bacillus subtilis] [EC:6.2.1.5] [DB:pir2] >gp:[GI:e1185200:g2633981] [LN:BSUB0009] [AC:Z99112:AL009126] [PN:succinyl-CoA synthetase (beta subunit)] [GN:sucC] [OR:Bacillus subtilis] [DB:genpept-bct1] [EC:6.2.1.5] [DE:Bacillus subtilis complete genome (section 9 of 21): from 1598421to 1807200.] [SP:P80886] [LE:81410] [RE:82567] [DI:direct] >gp:[GI:e332177:g2462967] [LN:BSYLQGCOD] [AC:AJ000975] [PN:putative succinyl-coA synthetase beta chain] [GN:sucC] [OR:Bacillus subtilis] [DB:genpept-bct1] [DE:Bacillus subtilis ylqg to codV gene region.] [SP:P80886] [LE:578] [RE:1735] [DI:direct]

| ORF Name | NTID | AAID | NT Length | AA Length | score | probability |
|---|---|---|---|---|---|---|
| AI7503000983_3913307_f3_640 | 566 | 4338 | 135 | 44 | | |

Description
NO-HIT

| ORF Name | NTID | AAID | NT Length | AA Length | score | probability |
|---|---|---|---|---|---|---|
| AI7503000983_3928177_f2_255 | 567 | 4339 | 360 | 119 | 91 | 0.00081 |

Description
gp:[GI:d1039115:g4514335] [LN:AB013370] [AC:AB013370] [PN:YndE] [GN:yndE] [OR:Bacillus halodurans] [SR:Bacillus halodurans (strain:C-125) DNA] [DB:genpept-bct1] [DE:Bacillus halodurans C-125 yndF, gerKA, yndF1 and yndF2 genes,partial and complete cds.] [LE:1025] [RE:1876] [DI:direct]

| ORF Name | NTID | AAID | NT Length | AA Length | score | probability |
|---|---|---|---|---|---|---|
| AI7503000983_3937551_c1_820 | 568 | 4340 | 999 | 332 | 803 | 6.0e-80 |

Description pir:[LN:B70461] [AC:B70461 ] [PN:aspartate-semialdehyde dehydrogenase,] [GN:asd ] [CL:aspartate-semialdehyde dehydrogenase] [OR:Aquifex aeolicus] [EC:1.2.1.11] [DB:pir2] >gp:[GI:g2984139] [LN:AE000760] [AC:AE000760:AE000657] [PN:aspartate-semialdehyde dehydrogenase] [GN:asd] [OR:Aquifex aeolicus] [DB:genpept-bct2] [DE:Aquifex aeolicus section 92 of 109 of the complete genome.] [LE:7783] [RE:8805] [DI:direct]

| ORF Name | NTID | AAID | NT Length | AA Length | score | probability |
|---|---|---|---|---|---|---|
| AI7503000983_3961702_c1_811 | 569 | 4341 | 1269 | 422 | 2249 | 3.5e-233 |

Description pir:[LN:JC5325] [AC:JC5325:PC4317 ] [PN:methicillin resistance factor FEMA] [GN:femA ] [CL:methicillin resistance factor femA] [OR:Staphylococcus epidermidis] [DB:pir2]

| ORF Name | NTID | AAID | NT Length | AA Length | score | probability |
|---|---|---|---|---|---|---|
| AI7503000983_4025303_c2_923 | 570 | 4342 | 792 | 263 | 450 | 1.5e-42 |

Description sp:[LN:TRPC_LACLA] [AC:Q01999] [GN:TRPC] [OR:LACTOCOCCUS LACTIS] [SR:,SUBSPLACTIS:STREPTOCOCCUS LACTIS] [EC:4.1.1.48] [DE:INDOLE-3-GLYCEROL PHOSPHATE SYNTHASE, (IGPS)] [SP:Q01999] [DB:swissprot] >pir:[LN:S35127] [AC:S35127 ] [PN:indole-3-glycerol-phosphate synthase,] [GN:trpC ] [CL:indole-3-glycerol-phosphate synthase:trpC homology] [OR:Lactococcus lactis subsp. lactis] [EC:4.1.1.48] [DB:pir2] >gp:[GI:g149519] [LN:LACTRPOP] [AC:M87483] [PN:indoleglycerol phosphate synthase] [GN:trpC] [OR:Lactococcus lactis] [SR:Lactococcus lactis (strain IL1403, sub_species lactis) DNA] [DB:genpept-bct1] [EC:4.1.1.48] [DE:L. lactis trpE, trpG, trpD, trpF, trpC, trpB trpA genes, completecds.] [LE:4089] [RE:4883] [DI:direct]

| ORF Name | NTID | AAID | NT Length | AA Length | score | probability |
|---|---|---|---|---|---|---|
| AI7503000983_4062762_f3_555 | 571 | 4343 | 405 | 134 | 508 | 1.1e-48 |

Description gp:[GI:g3135292] [LN:AF029731] [AC:AF029731] [PN:large conductance mechanosensitive channel] [GN:mscL] [OR:Staphylococcus aureus] [DB:genpept-bct2] [DE:Staphylococcus aureus large conductance mechanosensitive channel(mscL) gene, complete cds.] [NT:MscL] [LE:49] [RE:411] [DI:direct]

| ORF Name | NTID | AAID | NT Length | AA Length | score | probability |
|---|---|---|---|---|---|---|
| AI7503000983_4063802_c1_808 | 572 | 4344 | 1497 | 498 | 808 | 1.8e-80 |

Description sp:[LN:TRPE_LACLA] [AC:Q02001] [GN:TRPE] [OR:LACTOCOCCUS LACTIS] [SR:,SUBSPLACTIS:STREPTOCOCCUS LACTIS] [EC:4.1.3.27] [DE:ANTHRANILATE SYNTHASE COMPONENT I,] [SP:Q02001] [DB:swissprot] >pir:[LN:S35124] [AC:S35124 ] [PN:anthranilate synthase, alpha chain] [GN:trpE ] [CL:anthranilate synthase component I] [OR:Lactococcus lactis subsp. lactis] [EC:4.1.3.27] [DB:pir2] >gp:[GI:g149516] [LN:LACTRPOP] [AC:M87483] [PN:anthranilate synthase alpha subunit] [GN:trpE] [OR:Lactococcus lactis] [SR:Lactococcus lactis (strain IL1403, sub_species lactis) DNA] [DB:genpept-bct1] [EC:4.1.3.27] [DE:L. lactis trpE, trpG, trpD, trpF, trpC, trpB trpA genes, completecds.] [LE:954] [RE:2324] [DI:direct]

| ORF Name | NTID | AAID | NT Length | AA Length | score | probability |
|---|---|---|---|---|---|---|
| AI7503000983_40686_c1_737 | 573 | 4345 | 4089 | 1362 | 6425 | 0.0 |

Description
sp:[LN:DPO3_STAAU] [AC:Q53665:Q57110] [GN:POLC] [OR:STAPHYLOCOCCUS AUREUS] [EC:2.7.7.7] [DE:DNA POLYMERASE III, ALPHA CHAIN POLC-TYPE, (POLIII)] [SP:Q53665:Q57110] [DB:swissprot] >gp:[GI:d1013849:g1483182] [LN:D86727] [AC:D86727:D45368] [PN:DNA polymerase III] [OR:Staphylococcus aureus] [SR:Staphylococcus aureus (strain:IP8) DNA, clone:pBpolC] [DB:genpept-bct1] [DE:Staphylococcus aureus DNA for DNA polymerase III, complete cds.] [LE:34] [RE:4341] [DI:direct]

| ORF Name | NTID | AAID | NT Length | AA Length | score | probability |
|---|---|---|---|---|---|---|
| AI7503000983_4069675_f2_274 | 574 | 4346 | 162 | 53 | | |

Description
NO-HIT

| ORF Name | NTID | AAID | NT Length | AA Length | score | probability |
|---|---|---|---|---|---|---|
| AI7503000983_4080342_c3_996 | 575 | 4347 | 1515 | 504 | 1998 | 1.4e-206 |

Description
sp:[LN:GLPK_BACSU] [AC:P18157] [GN:GLPK] [OR:BACILLUS SUBTILIS] [EC:2.7.1.30] [DE:(GLYCEROKINASE) (GK)] [SP:P18157] [DB:swissprot] >pir:[LN:B45868] [AC:B45868:D47700:C69634:S18564 ] [PN:glycerol kinase, glpK] [GN:glpK ] [CL:xylulokinase] [OR:Bacillus subtilis] [EC:2.7.1.30] [DB:pir2] [MP:75 (degrees) ] >gp:[GI:g142992] [LN:BACGLPKD] [AC:M34393] [OR:Bacillus subtilis] [SR:B.subtilis (strain W168) DNA] [DB:genpept-bct1] [DE:B.subtilis glycerol kinase (glpK) and glycerol-3-phosphatedehydrogenase (glpD) genes, complete cds.] [NT:glycerol kinase (glpK) (EC 2.7.1.30)] [LE:698] [RE:2188] [DI:direct] >gp:[GI:e1182918:g2633252] [LN:BSUB0005] [AC:Z99108:AL009126] [PN:glycerol kinase] [GN:glpK] [FN:glycerol utilization] [OR:Bacillus subtilis] [DB:genpept-bct1] [EC:2.7.1.30] [DE:Bacillus subtilis complete genome (section 5 of 21): from 802821 to1011250.] [SP:P18157] [LE:200029] [RE:201519] [DI:direct] >gp:[GI:e1182930:g2633264] [LN:BSUB0006] [AC:Z99109:AL009126] [PN:glycerol kinase] [GN:glpK] [FN:glycerol utilization] [OR:Bacillus subtilis] [DB:genpept-bct1] [EC:2.7.1.30] [DE:Bacillus subtilis complete genome (section 6 of 21): from 999501 to1209940.] [SP:P18157] [LE:3349] [RE:4839] [DI:direct] >gp:[GI:e324941:g2226137] [LN:BSY14079] [AC:Y14079] [PN:glycerol kinase] [GN:glpK] [OR:Bacillus subtilis] [DB:genpept-bct1] [DE:Bacillus subtilis chromosomal DNA, region 75 degrees: glpPFKDoperon and downstream.] [NT:see EMBL M34393 and Swiss Prot P18157.] [SP:P18157] [LE:2997] [RE:4487] [DI:direct]

| ORF Name | NTID | AAID | NT Length | AA Length | score | probability |
|---|---|---|---|---|---|---|
| AI7503000983_4089062_c2_906 | 576 | 4348 | 1176 | 391 | 380 | 4.0e-35 |

Description
pir:[LN:C71302] [AC:C71302 ] [PN:probable exonuclease] [GN:TP0626 ] [OR:Treponema pallidum subsp. pallidum] [SR:, syphilis spirochete] [DB:pir2] >gp:[GI:g3322921] [LN:AE001237] [AC:AE001237:AE000520] [PN:exonuclease, putative] [GN:TP0626] [OR:Treponema pallidum] [DB:genpept-bct2] [DE:Treponema pallidum section 53 of 87 of the complete genome.] [NT:similar to SP:P23479 percent identity: 32.68;] [LE:11246] [RE:12421] [DI:direct]

| ORF Name | NTID | AAID | NT Length | AA Length | score | probability |
|---|---|---|---|---|---|---|
| AI7503000983_4093818_c2_859 | 577 | 4349 | 591 | 196 | 436 | 4.7e-41 |

Description
sp:[LN:PGSA_BACSU] [AC:P46322] [GN:PGSA] [OR:BACILLUS SUBTILIS] [EC:2.7.8.5] [DE:(EC 2.7.8.5) (PHOSPHATIDYLGLYCEROPHOSPHATE SYNTHASE) (PGP SYNTHASE)] [SP:P46322] [DB:swissprot] >gp:[GI:d1009402:g893358] [LN:BACPGS1A] [AC:D50064] [PN:PgsA] [GN:pgs1A] [OR:Bacillus subtilis] [SR:Bacillus subtilis (strain:Marburg168) DNA] [DB:genpept-bct1] [EC:2.7.8.5] [DE:Bacillus subtilis pgs1A gene for phosphatidylglycerophosphatesynthase, complete cds.] [LE:182] [RE:763] [DI:direct] >gp:[GI:g1842439] [LN:BSU87792] [AC:U87792] [PN:phosphatidylglycerophosphate synthase] [GN:pgsA] [FN:involved in the synthetic pathway for acidic] [OR:Bacillus subtilis] [DB:genpept-bct1] [DE:Bacillus subtilis tRNA-Ala, phosphatidylglycerophosphate synthase(pgsA) and CinA (cinA) genes, complete cds, and RecA (recA) gene,partial cds.] [NT:PgsA] [LE:5407] [RE:5990] [DI:direct]

| ORF Name | NTID | AAID | NT Length | AA Length | score | probability |
|---|---|---|---|---|---|---|
| AI7503000983_4095286_c2_869 | 578 | 4350 | 375 | 124 | 246 | 6.4e-21 |

Description
pir:[LN:C69884] [AC:C69884 ] [PN:conserved hypothetical protein ymcA] [GN:ymcA ] [OR:Bacillus subtilis] [DB:pir2] >gp:[GI:e1185293:g2634074] [LN:BSUB0009] [AC:Z99112:AL009126] [GN:ymcA] [FN:unknown] [OR:Bacillus subtilis] [DB:genpept-bct1] [DE:Bacillus subtilis complete genome (section 9 of 21): from 1598421to 1807200.] [NT:similar to hypothetical proteins] [LE:175322] [RE:175753] [DI:direct]

| ORF Name | NTID | AAID | NT Length | AA Length | score | probability |
|---|---|---|---|---|---|---|
| AI7503000983_4334383_f2_322 | 579 | 4351 | 135 | 44 | | |

Description
NO-HIT

| ORF Name | NTID | AAID | NT Length | AA Length | score | probability |
|---|---|---|---|---|---|---|
| AI7503000983_4336536_c1_739 | 580 | 4352 | 315 | 104 | 211 | 3.3e-17 |

Description
sp:[LN:YLXR_BACSU] [AC:P32728] [GN:YLXR] [OR:BACILLUS SUBTILIS] [DE:HYPOTHETICAL 10.4 KD PROTEIN IN NUSA-INFB INTERGENIC REGION (ORF3)] [SP:P32728] [DB:swissprot] >pir:[LN:D36905] [AC:D36905:D69882:S31992 ] [PN:conserved hypothetical protein ylxR:hypothetical protein 1 (nusA 3' region)] [GN:ylxR ] [OR:Bacillus subtilis] [DB:pir2] >gp:[GI:g580900] [LN:BSORF1T7A] [AC:Z18631] [GN:ORF3] [OR:Bacillus subtilis] [DB:genpept-bct1] [DE:B.subtilis infB-nusA operon.] [SP:P32728] [LE:2090] [RE:2365] [DI:direct] >gp:[GI:e1185252:g2634033] [LN:BSUB0009] [AC:Z99112:AL009126] [GN:ylxR] [FN:unknown] [OR:Bacillus subtilis] [DB:genpept-bct1] [DE:Bacillus subtilis complete genome (section 9 of 21): from 1598421to 1807200.] [NT:alternate gene name: ymxB; similar to hypothetical] [SP:P32728] [LE:134381] [RE:134656] [DI:direct]

| ORF Name | NTID | AAID | NT Length | AA Length | score | probability |
|---|---|---|---|---|---|---|
| AI7503000983_4414675_c1_783 | 581 | 4353 | 132 | 43 | | |

Description
NO-HIT

| ORF_Name | NTID | AAID | NT Length | AA Length | score | probability |
|---|---|---|---|---|---|---|
| AI7503000983_4425068_f2_474 | 582 | 4354 | 2613 | 870 | 880 | 4.2e-88 |

Description
pir:[LN:G69801] [AC:G69801 ] [PN:hypothetical protein yfhO] [GN:yfhO ] [OR:Bacillus subtilis] [DB:pir2] >gp:[GI:e1182850:g2633184] [LN:BSUB0005] [AC:Z99108:AL009126] [GN:yfhO] [FN:unknown] [OR:Bacillus subtilis] [DB:genpept-bct1] [DE:Bacillus subtilis complete genome (section 5 of 21): from 802821 to1011250.] [LE:128691] [RE:131150] [DI:direct] >gp:[GI:d1025397:g2804545] [LN:D85082] [AC:D85082] [PN:YfhO] [OR:Bacillus subtilis] [SR:Bacillus subtilis DNA] [DB:genpept-bct1] [DE:Bacillus subtilis DNA, genome sequence, 79 to 81 degree region.] [LE:21582] [RE:24041] [DI:direct]

| ORF_Name | NTID | AAID | NT Length | AA Length | score | probability |
|---|---|---|---|---|---|---|
| AI7503000983_4460063_f1_150 | 583 | 4355 | 123 | 40 | | |

Description
NO-HIT

| ORF_Name | NTID | AAID | NT Length | AA Length | score | probability |
|---|---|---|---|---|---|---|
| AI7503000983_447326_c2_871 | 584 | 4356 | 156 | 51 | | |

Description
NO-HIT

| ORF_Name | NTID | AAID | NT Length | AA Length | score | probability |
|---|---|---|---|---|---|---|
| AI7503000983_4493778_c3_952 | 585 | 4357 | 147 | 48 | | |

Description
NO-HIT

| ORF_Name | NTID | AAID | NT Length | AA Length | score | probability |
|---|---|---|---|---|---|---|
| AI7503000983_4572162_c3_970 | 586 | 4358 | 1290 | 429 | 932 | 1.3e-93 |

Description
pir:[LN:C69881] [AC:C69881 ] [PN:conserved hypothetical protein yluC] [GN:yluC ] [OR:Bacillus subtilis] [DB:pir2] >gp:[GI:e1185247:g2634028] [LN:BSUB0009] [AC:Z99112:AL009126] [GN:yluC] [FN:unknown] [OR:Bacillus subtilis] [DB:genpept-bct1] [DE:Bacillus subtilis complete genome (section 9 of 21): from 1598421to 1807200.] [NT:similar to hypothetical proteins] [LE:125000] [RE:126268] [DI:direct]

| ORF_Name | NTID | AAID | NT Length | AA Length | score | probability |
|---|---|---|---|---|---|---|
| AI7503000983_4687825_c3_955 | 587 | 4359 | 165 | 54 | | |

Description
NO-HIT

| ORF_Name | NTID | AAID | NT Length | AA Length | score | probability |
|---|---|---|---|---|---|---|
| AI7503000983_4719011_c2_841 | 588 | 4360 | 174 | 57 | | |

Description
NO-HIT

| ORF_Name | NTID | AAID | NT Length | AA Length | score | probability |
|---|---|---|---|---|---|---|
| AI7503000983_4740932_c1_825 | 589 | 4361 | 126 | 41 | | |

Description
NO-HIT

| ORF_Name | NTID | AAID | NT Length | AA Length | score | probability |
|---|---|---|---|---|---|---|
| AI7503000983_4798453_c1_790 | 590 | 4362 | 1026 | 341 | 242 | 2.7e-27 |

Description
pir:[LN:H69873] [AC:H69873 ] [PN:conserved hypothetical protein ylbC] [GN:ylbC ]
[OR:Bacillus subtilis] [DB:pir2] >gp:[GI:e334771:g2339999] [LN:BS16823KB] [AC:Z98682]
[PN:YlbC protein] [GN:ylbC] [OR:Bacillus subtilis] [DB:genpept-bct1] [DE:Bacillus
subtilis genomic DNA 23.9kB fragment.] [LE:11510] [RE:12550] [DI:direct]
>gp:[GI:e1185086:g2633867] [LN:BSUB0008] [AC:Z99111:AL009126] [GN:ylbC] [FN:unknown]
[OR:Bacillus subtilis] [DB:genpept-bct1] [DE:Bacillus subtilis complete genome (section
8 of 21): from 1394791to 1603020.] [NT:similar to hypothetical proteins from B.
subtilis] [LE:170993] [RE:172033] [DI:direct]

| ORF_Name | NTID | AAID | NT Length | AA Length | score | probability |
|---|---|---|---|---|---|---|
| AI7503000983_4884675_c3_1057 | 591 | 4363 | 1212 | 403 | 1268 | 3.2e-129 |

Description
sp:[LN:TRPB_LACLA] [AC:Q01998] [GN:TRPB] [OR:LACTOCOCCUS LACTIS]
[SR:,SUBSPLACTIS:STREPTOCOCCUS LACTIS] [EC:4.2.1.20] [DE:TRYPTOPHAN SYNTHASE BETA
CHAIN,] [SP:Q01998] [DB:swissprot] >pir:[LN:S35129] [AC:S35129 ] [PN:tryptophan
synthase, beta chain] [GN:trpB ] [CL:tryptophan synthase beta chain:tryptophan synthase
beta chain homology] [OR:Lactococcus lactis subsp. lactis] [EC:4.2.1.20] [DB:pir2]
>gp:[GI:g149521] [LN:LACTRPOP] [AC:M87483] [PN:tryptophan synthase beta subunit]
[GN:trpB] [OR:Lactococcus lactis] [SR:Lactococcus lactis (strain IL1403, sub_species
lactis) DNA] [DB:genpept-bct1] [EC:4.2.1.20] [DE:L. lactis trpE, trpG, trpD, trpF,
trpC, trpB trpA genes, completecds.] [LE:6514] [RE:7722] [DI:direct]

| ORF_Name | NTID | AAID | NT Length | AA Length | score | probability |
|---|---|---|---|---|---|---|
| AI7503000983_4890802_f2_275 | 592 | 4364 | 1152 | 383 | 819 | 1.2e-81 |

Description
sp:[LN:TYRA_BACSU] [AC:P20692] [GN:TYRA] [OR:BACILLUS SUBTILIS] [EC:1.3.1.12]
[DE:PREPHENATE DEHYDROGENASE, (PDH)] [SP:P20692] [DB:swissprot]

| ORF_Name | NTID | AAID | NT Length | AA Length | score | probability |
|---|---|---|---|---|---|---|
| AI7503000983_4891577_c2_879 | 593 | 4365 | 582 | 193 | 453 | 7.4e-43 |

Description
pir:[LN:G69657] [AC:G69657 ] [PN:tRNA isopentenylpyrophosphate transferase miaA]
[GN:miaA ] [CL:delta(2)-isopentenylpyrophosphate transferase] [OR:Bacillus subtilis]
[DB:pir2] >gp:[GI:e1183392:g2634117] [LN:BSUB0010] [AC:Z99113:AL009126] [PN:tRNA
isopentenylpyrophosphate transferase] [GN:miaA] [OR:Bacillus subtilis]
[DB:genpept-bct1] [DE:Bacillus subtilis complete genome (section 10 of 21): from
1781201to 2014980.] [LE:84430] [RE:85374] [DI:direct]

| ORF_Name | NTID | AAID | NT Length | AA Length | score | probability |
|---|---|---|---|---|---|---|
| AI7503000983_4942202_c3_1058 | 594 | 4366 | 123 | 40 | | |

Description
NO-HIT

| ORF Name | NTID | AAID | NT Length | AA Length | score | probability |
|---|---|---|---|---|---|---|
| AI7503000983_4964686_f3_520 | 595 | 4367 | 204 | 67 | 195 | 1.6e-15 |

Description
pir:[LN:C70057] [AC:C70057 ] [PN:4-oxalocrotonate tautomerase homolog ywhB] [GN:ywhB ] [CL:4-oxalocrotonate tautomerase] [OR:Bacillus subtilis] [DB:pir2]
>gp:[GI:e267624:g1565237] [LN:BSTHRZ] [AC:Z80360] [PN:Unknown, highly similar to Pseudomonas putida] [GN:ywhB] [OR:Bacillus subtilis] [DB:genpept-bct1] [DE:B.subtilis thrZ downstream chromosomal region.] [LE:2388] [RE:2576] [DI:complement]
>gp:[GI:e1186254:g2636290] [LN:BSUB0020] [AC:Z99123:AL009126] [GN:ywhB] [FN:unknown] [OR:Bacillus subtilis] [DB:genpept-bct1] [DE:Bacillus subtilis complete genome (section 20 of 21): from 3798401to 4010550.] [NT:similar to 4-oxalocrotonate tautomerase] [LE:54138] [RE:54326] [DI:direct]

| ORF Name | NTID | AAID | NT Length | AA Length | score | probability |
|---|---|---|---|---|---|---|
| AI7503000983_5109378_f3_546 | 596 | 4368 | 615 | 204 | 469 | 1.5e-44 |

Description
pir:[LN:A69892] [AC:A69892 ] [PN:conserved hypothetical protein yneS] [GN:yneS ] [CL:Escherichia coli ygiH protein] [OR:Bacillus subtilis] [DB:pir2]
>gp:[GI:e249655:g1405459] [LN:BC170DEGR] [AC:Z73234] [PN:YneS] [GN:yneS] [OR:Bacillus subtilis] [DB:genpept-bct1] [DE:B.subtilis DNA (26.2 kb fragment; 170 degree region).] [NT:similar to hypothetical protein MG247 from] [LE:13596] [RE:14177] [DI:complement]
>gp:[GI:e1183465:g2634190] [LN:BSUB0010] [AC:Z99113:AL009126] [GN:yneS] [FN:unknown] [OR:Bacillus subtilis] [DB:genpept-bct1] [DE:Bacillus subtilis complete genome (section 10 of 21): from 1781201to 2014980.] [NT:similar to hypothetical proteins] [LE:149975] [RE:150556] [DI:complement]

| ORF Name | NTID | AAID | NT Length | AA Length | score | probability |
|---|---|---|---|---|---|---|
| AI7503000983_5109625_c3_1011 | 597 | 4369 | 372 | 123 | 258 | 3.4e-22 |

Description
pir:[LN:D70039] [AC:D70039 ] [PN:two-component response regulator [YvfT] homolog yvfU] [GN:yvfU ] [CL:regulatory protein comA:response regulator homology] [OR:Bacillus subtilis] [DB:pir2] >gp:[GI:e1186094:g2635919] [LN:BSUB0018] [AC:Z99121:AL009126] [GN:yvfU] [FN:unknown] [OR:Bacillus subtilis] [DB:genpept-bct1] [DE:Bacillus subtilis complete genome (section 18 of 21): from 3399551to 3609060.] [NT:similar to two-component response regulator [YvfT]] [LE:95389] [RE:95991] [DI:complement]
>gp:[GI:e313075:g1945721] [LN:BSZ94043] [AC:Z94043] [PN:hypothetical protein] [GN:yvfU] [OR:Bacillus subtilis] [DB:genpept-bct1] [DE:B.subtilis genomic DNA fragment (88 kb).] [NT:probable two component regulatory system:] [LE:85680] [RE:86282] [DI:direct]

| ORF Name | NTID | AAID | NT Length | AA Length | score | probability |
|---|---|---|---|---|---|---|
| AI7503000983_5120635_c2_903 | 598 | 4370 | 240 | 79 | 76 | 0.026 |

Description
sp:[LN:FS01_SCHMA] [AC:P16463] [OR:SCHISTOSOMA MANSONI] [SR:,BLOOD FLUKE] [DE:FEMALE SPECIFIC 800 PROTEIN (FS800)] [SP:P16463] [DB:swissprot] >gp:[GI:g160990] [LN:SCMFS800] [AC:J03999] [PN:female-specific 800 protein] [GN:fs800] [OR:Schistosoma mansoni] [SR:Schistosoma mansoni (strain Puerto Rican) cDNA to mRNA] [DB:genpept-inv1] [DE:Schistosoma mansoni female-specific 800 protein (fs800) mRNA,complete cds.] [NT:putative] [LE:4] [RE:720] [DI:direct]

| ORF_Name | NTID | AAID | NT Length | AA Length | score | probability |
|---|---|---|---|---|---|---|
| AI7503000983_5195328_c1_749 | 599 | 4371 | 393 | 130 | 142 | 2.3e-09 |

Description
gp:[GI:g1842438] [LN:BSU87792] [AC:U87792] [PN:unknown] [OR:Bacillus subtilis]
[DB:genpept-bct1] [DE:Bacillus subtilis tRNA-Ala, phosphatidylglycerophosphate
synthase(pgsA) and CinA (cinA) genes, complete cds, and RecA (recA) gene,partial cds.]
[NT:ORF307; hypothetical 34.7 kd protein] [LE:4436] [RE:5359] [DI:direct]

| ORF_Name | NTID | AAID | NT Length | AA Length | score | probability |
|---|---|---|---|---|---|---|
| AI7503000983_5198557_c1_734 | 600 | 4372 | 801 | 266 | 847 | 1.3e-84 |

Description
gp:[GI:d1032955:g3358087] [LN:AB004319] [AC:AB004319] [PN:undecaprenyl diphosphate
synthase] [GN:upps] [OR:Micrococcus luteus] [SR:Micrococcus luteus (strain:B-P 26) DNA]
[DB:genpept-bct1] [DE:Micrococcus luteus DNA for undecaprenyl diphosphate
synthase,complete cds.] [LE:1] [RE:750] [DI:direct]

| ORF_Name | NTID | AAID | NT Length | AA Length | score | probability |
|---|---|---|---|---|---|---|
| AI7503000983_5212776_c2_832 | 601 | 4373 | 867 | 288 | 839 | 9.2e-84 |

Description
pir:[LN:F69880] [AC:F69880 ] [PN:conserved hypothetical protein ylqF] [GN:ylqF ]
[CL:conserved hypothetical protein MG442] [OR:Bacillus subtilis] [DB:pir2]
>gp:[GI:e1185196:g2633977] [LN:BSUB0009] [AC:Z99112:AL009126] [GN:ylqF] [FN:unknown]
[OR:Bacillus subtilis] [DB:genpept-bct1] [DE:Bacillus subtilis complete genome (section
9 of 21): from 1598421to 1807200.] [NT:similar to hypothetical proteins] [LE:77511]
[RE:78359] [DI:direct]

| ORF_Name | NTID | AAID | NT Length | AA Length | score | probability |
|---|---|---|---|---|---|---|
| AI7503000983_5355012_c1_770 | 602 | 4374 | 1359 | 452 | 2274 | 7.9e-236 |

Description
sp:[LN:GLNA_STAAU] [AC:Q59812] [GN:GLNA] [OR:STAPHYLOCOCCUS AUREUS] [EC:6.3.1.2]
[DE:GLUTAMINE SYNTHETASE, (GLUTAMATE--AMMONIA LIGASE) (GS)] [SP:Q59812] [DB:swissprot]
>gp:[GI:e214721:g1134886] [LN:SAGLNAR] [AC:X76490] [PN:glutamine synthetase] [GN:glnA]
[OR:Staphylococcus aureus] [DB:genpept-bct1] [DE:S.aureus (bb270) glnA and glnR genes.]
[SP:Q59812] [LE:1362] [RE:2702] [DI:direct]

| ORF_Name | NTID | AAID | NT Length | AA Length | score | probability |
|---|---|---|---|---|---|---|
| AI7503000983_553455_f3_540 | 603 | 4375 | 153 | 50 | | |

Description
NO-HIT

| ORF Name | NTID | AAID | NT Length | AA Length | score | probability |
|---|---|---|---|---|---|---|
| AI7503000983_6258588_c1_802 | 604 | 4376 | 1470 | 489 | 1305 | 3.8e-133 |

Description sp:[LN:ALST_BACSU] [AC:Q45068] [GN:ALST] [OR:BACILLUS SUBTILIS] [DE:AMINO ACID CARRIER PROTEIN ALST] [SP:Q45068] [DB:swissprot] >pir:[LN:A69585] [AC:A69585 ] [PN:amino acid carrier protein alsT] [GN:alsT ] [CL:sodium-dependent D-alanine/glycine transport protein] [OR:Bacillus subtilis] [DB:pir2] >gp:[GI:e249660:g1405464] [LN:BC170DEGR] [AC:Z73234] [PN:AlsT] [GN:alsT] [FN:aminoacid carrier protein] [OR:Bacillus subtilis] [DB:genpept-bct1] [DE:B.subtilis DNA (26.2 kb fragment; 170 degree region).] [NT:similar to sodium/proton dependent alanine carrier] [SP:Q45068] [LE:20601] [RE:21998] [DI:direct] >gp:[GI:e1183470:g2634195] [LN:BSUB0010] [AC:Z99113:AL009126] [PN:amino acid carrier protein] [GN:alsT] [OR:Bacillus subtilis] [DB:genpept-bct1] [DE:Bacillus subtilis complete genome (section 10 of 21): from 1781201to 2014980.] [SP:Q45068] [LE:156980] [RE:158377] [DI:direct]

| ORF Name | NTID | AAID | NT Length | AA Length | score | probability |
|---|---|---|---|---|---|---|
| AI7503000983_6416566_c1_800 | 605 | 4377 | 2031 | 676 | 3180 | 0.0 |

Description sp:[LN:PARE_STAAU] [AC:P50072] [GN:PARE:GRLB] [OR:STAPHYLOCOCCUS AUREUS] [EC:5.99.1.-] [DE:TOPOISOMERASE IV SUBUNIT B,] [SP:P50072] [DB:swissprot] >pir:[LN:S54426] [AC:S54426 ] [PN:DNA topoisomerase (ATP-hydrolyzing), chain B] [CL:DNA topoisomerase (ATP-hydrolyzing) chain B] [OR:Staphylococcus aureus] [EC:5.99.1.3] [DB:pir2] >gp:[GI:d1011746:g1777320] [LN:D67075] [AC:D67075] [PN:DNA topoisomerase IV GrlB subunit] [GN:grlB] [OR:Staphylococcus aureus] [SR:Staphylococcus aureus (isolate:RN4220) DNA] [DB:genpept-bct1] [DE:Staphylococcus aureus DNA for DNA topoisomerase IV GrlB subunit,DNA topoisomerase IV GrlA subunit, complete cds.] [LE:385] [RE:2376] [DI:direct] >gp:[GI:g561879] [LN:STAGYRASL] [AC:L25288] [PN:gyrase-like protein beta subunit] [GN:grlB] [OR:Staphylococcus aureus] [SR:Staphylococcus aureus (tissue library: FDA 574) DNA] [DB:genpept-bct1] [DE:Staphylococcus aureus gyrase-like protein alpha and beta subunit(grlA and grlB) genes, complete cds.] [LE:41] [RE:2032] [DI:direct] >gp:[GI:e306312:g2302281] [LN:A48501] [AC:A48501] [OR:Staphylococcus aureus] [DB:genpept-pat] [DE:Sequence 3 from Patent WO9603516.] [NT:unnamed protein product] [LE:1] [RE:1992] [DI:direct]

| ORF Name | NTID | AAID | NT Length | AA Length | score | probability |
|---|---|---|---|---|---|---|
| AI7503000983_6525_f3_577 | 606 | 4378 | 1035 | 344 | 729 | 4.2e-72 |

Description sp:[LN:LYSP_ECOLI] [AC:P25737] [GN:LYSP:CADR] [OR:ESCHERICHIA COLI] [DE:LYSINE-SPECIFIC PERMEASE] [SP:P25737] [DB:swissprot]

| ORF_Name | NTID | AAID | NT Length | AA Length | score | probability |
|---|---|---|---|---|---|---|
| AI7503000983_6641963_c3_1009 | 607 | 4379 | 1485 | 494 | 1302 | 8.0e-133 |

Description
sp:[LN:YWNE_BACSU] [AC:P71040] [GN:YWNE] [OR:BACILLUS SUBTILIS] [DE:HYPOTHETICAL 55.8 KD PROTEIN IN SPOIIQ-MTA INTERGENIC REGION] [SP:P71040] [DB:swissprot] >pir:[LN:G70063] [AC:G70063 ] [PN:cardiolipin synthase homolog ywnE] [GN:ywnE ] [CL:Bacillus probable cardiolipin synthetase] [OR:Bacillus subtilis] [DB:pir2] >gp:[GI:e1184565:g2636184] [LN:BSUB0019] [AC:Z99122:AL009126] [GN:ywnE] [FN:unknown] [OR:Bacillus subtilis] [DB:genpept-bct1] [DE:Bacillus subtilis complete genome (section 19 of 21): from 3597091to 3809700.] [NT:similar to cardiolipin synthase] [SP:P71040] [LE:164628] [RE:166076] [DI:direct] >gp:[GI:e269549:g1592701] [LN:BSUEROP] [AC:Y08559] [PN:Unknown] [GN:ywnE] [OR:Bacillus subtilis] [DB:genpept-bct1] [DE:B.subtilis urease operon and downstream DNA.] [NT:Product similar to Escherichia coli cardiolipin] [SP:P71040] [LE:5155] [RE:6603] [DI:complement] >gp:[GI:e1184565:g2636184] [LN:BSUB0019] [AC:Z99122:AL009126] [GN:ywnE] [FN:unknown] [OR:Bacillus subtilis] [DB:genpept] [DE:Bacillus subtilis complete genome (section 19 of 21): from 3597091to 3809700.] [NT:similar to cardiolipin synthase] [SP:P71040] [LE:164628] [RE:166076] [DI:direct]

| ORF_Name | NTID | AAID | NT Length | AA Length | score | probability |
|---|---|---|---|---|---|---|
| AI7503000983_6664127_c2_940 | 608 | 4380 | 438 | 145 | | |

Description
NO-HIT

| ORF_Name | NTID | AAID | NT Length | AA Length | score | probability |
|---|---|---|---|---|---|---|
| AI7503000983_6678140_c3_972 | 609 | 4381 | 348 | 115 | 328 | 3.8e-28 |

Description
pir:[LN:S52267] [AC:S52267 ] [PN:DNA polymerase III] [CL:DNA-directed DNA polymerase III alpha chain polC] [OR:Staphylococcus aureus] [DB:pir2] >gp:[GI:g642270] [LN:SADNAPOL3] [AC:Z48003:L39156] [PN:DNA polymerase III] [OR:Staphylococcus aureus] [DB:genpept-bct1] [DE:S.aureus gene for DNA polymerase III.] [SP:Q53665] [LE:34] [RE:4281] [DI:direct]

| ORF_Name | NTID | AAID | NT Length | AA Length | score | probability |
|---|---|---|---|---|---|---|
| AI7503000983_6688126_c1_751 | 610 | 4382 | 1074 | 357 | 1661 | 7.2e-171 |

Description
sp:[LN:RECA_STAAU] [AC:Q02350] [GN:RECA] [OR:STAPHYLOCOCCUS AUREUS] [DE:RECA PROTEIN] [SP:Q02350] [DB:swissprot] >gp:[GI:g463285] [LN:STARECAA] [AC:L25893] [GN:recA] [FN:genetic recombination] [OR:Staphylococcus aureus] [SR:Staphylococcus aureus DNA] [DB:genpept-bct1] [DE:Staphylococcus aureus recA gene, complete cds.] [NT:putative] [LE:16] [RE:1059] [DI:direct]

| ORF_Name | NTID | AAID | NT Length | AA Length | score | probability |
|---|---|---|---|---|---|---|
| AI7503000983_673437_f3_529 | 611 | 4383 | 147 | 48 | | |

Description
NO-HIT

| ORF Name | NTID | AAID | NT Length | AA Length | score | probability |
|---|---|---|---|---|---|---|
| AI7503000983_6818827_c3_1072 | 612 | 4384 | 1608 | 535 | 2088 | 4.1e-216 |

Description
pir:[LN:E69861] [AC:E69861 ] [PN:ABC transporter (ATP-binding protein) homolog ykpA]
[GN:ykpA ] [CL:ATP-binding cassette homology] [OR:Bacillus subtilis] [DB:pir2]
>gp:[GI:e1185033:g2633814] [LN:BSUB0008] [AC:Z99111:AL009126] [GN:ykpA] [FN:unknown]
[OR:Bacillus subtilis] [DB:genpept-bct1] [DE:Bacillus subtilis complete genome (section
8 of 21): from 1394791to 1603020.] [NT:similar to ABC transporter (ATP-binding
protein)] [LE:116988] [RE:118610] [DI:direct] >gp:[GI:g3282128] [LN:AF012285]
[AC:AF012285:AF012284:U51911] [PN:YkpA] [GN:ykpA] [OR:Bacillus subtilis]
[DB:genpept-bct2] [DE:Bacillus subtilis mobA-nprE gene region.] [NT:similar to E. coli
hypothetical ABC transporter] [LE:17476] [RE:19098] [DI:direct]

| ORF Name | NTID | AAID | NT Length | AA Length | score | probability |
|---|---|---|---|---|---|---|
| AI7503000983_6837812_c1_735 | 613 | 4385 | 786 | 261 | 611 | 1.3e-59 |

Description
sp:[LN:CDSA_BACSU] [AC:O31752] [GN:CDSA] [OR:BACILLUS SUBTILIS] [EC:2.7.7.41]
[DE:SYNTHASE)] [SP:O31752] [DB:swissprot] >pir:[LN:G69597] [AC:G69597 ]
[PN:phosphatidate cytidylyltransferase cdsA] [GN:cdsA ] [OR:Bacillus subtilis]
[DB:pir2] >gp:[GI:e1185245:g2634026] [LN:BSUB0009] [AC:Z99112:AL009126]
[PN:phosphatidate cytidylyltransferase] [GN:cdsA] [FN:phospholipid biosynthesis]
[OR:Bacillus subtilis] [DB:genpept-bct1] [EC:2.7.7.41] [DE:Bacillus subtilis complete
genome (section 9 of 21): from 1598421to 1807200.] [SP:O31752] [LE:122972] [RE:123781]
[DI:direct]

| ORF Name | NTID | AAID | NT Length | AA Length | score | probability |
|---|---|---|---|---|---|---|
| AI7503000983_6929652_c1_822 | 614 | 4386 | 744 | 247 | 683 | 3.1e-67 |

Description
pir:[LN:F69866] [AC:F69866 ] [PN:tetrahydrodipicolinate succinylase homolog ykuQ]
[GN:ykuQ ] [OR:Bacillus subtilis] [DB:pir2] >gp:[GI:e1181922:g2632238] [LN:BS16829KB]
[AC:AJ222587] [PN:YkuQ protein] [GN:ykuQ] [OR:Bacillus subtilis] [DB:genpept-bct1]
[DE:Bacillus subtilis 29kB DNA fragment from ykwC gene to cse15 gene.] [NT:homologous
to acetyltransferases] [LE:23332] [RE:24042] [DI:direct] >gp:[GI:e1185008:g2633789]
[LN:BSUB0008] [AC:Z99111:AL009126] [GN:ykuQ] [FN:unknown] [OR:Bacillus subtilis]
[DB:genpept-bct1] [DE:Bacillus subtilis complete genome (section 8 of 21): from
1394791to 1603020.] [NT:similar to tetrahydrodipicolinate succinylase] [LE:93588]
[RE:94298] [DI:direct]

| ORF Name | NTID | AAID | NT Length | AA Length | score | probability |
|---|---|---|---|---|---|---|
| AI7503000983_6929677_c1_766 | 615 | 4387 | 258 | 85 | 187 | 1.1e-14 |

Description
pir:[LN:B69884] [AC:B69884 ] [PN:host factor-1 protein homolog ymaH] [GN:ymaH ]
[CL:host factor I] [OR:Bacillus subtilis] [DB:pir2] >gp:[GI:e1183393:g2634118]
[LN:BSUB0010] [AC:Z99113:AL009126] [GN:ymaH] [FN:unknown] [OR:Bacillus subtilis]
[DB:genpept-bct1] [DE:Bacillus subtilis complete genome (section 10 of 21): from
1781201to 2014980.] [NT:similar to host factor-1 protein] [LE:85414] [RE:85635]
[DI:direct]

| ORF Name | NTID | AAID | NT Length | AA Length | score | probability |
|---|---|---|---|---|---|---|
| AI7503000983_6933390_c1_759 | 616 | 4388 | 552 | 183 | 402 | 1.9e-37 |

Description sp:[LN:GLPP_BACSU] [AC:P30300] [GN:GLPP] [OR:BACILLUS SUBTILIS] [DE:GLYCEROL UPTAKE OPERON ANTITERMINATOR REGULATORY PROTEIN] [SP:P30300] [DB:swissprot] >pir:[LN:B47700] [AC:B47700:D69634 ] [PN:glycerol metabolism regulatory protein GlpP] [GN:glpP ] [OR:Bacillus subtilis] [DB:pir2] [MP:75 (degrees) ] >gp:[GI:g142996] [LN:BACGLPPFK] [AC:M99611] [PN:regulatory protein] [GN:glpP] [FN:putative antiterminator] [OR:Bacillus subtilis] [SR:Bacillus subtilis DNA] [DB:genpept-bct1] [DE:Bacillus subtilis antiterminator regulatory protein (glpP),glycerol uptake facilitator (glpF) genes, complete cds, glycerolkinase (glpK) gene, 5' end.] [LE:328] [RE:906] [DI:direct] >gp:[GI:e1182916:g2633250] [LN:BSUB0005] [AC:Z99108:AL009126] [PN:transcription antiterminator] [GN:glpP] [FN:control of mRNA stability of glpD] [OR:Bacillus subtilis] [DB:genpept-bct1] [DE:Bacillus subtilis complete genome (section 5 of 21): from 802821 to1011250.] [SP:P30300] [LE:198429] [RE:199007] [DI:direct] >gp:[GI:e1182928:g2633262] [LN:BSUB0006] [AC:Z99109:AL009126] [PN:transcription antiterminator] [GN:glpP] [FN:control of mRNA stability of glpD] [OR:Bacillus subtilis] [DB:genpept-bct1] [DE:Bacillus subtilis complete genome (section 6 of 21): from 999501 to1209940.] [SP:P30300] [LE:1749] [RE:2327] [DI:direct] >gp:[GI:e324939:g2226135] [LN:BSY14079] [AC:Y14079] [PN:regulatory protein] [GN:glpP] [FN:putative antiterminator] [OR:Bacillus subtilis] [DB:genpept-bct1] [DE:Bacillus subtilis chromosomal DNA, region 75 degrees: glpPFKDoperon and downstream.] [NT:see EMBL M99611 and Swiss Prot P30300.] [SP:P30300] [LE:1397] [RE:1975] [DI:direct]

| ORF Name | NTID | AAID | NT Length | AA Length | score | probability |
|---|---|---|---|---|---|---|
| AI7503000983_7064077_c1_740 | 617 | 4389 | 2187 | 728 | 2508 | 1.3e-260 |

Description sp:[LN:IF2_BACSU] [AC:P17889:O31757] [GN:INFB] [OR:BACILLUS SUBTILIS] [DE:TRANSLATION INITIATION FACTOR IF-2] [SP:P17889:O31757] [DB:swissprot] >pir:[LN:A35269] [AC:A35269:B35269:S31994:G69644 ] [PN:translation initiation factor IF-2] [GN:infB ] [CL:translation initiation factor IF-2:translation elongation factor Tu homology] [OR:Bacillus subtilis] [DB:pir1] >gp:[GI:g143359] [LN:BACPSIF2A] [AC:M34836] [OR:Bacillus subtilis] [SR:B.subtilis (strain RS410) DNA, clones lambda-JET[1,2],pUK, an] [DB:genpept-bct1] [DE:B.subtilis protein synthesis initiation factor 2 (infB) gene,complete cds.] [NT:protein synthesis initiation factor 2 (infB)] [LE:381] [RE:2531] [DI:direct] >gp:[GI:g49319] [LN:BSORF1T7A] [AC:Z18631] [GN:IF2] [OR:Bacillus subtilis] [DB:genpept-bct1] [DE:B.subtilis infB-nusA operon.] [SP:P17889] [LE:2689] [RE:4839] [DI:direct]

| ORF Name | NTID | AAID | NT Length | AA Length | score | probability |
|---|---|---|---|---|---|---|
| AI7503000983_7203176_c1_810 | 618 | 4390 | 801 | 266 | 426 | 5.4e-40 |

Description sp:[LN:TRPA_METJA] [AC:Q60180] [GN:TRPA:MJ1038] [OR:METHANOCOCCUS JANNASCHII] [EC:4.2.1.20] [DE:TRYPTOPHAN SYNTHASE ALPHA CHAIN,] [SP:Q60180] [DB:swissprot] >pir:[LN:E64429] [AC:E64429 ] [PN:tryptophan synthase, alpha chain] [CL:tryptophan synthase alpha chain:tryptophan synthase alpha chain homology] [OR:Methanococcus jannaschii] [EC:4.2.1.20] [DB:pir2] [MP:FOR969735-970589 ] >gp:[GI:g1591691] [LN:U67546] [AC:U67546:L77117] [PN:tryptophan synthase alpha subunit (trpA)] [GN:MJ1038] [OR:Methanococcus jannaschii] [DB:genpept-bct2] [DE:Methanococcus jannaschii section 88 of 150 of the complete genome.] [NT:similar to GB:M65060 SP:P26920 PID:149750] [LE:5837] [RE:6691] [DI:direct]

| ORF Name | NTID | AAID | NT Length | AA Length | score | probability |
|---|---|---|---|---|---|---|
| AI7503000983_7242250_c2_924 | 619 | 4391 | 681 | 226 | 306 | 2.8e-27 |

Description
gp:[GI:g5002553] [LN:AF074603] [AC:AF074603] [PN:NonF] [GN:nonF] [OR:Streptomyces griseus subsp. griseus] [DB:genpept-bct2] [DE:Streptomyces griseus subsp. griseus nonactin biosynthesis genecluster, partial sequence.] [LE:12384] [RE:13088] [DI:direct]

| ORF Name | NTID | AAID | NT Length | AA Length | score | probability |
|---|---|---|---|---|---|---|
| AI7503000983_801552_f2_228 | 620 | 4392 | 381 | 126 | 74 | 0.011 |

Description
gp:[GI:g2454643] [LN:AF020905] [AC:AF020905] [PN:E5] [GN:E5] [OR:common chimpanzee papillomavirus 1] [DB:genpept-vrl] [DE:Common chimpanzee papillomavirus 1, complete genome.] [LE:3901] [RE:4185] [DI:direct]

| ORF Name | NTID | AAID | NT Length | AA Length | score | probability |
|---|---|---|---|---|---|---|
| AI7503000983_835252_f1_13 | 621 | 4393 | 156 | 51 | | |

Description
NO-HIT

| ORF Name | NTID | AAID | NT Length | AA Length | score | probability |
|---|---|---|---|---|---|---|
| AI7503000983_837550_c2_914 | 622 | 4394 | 246 | 81 | | |

Description
NO-HIT

| ORF Name | NTID | AAID | NT Length | AA Length | score | probability |
|---|---|---|---|---|---|---|
| AI7503000983_869052_c2_876 | 623 | 4395 | 1677 | 558 | 1700 | 5.3e-175 |

Description
sp:[LN:GLPD_BACSU] [AC:P18158] [GN:GLPD] [OR:BACILLUS SUBTILIS] [EC:1.1.99.5] [DE:AEROBIC GLYCEROL-3-PHOSPHATE DEHYDROGENASE,] [SP:P18158] [DB:swissprot] >pir:[LN:C45868] [AC:C45868;A69634;S18565 ] [PN:glycerol-3-phosphate dehydrogenase, glpD] [GN:glpD ] [OR:Bacillus subtilis] [EC:1.1.99.5] [DB:pir2] >gp:[GI:g142993] [LN:BACGLPKD] [AC:M34393] [OR:Bacillus subtilis] [SR:B.subtilis (strain W168) DNA] [DB:genpept-bct1] [DE:B.subtilis glycerol kinase (glpK) and glycerol-3-phosphatedehydrogenase (glpD) genes, complete cds.] [NT:glycerol-3-phosphate dehydrogenase (glpD) (EC] [LE:2329] [RE:3996] [DI:direct] >gp:[GI:e1182919:g2633253] [LN:BSUB0005] [AC:Z99108:AL009126] [PN:glycerol-3-phosphate dehydrogenase] [GN:glpD] [FN:glycerol utilization] [OR:Bacillus subtilis] [DB:genpept-bct1] [EC:1.1.99.5] [DE:Bacillus subtilis complete genome (section 5 of 21): from 802821 to1011250.] [SP:P18158] [LE:201660] [RE:203327] [DI:direct] >gp:[GI:e1182931:g2633265] [LN:BSUB0006] [AC:Z99109:AL009126] [PN:glycerol-3-phosphate dehydrogenase] [GN:glpD] [FN:glycerol utilization] [OR:Bacillus subtilis] [DB:genpept-bct1] [EC:1.1.99.5] [DE:Bacillus subtilis complete genome (section 6 of 21): from 999501 to1209940.] [SP:P18158] [LE:4980] [RE:6647] [DI:direct] >gp:[GI:e324942:g2226138] [LN:BSY14079] [AC:Y14079] [PN:glycerol-3-phosphate dehydrogenase] [GN:glpD] [OR:Bacillus subtilis] [DB:genpept-bct1] [DE:Bacillus subtilis chromosomal DNA, region 75 degrees: glpPFKDoperon and downstream.] [NT:see EMBL M34393 and Swiss Prot P18158.] [SP:P18158] [LE:4628] [RE:6295] [DI:direct]

| ORF Name | NTID | AAID | NT Length | AA Length | score | probability |
|---|---|---|---|---|---|---|
| AI7503000983_891700_c2_865 | 624 | 4396 | 867 | 288 | 599 | 2.5e-58 |

Description
pir:[LN:S22397] [AC:S22397 ] [PN:pyruvate synthase, beta chain] [CL:pyruvate synthase beta chain] [OR:Halobacterium halobium] [EC:1.2.7.1] [DB:pir2] >gp:[GI:g43499] [LN:HHFEROXI] [AC:X64521] [PN:ferredoxin oxidoreductase] [OR:Halobacterium halobium] [DB:genpept-bct1] [EC:1.2.7.1] [DE:H.halobium gene for pyruvate:ferredoxin oxidoreductase.] [NT:beta-subunit; pyruvate synthase] [LE:2057] [RE:2995] [DI:direct]

| ORF Name | NTID | AAID | NT Length | AA Length | score | probability |
|---|---|---|---|---|---|---|
| AI7503000983_892186_f1_171 | 625 | 4397 | 129 | 42 | | |

Description
NO-HIT

| ORF Name | NTID | AAID | NT Length | AA Length | score | probability |
|---|---|---|---|---|---|---|
| AI7503000983_893826_f2_384 | 626 | 4398 | 123 | 40 | 49 | 0.031 |

Description
pir:[LN:D64600] [AC:D64600 ] [PN:conserved hypothetical integral membrane protein HP0644] [OR:Helicobacter pylori] [DB:pir2] >gp:[GI:g2313764] [LN:AE000578] [AC:AE000578:AE000511] [PN:conserved hypothetical integral membrane] [GN:HP0644] [OR:Helicobacter pylori 26695] [DB:genpept-bct2] [DE:Helicobacter pylori 26695 section 56 of 134 of the complete genome.] [NT:similar to SP:P25254 percent identity: 30.26;] [LE:6414] [RE:6707] [DI:direct]

| ORF Name | NTID | AAID | NT Length | AA Length | score | probability |
|---|---|---|---|---|---|---|
| AI7503000983_9767263_c2_866 | 627 | 4399 | 639 | 212 | 280 | 1.6e-24 |

Description
pir:[LN:A69922] [AC:A69922 ] [PN:phage-related replication protein homolog yoqZ] [GN:yoqZ ] [CL:phage-related replication protein] [OR:Bacillus subtilis] [DB:pir2] >gp:[GI:e1185518:g2634439] [LN:BSUB0011] [AC:Z99114:AL009126] [GN:yoqZ] [FN:unknown] [OR:Bacillus subtilis] [DB:genpept-bct1] [DE:Bacillus subtilis complete genome (section 11 of 21): from 2000171to 2207900.] [NT:similar to phage-related protein] [LE:189032] [RE:189856] [DI:complement] >gp:[GI:g3025599] [LN:AF020713] [AC:AF020713] [GN:yoqZ] [OR:Bacteriophage SPBc2] [DB:genpept-phg] [DE:Bacteriophage SPBc2 complete genome.] [NT:similar to bacteriophage SPP1 ORF37.1 product] [LE:95664] [RE:96488] [DI:direct]

| ORF Name | NTID | AAID | NT Length | AA Length | score | probability |
|---|---|---|---|---|---|---|
| AI7503000983_978450_c1_804 | 628 | 4400 | 2049 | 682 | 965 | 4.1e-97 |

Description
gp:[GI:d1025380:g2804528] [LN:D85082] [AC:D85082] [PN:YfiX] [OR:Bacillus subtilis] [SR:Bacillus subtilis DNA] [DB:genpept-bct1] [DE:Bacillus subtilis DNA, genome sequence, 79 to 81 degree region.] [LE:7094] [RE:8926] [DI:direct]

| ORF Name | NTID | AAID | NT Length | AA Length | score | probability |
|---|---|---|---|---|---|---|
| AI7503000983_9798180_c1_792 | 629 | 4401 | 204 | 67 | | |

Description
NO-HIT

| ORF Name | NTID | AAID | NT Length | AA Length | score | probability |
|---|---|---|---|---|---|---|
| AI7503000983_9804202_c1_732 | 630 | 4402 | 627 | 208 | 704 | 1.9e-69 |

Description
pir:[LN:B69727] [AC:B69727 ] [PN:translation elongation factor EF-Ts tsf] [GN:tsf ]
[CL:translation elongation factor EF-Ts] [OR:Bacillus subtilis] [DB:pir2]
>gp:[GI:e1185241:g2634022] [LN:BSUB0009] [AC:Z99112:AL009126] [PN:elongation factor Ts]
[GN:tsf] [OR:Bacillus subtilis] [DB:genpept-bct1] [DE:Bacillus subtilis complete genome
(section 9 of 21): from 1598421to 1807200.] [SP:P80700] [LE:119747] [RE:120628]
[DI:direct]

| ORF Name | NTID | AAID | NT Length | AA Length | score | probability |
|---|---|---|---|---|---|---|
| AI7503000983_9807807_c1_748 | 631 | 4403 | 873 | 290 | 522 | 3.6e-50 |

Description
gp:[GI:g1842437] [LN:BSU87792] [AC:U87792] [PN:unknown] [OR:Bacillus subtilis]
[DB:genpept-bct1] [DE:Bacillus subtilis tRNA-Ala, phosphatidylglycerophosphate
synthase(pgsA) and CinA (cinA) genes, complete cds, and RecA (recA) gene,partial cds.]
[NT:hypothetical 17.9 kDa protein; ORF158] [LE:3676] [RE:4152] [DI:direct]

| ORF Name | NTID | AAID | NT Length | AA Length | score | probability |
|---|---|---|---|---|---|---|
| AI7503000983_9814213_f3_499 | 632 | 4404 | 471 | 156 | 232 | 1.9e-19 |

Description
pir:[LN:C69419] [AC:C69419 ] [PN:phosphate ABC transporter, periplasmic
phosphate-binding protein (phoX) homolog] [CL:sphX protein] [OR:Archaeoglobus fulgidus]
[DB:pir2] >gp:[GI:g2649219] [LN:AE001010] [AC:AE001010:AE000782] [PN:phosphate ABC
transporter, periplasmic] [GN:AF1356] [OR:Archaeoglobus fulgidus] [DB:genpept-bct2]
[DE:Archaeoglobus fulgidus section 97 of 172 of the complete genome.] [NT:similar to
PID:1052826 percent identity: 25.09;] [LE:4300] [RE:5283] [DI:direct]

| ORF Name | NTID | AAID | NT Length | AA Length | score | probability |
|---|---|---|---|---|---|---|
| AI7503000983_9862675_f2_310 | 633 | 4405 | 135 | 44 | | |

Description
NO-HIT

| ORF Name | NTID | AAID | NT Length | AA Length | score | probability |
|---|---|---|---|---|---|---|
| AI7503000983_995967_c2_888 | 634 | 4406 | 747 | 248 | 341 | 5.4e-31 |

Description
pir:[LN:B70039] [AC:B70039 ] [PN:hypothetical protein yvfS] [GN:yvfS ] [OR:Bacillus
subtilis] [DB:pir2] >gp:[GI:e1186096:g2635921] [LN:BSUB0018] [AC:Z99121:AL009126]
[GN:yvfS] [FN:unknown] [OR:Bacillus subtilis] [DB:genpept-bct1] [DE:Bacillus subtilis
complete genome (section 18 of 21): from 3399551to 3609060.] [LE:97127] [RE:97864]
[DI:complement] >gp:[GI:e313010:g1945719] [LN:BSZ94043] [AC:Z94043] [PN:hypothetical
protein] [GN:yvfS] [OR:Bacillus subtilis] [DB:genpept-bct1] [DE:B.subtilis genomic DNA
fragment (88 kb).] [NT:probable permease] [LE:83807] [RE:84544] [DI:direct]

| ORF Name | NTID | AAID | NT Length | AA Length | score | probability |
|---|---|---|---|---|---|---|
| AI7503000984_10017151_f3_388 | 635 | 4407 | 132 | 43 | | |

Description
NO-HIT

| ORF Name | NTID | AAID | NT Length | AA Length | score | probability |
|---|---|---|---|---|---|---|
| AI7503000984_10039050_f1_17 | 636 | 4408 | 165 | 54 | | |

Description
NO-HIT

| ORF Name | NTID | AAID | NT Length | AA Length | score | probability |
|---|---|---|---|---|---|---|
| AI7503000984_10193760_f1_89 | 637 | 4409 | 165 | 54 | | |

Description
NO-HIT

| ORF Name | NTID | AAID | NT Length | AA Length | score | probability |
|---|---|---|---|---|---|---|
| AI7503000984_10553125_f3_371 | 638 | 4410 | 810 | 269 | 335 | 1.6e-31 |

Description
gp:[GI:g211700] [LN:CHKCX] [AC:M13496] [PN:type X collagen] [OR:Gallus gallus]
[SR:Chicken red blood cell DNA, clone pYN92E1; and embryo chondrocyte] [DB:genpept-vrt]
[DE:Chicken type X collagen gene.] [LE:<380] [RE:2208] [DI:direct]

| ORF Name | NTID | AAID | NT Length | AA Length | score | probability |
|---|---|---|---|---|---|---|
| AI7503000984_10665903_c1_491 | 639 | 4411 | 378 | 125 | 151 | 6.0e-10 |

Description
sp:[LN:YCGC_ECOLI] [AC:P37349:P76013] [GN:YCGC] [OR:ESCHERICHIA COLI] [DE:HYPOTHETICAL
51.6 KD PROTEIN IN TREA-PTH INTERGENIC REGION] [SP:P37349:P76013] [DB:swissprot]
>pir:[LN:C64866] [AC:C64866 ] [PN:trehalase precursor] [GN:ycgC ]
[CL:phosphotransferase system phosphohistidine-containing protein homology]
[OR:Escherichia coli] [DB:pir2] >gp:[GI:d1037041:g4062781] [LN:D90754]
[AC:D90754:AB001340] [PN:Hypothetical protein in treA 5'region .] [GN:ycgC]
[OR:Escherichia coli] [SR:Escherichia coli(strain:K12) DNA, clone:Kohara clone #245]
[DB:genpept-bct1] [DE:Escherichia coli genomic DNA. (26.8 - 27.1 min).]
[NT:ORF_ID:o245#7; similar to SwissProt Accession] [LE:9793] [RE:11214] [DI:complement]
>gp:[GI:g1787448] [LN:AE000218] [AC:AE000218:U00096] [PN:putative PTS system enzyme I]
[GN:ycgC] [FN:putative transport; Not classified] [OR:Escherichia coli]
[DB:genpept-bct2] [DE:Escherichia coli K-12 MG1655 section 108 of 400 of the
completegenome.] [NT:f473; 100 pct identical to fragment YCGC_ECOLI] [LE:3099]
[RE:4520] [DI:complement]

| ORF Name | NTID | AAID | NT Length | AA Length | score | probability |
|---|---|---|---|---|---|---|
| AI7503000984_10828312_f1_104 | 640 | 4412 | 1617 | 538 | 272 | 1.2e-20 |

Description
pir:[LN:D69796] [AC:D69796 ] [PN:two-component sensor histidine kinase homolog yesM]
[GN:yesM ] [OR:Bacillus subtilis] [DB:pir2] >gp:[GI:e1182674:g2633008] [LN:BSUB0004]
[AC:Z99107:AL009126] [GN:yesM] [FN:unknown] [OR:Bacillus subtilis] [DB:genpept-bct1]
[DE:Bacillus subtilis complete genome (section 4 of 21): from 600701 to813890.]
[NT:similar to two-component sensor histidine kinase] [LE:157527] [RE:159260]
[DI:direct]

| ORF Name | NTID | AAID | NT Length | AA Length | score | probability |
|---|---|---|---|---|---|---|
| AI7503000984_1182765_c3_673 | 641 | 4413 | 7215 | 2404 | 2909 | 0.0 |

Description
gp:[GI:g2982196] [LN:AF007865] [AC:AF007865] [PN:bacitracin synthetase 3] [GN:bacC]
[OR:Bacillus licheniformis] [DB:genpept-bct2] [DE:Bacillus licheniformis bacitracin
synthetase operon, completesequence; BacS (bacS), BcrA (bcrA), BcrB (bcrB), and BcrC
(bcrC)genes, complete cds.] [NT:peptide synthetase; BA3; BacC] [LE:25258] [RE:44337]
[DI:direct]

| ORF Name | NTID | AAID | NT Length | AA Length | score | probability |
|---|---|---|---|---|---|---|
| AI7503000984_11832518_c2_558 | 642 | 4414 | 144 | 47 | | |

Description
NO-HIT

| ORF Name | NTID | AAID | NT Length | AA Length | score | probability |
|---|---|---|---|---|---|---|
| AI7503000984_11895058_c1_444 | 643 | 4415 | 939 | 312 | 164 | 5.1e-10 |

Description
pir:[LN:S25140] [AC:S25140 ] [PN:serine proteinase homolog] [OR:Enterococcus faecalis]
[DB:pir2] >gp:[GI:g43338] [LN:EFSPREG] [AC:Z12296] [PN:Staphylococcal serine proteinase
homologue] [GN:sprE] [OR:Enterococcus faecalis] [DB:genpept-bct1] [DE:E.faecalis sprE
gene for serine proteinase homologue.] [LE:91] [RE:945] [DI:direct]

| ORF Name | NTID | AAID | NT Length | AA Length | score | probability |
|---|---|---|---|---|---|---|
| AI7503000984_12554627_c3_625 | 644 | 4416 | 216 | 71 | | |

Description
NO-HIT

| ORF Name | NTID | AAID | NT Length | AA Length | score | probability |
|---|---|---|---|---|---|---|
| AI7503000984_1367200_f2_264 | 645 | 4417 | 624 | 207 | 104 | 0.00095 |

Description
sp:[LN:VS10_ROTBS] [AC:P34718] [GN:S10] [OR:BOVINE ROTAVIRUS] [SR:GROUP C / SHINTOKU,]
[DE:MINOR OUTER CAPSID PROTEIN (NS26)] [SP:P34718] [DB:swissprot]

| ORF Name | NTID | AAID | NT Length | AA Length | score | probability |
|---|---|---|---|---|---|---|
| AI7503000984_1367202_c1_489 | 646 | 4418 | 963 | 320 | 516 | 1.1e-60 |

Description
pir:[LN:E64866] [AC:E64866 ] [PN:hypothetical protein b1200] [OR:Escherichia coli]
[DB:pir2] >gp:[GI:d1037043:g4062783] [LN:D90754] [AC:D90754:AB001340] [PN:Hypothetical
protein] [OR:Escherichia coli] [SR:Escherichia coli(strain:K12) DNA, clone:Kohara clone
245] [DB:genpept-bct1] [DE:Escherichia coli genomic DNA. (26.8 - 27.1 min).]
[NT:ORF_ID:o246#2; similar to PIR Accession Number] [LE:11865] [RE:12965]
[DI:complement] >gp:[GI:g1787450] [LN:AE000218] [AC:AE000218:U00096] [PN:putative
dihydroxyacetone kinase (EC 2.7.1.2)] [GN:b1200] [FN:putative enzyme; Not classified]
[OR:Escherichia coli] [DB:genpept-bct2] [DE:Escherichia coli K-12 MG1655 section 108 of
400 of the completegenome.] [NT:f366; 35 pct identical (32 gaps) to 355 residues]
[LE:5171] [RE:6271] [DI:complement]

| ORF Name | NTID | AAID | NT Length | AA Length | score | probability |
|---|---|---|---|---|---|---|
| AI7503000984_1367340_c1_424 | 647 | 4419 | 843 | 280 | 250 | 9.9e-31 |

Description
gp:[GI:e187587:g1420862] [LN:SPOPPDACA] [AC:X89237] [PN:oligopeptidepermease] [GN:oppD] [OR:Streptococcus pyogenes] [DB:genpept-bct1] [DE:S.pyogenes DNA for oppA, oppB, oppC, oppD, oppF, and dacA genes.] [LE:5854] [RE:6924] [DI:direct]

| ORF Name | NTID | AAID | NT Length | AA Length | score | probability |
|---|---|---|---|---|---|---|
| AI7503000984_13707008_f3_321 | 648 | 4420 | 231 | 76 | | |

Description
NO-HIT

| ORF Name | NTID | AAID | NT Length | AA Length | score | probability |
|---|---|---|---|---|---|---|
| AI7503000984_1385962_c3_666 | 649 | 4421 | 984 | 327 | 1016 | 1.6e-102 |

Description
sp:[LN:BIOB_BACSU] [AC:P53557] [GN:BIOB] [OR:BACILLUS SUBTILIS] [EC:2.8.1.6] [DE:BIOTIN SYNTHASE, (BIOTIN SYNTHETASE)] [SP:P53557] [DB:swissprot] >pir:[LN:D69594] [AC:D69594 ] [PN:biotin synthetase bioB] [GN:bioB ] [CL:biotin synthetase] [OR:Bacillus subtilis] [DB:pir2] >gp:[GI:g1277029] [LN:BSU51868] [AC:U51868] [PN:biotin synthase] [GN:bioB] [FN:biotin pathway] [OR:Bacillus subtilis] [DB:genpept-bct1] [DE:Bacillus subtilis biotin biosynthetic operon genes, complete andpartial cds.] [LE:6088] [RE:7095] [DI:direct] >gp:[GI:e1185893:g2635504] [LN:BSUB0016] [AC:Z99119:AL009126] [PN:biotin synthetase] [GN:bioB] [FN:biotin biosynthesis] [OR:Bacillus subtilis] [DB:genpept-bct1] [EC:2.8.1.-] [DE:Bacillus subtilis complete genome (section 16 of 21): from 2997771to 3213410.] [SP:P53557] [LE:91793] [RE:92800] [DI:complement] >gp:[GI:g2293187] [LN:AF008220] [AC:AF008220] [PN:biotin synthase] [GN:bioB] [OR:Bacillus subtilis] [DB:genpept-bct2] [DE:Bacillus subtilis rrnB-dnaB genomic region.] [LE:87627] [RE:88634] [DI:direct]

| ORF Name | NTID | AAID | NT Length | AA Length | score | probability |
|---|---|---|---|---|---|---|
| AI7503000984_14492327_c1_486 | 650 | 4422 | 429 | 142 | 495 | 2.6e-47 |

Description
sp:[LN:FOSB_STAEP] [AC:Q03377] [GN:FOSB] [OR:STAPHYLOCOCCUS EPIDERMIDIS] [DE:FOSFOMYCIN RESISTANCE PROTEIN] [SP:Q03377] [DB:swissprot] >pir:[LN:B48175] [AC:B48175 ] [PN:fosfomycin resistance protein B] [CL:fosfomycin resistance protein] [OR:Staphylococcus epidermidis] [DB:pir2] >gp:[GI:g46982] [LN:SEFOSB] [AC:X54227] [GN:fosB] [OR:Staphylococcus epidermidis] [DB:genpept-bct1] [DE:S.epidermidis plasmid pIP1842 fosB gene for FOSB.] [SP:Q03377] [LE:714] [RE:1133] [DI:direct]

| ORF Name | NTID | AAID | NT Length | AA Length | score | probability |
|---|---|---|---|---|---|---|
| AI7503000984_14510962_c1_446 | 651 | 4423 | 138 | 45 | | |

Description
NO-HIT

| ORF Name | NTID | AAID | NT Length | AA Length | score | probability |
|---|---|---|---|---|---|---|
| AI7503000984_14895212_c3_639 | 652 | 4424 | 822 | 273 | 980 | 1.1e-98 |

Description gp:[GI:g3800821] [LN:AF076683] [AC:AF076683] [PN:oligopeptide transporter putative ATPase domain] [GN:opp-1D] [OR:Staphylococcus aureus] [DB:genpept-bct2] [DE:Staphylococcus aureus oligopeptide transporter putative substratebinding domain (opp-1A), oligopeptide transporter putative membranepermease domain (opp-1B), oligopeptide transporter putativemembrane permease domain (opp-1C), oligopeptide transporterputative ATPase domain (opp-1D), and oligopeptide transporterputative ATPase domain (opp-1F) genes, complete cds; and unknowngene.] [LE:3335] [RE:4150] [DI:direct]

| ORF Name | NTID | AAID | NT Length | AA Length | score | probability |
|---|---|---|---|---|---|---|
| AI7503000984_157625_c1_428 | 653 | 4425 | 930 | 309 | 111 | 0.00054 |

Description gp:[GI:e1407888:g4493994] [LN:PFMAL3P7] [AC:AL034559] [GN:MAL3P7.44] [OR:Plasmodium falciparum] [SR:malaria parasite P. falciparum] [DB:genpept-inv1] [DE:Plasmodium falciparum MAL3P7, complete sequence.] [NT:predicted using hexExon; MAL3P7.44 (PFC1065w),] [LE:188885] [RE:191470] [DI:direct]

| ORF Name | NTID | AAID | NT Length | AA Length | score | probability |
|---|---|---|---|---|---|---|
| AI7503000984_162550_c3_650 | 654 | 4426 | 198 | 65 | 49 | 0.035 |

Description sp:[LN:YPMB_BACSU] [AC:P54396] [GN:YPMB] [OR:BACILLUS SUBTILIS] [DE:HYPOTHETICAL 17.9 KD PROTEIN IN DING-ASPB INTERGENIC REGION] [SP:P54396] [DB:swissprot] >pir:[LN:F69938] [AC:F69938 ] [PN:hypothetical protein ypmB] [GN:ypmB ] [OR:Bacillus subtilis] [DB:pir2] >gp:[GI:g1146245] [LN:BACYPIA] [AC:L47709] [GN:ypmB] [FN:hypothetical] [OR:Bacillus subtilis] [DB:genpept-bct1] [DE:Bacillus subtilis (clone YAC15-6B) ypiABF genes, qcrABC genes,ypjABCDEFGHI genes, birA gene, panBCD genes, dinG gene, ypmB gene,aspB gene, asnS gene, dnaD gene, nth gene and ypoC gene, completecds's.] [NT:putative] [LE:18616] [RE:19101] [DI:direct] >gp:[GI:e1183683:g2634656] [LN:BSUB0012] [AC:Z99115:AL009126] [GN:ypmB] [FN:unknown] [OR:Bacillus subtilis] [DB:genpept-bct1] [DE:Bacillus subtilis complete genome (section 12 of 21): from 2195541to 2409220.] [SP:P54396] [LE:152566] [RE:153051] [DI:complement]

| ORF Name | NTID | AAID | NT Length | AA Length | score | probability |
|---|---|---|---|---|---|---|
| AI7503000984_162578_c1_425 | 655 | 4427 | 984 | 327 | 338 | 1.1e-30 |

Description pir:[LN:A69867] [AC:A69867 ] [PN:conserved hypothetical protein ykuT] [GN:ykuT ] [OR:Bacillus subtilis] [DB:pir2] >gp:[GI:e1181925:g2632241] [LN:BS16829KB] [AC:AJ222587] [PN:YkuT protein] [GN:ykuT] [OR:Bacillus subtilis] [DB:genpept-bct1] [DE:Bacillus subtilis 29kB DNA fragment from ykwC gene to cse15 gene.] [LE:25580] [RE:26383] [DI:complement] >gp:[GI:e1185011:g2633792] [LN:BSUB0008] [AC:Z99111:AL009126] [GN:ykuT] [FN:unknown] [OR:Bacillus subtilis] [DB:genpept-bct1] [DE:Bacillus subtilis complete genome (section 8 of 21): from 1394791to 1603020.] [NT:similar to hypothetical proteins] [LE:95836] [RE:96639] [DI:complement]

| ORF Name | NTID | AAID | NT Length | AA Length | score | probability |
|---|---|---|---|---|---|---|
| AI7503000984_16486075_f2_138 | 656 | 4428 | 153 | 50 | | |

Description

NO-HIT

| ORF Name | NTID | AAID | NT Length | AA Length | score | probability |
|---|---|---|---|---|---|---|
| AI7503000984_165902_c3_674 | 657 | 4429 | 627 | 208 | 185 | 1.8e-14 |

Description sp:[LN:LP14_BACSU] [AC:P39144] [GN:LPA-14] [OR:BACILLUS SUBTILIS] [DE:LIPOPEPTIDE ANTIBIOTICS ITURIN A AND SURFACTIN BIOSYNTHESIS PROTEIN] [SP:P39144] [DB:swissprot] >pir:[LN:I39875] [AC:I39875 ] [PN:siderophore biosynthesis regulatory protein sfp:lipopeptide antibiotics iturin A:surfactin production protein] [GN:lpa-14:sfb:sfp:sfp(0) ] [CL:siderophore biosynthesis regulatory protein sfp] [OR:Bacillus subtilis] [DB:pir2] >gp:[GI:d1005421:g473916] [LN:BACLPA14] [AC:D21876] [PN:lipopeptide antibiotics iturin A] [GN:lpa-14] [OR:Bacillus subtilis] [SR:Bacillus subtilis (strain:RB14) DNA] [DB:genpept-bct1] [DE:B. subtilis lpa-14 gene encoding lipopeptide antibiotics iturin A.] [LE:1] [RE:675] [DI:direct]

| ORF Name | NTID | AAID | NT Length | AA Length | score | probability |
|---|---|---|---|---|---|---|
| AI7503000984_187561_c1_470 | 658 | 4430 | 879 | 292 | | |

Description

NO-HIT

| ORF Name | NTID | AAID | NT Length | AA Length | score | probability |
|---|---|---|---|---|---|---|
| AI7503000984_194010_c3_607 | 659 | 4431 | 1512 | 503 | 1381 | 3.4e-141 |

Description gp:[GI:d1039113:g4514332] [LN:AB013369] [AC:AB013369] [OR:Bacillus halodurans] [SR:Bacillus halodurans (strain:C-125) DNA] [DB:genpept-bct1] [DE:Bacillus halodurans C-125 yesT and comEC genes, partial andcomplete cds.] [NT:unknown] [LE:4328] [RE:5830] [DI:direct]

| ORF Name | NTID | AAID | NT Length | AA Length | score | probability |
|---|---|---|---|---|---|---|
| AI7503000984_19688401_c2_516 | 660 | 4432 | 126 | 41 | | |

Description

NO-HIT

| ORF Name | NTID | AAID | NT Length | AA Length | score | probability |
|---|---|---|---|---|---|---|
| AI7503000984_19773387_f3_363 | 661 | 4433 | 1248 | 415 | 746 | 6.6e-74 |

Description sp:[LN:STPA_STAAU] [AC:P81297] [OR:STAPHYLOCOCCUS AUREUS] [EC:3.4.22.-] [DE:STAPHOPAIN,] [SP:P81297] [DB:swissprot]

| ORF Name | NTID | AAID | NT Length | AA Length | score | probability |
|---|---|---|---|---|---|---|
| AI7503000984_20585963_f3_396 | 662 | 4434 | 897 | 298 | 657 | 1.8e-64 |

Description gp:[GI:g929972] [LN:BAU30714] [AC:U30714] [OR:Bacillus anthracis] [SR:plasmid pXO1] [DB:genpept-bct1] [DE:Bacillus anthracis Weybridge A toxin plasmid pXO1 right invertedrepeat element (WeyAR) bordering the toxin-encoding region, ORFAand ORFB genes, complete cds.] [NT:ORFB; similar to B. anthracis SterneL element ORFB;] [LE:512] [RE:1336] [DI:direct] >gp:[GI:g929975] [LN:BAU30715] [AC:U30715] [OR:Bacillus anthracis] [SR:plasmid pXO1] [DB:genpept-bct1] [DE:Bacillus anthracis Sterne toxin plasmid pXO1 left inverted repeatelement (SterneL) bordering the toxin-encoding region, ORFB andtruncated ORFA genes, complete cds.] [NT:ORFB; similar to B. anthracis WeyAR element ORFB;] [LE:458] [RE:1282] [DI:direct] >gp:[GI:g4894312] [LN:AF065404] [AC:AF065404] [PN:pXO1-96] [OR:Bacillus anthracis] [DB:genpept-bct2] [DE:Bacillus anthracis virulence plasmid PX01, complete sequence.] [LE:116307] [RE:117131] [DI:direct]

| ORF Name | NTID | AAID | NT Length | AA Length | score | probability |
|---|---|---|---|---|---|---|
| AI7503000984_20704012_f1_106 | 663 | 4435 | 240 | 79 | | |

Description
NO-HIT

| ORF Name | NTID | AAID | NT Length | AA Length | score | probability |
|---|---|---|---|---|---|---|
| AI7503000984_20979688_c2_511 | 664 | 4436 | 786 | 261 | 369 | 5.9e-34 |

Description
sp:[LN:NIKC_ECOLI] [AC:P33592] [GN:NIKC] [OR:ESCHERICHIA COLI] [DE:NICKEL TRANSPORT SYSTEM PERMEASE PROTEIN NIKC] [SP:P33592] [DB:swissprot] >pir:[LN:S39596] [AC:S39596;S47697;A65145 ] [PN:nikC protein] [GN:nikC ] [CL:oligopeptide permease protein oppB] [OR:Escherichia coli] [DB:pir2] >gp:[GI:g581141] [LN:ECNIK] [AC:X73143] [PN:NikC] [GN:nikC] [OR:Escherichia coli] [DB:genpept-bct1] [DE:E.coli DNA sequence of nik locus.] [SP:P33592] [LE:2942] [RE:3775] [DI:direct] >gp:[GI:g912461] [LN:ECOUW76] [AC:U00039] [GN:nikC] [OR:Escherichia coli] [SR:Escherichia coli (sub_strain MG1655, strain K-12) (library: lambda] [DB:genpept-bct1] [DE:E. coli chromosomal region from 76.0 to 81.5 minutes.] [LE:30444] [RE:31277] [DI:direct] >gp:[GI:g1789889] [LN:AE000423] [AC:AE000423;U00096] [PN:transport of nickel, membrane protein] [GN:nikC] [FN:transport; Transport of small molecules:] [OR:Escherichia coli] [DB:genpept-bct2] [DE:Escherichia coli K-12 MG1655 section 313 of 400 of the completegenome.] [NT:o277] [LE:7496] [RE:8329] [DI:direct]

| ORF Name | NTID | AAID | NT Length | AA Length | score | probability |
|---|---|---|---|---|---|---|
| AI7503000984_212827_f3_295 | 665 | 4437 | 1482 | 493 | 429 | 2.6e-40 |

Description
pir:[LN:G70006] [AC:G70006 ] [PN:multidrug resistance protein homolog yubD] [GN:yubD ] [OR:Bacillus subtilis] [DB:pir2] >gp:[GI:e1185986;g2635597] [LN:BSUB0016] [AC:Z99119;AL009126] [GN:yubD] [FN:unknown] [OR:Bacillus subtilis] [DB:genpept-bct1] [DE:Bacillus subtilis complete genome (section 16 of 21): from 2997771to 3213410.] [NT:similar to multidrug resistance protein] [LE:193143] [RE:194678] [DI:complement]

| ORF Name | NTID | AAID | NT Length | AA Length | score | probability |
|---|---|---|---|---|---|---|
| AI7503000984_21588287_f2_271 | 666 | 4438 | 126 | 41 | | |

Description
NO-HIT

| ORF Name | NTID | AAID | NT Length | AA Length | score | probability |
|---|---|---|---|---|---|---|
| AI7503000984_21907016_f1_123 | 667 | 4439 | 132 | 43 | | |

Description
NO-HIT

| ORF Name | NTID | AAID | NT Length | AA Length | score | probability |
|---|---|---|---|---|---|---|
| AI7503000984_22042337_c2_588 | 668 | 4440 | 1434 | 477 | 981 | 8.3e-99 |

Description
pir:[LN:F69763] [AC:F69763 ] [PN:multidrug resistance protein homolog ycnB] [GN:ycnB ] [CL:lincomycin-resistance protein lmrB] [OR:Bacillus subtilis] [DB:pir2]
>gp:[GI:e1182351:g2632685] [LN:BSUB0003] [AC:Z99106:AL009126] [GN:ycnB] [FN:unknown] [OR:Bacillus subtilis] [DB:genpept-bct1] [DE:Bacillus subtilis complete genome (section 3 of 21): from 402751 to611850.] [NT:similar to multidrug resistance protein] [LE:32866] [RE:34284] [DI:complement] >gp:[GI:d1009651:g1805454] [LN:D50453] [AC:D50453] [PN:homologue of multidrug resistance protein B,] [GN:ycnB] [OR:Bacillus subtilis] [SR:Bacillus subtilis (strain:168 trpC2) DNA] [DB:genpept-bct1] [DE:Bacillus subtilis DNA for 25-36 degree region containing theamyE-srfA region, complete cds.] [LE:115269] [RE:116687] [DI:complement]

| ORF Name | NTID | AAID | NT Length | AA Length | score | probability |
|---|---|---|---|---|---|---|
| AI7503000984_22323413_c2_518 | 669 | 4441 | 144 | 47 | | |

Description
NO-HIT

| ORF Name | NTID | AAID | NT Length | AA Length | score | probability |
|---|---|---|---|---|---|---|
| AI7503000984_22464127_f2_191 | 670 | 4442 | 153 | 50 | | |

Description
NO-HIT

| ORF Name | NTID | AAID | NT Length | AA Length | score | probability |
|---|---|---|---|---|---|---|
| AI7503000984_22537818_c2_513 | 671 | 4443 | 150 | 49 | | |

Description
NO-HIT

| ORF Name | NTID | AAID | NT Length | AA Length | score | probability |
|---|---|---|---|---|---|---|
| AI7503000984_22664140_f3_355 | 672 | 4444 | 1395 | 464 | 191 | 1.0e-11 |

Description
pir:[LN:F69280] [AC:F69280 ] [PN:iron (II) transporter (feoB-1) homolog] [CL:ferrous iron transport protein B:translation elongation factor Tu homology] [OR:Archaeoglobus fulgidus] [DB:pir2] >gp:[GI:g2650395] [LN:AE001089] [AC:AE001089:AE000782] [PN:iron (II) transporter (feoB-1)] [GN:AF0246] [OR:Archaeoglobus fulgidus] [DB:genpept-bct2] [DE:Archaeoglobus fulgidus section 18 of 172 of the complete genome.] [NT:similar to GB:L77117 SP:Q57986 PID:1591272 percent] [LE:10039] [RE:11958] [DI:complement]

| ORF Name | NTID | AAID | NT Length | AA Length | score | probability |
|---|---|---|---|---|---|---|
| AI7503000984_22664550_c2_512 | 673 | 4445 | 663 | 220 | 275 | 5.4e-24 |

Description
pir:[LN:C65145] [AC:C65145:S39598:S47699 ] [PN:nikE protein] [GN:nikE ] [CL:unassigned ATP-binding cassette proteins: ATP-binding cassette homology] [OR:Escherichia coli] [DB:pir2] >gp:[GI:g466616] [LN:ECOUW76] [AC:U00039] [GN:nikE] [OR:Escherichia coli] [SR:Escherichia coli (sub_strain MG1655, strain K-12) (library: lambda] [DB:genpept-bct1] [DE:E. coli chromosomal region from 76.0 to 81.5 minutes.] [LE:32038] [RE:32844] [DI:direct] >gp:[GI:g1789891] [LN:AE000423] [AC:AE000423:U00096] [PN:ATP-binding protein of nickel transport system] [GN:nikE] [FN:transport; Transport of small molecules:] [OR:Escherichia coli] [DB:genpept-bct2] [DE:Escherichia coli K-12 MG1655 section 313 of 400 of the completegenome.] [NT:o268] [LE:9090] [RE:9896] [DI:direct]

| ORF Name | NTID | AAID | NT Length | AA Length | score | probability |
|---|---|---|---|---|---|---|
| AI7503000984_22853432_c1_448 | 674 | 4446 | 384 | 127 | 152 | 2.4e-10 |

Description
sp:[LN:INVO_PIG] [AC:P18175] [GN:IVL] [OR:SUS SCROFA] [SR:,PIG] [DE:INVOLUCRIN] [SP:P18175] [DB:swissprot] >pir:[LN:I46592] [AC:I46592 ] [PN:involucrin] [CL:involucrin] [OR:Sus scrofa domestica] [SR:, domestic pig] [DB:pir2] >gp:[GI:g164523] [LN:PIGINVOLA] [AC:M34441] [OR:Sus scrofa] [SR:Pig (Yorkshire) adult skin keratinocyte DNA] [DB:genpept-mam] [DE:Pig involucrin gene, complete cds.] [NT:involucrin] [LE:1] [RE:1044] [DI:direct]

| ORF Name | NTID | AAID | NT Length | AA Length | score | probability |
|---|---|---|---|---|---|---|
| AI7503000984_23444425_c1_426 | 675 | 4447 | 846 | 281 | 362 | 3.2e-33 |

Description
pir:[LN:B69834] [AC:B69834 ] [PN:conserved hypothetical protein yhjK] [GN:yhjK ] [OR:Bacillus subtilis] [DB:pir2] >gp:[GI:e1183056:g2633390] [LN:BSUB0006] [AC:Z99109:AL009126] [GN:yhjK] [FN:unknown] [OR:Bacillus subtilis] [DB:genpept-bct1] [DE:Bacillus subtilis complete genome (section 6 of 21): from 999501 to1209940.] [NT:similar to hypothetical proteins] [LE:127427] [RE:128287] [DI:complement] >gp:[GI:e324984:g2226183] [LN:BSY14081] [AC:Y14081] [PN:hypothetical protein] [GN:yhjK] [OR:Bacillus subtilis] [DB:genpept-bct1] [DE:Bacillus subtilis chromosomal DNA, region 92 degrees: regionbetween comK and addAB.] [NT:Similarity to a large family of hypothetical] [LE:9722] [RE:10582] [DI:complement]

| ORF Name | NTID | AAID | NT Length | AA Length | score | probability |
|---|---|---|---|---|---|---|
| AI7503000984_23470290_c2_554 | 676 | 4448 | 915 | 304 | 1205 | 1.5e-122 |

Description
gp:[GI:g3800820] [LN:AF076683] [AC:AF076683] [PN:oligopeptide transporter putative membrane] [GN:opp-1C] [OR:Staphylococcus aureus] [DB:genpept-bct2] [DE:Staphylococcus aureus oligopeptide transporter putative substratebinding domain (opp-1A), oligopeptide transporter putative membranepermease domain (opp-1B), oligopeptide transporter putativemembrane permease domain (opp-1C), oligopeptide transporterputative ATPase domain (opp-1D), and oligopeptide transporterputative ATPase domain (opp-1F) genes, complete cds; and unknowngene.] [LE:2469] [RE:3338] [DI:direct]

| ORF Name | NTID | AAID | NT Length | AA Length | score | probability |
|---|---|---|---|---|---|---|
| AI7503000984_235837_c1_471 | 677 | 4449 | 1425 | 474 | | |

Description
NO-HIT

| ORF Name | NTID | AAID | NT Length | AA Length | score | probability |
|---|---|---|---|---|---|---|
| AI7503000984_23601510_c1_488 | 678 | 4450 | 1137 | 378 | 911 | 2.2e-91 |

Description
sp:[LN:GLDA_BACST] [AC:P32816] [GN:GLDA:GLD] [OR:BACILLUS STEAROTHERMOPHILUS] [EC:1.1.1.6] [DE:GLYCEROL DEHYDROGENASE, (GLDH)] [SP:P32816] [DB:swissprot] >pir:[LN:JQ1474] [AC:JQ1474:S38514 ] [PN:glycerol dehydrogenase,] [GN:gldA ] [CL:glycerol dehydrogenase:lactaldehyde reductase homology] [OR:Bacillus stearothermophilus] [EC:1.1.1.6] [DB:pir2] >gp:[GI:g142978] [LN:BACGLDA] [AC:M65289] [PN:glycerol dehydrogenase] [GN:gld] [OR:Bacillus stearothermophilus] [SR:Bacillus stearothermophilus (sub_species nondiastaticus) (library] [DB:genpept-bct1] [EC:1.1.1.6] [DE:Bacillus stearothermophilus glycerol dehydrogenase (proposed gld)gene, complete cds.] [LE:742] [RE:1854] [DI:direct]

| ORF Name | NTID | AAID | NT Length | AA Length | score | probability |
|---|---|---|---|---|---|---|
| AI7503000984_23652218_c1_459 | 679 | 4451 | 168 | 55 | 83 | 0.0012 |

Description
sp:[LN:GGI3_STAHA] [AC:P11699] [OR:STAPHYLOCOCCUS HAEMOLYTICUS] [DE:ANTIBACTERIAL PROTEIN 3 (GONOCOCCAL GROWTH INHIBITOR 3)] [SP:P11699] [DB:swissprot] >pir:[LN:BXSA3] [AC:S00601 ] [PN:antibacterial protein 3:gonococcal growth inhibitor 3] [CL:Staphylococcus haemolyticus antibacterial protein] [OR:Staphylococcus haemolyticus] [DB:pir1]

| ORF Name | NTID | AAID | NT Length | AA Length | score | probability |
|---|---|---|---|---|---|---|
| AI7503000984_23860307_c3_641 | 680 | 4452 | 1218 | 405 | 1603 | 1.0e-164 |

Description
gp:[GI:g3800823] [LN:AF076683] [AC:AF076683] [PN:unknown] [OR:Staphylococcus aureus] [DB:genpept-bct2] [DE:Staphylococcus aureus oligopeptide transporter putative substratebinding domain (opp-1A), oligopeptide transporter putative membranepermease domain (opp-1B), oligopeptide transporter putativemembrane permease domain (opp-1C), oligopeptide transporterputative ATPase domain (opp-1D), and oligopeptide transporterputative ATPase domain (opp-1F) genes, complete cds; and unknowngene.] [NT:orfX] [LE:4904] [RE:6097] [DI:direct]

| ORF Name | NTID | AAID | NT Length | AA Length | score | probability |
|---|---|---|---|---|---|---|
| AI7503000984_24000275_f3_303 | 681 | 4453 | 1026 | 341 | 1033 | 2.5e-104 |

Description
sp:[LN:OTCC_HAEIN] [AC:P44770] [GN:ARCB:HI0596] [OR:HAEMOPHILUS INFLUENZAE] [EC:2.1.3.3] [DE:ORNITHINE CARBAMOYLTRANSFERASE, CATABOLIC, (OTCASE)] [SP:P44770] [DB:swissprot] >pir:[LN:H64079] [AC:H64079 ] [PN:ornithine carbamoyltransferase,] [CL:ornithine carbamoyltransferase: aspartate/ornithine carbamoyltransferase homology] [OR:Haemophilus influenzae] [EC:2.1.3.3] [DB:pir2] >gp:[GI:g1573585] [LN:U32741] [AC:U32741:L42023] [PN:ornithine carbamoyltransferase (arcB)] [GN:HI0596] [OR:Haemophilus influenzae Rd] [DB:genpept-bct2] [DE:Haemophilus influenzae Rd section 56 of 163 of the complete genome.] [NT:similar to GB:X05637 SP:P08308 PID:45288 percent] [LE:3467] [RE:4471] [DI:complement]

| ORF Name | NTID | AAID | NT Length | AA Length | score | probability |
|---|---|---|---|---|---|---|
| AI7503000984_24095387_c1_438 | 682 | 4454 | 129 | 42 | | |

Description
NO-HIT

| ORF Name | NTID | AAID | NT Length | AA Length | score | probability |
|---|---|---|---|---|---|---|
| AI7503000984_24105393_c2_562 | 683 | 4455 | 768 | 255 | 711 | 3.4e-70 |

Description
gp:[GI:e1456529:g4914622] [LN:LMAJ9627] [AC:AJ009627] [PN:pyruvate-formate lyase activating enzyme] [GN:pflC] [OR:Listeria monocytogenes] [DB:genpept-bct1] [DE:Listeria monocytogenes pflC, orfA, lltB and orfC genes.] [NT:putative; similar to Streptococcus mutans PflC] [LE:149] [RE:895] [DI:direct]

| ORF Name | NTID | AAID | NT Length | AA Length | score | probability |
|---|---|---|---|---|---|---|
| AI7503000984_24225375_c2_533 | 684 | 4456 | 213 | 70 | 97 | 3.9e-05 |

Description
gp:[GI:g3212079] [LN:AF068633] [AC:AF068633] [PN:phenol soluble modulin beta 1]
[FN:inflammatory protein] [OR:Staphylococcus epidermidis] [DB:genpept-bct2]
[DE:Staphylococcus epidermidis phenol soluble modulin beta 1 and phenolsoluble modulin
beta 2 genes, complete cds.] [NT:PSM beta 1] [LE:669] [RE:803] [DI:direct]
>gp:[GI:g3212080] [LN:AF068633] [AC:AF068633] [PN:phenol soluble modulin beta 2]
[FN:inflammatory protein] [OR:Staphylococcus epidermidis] [DB:genpept-bct2]
[DE:Staphylococcus epidermidis phenol soluble modulin beta 1 and phenolsoluble modulin
beta 2 genes, complete cds.] [NT:PSM beta 2] [LE:859] [RE:993] [DI:direct]

| ORF Name | NTID | AAID | NT Length | AA Length | score | probability |
|---|---|---|---|---|---|---|
| AI7503000984_24257881_f1_68 | 685 | 4457 | 138 | 45 | | |

Description
NO-HIT

| ORF Name | NTID | AAID | NT Length | AA Length | score | probability |
|---|---|---|---|---|---|---|
| AI7503000984_24266041_f1_22 | 686 | 4458 | 129 | 42 | | |

Description
NO-HIT

| ORF Name | NTID | AAID | NT Length | AA Length | score | probability |
|---|---|---|---|---|---|---|
| AI7503000984_24391678_f1_120 | 687 | 4459 | 171 | 56 | | |

Description
NO-HIT

| ORF Name | NTID | AAID | NT Length | AA Length | score | probability |
|---|---|---|---|---|---|---|
| AI7503000984_24407677_f3_293 | 688 | 4460 | 234 | 77 | | |

Description
NO-HIT

| ORF Name | NTID | AAID | NT Length | AA Length | score | probability |
|---|---|---|---|---|---|---|
| AI7503000984_24650300_c1_476 | 689 | 4461 | 1365 | 454 | 1037 | 9.6e-105 |

Description
sp:[LN:BRNQ_LACDL] [AC:P54104] [GN:BRNQ] [OR:LACTOBACILLUS DELBRUECKII]
[SR:,SUBSPLACTIS] [DE:CHAIN AMINO ACID UPTAKE CARRIER)] [SP:P54104] [DB:swissprot]
>pir:[LN:S60180] [AC:S60180 ] [PN:branched-chain amino acid carrier brnQ] [GN:brnQ ]
[CL:branched-chain amino acid transport system II carrier protein braZ]
[OR:Lactobacillus delbrueckii] [DB:pir2] >gp:[GI:g732813] [LN:LDBRNQGN] [AC:Z48676]
[PN:branched-chain amino acid carrier] [GN:brnQ] [FN:transport of branched-chain amino
acids (Leu,] [OR:Lactobacillus delbrueckii] [DB:genpept-bct1] [DE:L.delbrueckii brnQ
gene for branched-chain amino acid carrier.] [SP:P54104] [LE:611] [RE:1951] [DI:direct]

| ORF Name | NTID | AAID | NT Length | AA Length | score | probability |
|---|---|---|---|---|---|---|
| AI7503000984_24664012_f2_199 | 690 | 4462 | 453 | 150 | 82 | 0.0052 |

Description gp:[GI:d1025730:g2879910] [LN:D85752] [AC:D85752] [GN:bacD] [OR:Enterococcus faecalis] [SR:Enterococcus faecalis plasmid:pPD1 DNA] [DB:genpept-bct1] [DE:Enterococcus faecalis plasmid pPD1 bacA, bacB, bacC, bacD, bacE,bacF, bacG, bacH and bacI genes, complete cds.] [LE:3977] [RE:4324] [DI:direct]

| ORF Name | NTID | AAID | NT Length | AA Length | score | probability |
|---|---|---|---|---|---|---|
| AI7503000984_24711588_c2_589 | 691 | 4463 | 225 | 74 | | |

Description

NO-HIT

| ORF Name | NTID | AAID | NT Length | AA Length | score | probability |
|---|---|---|---|---|---|---|
| AI7503000984_24884688_c2_509 | 692 | 4464 | 528 | 175 | 216 | 5.6e-17 |

Description gp:[GI:g3800818] [LN:AF076683] [AC:AF076683] [PN:oligopeptide transporter putative substrate] [GN:opp-1A] [OR:Staphylococcus aureus] [DB:genpept-bct2] [DE:Staphylococcus aureus oligopeptide transporter putative substratebinding domain (opp-1A), oligopeptide transporter putative membranepermease domain (opp-1B), oligopeptide transporter putativemembrane permease domain (opp-1C), oligopeptide transporterputative ATPase domain (opp-1D), and oligopeptide transporterputative ATPase domain (opp-1F) genes, complete cds; and unknowngene.] [LE:64] [RE:1524] [DI:direct]

| ORF Name | NTID | AAID | NT Length | AA Length | score | probability |
|---|---|---|---|---|---|---|
| AI7503000984_24886552_c3_635 | 693 | 4465 | 792 | 263 | 603 | 9.4e-59 |

Description gp:[GI:d1037145:g4062842] [LN:AB009078] [AC:AB009078] [PN:L-2.3-butanediol dehydrogenase] [OR:Brevibacterium saccharolyticum] [SR:Brevibacterium saccharolyticum DNA] [DB:genpept-bct1] [DE:Brevibacterium saccharolyticum gene for L-2.3-butanedioldehydrogenase, complete cds.] [LE:1743] [RE:2519] [DI:direct]

| ORF Name | NTID | AAID | NT Length | AA Length | score | probability |
|---|---|---|---|---|---|---|
| AI7503000984_25429665_c1_496 | 694 | 4466 | 1338 | 445 | 267 | 4.3e-21 |

Description pir:[LN:S58131] [AC:S58131 ] [PN:integral membrane protein LmrP] [OR:Lactococcus lactis] [DB:pir2] >gp:[GI:g1052754] [LN:LLLMRP] [AC:X89779] [PN:LmrP integral membrane protein] [GN:lmrP] [OR:Lactococcus lactis] [DB:genpept-bct1] [DE:L.lactis DNA for LmrP gene.] [LE:634] [RE:1860] [DI:direct]

| ORF Name | NTID | AAID | NT Length | AA Length | score | probability |
|---|---|---|---|---|---|---|
| AI7503000984_25476378_f1_13 | 695 | 4467 | 159 | 52 | | |

Description

NO-HIT

| ORF Name | NTID | AAID | NT Length | AA Length | score | probability |
|---|---|---|---|---|---|---|
| AI7503000984_25894687_c3_624 | 696 | 4468 | 243 | 80 | | |

Description

NO-HIT

| ORF_Name | NTID | AAID | NT Length | AA Length | score | probability |
|---|---|---|---|---|---|---|
| AI7503000984_26182681_c3_595 | 697 | 4469 | 528 | 175 | | |

Description
NO-HIT

| ORF_Name | NTID | AAID | NT Length | AA Length | score | probability |
|---|---|---|---|---|---|---|
| AI7503000984_26208450_f1_24 | 698 | 4470 | 165 | 54 | | |

Description
NO-HIT

| ORF_Name | NTID | AAID | NT Length | AA Length | score | probability |
|---|---|---|---|---|---|---|
| AI7503000984_26229678_f1_27 | 699 | 4471 | 177 | 58 | | |

Description
NO-HIT

| ORF_Name | NTID | AAID | NT Length | AA Length | score | probability |
|---|---|---|---|---|---|---|
| AI7503000984_26265641_c2_543 | 700 | 4472 | 147 | 48 | | |

Description
NO-HIT

| ORF_Name | NTID | AAID | NT Length | AA Length | score | probability |
|---|---|---|---|---|---|---|
| AI7503000984_26367135_c1_508 | 701 | 4473 | 2079 | 692 | 1496 | 2.2e-153 |

Description
sp:[LN:LIP_STAEP] [AC:Q02510] [GN:GEHC] [OR:STAPHYLOCOCCUS EPIDERMIDIS] [EC:3.1.1.3]
[DE:LIPASE PRECURSOR, (GLYCEROL ESTER HYDROLASE)] [SP:Q02510] [DB:swissprot]
>pir:[LN:A47705] [AC:A47705 ] [PN:triacylglycerol lipase,] [CL:Staphylococcus
triacylglycerol lipase] [OR:Staphylococcus epidermidis] [EC:3.1.1.3] [DB:pir2]
>gp:[GI:g153022] [LN:STAGEHC] [AC:M95577] [PN:lipase] [GN:gehC] [OR:Staphylococcus
epidermidis] [SR:Staphylococcus epidermidis (strain 9) DNA] [DB:genpept-bct1]
[DE:Staphylococcus epidermidis lipase (gehC) gene, complete cds.] [NT:GTG start codon]
[LE:121] [RE:2187] [DI:direct]

| ORF_Name | NTID | AAID | NT Length | AA Length | score | probability |
|---|---|---|---|---|---|---|
| AI7503000984_26369027_f2_260 | 702 | 4474 | 984 | 327 | 1350 | 6.5e-138 |

Description
pir:[LN:E69806] [AC:E69806 ] [PN:conserved hypothetical protein yfjN] [GN:yfjN ]
[OR:Bacillus subtilis] [DB:pir2] >gp:[GI:e1182793:g2633127] [LN:BSUB0005]
[AC:Z99108:AL009126] [GN:yfjN] [FN:unknown] [OR:Bacillus subtilis] [DB:genpept-bct1]
[DE:Bacillus subtilis complete genome (section 5 of 21): from 802821 to1011250.]
[NT:similar to hypothetical proteins] [LE:73112] [RE:74089] [DI:direct]
>gp:[GI:d1025211:g2780398] [LN:D78509] [AC:D78509] [PN:YfjN] [OR:Bacillus subtilis]
[SR:Bacillus subtilis (strain:AC327) DNA] [DB:genpept-bct1] [DE:Bacillus subtilis
YfjG-YfjR genes, complete cds.] [LE:12236] [RE:13213] [DI:complement]

| ORF_Name | NTID | AAID | NT Length | AA Length | score | probability |
|---|---|---|---|---|---|---|
| AI7503000984_26600936_f2_253 | 703 | 4475 | 513 | 170 | 373 | 2.2e-34 |

Description
sp:[LN:Y318_HAEIN] [AC:P43984] [GN:HI0318] [OR:HAEMOPHILUS INFLUENZAE] [DE:HYPOTHETICAL PROTEIN HI0318] [SP:P43984] [DB:swissprot] >pir:[LN:B64006] [AC:B64006 ] [PN:hypothetical protein HI0318] [OR:Haemophilus influenzae] [DB:pir2] >gp:[GI:g1573288] [LN:U32717] [AC:U32717:L42023] [PN:conserved hypothetical protein] [GN:HI0318] [OR:Haemophilus influenzae Rd] [DB:genpept-bct2] [DE:Haemophilus influenzae Rd section 32 of 163 of the complete genome.] [NT:similar to SP:P54158 PID:1256620 GB:AL009126] [LE:4064] [RE:4582] [DI:direct]

| ORF_Name | NTID | AAID | NT Length | AA Length | score | probability |
|---|---|---|---|---|---|---|
| AI7503000984_26759430_c3_654 | 704 | 4476 | 978 | 325 | 872 | 2.9e-87 |

Description
pir:[LN:E69670] [AC:E69670 ] [PN:glycine betaine/carnitine/choline ABC transporter (osmoprotec) opuCC] [GN:opuCC ] [OR:Bacillus subtilis] [DB:pir2] >gp:[GI:e1186069:g2635894] [LN:BSUB0018] [AC:Z99121:AL009126] [PN:glycine betaine/carnitine/choline ABC] [GN:opuCC] [FN:high affinity transport of glycine betaine,] [OR:Bacillus subtilis] [DB:genpept-bct1] [DE:Bacillus subtilis complete genome (section 18 of 21): from 3399551to 3609060.] [NT:alternate gene name: yvbC] [LE:67766] [RE:68677] [DI:complement]

| ORF_Name | NTID | AAID | NT Length | AA Length | score | probability |
|---|---|---|---|---|---|---|
| AI7503000984_26760076_f3_305 | 705 | 4477 | 1578 | 525 | 1550 | 4.2e-159 |

Description
sp:[LN:YFCC_HAEIN] [AC:P44023] [GN:HI0594] [OR:HAEMOPHILUS INFLUENZAE] [DE:HYPOTHETICAL PROTEIN HI0594] [SP:P44023] [DB:swissprot] >pir:[LN:E64010] [AC:E64010 ] [PN:hypothetical protein HI0594] [CL:Haemophilus influenzae conserved hypothetical protein HI0594] [OR:Haemophilus influenzae] [DB:pir2] >gp:[GI:g1573583] [LN:U32741] [AC:U32741:L42023] [PN:conserved hypothetical transmembrane protein] [GN:HI0594] [OR:Haemophilus influenzae Rd] [DB:genpept-bct2] [DE:Haemophilus influenzae Rd section 56 of 163 of the complete genome.] [NT:similar to GB:AE000783 percent identity: 35.02;] [LE:891] [RE:2420] [DI:complement]

| ORF_Name | NTID | AAID | NT Length | AA Length | score | probability |
|---|---|---|---|---|---|---|
| AI7503000984_26774137_c2_574 | 706 | 4478 | 126 | 41 | | |

Description
NO-HIT

| ORF_Name | NTID | AAID | NT Length | AA Length | score | probability |
|---|---|---|---|---|---|---|
| AI7503000984_272593_c3_636 | 707 | 4479 | 879 | 292 | 82 | 0.0082 |

Description
sp:[LN:YORB_LISMO] [AC:P33382] [OR:LISTERIA MONOCYTOGENES] [DE:HYPOTHETICAL 12.0 KD PROTEIN IN PLCB-LDH INTERGENIC REGION (ORFB)] [SP:P33382] [DB:swissprot] >pir:[LN:I43868] [AC:I43868 ] [PN:ORFB] [CL:hypothetical protein MJ1413] [OR:Listeria monocytogenes] [DB:pir2] >gp:[GI:g149648] [LN:LISACTLDH] [AC:M82881] [OR:Listeria monocytogenes] [SR:Listeria monocytogenes (strain L028) DNA] [DB:genpept-bct1] [DE:Listeria monocytogenes lecithinase, lactate dehydrogenase (actA)gene complete cds, (plcB) gene complete cds, (ldh) gene completecds.] [NT:ORFB] [LE:4094] [RE:4426] [DI:complement]

| ORF Name | NTID | AAID | NT Length | AA Length | score | probability |
|---|---|---|---|---|---|---|
| AI7503000984_2906307_f1_60 | 708 | 4480 | 126 | 41 | | |

Description
NO-HIT

| ORF Name | NTID | AAID | NT Length | AA Length | score | probability |
|---|---|---|---|---|---|---|
| AI7503000984_2928437_c1_477 | 709 | 4481 | 921 | 306 | 375 | 1.4e-34 |

Description
pir:[LN:A69401] [AC:A69401 ] [PN:conserved hypothetical protein AF1210]
[OR:Archaeoglobus fulgidus] [DB:pir2] >gp:[GI:g2649377] [LN:AE001021]
[AC:AE001021:AE000782] [PN:conserved hypothetical protein] [GN:AF1210]
[OR:Archaeoglobus fulgidus] [DB:genpept-bct2] [DE:Archaeoglobus fulgidus section 86 of
172 of the complete genome.] [NT:similar to GP:1654020 percent identity: 34.56;]
[LE:12088] [RE:13029] [DI:complement]

| ORF Name | NTID | AAID | NT Length | AA Length | score | probability |
|---|---|---|---|---|---|---|
| AI7503000984_2929718_c1_463 | 710 | 4482 | 1959 | 652 | 3345 | 0.0 |

Description
gp:[GI:g3789932] [LN:AF090142] [AC:AF090142] [PN:lipase precursor] [GN:gehD]
[OR:Staphylococcus epidermidis] [DB:genpept-bct2] [EC:3.1.1.3] [DE:Staphylococcus
epidermidis lipase precursor (gehD) gene, completecds.] [NT:GehD] [LE:293] [RE:2224]
[DI:direct]

| ORF Name | NTID | AAID | NT Length | AA Length | score | probability |
|---|---|---|---|---|---|---|
| AI7503000984_29398437_f2_132 | 711 | 4483 | 234 | 77 | | |

Description
NO-HIT

| ORF Name | NTID | AAID | NT Length | AA Length | score | probability |
|---|---|---|---|---|---|---|
| AI7503000984_3003137_f2_215 | 712 | 4484 | 906 | 301 | 294 | 5.2e-26 |

Description
pir:[LN:H70313] [AC:H70313 ] [PN:cobalamin synthesis related protein CobW] [GN:cobW ]
[OR:Aquifex aeolicus] [DB:pir2] >gp:[GI:g2982874] [LN:AE000675] [AC:AE000675:AE000657]
[PN:cobalamin synthesis related protein CobW] [GN:cobW] [OR:Aquifex aeolicus]
[DB:genpept-bct2] [DE:Aquifex aeolicus section 7 of 109 of the complete genome.]
[LE:11287] [RE:12165] [DI:direct]

| ORF Name | NTID | AAID | NT Length | AA Length | score | probability |
|---|---|---|---|---|---|---|
| AI7503000984_30103592_c3_600 | 713 | 4485 | 132 | 43 | | |

Description
NO-HIT

| ORF Name | NTID | AAID | NT Length | AA Length | score | probability |
|---|---|---|---|---|---|---|
| AI7503000984_30251551_f3_412 | 714 | 4486 | 159 | 52 | 73 | 0.027 |

Description
sp:[LN:YO21_BPHP1] [AC:P51723] [OR:BACTERIOPHAGE HP1] [DE:HYPOTHETICAL 19.2 KD PROTEIN IN REP-HOL INTERGENIC REGION (ORF21)] [SP:P51723] [DB:swissprot] >pir:[LN:S69527] [AC:S69527 ] [PN:hypothetical protein 21] [OR:phage HP1] [DB:pir2] >gp:[GI:g1046248] [LN:BHU24159] [AC:U24159:U06847:M28366:M12911:M22941:M12910:M15313] [OR:Bacteriophage HP1] [DB:genpept-phg] [DE:Bacteriophage HP1 strain HP1c1, complete genome.] [NT:orf21] [LE:17028] [RE:17528] [DI:direct]

| ORF Name | NTID | AAID | NT Length | AA Length | score | probability |
|---|---|---|---|---|---|---|
| AI7503000984_30271882_c3_618 | 715 | 4487 | 720 | 239 | 268 | 3.0e-23 |

Description
gp:[GI:g490316] [LN:A02585] [AC:A02585] [GN:bioD] [OR:synthetic construct] [DB:genpept-pat] [DE:Synthetic (LORF1) bioD gene.] [LE:39] [RE:764] [DI:direct]

| ORF Name | NTID | AAID | NT Length | AA Length | score | probability |
|---|---|---|---|---|---|---|
| AI7503000984_30272531_f2_228 | 716 | 4488 | 144 | 47 | | |

Description
NO-HIT

| ORF Name | NTID | AAID | NT Length | AA Length | score | probability |
|---|---|---|---|---|---|---|
| AI7503000984_30351677_c3_598 | 717 | 4489 | 804 | 267 | | |

Description
NO-HIT

| ORF Name | NTID | AAID | NT Length | AA Length | score | probability |
|---|---|---|---|---|---|---|
| AI7503000984_30742307_c2_572 | 718 | 4490 | 669 | 222 | 640 | 1.1e-62 |

Description
pir:[LN:F69670] [AC:F69670 ] [PN:glycine betaine/carnitine/choline ABC transporter (membrane p) opuCD] [GN:opuCD ] [CL:glycine betaine/carnitine/choline ABC transporter] [OR:Bacillus subtilis] [DB:pir2] >gp:[GI:g2271392] [LN:AF009352] [AC:AF009352] [PN:transmembrane protein] [GN:opuCD] [OR:Bacillus subtilis] [DB:genpept-bct1] [DE:Bacillus subtilis osmoprotectant transport system OpuC includingATPase (opuCA), transmembrane protein (opuCB), osmoprotectantbinding protein precursor (opuCC) and transmembrane protein (opuCD)genes, complete cds.] [NT:OpuCD; part of the osmoprotectant transport system] [LE:3627] [RE:4316] [DI:direct] >gp:[GI:e1186068:g2635893] [LN:BSUB0018] [AC:Z99121:AL009126] [PN:glycine betaine/carnitine/choline ABC] [GN:opuCD] [FN:high affinity transport of glycine betaine,] [OR:Bacillus subtilis] [DB:genpept-bct1] [DE:Bacillus subtilis complete genome (section 18 of 21): from 3399551to 3609060.] [NT:alternate gene name: yvbB] [LE:67059] [RE:67748] [DI:complement]

| ORF Name | NTID | AAID | NT Length | AA Length | score | probability |
|---|---|---|---|---|---|---|
| AI7503000984_3125687_f1_114 | 719 | 4491 | 132 | 43 | | |

Description
NO-HIT

| ORF_Name | NTID | AAID | NT Length | AA Length | score | probability |
|---|---|---|---|---|---|---|
| AI7503000984_31287513_c1_464 | 720 | 4492 | 150 | 49 | | |

Description
NO-HIT

| ORF_Name | NTID | AAID | NT Length | AA Length | score | probability |
|---|---|---|---|---|---|---|
| AI7503000984_3163552_c3_597 | 721 | 4493 | 963 | 320 | 356 | 1.4e-32 |

Description
gp:[GI:g3800819] [LN:AF076683] [AC:AF076683] [PN:oligopeptide transporter putative membrane] [GN:opp-1B] [OR:Staphylococcus aureus] [DB:genpept-bct2] [DE:Staphylococcus aureus oligopeptide transporter putative substratebinding domain (opp-1A), oligopeptide transporter putative membranepermease domain (opp-1B), oligopeptide transporter putativemembrane permease domain (opp-1C), oligopeptide transporterputative ATPase domain (opp-1D), and oligopeptide transporterputative ATPase domain (opp-1F) genes, complete cds; and unknowngene.] [LE:1537] [RE:2472] [DI:direct]

| ORF_Name | NTID | AAID | NT Length | AA Length | score | probability |
|---|---|---|---|---|---|---|
| AI7503000984_3174187_f2_222 | 722 | 4494 | 330 | 109 | | |

Description
NO-HIT

| ORF_Name | NTID | AAID | NT Length | AA Length | score | probability |
|---|---|---|---|---|---|---|
| AI7503000984_32609682_f3_403 | 723 | 4495 | 129 | 42 | | |

Description
NO-HIT

| ORF_Name | NTID | AAID | NT Length | AA Length | score | probability |
|---|---|---|---|---|---|---|
| AI7503000984_32615677_c2_544 | 724 | 4496 | 1035 | 344 | 510 | 6.7e-49 |

Description
pir:[LN:A69756] [AC:A69756 ] [PN:adhesion protein homolog ycdH] [GN:ycdH ] [CL:adhesin B] [OR:Bacillus subtilis] [DB:pir2] >gp:[GI:d1023108:g2415736] [LN:AB000617] [AC:AB000617] [PN:YcdH] [GN:ycdH] [OR:Bacillus subtilis] [SR:Bacillus subtilis (strain:168 trpC2) DNA] [DB:genpept-bct1] [DE:Bacillus subtilis genomic DNA, 22 to 25 degree region, completecds.] [NT:homologue of adhesion protein precursor of] [LE:21421] [RE:22380] [DI:direct] >gp:[GI:e1182237:g2632571] [LN:BSUB0002] [AC:Z99105:AL009126] [GN:ycdH] [FN:unknown] [OR:Bacillus subtilis] [DB:genpept-bct1] [DE:Bacillus subtilis complete genome (section 2 of 21): from 194651 to415810.] [NT:similar to adhesion protein] [LE:113236] [RE:114195] [DI:direct]

| ORF_Name | NTID | AAID | NT Length | AA Length | score | probability |
|---|---|---|---|---|---|---|
| AI7503000984_32755_f2_185 | 725 | 4497 | 195 | 64 | | |

Description
NO-HIT

| ORF_Name | NTID | AAID | NT Length | AA Length | score | probability |
|---|---|---|---|---|---|---|
| AI7503000984_33241562_f2_147 | 726 | 4498 | 144 | 47 | | |

Description
NO-HIT

| ORF Name | NTID | AAID | NT Length | AA Length | score | probability |
|---|---|---|---|---|---|---|
| AI7503000984_33479716_c3_634 | 727 | 4499 | 1401 | 466 | 421 | 1.8e-39 |

Description
gp:[GI:e1429016:g4753872] [LN:SCH10] [AC:AL049754] [PN:putative transmembrane efflux protein] [GN:SCH10.26c] [OR:Streptomyces coelicolor] [DB:genpept-bct1] [DE:Streptomyces coelicolor cosmid H10.] [NT:SCH10.26c, probable transmembrane efflux protein,] [LE:22729] [RE:24183] [DI:complement]

| ORF Name | NTID | AAID | NT Length | AA Length | score | probability |
|---|---|---|---|---|---|---|
| AI7503000984_34171927_c1_468 | 728 | 4500 | 144 | 47 | | |

Description
NO-HIT

| ORF Name | NTID | AAID | NT Length | AA Length | score | probability |
|---|---|---|---|---|---|---|
| AI7503000984_34277062_c3_602 | 729 | 4501 | 153 | 50 | | |

Description
NO-HIT

| ORF Name | NTID | AAID | NT Length | AA Length | score | probability |
|---|---|---|---|---|---|---|
| AI7503000984_34408552_f1_21 | 730 | 4502 | 126 | 41 | | |

Description
NO-HIT

| ORF Name | NTID | AAID | NT Length | AA Length | score | probability |
|---|---|---|---|---|---|---|
| AI7503000984_34429837_f1_39 | 731 | 4503 | 948 | 315 | 769 | 2.4e-76 |

Description
sp:[LN:ARCL_ECOLI] [AC:Q46807] [GN:YQEA] [OR:ESCHERICHIA COLI] [DE:CARBAMATE KINASE-LIKE PROTEIN 1] [SP:Q46807] [DB:swissprot] >pir:[LN:B65071] [AC:B65071 ] [PN:hypothetical protein b2874] [CL:carbamate kinase] [OR:Escherichia coli] [DB:pir2] >gp:[GI:g887824] [LN:ECU28375] [AC:U28375] [OR:Escherichia coli] [DB:genpept-bct1] [DE:Escherichia coli K-12 genome; approximately 64 to 65 minutes.] [NT:ORF_o310] [LE:21276] [RE:22208] [DI:direct] >gp:[GI:g1789238] [LN:AE000370] [AC:AE000370:U00096] [PN:putative kinase] [GN:yqeA] [FN:putative enzyme; Not classified] [OR:Escherichia coli] [DB:genpept-bct2] [DE:Escherichia coli K-12 MG1655 section 260 of 400 of the completegenome.] [NT:o310; This 310 aa ORF is 45 pct identical (21 gaps)] [LE:11360] [RE:12292] [DI:direct]

| ORF Name | NTID | AAID | NT Length | AA Length | score | probability |
|---|---|---|---|---|---|---|
| AI7503000984_34631527_f1_109 | 732 | 4504 | 336 | 111 | 374 | 1.7e-34 |

Description
gp:[GI:d1045996:g5360820] [LN:D86934] [AC:D86934] [PN:transposase] [OR:Staphylococcus aureus] [SR:Staphylococcus aureus (strain:N315) DNA, clone_lib:library of N31] [DB:genpept] [DE:Staphylococcus aureus genes, mec region, partial and complete cds.] [NT:ORF N026; putative] [LE:19527] [RE:19751] [DI:direct]

| ORF Name | NTID | AAID | NT Length | AA Length | score | probability |
|---|---|---|---|---|---|---|
| AI7503000984_34642135_c3_663 | 733 | 4505 | 246 | 81 | 79 | 0.020 |

Description
gp:[GI:g488889] [LN:A12521] [AC:A12521] [PN:Acidic Basic Repeat Antigen Rhoptry (ABRA)] [OR:Plasmodium falciparum] [SR:malaria parasite P. falciparum] [DB:genpept-pat] [DE:Ag189 clone.] [LE:1:61] [RE:45:963] [DI:directJoin]

| ORF Name | NTID | AAID | NT Length | AA Length | score | probability |
|---|---|---|---|---|---|---|
| AI7503000984_34657677_c3_615 | 734 | 4506 | 2994 | 997 | 2435 | 6.9e-253 |

Description
gp:[GI:g4185565] [LN:AF115379] [AC:AF115379] [PN:surface protein Pls] [GN:pls] [OR:Staphylococcus aureus] [DB:genpept-bct2] [DE:Staphylococcus aureus surface protein Pls (pls) gene, complete cds.] [NT:methicillin resistant; contains a DS repeat area] [LE:1] [RE:4914] [DI:direct]

| ORF Name | NTID | AAID | NT Length | AA Length | score | probability |
|---|---|---|---|---|---|---|
| AI7503000984_35312766_f2_151 | 735 | 4507 | 195 | 64 | | |

Description
NO-HIT

| ORF Name | NTID | AAID | NT Length | AA Length | score | probability |
|---|---|---|---|---|---|---|
| AI7503000984_35331905_c3_612 | 736 | 4508 | 318 | 105 | 81 | 0.012 |

Description
gp:[GI:g5052610] [LN:AF145660] [AC:AF145660] [PN:BcDNA.GH10614] [GN:BcDNA.GH10614] [OR:Drosophila melanogaster] [SR:fruit fly] [DB:genpept-inv2] [DE:Drosophila melanogaster clone GH10614 BcDNA.GH10614 (BcDNA.GH10614)mRNA, complete cds.] [LE:14] [RE:964] [DI:direct]

| ORF Name | NTID | AAID | NT Length | AA Length | score | probability |
|---|---|---|---|---|---|---|
| AI7503000984_36042152_c3_616 | 737 | 4509 | 3246 | 1081 | 2306 | 1.8e-251 |

Description
gp:[GI:g4185565] [LN:AF115379] [AC:AF115379] [PN:surface protein Pls] [GN:pls] [OR:Staphylococcus aureus] [DB:genpept-bct2] [DE:Staphylococcus aureus surface protein Pls (pls) gene, complete cds.] [NT:methicillin resistant; contains a DS repeat area] [LE:1] [RE:4914] [DI:direct]

| ORF Name | NTID | AAID | NT Length | AA Length | score | probability |
|---|---|---|---|---|---|---|
| AI7503000984_36135752_f1_90 | 738 | 4510 | 1128 | 375 | 172 | 1.7e-10 |

Description
sp:[LN:YPDA_BACSU] [AC:P50736] [GN:YPDA] [OR:BACILLUS SUBTILIS] [DE:HYPOTHETICAL 36.3 KD PROTEIN IN RECQ-CMK INTERGENIC REGION] [SP:P50736] [DB:swissprot] >pir:[LN:A69934] [AC:A69934 ] [PN:thioredoxin reductase homolog ypdA] [GN:ypdA ] [OR:Bacillus subtilis] [DB:pir2] >gp:[GI:e1183740:g2634713] [LN:BSUB0012] [AC:Z99115:AL009126] [GN:ypdA] [FN:unknown] [OR:Bacillus subtilis] [DB:genpept-bct1] [DE:Bacillus subtilis complete genome (section 12 of 21): from 2195541to 2409220.] [NT:similar to thioredoxin reductase] [SP:P50736] [LE:204681] [RE:205655] [DI:complement]
>gp:[GI:e1185564:g2634730] [LN:BSUB0013] [AC:Z99116:AL009126] [GN:ypdA] [FN:unknown] [OR:Bacillus subtilis] [DB:genpept-bct1] [DE:Bacillus subtilis complete genome (section 13 of 21): from 2395261to 2613730.] [NT:similar to thioredoxin reductase] [SP:P50736] [LE:4961] [RE:5935] [DI:complement] >gp:[GI:g1146207] [LN:BACSERA] [AC:L47648] [GN:ypdA] [OR:Bacillus subtilis] [DB:genpept-bct2] [DE:Bacillus subtilis phosphoglycerate dehydrogenase (serA), ypaA,ferredoxin (fer), ypbB, recS, ypbD, ypbE, ypbF, ypbG, ypbH,glutamate dehydrogenase (ypcA), ypdA, ypdB, ypdC, spore cortexlytic enzyme (sleB), ypeB, ypfA, ypfB, cytidine monophosphatekinase (cmk), ypfD, ypgA, yphA, yphB, yphC, NAD+ dependentglycerol-3-phosphate dehydrogenase (glyc), yphE and yphF genes,complete cds.] [NT:putative] [LE:10742] [RE:11716] [DI:direct]

| ORF Name | NTID | AAID | NT Length | AA Length | score | probability |
|---|---|---|---|---|---|---|
| AI7503000984_36601703_c1_467 | 739 | 4511 | 939 | 312 | 406 | 7.0e-38 |

Description
sp:[LN:APBE_TREPA] [AC:O83774] [GN:APBE:TP0796] [OR:TREPONEMA PALLIDUM] [DE:THIAMINE BIOSYNTHESIS LIPOPROTEIN APBE PRECURSOR] [SP:O83774] [DB:swissprot] >pir:[LN:C71281] [AC:C71281 ] [PN:conserved hypothetical protein TP0796] [GN:TP0796] [CL:hypothetical protein HI0172] [OR:Treponema pallidum subsp. pallidum] [SR:, syphilis spirochete] [DB:pir2] >gp:[GI:g3323101] [LN:AE001250] [AC:AE001250:AE000520] [PN:conserved hypothetical protein] [GN:TP0796] [OR:Treponema pallidum] [DB:genpept-bct2] [DE:Treponema pallidum section 66 of 87 of the complete genome.] [NT:similar to GB:L42023 SP:P44550 PID:1003244] [LE:10082] [RE:11170] [DI:complement]

| ORF Name | NTID | AAID | NT Length | AA Length | score | probability |
|---|---|---|---|---|---|---|
| AI7503000984_3939215_f2_247 | 740 | 4512 | 984 | 327 | 377 | 8.3e-35 |

Description
gp:[GI:g2766193] [LN:SHU75349] [AC:U75349] [PN:periplasmic-iron-binding protein BhiC] [GN:bhi operon] [OR:Brachyspira hyodysenteriae] [DB:genpept-bct2] [DE:Serpulina hyodysenteriae bhi operon, complete sequence.] [LE:1674] [RE:2693] [DI:direct]

| ORF Name | NTID | AAID | NT Length | AA Length | score | probability |
|---|---|---|---|---|---|---|
| AI7503000984_3948408_c3_655 | 741 | 4513 | 777 | 258 | 315 | 3.1e-28 |

Description sp:[LN:XYNC_CALSA] [AC:P23553] [GN:XYNC] [OR:CALDOCELLUM SACCHAROLYTICUM] [SR:,CALDICELLULOSIRUPTOR SACCHAROLYTICUS] [EC:3.1.-.-] [DE:ACETYL ESTERASE, (ACETYLXYLOSIDASE)] [SP:P23553] [DB:swissprot] >pir:[LN:B37202] [AC:B37202 ] [PN:acetylesterase, (XynC)] [OR:Caldocellum saccharolyticum] [EC:3.1.1.6] [DB:pir2] >gp:[GI:g144297] [LN:CDCXYNAB] [AC:M34459] [OR:Caldicellulosiruptor saccharolyticus] [SR:C.saccharolyticum DNA, clone pNZ1400] [DB:genpept-bct1] [DE:C.saccharolyticum xylanase A (XynA), beta-xylosidase (XynB) andacetyl esterase (XynC) genes, complete cds.] [NT:acetyl esterase (XynC)] [LE:1257] [RE:2057] [DI:direct] >gp:[GI:g2645420] [LN:AF005383] [AC:AF005383] [PN:acetylxylosidase] [GN:XynC] [OR:Caldicellulosiruptor saccharolyticus] [DB:genpept-bct2] [DE:Caldicellulosiruptor saccharolyticus putative transport protein(XynG), putative transport protein (XynH), xylanase (XynF),xylanase (XynE), xylanase (XynD), xylanase (XynA), acetylxylosidase(XynC) and xylanase (XynB) genes, complete cds.] [LE:13673] [RE:14473] [DI:direct]

| ORF Name | NTID | AAID | NT Length | AA Length | score | probability |
|---|---|---|---|---|---|---|
| AI7503000984_4062925_f2_246 | 742 | 4514 | 393 | 130 | 103 | 7.8e-07 |

Description gp:[GI:g2072447] [LN:LLU93364] [AC:U93364] [PN:EpsJ] [GN:epsJ] [OR:Lactococcus lactis subsp. cremoris] [DB:genpept-bct2] [DE:Lactococcus lactis cremoris plasmid pNZ4000 insertion sequenceIS982 putative transposase gene and eps gene cluster(epsRXABCDEFGHIJKL), complete cds.] [LE:10209] [RE:11399] [DI:direct] >gp:[GI:g2072447] [LN:AF036485] [AC:AF036485:AF036486:AF036487:U93364] [PN:EpsJ] [GN:epsJ] [OR:Plasmid pNZ4000] [DB:genpept] [DE:Plasmid pNZ4000, complete sequence.] [LE:16729] [RE:17919] [DI:complement]

| ORF Name | NTID | AAID | NT Length | AA Length | score | probability |
|---|---|---|---|---|---|---|
| AI7503000984_4072680_f1_75 | 743 | 4515 | 774 | 257 | 311 | 8.2e-28 |

Description pir:[LN:A70039] [AC:A70039 ] [PN:ABC transporter (ATP-binding protein) homolog yvfR] [GN:yvfR ] [CL:ATP-binding cassette homology] [OR:Bacillus subtilis] [DB:pir2] >gp:[GI:e1186097:g2635922] [AC:Z99121:AL009126] [GN:yvfR] [FN:unknown] [OR:Bacillus subtilis] [DB:genpept-bct1] [DE:Bacillus subtilis complete genome (section 18 of 21): from 3399551to 3609060.] [NT:similar to ABC transporter (ATP-binding protein)] [LE:97865] [RE:98770] [DI:complement] >gp:[GI:e313073:g1945718] [LN:BSZ94043] [AC:Z94043] [PN:hypothetical protein] [GN:yvfR] [OR:Bacillus subtilis] [DB:genpept-bct1] [DE:B.subtilis genomic DNA fragment (88 kb).] [NT:probable ABC transporter] [LE:82901] [RE:83806] [DI:direct]

| ORF Name | NTID | AAID | NT Length | AA Length | score | probability |
|---|---|---|---|---|---|---|
| AI7503000984_4079382_f3_313 | 744 | 4516 | 243 | 80 | | |

Description
NO-HIT

| ORF Name | NTID | AAID | NT Length | AA Length | score | probability |
|---|---|---|---|---|---|---|
| AI7503000984_4094052_f3_330 | 745 | 4517 | 219 | 72 | | |

Description
NO-HIT

| ORF Name | NTID | AAID | NT Length | AA Length | score | probability |
|---|---|---|---|---|---|---|
| AI7503000984_4098385_f1_115 | 746 | 4518 | 129 | 42 | | |

Description
NO-HIT

| ORF Name | NTID | AAID | NT Length | AA Length | score | probability |
|---|---|---|---|---|---|---|
| AI7503000984_4101063_f1_113 | 747 | 4519 | 396 | 131 | 88 | 0.022 |

Description
pir:[LN:T02638] [AC:T02638 ] [PN:G2 protein homolog] [GN:g2 ] [OR:Dictyostelium discoideum] [DB:pir2] >gp:[GI:g3068587] [LN:AF000580] [AC:AF000580] [PN:G2-like] [GN:g2] [OR:Dictyostelium discoideum] [DB:genpept-inv1] [DE:Dictyostelium discoideum plasmid Ddp5, complete genome.] [NT:similar to plasmid Ddp1 g2/g3/d4 protein; possible] [LE:11232] [RE:12167] [DI:direct]

| ORF Name | NTID | AAID | NT Length | AA Length | score | probability |
|---|---|---|---|---|---|---|
| AI7503000984_4101640_c2_545 | 748 | 4520 | 3054 | 1017 | 680 | 1.9e-66 |

Description
sp:[LN:YQIG_BACSU] [AC:P54524] [GN:YQIG] [OR:BACILLUS SUBTILIS] [EC:1.-.-.-] [DE:PROBABLE NADH-DEPENDENT FLAVIN OXIDOREDUCTASE YQIG,] [SP:P54524] [DB:swissprot] >pir:[LN:C69961] [AC:C69961 ] [PN:NADH-dependent flavin oxidoreductase homolog yqiG] [GN:yqiG ] [OR:Bacillus subtilis] [DB:pir2] >gp:[GI:d1013261:g1303926] [LN:BACJH642] [AC:D84432:D82370] [PN:YqiG] [OR:Bacillus subtilis] [SR:Bacillus subtilis (strain:JH642(trpC2 PheA1)) DNA] [DB:genpept-bct1] [DE:Bacillus subtilis DNA, 283 Kb region containing skin element.] [LE:202096] [RE:203214] [DI:complement] >gp:[GI:e1185689:g2634855] [LN:BSUB0013] [AC:Z99116:AL009126] [GN:yqiG] [FN:unknown] [OR:Bacillus subtilis] [DB:genpept-bct1] [DE:Bacillus subtilis complete genome (section 13 of 21): from 2395261to 2613730.] [NT:similar to NADH-dependent flavin oxidoreductase] [SP:P54524] [LE:120407] [RE:121525] [DI:direct]

| ORF Name | NTID | AAID | NT Length | AA Length | score | probability |
|---|---|---|---|---|---|---|
| AI7503000984_4705053_c2_536 | 749 | 4521 | 1221 | 406 | 454 | 5.8e-43 |

Description
sp:[LN:BIOF_HAEIN] [AC:P44422] [GN:BIOF:HI1553] [OR:HAEMOPHILUS INFLUENZAE] [EC:2.3.1.47] [DE:LIGASE)] [SP:P44422] [DB:swissprot] >pir:[LN:D64129] [AC:D64129 ] [PN:8-amino-7-oxononanoate synthase homolog] [CL:5-aminolevulinate synthase] [OR:Haemophilus influenzae] [DB:pir2] >gp:[GI:g1574397] [LN:U32830] [AC:U32830:L42023] [PN:8-amino-7-oxononanoate synthase (bioF)] [GN:HI1553] [OR:Haemophilus influenzae Rd] [DB:genpept-bct2] [DE:Haemophilus influenzae Rd section 145 of 163 of the completegenome.] [NT:similar to SP:P53556 PID:1277027 PID:2293185] [LE:7529] [RE:8671] [DI:complement]

| ORF Name | NTID | AAID | NT Length | AA Length | score | probability |
|---|---|---|---|---|---|---|
| AI7503000984_4722131_f2_268 | 750 | 4522 | 141 | 46 | | |

Description
NO-HIT

| ORF Name | NTID | AAID | NT Length | AA Length | score | probability |
|---|---|---|---|---|---|---|
| AI7503000984_4765_f2_245 | 751 | 4523 | 321 | 106 | 90 | 0.0025 |

Description
gp:[GI:g5306152] [LN:AF160864] [AC:AF160864] [PN:haem lyase] [GN:yejR]
[OR:Mitochondrion Tetrahymena pyriformis] [SR:Tetrahymena pyriformis] [DB:genpept]
[DE:Tetrahymena pyriformis mitochondrial DNA, complete genome.] [NT:ATA initiation codon; ATG codon 128 nt downstream] [LE:18212] [RE:19750] [DI:complement]

| ORF Name | NTID | AAID | NT Length | AA Length | score | probability |
|---|---|---|---|---|---|---|
| AI7503000984_4773518_c3_664 | 752 | 4524 | 885 | 294 | 563 | 1.6e-54 |

Description
gp:[GI:e312302:g1944618] [LN:SEGAPLPP] [AC:Y12602] [PN:acid phosphatase] [GN:lppC]
[PN:cell membrane lipoprotein] [OR:Streptococcus equisimilis] [DB:genpept-bct1]
[DE:Streptococcus equisimilis gapC and lppC genes.] [LE:1390] [RE:2247] [DI:direct]

| ORF Name | NTID | AAID | NT Length | AA Length | score | probability |
|---|---|---|---|---|---|---|
| AI7503000984_4782963_c1_460 | 753 | 4525 | 1365 | 454 | 1105 | 6.0e-112 |

Description
pir:[LN:B70316] [AC:B70316 ] [PN:DAPA aminotransferase] [GN:bioA ]
[CL:beta-alanine--pyruvate transaminase] [OR:Aquifex aeolicus] [DB:pir2]
>gp:[GI:g2982887] [LN:AE000676] [AC:AE000676:AE000657] [PN:DAPA aminotransferase]
[GN:bioA] [OR:Aquifex aeolicus] [DB:genpept-bct2] [DE:Aquifex aeolicus section 8 of 109 of the complete genome.] [LE:10739] [RE:12100] [DI:complement]

| ORF Name | NTID | AAID | NT Length | AA Length | score | probability |
|---|---|---|---|---|---|---|
| AI7503000984_4797177_c2_566 | 754 | 4526 | 588 | 195 | 308 | 1.7e-27 |

Description
gp:[GI:d1011096:g1001205] [LN:SYCSLLE] [AC:D64003:AB001339] [PN:hypothetical protein]
[OR:Synechocystis sp.] [SR:Synechocystis sp. (strain:PCC6803) DNA] [DB:genpept-bct1]
[DE:Synechocystis sp. PCC6803 complete genome, 22/27, 2755703-2868766.]
[NT:ORF_ID:slr0895] [LE:7468] [RE:8031] [DI:direct]

| ORF Name | NTID | AAID | NT Length | AA Length | score | probability |
|---|---|---|---|---|---|---|
| AI7503000984_4798202_c3_623 | 755 | 4527 | 816 | 271 | 103 | 0.023 |

Description
pir:[LN:B71605] [AC:B71605 ] [PN:hypothetical protein PFB0850c] [GN:PFB0850c ]
[OR:Plasmodium falciparum] [DB:pir2] >gp:[GI:g3845292] [LN:AE001420]
[AC:AE001420:AE001362] [PN:hypothetical protein] [GN:PFB0850c] [OR:Plasmodium falciparum] [SR:malaria parasite P. falciparum] [DB:genpept-inv2] [DE:Plasmodium falciparum chromosome 2, section 57 of 73 of thecomplete sequence.] [NT:predicted by GlimmerM] [LE:11963] [RE:14386] [DI:complement]

| ORF Name | NTID | AAID | NT Length | AA Length | score | probability |
|---|---|---|---|---|---|---|
| AI7503000984_4800077_f3_350 | 756 | 4528 | 156 | 51 | | |

Description
NO-HIT

| ORF_Name | NTID | AAID | NT Length | AA Length | score | probability |
|---|---|---|---|---|---|---|
| AI7503000984_4859628_c3_603 | 757 | 4529 | 195 | 64 | | |

Description
NO-HIT

| ORF_Name | NTID | AAID | NT Length | AA Length | score | probability |
|---|---|---|---|---|---|---|
| AI7503000984_4867842_c3_652 | 758 | 4530 | 978 | 325 | 486 | 2.3e-46 |

Description
pir:[LN:E69400] [AC:E69400 ] [PN:3-hydroxyacyl-CoA dehydrogenase (hbd-8) homolog]
[OR:Archaeoglobus fulgidus] [DB:pir2] >gp:[GI:g2649379] [LN:AE001021]
[AC:AE001021:AE000782] [PN:3-hydroxyacyl-CoA dehydrogenase (hbd-8)] [GN:AF1206]
[OR:Archaeoglobus fulgidus] [DB:genpept-bct2] [DE:Archaeoglobus fulgidus section 86 of
172 of the complete genome.] [NT:similar to PID:1055222 SP:P52041 percent identity:]
[LE:9126] [RE:10073] [DI:complement]

| ORF_Name | NTID | AAID | NT Length | AA Length | score | probability |
|---|---|---|---|---|---|---|
| AI7503000984_4884812_f3_314 | 759 | 4531 | 1257 | 418 | 579 | 1.1e-78 |

Description
gp:[GI:e1358508:g3980137] [LN:LMO34616] [AC:AJ007319] [PN:succinyl-diaminopimelate
desuccinylase] [GN:dapE] [OR:Listeria monocytogenes] [DB:genpept-bct1] [DE:Listeria
monocytogenes ascB, inlG, inlH, inlE, dapE genes.] [LE:5533] [RE:6672] [DI:direct]

| ORF_Name | NTID | AAID | NT Length | AA Length | score | probability |
|---|---|---|---|---|---|---|
| AI7503000984_4895061_c2_561 | 760 | 4532 | 2271 | 756 | 2671 | 6.8e-278 |

Description
pir:[LN:S01788] [AC:S01788:B32305:F64829 ] [PN:formate C-acetyltransferase, 1:pyruvate
formate-lyase I] [GN:pflB:pfl ] [CL:formate C-acetyltransferase 1:glycyl radical
homology] [OR:Escherichia coli] [EC:2.3.1.54] [DB:pir1] [MP:20.5 ]
>gp:[GI:d1036624:g1651427] [LN:D90728] [AC:D90728:AB001340] [PN:Formate
c-acetyltransferase (EC 2.3.1.54).] [GN:pfl] [OR:Escherichia coli] [SR:Escherichia
coli(strain:K12) DNA, clone:Kohara clone #216] [DB:genpept-bct1] [DE:Escherichia coli
genomic DNA. (20.4 - 20.8 min).] [NT:ORF_ID:o216#7; similar to PIR Accession Number]
[LE:6965] [RE:9247] [DI:complement] >gp:[GI:g42370] [LN:ECPFL] [AC:X08035]
[OR:Escherichia coli] [DB:genpept-bct1] [DE:E. coli pfl gene for pyruvate formate-lyase
(EC 2.3.1.54).] [NT:pyruvate formate-lyase (AA 1-760)] [SP:P09373] [LE:101] [RE:2383]
[DI:direct] >gp:[GI:g1787131] [LN:AE000192:U00096] [AC:AE000192:U00096] [PN:formate
acetyltransferase 1] [GN:pflB] [FN:enzyme; Energy metabolism, carbon: Anaerobic]
[OR:Escherichia coli] [DB:genpept-bct2] [EC:2.3.1.54] [DE:Escherichia coli K-12 MG1655
section 82 of 400 of the completegenome.] [NT:f760; 100 pct identical to PFLB_ECOLI SW:
P09373] [LE:5588] [RE:7870] [DI:complement]

| ORF_Name | NTID | AAID | NT Length | AA Length | score | probability |
|---|---|---|---|---|---|---|
| AI7503000984_4974091_c2_569 | 761 | 4533 | 504 | 167 | 93 | 0.00087 |

Description
pir:[LN:B71359] [AC:B71359 ] [PN:conserved hypothetical protein TP0156] [GN:TP0156 ]
[OR:Treponema pallidum subsp. pallidum] [SR:, syphilis spirochete] [DB:pir2]
>gp:[GI:g3322423] [LN:AE001200] [AC:AE001200:AE000520] [PN:conserved hypothetical
protein] [GN:TP0156] [OR:Treponema pallidum] [DB:genpept-bct2] [DE:Treponema pallidum
section 16 of 87 of the complete genome.] [NT:similar to GB:L42023 SP:P44679
PID:1003656] [LE:2984] [RE:3388] [DI:complement]

| ORF Name | NTID | AAID | NT Length | AA Length | score | probability |
|---|---|---|---|---|---|---|
| AI7503000984_505301_f3_345 | 762 | 4534 | 291 | 96 | | |

Description
NO-HIT

| ORF Name | NTID | AAID | NT Length | AA Length | score | probability |
|---|---|---|---|---|---|---|
| AI7503000984_5109785_c3_670 | 763 | 4535 | 255 | 84 | 76 | 0.010 |

Description
gp:[GI:g4103231] [LN:AF021085] [AC:AF021085] [PN:cytochrome b] [GN:cytb]
[OR:Mitochondrion Edaphus sp.] [SR:Edaphus sp] [DB:genpept-inv2] [DE:Edaphus sp.
cytochrome b (cytb) gene, mitochondrial gene encodingmitochondrial protein, partial
cds.] [LE:<1] [RE:>465] [DI:direct]

| ORF Name | NTID | AAID | NT Length | AA Length | score | probability |
|---|---|---|---|---|---|---|
| AI7503000984_5113413_c3_653 | 764 | 4536 | 642 | 213 | 579 | 3.3e-56 |

Description
pir:[LN:D69670] [AC:D69670 ] [PN:glycine betaine/carnitine/choline ABC transporter
(membrane p) opuCB] [GN:opuCB ] [CL:glycine betaine/carnitine/choline ABC transporter]
[OR:Bacillus subtilis] [DB:pir2] >gp:[GI:g2271390] [LN:AF009352] [AC:AF009352]
[PN:transmembrane protein] [GN:opuCB] [OR:Bacillus subtilis] [DB:genpept-bct1]
[DE:Bacillus subtilis osmoprotectant transport system OpuC includingATPase (opuCA),
transmembrane protein (opuCB), osmoprotectantbinding protein precursor (opuCC) and
transmembrane protein (opuCD)genes, complete cds.] [NT:OpuCB; part of the
osmoprotectant transport system] [LE:2025] [RE:2678] [DI:direct]
>gp:[GI:e1186070:g2635895] [LN:BSUB0018] [AC:Z99121:AL009126] [PN:glycine
betaine/carnitine/choline ABC] [GN:opuCB] [FN:high affinity transport of glycine
betaine,] [OR:Bacillus subtilis] [DB:genpept-bct1] [DE:Bacillus subtilis complete
genome (section 18 of 21): from 3399551to 3609060.] [NT:alternate gene name: yvbD]
[LE:68697] [RE:69350] [DI:complement]

| ORF Name | NTID | AAID | NT Length | AA Length | score | probability |
|---|---|---|---|---|---|---|
| AI7503000984_5160925_c1_443 | 765 | 4537 | 192 | 63 | | |

Description
NO-HIT

| ORF Name | NTID | AAID | NT Length | AA Length | score | probability |
|---|---|---|---|---|---|---|
| AI7503000984_5189037_c3_620 | 766 | 4538 | 711 | 236 | 351 | 4.7e-32 |

Description
pir:[LN:H64461] [AC:H64461 ] [PN:6-carboxyhexanoate--CoA ligase,]
[CL:6-carboxyhexanoate--CoA ligase bioW] [OR:Methanococcus jannaschii] [EC:6.2.1.14]
[DB:pir2] [MP:FOR1244632-1245345 ] >gp:[GI:g1591935] [LN:U67570] [AC:U67570:L77117]
[PN:6-carboxyhexanoate-CoA ligase (bioW)] [GN:MJ1297] [OR:Methanococcus jannaschii]
[DB:genpept-bct2] [DE:Methanococcus jannaschii section 112 of 150 of the complete
genome.] [NT:similar to GB:M29291 SP:P22822 PID:142594 percent] [LE:6098] [RE:6811]
[DI:direct]

| ORF Name | NTID | AAID | NT Length | AA Length | score | probability |
|---|---|---|---|---|---|---|
| AI7503000984_5860630_c2_564 | 767 | 4539 | 171 | 56 | | |

Description
NO-HIT

| ORF Name | NTID | AAID | NT Length | AA Length | score | probability |
|---|---|---|---|---|---|---|
| AI7503000984_6056567_c1_490 | 768 | 4540 | 579 | 192 | 320 | 9.1e-29 |

Description
pir:[LN:D64866] [AC:D64866 ] [PN:hypothetical protein b1199] [OR:Escherichia coli] [DB:pir2] >gp:[GI:g1787449] [LN:AE000218] [AC:AE000218:U00096] [PN:putative dihydroxyacetone kinase (EC 2.7.1.2)] [GN:b1199] [FN:putative enzyme; Not classified] [OR:Escherichia coli] [DB:genpept-bct2] [DE:Escherichia coli K-12 MG1655 section 108 of 400 of the completegenome.] [NT:f210; 30 pct identical (16 gaps) to 181 residues] [LE:4528] [RE:5160] [DI:complement]

| ORF Name | NTID | AAID | NT Length | AA Length | score | probability |
|---|---|---|---|---|---|---|
| AI7503000984_625262_c1_430 | 769 | 4541 | 228 | 75 | 54 | 0.013 |

Description
gp:[GI:g765037] [LN:DROMTTRND] [AC:M18022] [PN:NADH dehydrogenase subunit 2] [OR:Mitochondrion Drosophila melanogaster] [SR:fruit fly] [DB:genpept-inv2] [DE:D.melanogaster Trp-tRNA, Cys-tRNA, Tyr-tRNA, NADH dehydrogenasesubunit 2 (3' end) cytochrome oxidase subunit 1 (5' end) genes.] [LE:<1] [RE:462] [DI:direct]

| ORF Name | NTID | AAID | NT Length | AA Length | score | probability |
|---|---|---|---|---|---|---|
| AI7503000984_6302217_c3_638 | 770 | 4542 | 948 | 315 | 1335 | 2.5e-136 |

Description
gp:[GI:g3800819] [LN:AF076683] [AC:AF076683] [PN:oligopeptide transporter putative membrane] [GN:opp-1B] [OR:Staphylococcus aureus] [DB:genpept-bct2] [DE:Staphylococcus aureus oligopeptide transporter putative substratebinding domain (opp-1A), oligopeptide transporter putative membranepermease domain (opp-1B), oligopeptide transporter putativemembrane permease domain (opp-1C), oligopeptide transporterputative ATPase domain (opp-1D), and oligopeptide transporterputative ATPase domain (opp-1F) genes, complete cds; and unknowngene.] [LE:1537] [RE:2472] [DI:direct]

| ORF Name | NTID | AAID | NT Length | AA Length | score | probability |
|---|---|---|---|---|---|---|
| AI7503000984_6725817_c3_658 | 771 | 4543 | 165 | 54 | | |

Description
NO-HIT

| ORF Name | NTID | AAID | NT Length | AA Length | score | probability |
|---|---|---|---|---|---|---|
| AI7503000984_7072825_c1_435 | 772 | 4544 | 774 | 257 | 459 | 1.7e-43 |

Description
gp:[GI:g4980796] [LN:AE001711] [AC:AE001711:AE000512] [PN:oxidoreductase, short chain] [GN:TM0297] [OR:Thermotoga maritima] [DB:genpept-bct2] [DE:Thermotoga maritima section 23 of 136 of the complete genome.] [NT:similar to SP:P50167 PID:763164 percent identity:] [LE:7161] [RE:7934] [DI:direct]

| ORF Name | NTID | AAID | NT Length | AA Length | score | probability |
|---|---|---|---|---|---|---|
| AI7503000984_800300_c1_458 | 773 | 4545 | 585 | 194 | 313 | 5.0e-28 |

Description
pir:[LN:S23693] [AC:S23693 ] [PN:erythrocyte membrane-associated antigen (clone pPf K19)] [OR:Plasmodium falciparum] [DB:pir2]

| ORF Name | NTID | AAID | NT Length | AA Length | score | probability |
|---|---|---|---|---|---|---|
| AI7503000984_814140_c1_437 | 774 | 4546 | 1422 | 473 | 1168 | 1.3e-118 |

Description sp:[LN:UHPT_ECOLI] [AC:P13408:P76727] [GN:UHPT] [OR:ESCHERICHIA COLI] [DE:HEXOSE PHOSPHATE TRANSPORT PROTEIN] [SP:P13408:P76727] [DB:swissprot] >pir:[LN:MMECHP] [AC:A30395:H41853:C65168:Q00500:S30079 ] [PN:hexose phosphate transport protein uhpT] [GN:uhpT ] [CL:hexose phosphate transport protein uhpT] [OR:Escherichia coli] [DB:pir1] [MP:82 min ] >gp:[GI:g148115] [LN:ECOUHP] [AC:M17102] [OR:Escherichia coli] [SR:E.coli DNA, clone pRJK10] [DB:genpept-bct1] [DE:E.coli uhp operon encoding UhpA, UhpB, UhpC, and UhpT protein,(encoding hexose phosphate transport protein), complete cds, and anilvBN operon encoded protein, 3' end.] [NT:hexose phosphate transport protein UhpT] [LE:3722] [RE:5113] [DI:direct] >gp:[GI:g148120] [LN:ECOUHPABCT] [AC:M89479] [PN:hexosephosphate transport protein] [GN:uhpT] [OR:Escherichia coli] [SR:Escherichia coli DNA] [DB:genpept-bct1] [DE:Escherichia coli uhpABCT operon encoding hexosephosphateutilization protein (uhpA) gene, complete cds, and hexosephosphatetransport protein (uhpB, uhpC, uhpT) genes, complete cds.] [LE:3722] [RE:5113] [DI:direct] >gp:[GI:g2367259] [LN:AE000444] [AC:AE000444:U00096] [PN:hexose phosphate transport protein] [GN:uhpT] [FN:transport; Transport of small molecules;] [OR:Escherichia coli] [DB:genpept-bct2] [DE:Escherichia coli K-12 MG1655 section 334 of 400 of the completegenome.] [NT:f463; 99 pct identical amino acid sequence and] [LE:5590] [RE:6981] [DI:complement]

| ORF Name | NTID | AAID | NT Length | AA Length | score | probability |
|---|---|---|---|---|---|---|
| AI7503000984_81525_f3_398 | 775 | 4547 | 135 | 44 | | |

Description
NO-HIT

| ORF Name | NTID | AAID | NT Length | AA Length | score | probability |
|---|---|---|---|---|---|---|
| AI7503000984_816878_c3_637 | 776 | 4548 | 1632 | 543 | 2188 | 1.0e-226 |

Description gp:[GI:g3800818] [LN:AF076683] [AC:AF076683] [PN:oligopeptide transporter putative substrate] [GN:opp-1A] [OR:Staphylococcus aureus] [DB:genpept-bct2] [DE:Staphylococcus aureus oligopeptide transporter putative substratebinding domain (opp-1A), oligopeptide transporter putative membranepermease domain (opp-1B), oligopeptide transporter putativemembrane permease domain (opp-1C), oligopeptide transporterputative ATPase domain (opp-1D), and oligopeptide transporterputative ATPase domain (opp-1F) genes, complete cds; and unknowngene.] [LE:64] [RE:1524] [DI:direct]

| ORF Name | NTID | AAID | NT Length | AA Length | score | probability |
|---|---|---|---|---|---|---|
| AI7503000984_822150_f2_262 | 777 | 4549 | 516 | 171 | 89 | 0.028 |

Description gp:[GI:d1006984:g567946] [LN:PXMTGBP] [AC:D30753] [PN:21K protein] [FN:Presumably cell to cell movement] [OR:Potato mop-top virus] [SR:Potato mop-top virus (individual_isolate Todd) (library: Tb2-1) [DB:genpept-vrl] [DE:Potato mop-top virus RNA for 51K protein, 13K protein, 21K proteinand 8K protein, complete cds.] [NT:putative] [LE:1961] [RE:2533] [DI:direct]

| ORF Name | NTID | AAID | NT Length | AA Length | score | probability |
|---|---|---|---|---|---|---|
| AI7503000984_875765_c2_525 | 778 | 4550 | 210 | 69 | | |

Description
NO-HIT

| ORF Name | NTID | AAID | NT Length | AA Length | score | probability |
|---|---|---|---|---|---|---|
| AI7503000984_969157_c1_420 | 779 | 4551 | 1026 | 341 | 220 | 8.5e-16 |

Description
gp:[GI:g3800818] [LN:AF076683] [AC:AF076683] [PN:oligopeptide transporter putative substrate] [GN:opp-1A] [OR:Staphylococcus aureus] [DB:genpept-bct2] [DE:Staphylococcus aureus oligopeptide transporter putative substratebinding domain (opp-1A), oligopeptide transporter putative membranepermease domain (opp-1B), oligopeptide transporter putativemembrane permease domain (opp-1C), oligopeptide transporterputative ATPase domain (opp-1D), and oligopeptide transporterputative ATPase domain (opp-1F) genes, complete cds; and unknowngene.] [LE:64] [RE:1524] [DI:direct]

| ORF Name | NTID | AAID | NT Length | AA Length | score | probability |
|---|---|---|---|---|---|---|
| AI7503000984_9806718_c1_474 | 780 | 4552 | 762 | 253 | 862 | 3.4e-86 |

Description
gp:[GI:g3800822] [LN:AF076683] [AC:AF076683] [PN:oligopeptide transporter putative ATPase domain] [GN:opp-1F] [OR:Staphylococcus aureus] [DB:genpept-bct2] [DE:Staphylococcus aureus oligopeptide transporter putative substratebinding domain (opp-1A), oligopeptide transporter putative membranepermease domain (opp-1B), oligopeptide transporter putativemembrane permease domain (opp-1C), oligopeptide transporterputative ATPase domain (opp-1D), and oligopeptide transporterputative ATPase domain (opp-1F) genes, complete cds; and unknowngene.] [LE:4137] [RE:4892] [DI:direct]

| ORF Name | NTID | AAID | NT Length | AA Length | score | probability |
|---|---|---|---|---|---|---|
| AI7503000984_984686_c1_478 | 781 | 4553 | 1221 | 406 | 1172 | 4.8e-119 |

Description
pir:[LN:C69670] [AC:C69670 ] [PN:glycine betaine/carnitine/choline ABC transporter (ATP-bindin) opuCA] [GN:opuCA ] [CL:glycine betaine/proline transport protein proV: ATP-binding cassette homology:CBS homology] [OR:Bacillus subtilis] [DB:pir2]
>gp:[GI:g2271389] [LN:AF009352] [AC:AF009352] [PN:ATPase] [GN:opuCA] [OR:Bacillus subtilis] [DB:genpept-bct1] [DE:Bacillus subtilis osmoprotectant transport system OpuC includingATPase (opuCA), transmembrane protein (opuCB), osmoprotectantbinding protein precursor (opuCC) and transmembrane protein (opuCD)genes, complete cds.] [NT:OpuCA; part of the osmoprotectant transport system] [LE:860] [RE:2002] [DI:direct]
>gp:[GI:e1186071:g2635896] [LN:BSUB0018] [AC:Z99121:AL009126] [PN:glycine betaine/carnitine/choline ABC] [GN:opuCA] [FN:high affinity transport of glycine betaine,] [OR:Bacillus subtilis] [DB:genpept-bct1] [DE:Bacillus subtilis complete genome (section 18 of 21): from 3399551to 3609060.] [NT:alternate gene name: yvbE] [LE:69373] [RE:70515] [DI:complement]

| ORF Name | NTID | AAID | NT Length | AA Length | score | probability |
|---|---|---|---|---|---|---|
| AI7503000984_9970167_f3_393 | 782 | 4554 | 861 | 286 | 219 | 2.9e-25 |

Description
pir:[LN:E69796] [AC:E69796 ] [PN:two-component response regulator [YesM] homolog yesN] [GN:yesN ] [CL:response regulator homology] [OR:Bacillus subtilis] [DB:pir2]
>gp:[GI:e1182675:g2633009] [LN:BSUB0004] [AC:Z99107:AL009126] [GN:yesN] [FN:unknown] [OR:Bacillus subtilis] [DB:genpept-bct1] [DE:Bacillus subtilis complete genome (section 4 of 21): from 600701 to813890.] [NT:similar to two-component response regulator [YesM]] [LE:159260] [RE:160366] [DI:direct]

| ORF Name | NTID | AAID | NT Length | AA Length | score | probability |
|---|---|---|---|---|---|---|
| AI7503000984_9973515_c1_495 | 783 | 4555 | 261 | 86 | | |

Description
NO-HIT

| ORF Name | NTID | AAID | NT Length | AA Length | score | probability |
|---|---|---|---|---|---|---|
| AI7503000985_10000183_c3_2061 | 784 | 4556 | 168 | 55 | | |

Description
NO-HIT

| ORF Name | NTID | AAID | NT Length | AA Length | score | probability |
|---|---|---|---|---|---|---|
| AI7503000985_10034627_f3_956 | 785 | 4557 | 144 | 47 | | |

Description
NO-HIT

| ORF Name | NTID | AAID | NT Length | AA Length | score | probability |
|---|---|---|---|---|---|---|
| AI7503000985_10195252_f2_807 | 786 | 4558 | 126 | 41 | | |

Description
NO-HIT

| ORF Name | NTID | AAID | NT Length | AA Length | score | probability |
|---|---|---|---|---|---|---|
| AI7503000985_10203501_c2_1757 | 787 | 4559 | 156 | 51 | | |

Description
NO-HIT

| ORF Name | NTID | AAID | NT Length | AA Length | score | probability |
|---|---|---|---|---|---|---|
| AI7503000985_10241433_c1_1640 | 788 | 4560 | 126 | 41 | 104 | 1.4e-05 |

Description
sp:[LN:YDGI_BACSU] [AC:P96707] [GN:YDGI] [OR:BACILLUS SUBTILIS] [EC:1.-.-.-]
[DE:PUTATIVE NAD(P)H NITROREDUCTASE YDGI,] [SP:P96707] [DB:swissprot] >pir:[LN:C69783]
[AC:C69783 ] [PN:NADH dehydrogenase homolog ydgI] [GN:ydgI ] [CL:nitroreductase]
[OR:Bacillus subtilis] [DB:pir2] >gp:[GI:d1020152:g1881372] [LN:AB001488] [AC:AB001488]
[GN:ydgI] [OR:Bacillus subtilis] [SR:Bacillus subtilis (strain:168) DNA]
[DB:genpept-bct1] [DE:Bacillus subtilis genome sequence, 148 kb sequence of the
regionbetween 35 and 47 degree.] [NT:SIMILAR TO NITROREDUCTASE.] [LE:145410]
[RE:146039] [DI:complement] >gp:[GI:e1182545:g2632879] [LN:BSUB0004]
[AC:Z99107:AL009126] [GN:ydgI] [FN:unknown] [OR:Bacillus subtilis] [DB:genpept-bct1]
[DE:Bacillus subtilis complete genome (section 4 of 21): from 600701 to813890.]
[NT:similar to NADH dehydrogenase] [SP:P96707] [LE:11206] [RE:11835] [DI:complement]

| ORF Name | NTID | AAID | NT Length | AA Length | score | probability |
|---|---|---|---|---|---|---|
| AI7503000985_10332262_f1_254 | 789 | 4561 | 366 | 121 | | |

Description
NO-HIT

| ORF Name | NTID | AAID | NT Length | AA Length | score | probability |
|---|---|---|---|---|---|---|
| AI7503000985_1046885_f1_82 | 790 | 4562 | 2217 | 738 | 1356 | 1.5e-138 |

Description
gp:[GI:e245927:g2462047] [LN:ACRBDOXN] [AC:Z46863] [PN:polyphosphate kinase] [GN:ppk]
[OR:Acinetobacter sp. ADP1] [DB:genpept-bct1] [DE:Acinetobacter sp. cysD, cobQ, sodM,
lysS, rubA, rubB, estB, oxyR,ppk, mtgA, ORF2 and ORF3 genes.] [NT:putative;
transcription of ppk is induced by] [LE:9244] [RE:11319] [DI:complement]

| ORF Name | NTID | AAID | NT Length | AA Length | score | probability |
|---|---|---|---|---|---|---|
| AI7503000985_10585432_c1_1539 | 791 | 4563 | 591 | 196 | 171 | 2.3e-18 |

Description sp:[LN:GGT_BACSU] [AC:P54422] [GN:GGT] [OR:BACILLUS SUBTILIS] [EC:2.3.2.2]
[DE:GAMMA-GLUTAMYLTRANSPEPTIDASE PRECURSOR,] [SP:P54422] [DB:swissprot]
>pir:[LN:F69631] [AC:F69631:JC5867:PC4504 ] [PN:gamma-glutamyltransferase,
precursor:gamma glutamyl transpeptidase] [GN:ggt ] [CL:gamma-glutamyltransferase]
[OR:Bacillus subtilis] [EC:2.3.2.2] [DB:pir2] >gp:[GI:e1183499:g2634224] [LN:BSUB0010]
[AC:Z99113:AL009126] [PN:gamma-glutamyltranspeptidase] [GN:ggt] [FN:glutathione
metabolism] [OR:Bacillus subtilis] [DB:genpept-bct1] [EC:2.3.2.2] [DE:Bacillus subtilis
complete genome (section 10 of 21): from 1781201to 2014980.] [NT:alternate gene name:
pac] [SP:P54422] [LE:222733] [RE:224496] [DI:direct] >gp:[GI:e1185314:g2634235]
[LN:BSUB0011] [AC:Z99114:AL009126] [PN:gamma-glutamyltranspeptidase] [GN:ggt]
[FN:glutathione metabolism] [OR:Bacillus subtilis] [DB:genpept-bct1] [EC:2.3.2.2]
[DE:Bacillus subtilis complete genome (section 11 of 21): from 2000171to 2207900.]
[NT:alternate gene name: pac] [SP:P54422] [LE:3763] [RE:5526] [DI:direct]
>gp:[GI:g1491813] [LN:BSU49358] [AC:U49358] [PN:gamma-glutamyltranspeptidase] [GN:ggt]
[OR:Bacillus subtilis] [SR:Bacillus subtilis strain=JH642] [DB:genpept-bct2]
[DE:Bacillus subtilis gamma-glutamyltranspeptidase (ggt) gene, completecds.] [LE:250]
[RE:2013] [DI:direct]

| ORF Name | NTID | AAID | NT Length | AA Length | score | probability |
|---|---|---|---|---|---|---|
| AI7503000985_10600010_c2_1931 | 792 | 4564 | 192 | 63 | | |

Description
NO-HIT

| ORF Name | NTID | AAID | NT Length | AA Length | score | probability |
|---|---|---|---|---|---|---|
| AI7503000985_10601625_c3_2039 | 793 | 4565 | 231 | 76 | 55 | 0.0050 |

Description gp:[GI:e1286089:g3036830] [LN:CJAJ0856] [AC:AJ000856] [PN:ABC transporter protein]
[GN:kpsM] [OR:Campylobacter jejuni] [DB:genpept-bct1] [DE:Campylobacter jejuni kpsM,
kpsT genes.] [LE:134] [RE:916] [DI:direct]

| ORF Name | NTID | AAID | NT Length | AA Length | score | probability |
|---|---|---|---|---|---|---|
| AI7503000985_10605337_c2_1945 | 794 | 4566 | 747 | 248 | 706 | 1.1e-69 |

Description gp:[GI:g666983] [LN:BSPAAT] [AC:X77636] [PN:putative ATP binding subunit] [GN:ORF3]
[OR:Bacillus subtilis] [DB:genpept-bct1] [DE:B.subtilis putative amino acid transporter
gene.] [NT:potential ABC-transport system] [SP:P39456] [LE:1627] [RE:2370] [DI:direct]

| ORF Name | NTID | AAID | NT Length | AA Length | score | probability |
|---|---|---|---|---|---|---|
| AI7503000985_1063552_f3_982 | 795 | 4567 | 390 | 129 | | |

Description
NO-HIT

| ORF Name | NTID | AAID | NT Length | AA Length | score | probability |
|---|---|---|---|---|---|---|
| AI7503000985_1064050_f2_826 | 796 | 4568 | 150 | 49 | | |

Description
NO-HIT

| ORF_Name | NTID | AAID | NT Length | AA Length | score | probability |
|---|---|---|---|---|---|---|
| AI7503000985_10657827_c1_1607 | 797 | 4569 | 1401 | 466 | 393 | 1.7e-36 |

Description
gp:[GI:e304997:g2294506] [LN:A37836] [AC:A37836] [OR:Streptomyces pristinaespiralis] [DB:genpept-pat] [DE:Sequence 6 from Patent WO9408014.] [NT:unnamed protein product] [LE:103] [RE:1689] [DI:direct]

| ORF_Name | NTID | AAID | NT Length | AA Length | score | probability |
|---|---|---|---|---|---|---|
| AI7503000985_10667002_c2_1653 | 798 | 4570 | 129 | 42 | | |

Description
NO-HIT

| ORF_Name | NTID | AAID | NT Length | AA Length | score | probability |
|---|---|---|---|---|---|---|
| AI7503000985_10667003_f1_29 | 799 | 4571 | 174 | 57 | | |

Description
NO-HIT

| ORF_Name | NTID | AAID | NT Length | AA Length | score | probability |
|---|---|---|---|---|---|---|
| AI7503000985_10718762_f1_204 | 800 | 4572 | 165 | 54 | | |

Description
NO-HIT

| ORF_Name | NTID | AAID | NT Length | AA Length | score | probability |
|---|---|---|---|---|---|---|
| AI7503000985_10736312_c1_1452 | 801 | 4573 | 132 | 43 | | |

Description
NO-HIT

| ORF_Name | NTID | AAID | NT Length | AA Length | score | probability |
|---|---|---|---|---|---|---|
| AI7503000985_1074177_c2_1838 | 802 | 4574 | 825 | 274 | 417 | 4.8e-39 |

Description
pir:[LN:F64819] [AC:F64819 ] [PN:hypothetical protein b0822] [OR:Escherichia coli] [DB:pir2] >gp:[GI:d1036489:g4062389] [LN:D90719] [AC:D90719:AB001340] [PN:Hypothetical protein 1] [OR:Escherichia coli] [SR:Escherichia coli(strain:K12) DNA, clone:Kohara clone #206] [DB:genpept-bct1] [DE:Escherichia coli genomic DNA. (18.2 - 18.6 min).] [NT:ORF_ID:o207#5; similar to PIR Accession Number] [LE:13745] [RE:14560] [DI:complement] >gp:[GI:d1036496:g4062396] [LN:D90720] [AC:D90720:AB001340] [PN:Hypothetical protein 1] [OR:Escherichia coli] [SR:Escherichia coli(strain:K12) DNA, clone:Kohara clone #207] [DB:genpept-bct1] [DE:Escherichia coli genomic DNA. (18.4 - 18.8 min).] [NT:ORF_ID:o207#5; similar to PIR Accession Number] [LE:5774] [RE:6589] [DI:complement] >gp:[GI:g1787043] [LN:AE000184] [AC:AE000184:U00096] [PN:orf, hypothetical protein] [GN:b0822] [FN:orf; Unknown] [OR:Escherichia coli] [DB:genpept-bct2] [DE:Escherichia coli K-12 MG1655 section 74 of 400 of the completegenome.] [NT:f271; This 271 aa ORF is 24 pct identical (16 gaps)] [LE:6609] [RE:7424] [DI:complement]

| ORF Name | NTID | AAID | NT Length | AA Length | score | probability |
|---|---|---|---|---|---|---|
| AI7503000985_10756925_f1_228 | 803 | 4575 | 1566 | 521 | 793 | 6.9e-79 |

Description
gp:[GI:d1020925:g2116759] [LN:D86418] [AC:D86418] [PN:YfnA] [OR:Bacillus subtilis]
[SR:Bacillus subtilis (strain:AC327) DNA] [DB:genpept-bct1] [DE:Bacillus subtilis
genomic DNA 69-70 degree region, partialsequence.] [LE:7539] [RE:8927] [DI:direct]

| ORF Name | NTID | AAID | NT Length | AA Length | score | probability |
|---|---|---|---|---|---|---|
| AI7503000985_10938903_f1_322 | 804 | 4576 | 144 | 47 | | |

Description
NO-HIT

| ORF Name | NTID | AAID | NT Length | AA Length | score | probability |
|---|---|---|---|---|---|---|
| AI7503000985_10954127_f3_1025 | 805 | 4577 | 201 | 66 | | |

Description
NO-HIT

| ORF Name | NTID | AAID | NT Length | AA Length | score | probability |
|---|---|---|---|---|---|---|
| AI7503000985_10973385_c3_2080 | 806 | 4578 | 312 | 103 | 80 | 0.010 |

Description
gp:[GI:g4731918] [LN:AF111944] [AC:AF111944] [PN:development protein DG1122]
[GN:DG1122] [OR:Dictyostelium discoideum] [DB:genpept-inv2] [DE:Dictyostelium
discoideum AX4 development protein DG1122 (DG1122)gene, partial cds.] [LE:207:829]
[RE:744:>1036] [DI:directJoin]

| ORF Name | NTID | AAID | NT Length | AA Length | score | probability |
|---|---|---|---|---|---|---|
| AI7503000985_11063801_f1_381 | 807 | 4579 | 225 | 74 | | |

Description
NO-HIT

| ORF Name | NTID | AAID | NT Length | AA Length | score | probability |
|---|---|---|---|---|---|---|
| AI7503000985_11132010_c1_1519 | 808 | 4580 | 126 | 41 | | |

Description
NO-HIT

| ORF Name | NTID | AAID | NT Length | AA Length | score | probability |
|---|---|---|---|---|---|---|
| AI7503000985_115761_c3_2118 | 809 | 4581 | 1458 | 485 | 799 | 1.6e-79 |

Description
pir:[LN:S77243] [AC:S77243 ] [PN:hypothetical protein slr1363] [OR:Synechocystis sp.]
[SR:PCC 6803, , PCC 6803] [SR:PCC 6803, ] [DB:pir2] >gp:[GI:d1018310:g1652657]
[LN:D90907] [AC:D90907:AB001339] [PN:hypothetical protein] [GN:glgP] [OR:Synechocystis
sp.] [SR:Synechocystis sp. (strain:PCC6803) DNA] [DB:genpept-bct1] [DE:Synechocystis
sp. PCC6803 complete genome, 9/27, 1056467-1188885.] [NT:ORF_ID:slr1363] [LE:49200]
[RE:50702] [DI:direct]

| ORF Name | NTID | AAID | NT Length | AA Length | score | probability |
|---|---|---|---|---|---|---|
| AI7503000985_117150_f1_173 | 810 | 4582 | 1311 | 436 | 1525 | 1.9e-156 |

Description
gp:[GI:g4096796] [LN:SCU40157] [AC:U40157] [OR:Staphylococcus carnosus]
[DB:genpept-bct2] [DE:Staphylococcus carnosus condensing-enzyme-like protein (orf1) andSpoVE-like protein (orf2) genes, complete cds.] [NT:orf1; unknown function; similar to] [LE:193] [RE:1362] [DI:direct]

| ORF Name | NTID | AAID | NT Length | AA Length | score | probability |
|---|---|---|---|---|---|---|
| AI7503000985_1173130_c1_1530 | 811 | 4583 | 2091 | 696 | 2666 | 2.3e-277 |

Description
pir:[LN:S46952] [AC:S46952:S63605 ] [PN:phosphotransferase system enzyme II,, glucose-specific, factor IIA:glucose permease:phosphoenolpyruvate:glucose phosphotransferase system enzyme II, glucose-specific:phosphotransferase system enzyme II, glucose-specific, factor 1:protein-Npi-phosphohistidine--sugar phosphotransferase, glucose-specific, factor II] [GN:glcA:ptsG ] [CL:phosphotransferase system N-acetylglucosamine-specific enzyme II:phosphotransferase system glucose-specific enzyme II, factor II homology:phosphotransferase system glucose-specific enzyme II, factor III homology] [OR:Staphylococcus carnosus] [EC:2.7.1.69] [DB:pir1]
>gp:[GI:g1072418] [LN:SCGLCAB] [AC:X93360:X80415] [GN:glcA] [OR:Staphylococcus carnosus] [DB:genpept-bct1] [DE:S.carnosus glcA gene and glcB gene.] [LE:540] [RE:2567] [DI:direct]

| ORF Name | NTID | AAID | NT Length | AA Length | score | probability |
|---|---|---|---|---|---|---|
| AI7503000985_11756543_f2_497 | 812 | 4584 | 231 | 76 | | |

Description
NO-HIT

| ORF Name | NTID | AAID | NT Length | AA Length | score | probability |
|---|---|---|---|---|---|---|
| AI7503000985_1178593_f3_990 | 813 | 4585 | 1590 | 529 | 1527 | 1.1e-156 |

Description
pir:[LN:C69794] [AC:C69794 ] [PN:glutamate synthase (ferredoxin) homolog yerD] [GN:yerD ] [OR:Bacillus subtilis] [DB:pir2] >gp:[GI:e1182639:g2632973] [LN:BSUB0004]
[AC:Z99107:AL009126] [GN:yerD] [FN:unknown] [OR:Bacillus subtilis] [DB:genpept-bct1]
[DE:Bacillus subtilis complete genome (section 4 of 21): from 600701 to813890.]
[NT:similar to glutamate synthase (ferredoxin)] [LE:115586] [RE:117163] [DI:complement]
>gp:[GI:e1167974:g2577963] [LN:BSYERABCD] [AC:Y15254] [PN:YerD protein] [GN:yerD]
[OR:Bacillus subtilis] [DB:genpept-bct1] [DE:Bacillus subtilis 13kB DNA fragment, from yerA to sapB gene.] [NT:similar to plectonema boryanum large subunit of] [LE:3231]
[RE:4808] [DI:complement]

| ORF Name | NTID | AAID | NT Length | AA Length | score | probability |
|---|---|---|---|---|---|---|
| AI7503000985_1180292_c1_1536 | 814 | 4586 | 1164 | 387 | 1050 | 4.0e-106 |

Description
pir:[LN:F70069] [AC:F70069 ] [PN:capsular polyglutamate biosynthesis homolog ywsC]
[GN:ywsC ] [OR:Bacillus subtilis] [DB:pir2] >gp:[GI:e1184496:g2636115] [LN:BSUB0019]
[AC:Z99122:AL009126] [GN:ywsC] [FN:unknown] [OR:Bacillus subtilis] [DB:genpept-bct1]
[DE:Bacillus subtilis complete genome (section 19 of 21): from 3597091to 3809700.]
[NT:similar to capsular polyglutamate biosynthesis] [LE:101413] [RE:102594]
[DI:complement] >gp:[GI:e1184496:g2636115] [LN:BSUB0019] [AC:Z99122:AL009126] [GN:ywsC]
[FN:unknown] [OR:Bacillus subtilis] [DB:genpept] [DE:Bacillus subtilis complete genome (section 19 of 21): from 3597091to 3809700.] [NT:similar to capsular polyglutamate biosynthesis] [LE:101413] [RE:102594] [DI:complement]

| ORF Name | NTID | AAID | NT Length | AA Length | score | probability |
|---|---|---|---|---|---|---|
| AI7503000985_11855463_c3_2075 | 815 | 4587 | 747 | 248 | 791 | 1.1e-78 |

Description pir:[LN:H69611] [AC:H69611 ] [PN:3'-phosphoadenosine 5'-phosphosulfate reductase, cysH:3'-phosphoadenylylsulfate reductase, thioredoxin dependent: PAPS reductase:PAPS sulfotransferase] [GN:cysH ] [OR:Bacillus subtilis] [EC:1.8.99.4] [DB:pir2]
>gp:[GI:e332183:g2462956] [LN:BSPYREYLO] [AC:AJ000974] [PN:putative phospho-adenylylsulphate] [GN:cysH] [OR:Bacillus subtilis] [DB:genpept-bct1] [DE:Bacillus subtilis pyrE to yloA gene region.] [LE:548] [RE:1249] [DI:direct]
>gp:[GI:e1185149:g2633930] [LN:BSUB0009] [AC:Z99112:AL009126] [PN:phosphoadenosine phosphosulfate] [GN:cysH] [FN:cysteine biosynthesis] [OR:Bacillus subtilis] [DB:genpept-bct1] [EC:1.8.99.4] [DE:Bacillus subtilis complete genome (section 9 of 21): from 1598421to 1807200.] [LE:31361] [RE:32062] [DI:direct]

| ORF Name | NTID | AAID | NT Length | AA Length | score | probability |
|---|---|---|---|---|---|---|
| AI7503000985_11881630_f2_658 | 816 | 4588 | 132 | 43 | | |

Description
NO-HIT

| ORF Name | NTID | AAID | NT Length | AA Length | score | probability |
|---|---|---|---|---|---|---|
| AI7503000985_11886592_c2_1671 | 817 | 4589 | 654 | 217 | 481 | 8.0e-46 |

Description sp:[LN:HIS2_HAEIN] [AC:P44434] [GN:HISI:HISIE:HI0475] [OR:HAEMOPHILUS INFLUENZAE] [EC:3.5.4.19:3.6.1.31] [DE:PYROPHOSPHOHYDROLASE,] [SP:P44434] [DB:swissprot]
>pir:[LN:A64071] [AC:A64071 ] [PN:phosphoribosyl-AMP cyclohydrolase, / phosphoribosyl-ATP pyrophosphatase,] [CL:hisI bifunctional enzyme:hisI bifunctional enzyme homology:hisI protein homology] [OR:Haemophilus influenzae] [EC:3.5.4.19:3.6.1.31] [DB:pir2] >gp:[GI:g1573454] [LN:U32730] [AC:U32730:L42023] [PN:phosphoribosyl-AMP cyclohydrolase /] [GN:HI0475] [OR:Haemophilus influenzae Rd] [DB:genpept-bct2] [DE:Haemophilus influenzae Rd section 45 of 163 of the complete genome.] [NT:similar to SP:P06989 GB:D43637 GB:U02072 GB:X03974] [LE:4576] [RE:5241] [DI:direct]

| ORF Name | NTID | AAID | NT Length | AA Length | score | probability |
|---|---|---|---|---|---|---|
| AI7503000985_11955127_f1_420 | 818 | 4590 | 144 | 47 | | |

Description
NO-HIT

| ORF Name | NTID | AAID | NT Length | AA Length | score | probability |
|---|---|---|---|---|---|---|
| AI7503000985_119633_f1_70 | 819 | 4591 | 1389 | 462 | 494 | 3.3e-47 |

Description
pir:[LN:B69680] [AC:B69680:I40510 ] [PN:para-nitrobenzyl esterase,] [GN:pnbA ]
[CL:cholinesterase homology] [OR:Bacillus subtilis] [EC:3.1.1.-] [DB:pir2]
>gp:[GI:g1762126] [LN:BSU46134] [AC:U46134] [PN:intracellular esterase B] [GN:estB]
[OR:Bacillus subtilis] [DB:genpept-bct1] [EC:3.1.1.1] [DE:Bacillus subtilis putative
orf1 unknown protein, putativetranscriptional regulator (slr), and intracellular
esterase B(estB) genes, complete cds.] [NT:EstB; esterase of the serine-hydrolase
family] [LE:1035] [RE:2504] [DI:direct] >gp:[GI:e1186127:g2635952] [LN:BSUB0018]
[AC:Z99121:AL009126] [PN:para-nitrobenzyl esterase (intracellular)] [GN:pnbA]
[OR:Bacillus subtilis] [DB:genpept-bct1] [EC:3.1.1.1] [DE:Bacillus subtilis complete
genome (section 18 of 21): from 3399551to 3609060.] [NT:alternate gene name: estB]
[LE:130145] [RE:131614] [DI:direct] >gp:[GI:e238702:g1495277] [LN:BSYVEFGNS]
[AC:Z71928] [PN:para-nitrobenzyl esterase] [GN:pnbA] [OR:Bacillus subtilis]
[DB:genpept-bct1] [DE:B.subtilis pnbA, sigL, yve[J,K,L,M,N,O,P,Q,R,S,T]
andyvf[A,B,C,D,E,F,G,H] genes.] [LE:132] [RE:1601] [DI:complement]
>gp:[GI:e313129:g1945688] [LN:BSZ94043] [AC:Z94043] [PN:para-nitrobenzyl esterase]
[GN:pnbA] [OR:Bacillus subtilis] [DB:genpept-bct1] [DE:B.subtilis genomic DNA fragment
(88 kb).] [LE:50057] [RE:51526] [DI:complement]

| ORF Name | NTID | AAID | NT Length | AA Length | score | probability |
|---|---|---|---|---|---|---|
| AI7503000985_1207287_c2_1669 | 820 | 4592 | 621 | 206 | 365 | 1.6e-33 |

Description
sp:[LN:HIS1_LACLA] [AC:Q02129] [GN:HISG] [OR:LACTOCOCCUS LACTIS]
[SR:,SUBSPLACTIS:STREPTOCOCCUS LACTIS] [EC:2.4.2.17] [DE:ATP
PHOSPHORIBOSYLTRANSFERASE,] [SP:Q02129] [DB:swissprot] >pir:[LN:D45734] [AC:D45734 ]
[PN:HisG] [OR:Lactococcus lactis subsp. lactis] [DB:pir2] >gp:[GI:g2565141]
[LN:LLU92974] [AC:U92974:M90760:M90761] [PN:HisG] [GN:hisG] [OR:Lactococcus lactis]
[DB:genpept-bct1] [DE:Lactococcus lactis unknown gene, partial cds, and HisC
(hisC),unknown, HisG (hisG), unknown, HisB (hisB), unknown, HisH (hish),HisA (hisA),
HisF (hisF), HisIE (hisIE), unknown, unknown, LeuA(leuA), LeuB (leuB), LeuC (leuC),
LeuD (leuD), unknown, IlvD(ilvD), IlvB (ilvB), IlvN, IlvC (ilvC), IlvA (ilvA), AldB
(aldB)and aldR (aldR) genes, complete cds.] [NT:phosphoribosyl-ATP synthetase]
[LE:3125] [RE:3751] [DI:direct]

| ORF Name | NTID | AAID | NT Length | AA Length | score | probability |
|---|---|---|---|---|---|---|
| AI7503000985_1207938_c3_2244 | 821 | 4593 | 828 | 275 | 953 | 7.7e-96 |

Description
gp:[GI:g4433636] [LN:AF029224] [AC:AF029224:AF029225] [PN:NirC] [GN:nirC] [FN:putative
nitrite transporter] [OR:Staphylococcus carnosus] [DB:genpept-bct2] [DE:Staphylococcus
carnosus nir and nar operons, complete sequences.] [LE:226] [RE:1056] [DI:direct]

| ORF_Name | NTID | AAID | NT Length | AA Length | score | probability |
|---|---|---|---|---|---|---|
| AI7503000985_1230437_c1_1528 | 822 | 4594 | 408 | 135 | 202 | 2.9e-16 |

Description
sp:[LN:YWBH_BACSU] [AC:P39591] [GN:YWBH:IPA-23R] [OR:BACILLUS SUBTILIS] [DE:HYPOTHETICAL 14.3 KD PROTEIN IN EPR-GALK INTERGENIC REGION] [SP:P39591] [DB:swissprot] >pir:[LN:S39678] [AC:S39678:F70051 ] [PN:ywbH protein:hypothetical protein ipa-23r] [GN:ywbH ] [CL:conserved hypothetical protein HI1297] [OR:Bacillus subtilis] [DB:pir2] >gp:[GI:g413947] [LN:BSGENR] [AC:X73124] [GN:ipa-23r] [OR:Bacillus subtilis] [DB:genpept-bct1] [DE:B.subtilis genomic region (325 to 333).] [SP:P39591] [LE:23968] [RE:24354] [DI:complement] >gp:[GI:e1186331:g2636367] [LN:BSUB0020] [AC:Z99123:AL009126] [GN:ywbH] [FN:unknown] [OR:Bacillus subtilis] [DB:genpept-bct1] [DE:Bacillus subtilis complete genome (section 20 of 21): from 3798401to 4010550.] [NT:alternate gene name: ipa-23r] [SP:P39591] [LE:133605] [RE:133991] [DI:direct]

| ORF_Name | NTID | AAID | NT Length | AA Length | score | probability |
|---|---|---|---|---|---|---|
| AI7503000985_12600305_f1_260 | 823 | 4595 | 285 | 94 | | |

Description
NO-HIT

| ORF_Name | NTID | AAID | NT Length | AA Length | score | probability |
|---|---|---|---|---|---|---|
| AI7503000985_12690706_c3_2230 | 824 | 4596 | 231 | 76 | | |

Description
NO-HIT

| ORF_Name | NTID | AAID | NT Length | AA Length | score | probability |
|---|---|---|---|---|---|---|
| AI7503000985_12697136_f2_862 | 825 | 4597 | 873 | 290 | 1519 | 8.1e-156 |

Description
pir:[LN:S77609] [AC:S77609 ] [PN:probable intercellular adhesion protein B precursor:icaB protein] [GN:icaB ] [OR:Staphylococcus epidermidis] [DB:pir2] >gp:[GI:g1161381] [LN:SEU43366] [AC:U43366] [PN:IcaB] [GN:icaB] [OR:Staphylococcus epidermidis] [DB:genpept-bct2] [DE:Staphylococcus epidermidis operon mediating intercellular adhesion:IcaR, IcaA, IcaD, IcaB, and IcaC genes, complete cds.] [LE:2265] [RE:3134] [DI:direct]

| ORF_Name | NTID | AAID | NT Length | AA Length | score | probability |
|---|---|---|---|---|---|---|
| AI7503000985_12698410_f3_1111 | 826 | 4598 | 150 | 49 | | |

Description
NO-HIT

| ORF_Name | NTID | AAID | NT Length | AA Length | score | probability |
|---|---|---|---|---|---|---|
| AI7503000985_127002_f1_259 | 827 | 4599 | 162 | 53 | | |

Description
NO-HIT

| ORF Name | NTID | AAID | NT Length | AA Length | score | probability |
|---|---|---|---|---|---|---|
| AI7503000985_1281627_c3_2201 | 828 | 4600 | 1293 | 430 | 1106 | 4.7e-112 |

Description
pir:[LN:B69876] [AC:B69876 ] [PN:acetylornithine deacetylase homolog ylmB] [GN:ylmB ] [OR:Bacillus subtilis] [DB:pir2] >gp:[GI:e1185127:g2633908] [LN:BSUB0009] [AC:Z99112:AL009126] [GN:ylmB] [FN:unknown] [OR:Bacillus subtilis] [DB:genpept-bct1] [DE:Bacillus subtilis complete genome (section 9 of 21): from 1598421to 1807200.] [NT:similar to acetylornithine deacetylase] [LE:8531] [RE:9811] [DI:direct]

| ORF Name | NTID | AAID | NT Length | AA Length | score | probability |
|---|---|---|---|---|---|---|
| AI7503000985_129678_f1_53 | 829 | 4601 | 1416 | 471 | 1269 | 2.5e-129 |

Description
sp:[LN:YDGF_BACSU] [AC:P96704] [GN:YDGF] [OR:BACILLUS SUBTILIS] [DE:HYPOTHETICAL TRANSPORT PROTEIN IN EXPZ-DINB INTERGENIC REGION] [SP:P96704] [DB:swissprot]
>pir:[LN:H69782] [AC:H69782 ] [PN:amino acid ABC transporter (permease) homolog ydgF] [GN:ydgF ] [CL:arginine permease] [OR:Bacillus subtilis] [DB:pir2]
>gp:[GI:d1020148:g1881368] [LN:AB001488] [AC:AB001488] [GN:ydgF] [OR:Bacillus subtilis] [SR:Bacillus subtilis (strain:168) DNA] [DB:genpept-bct1] [DE:Bacillus subtilis genome sequence, 148 kb sequence of the regionbetween 35 and 47 degree.] [NT:PROBABLE AMINO ACID TRANSPORT PERMIASE.] [LE:139917] [RE:141293] [DI:complement]
>gp:[GI:e1182528:g2632862] [LN:BSUB0003] [AC:Z99106:AL009126] [GN:ydgF] [FN:unknown] [OR:Bacillus subtilis] [DB:genpept-bct1] [DE:Bacillus subtilis complete genome (section 3 of 21): from 402751 to611850.] [NT:similar to amino acid ABC transporter (permease)] [SP:P96704] [LE:203663] [RE:205039] [DI:complement] >gp:[GI:e1182541:g2632875] [LN:BSUB0004] [AC:Z99107:AL009126] [DB:genpept-bct1] [DE:Bacillus subtilis complete genome (section 4 of 21): from 600701 to813890.] [NT:similar to amino acid ABC transporter (permease)] [SP:P96704] [LE:5713] [RE:7089] [DI:complement]

| ORF Name | NTID | AAID | NT Length | AA Length | score | probability |
|---|---|---|---|---|---|---|
| AI7503000985_1298202_f2_822 | 830 | 4602 | 1986 | 661 | 1779 | 2.3e-183 |

Description
pir:[LN:G69848] [AC:G69848 ] [PN:fructose phosphotransferase system enzyme homolog yjdD] [GN:yjdD ] [OR:Bacillus subtilis] [DB:pir2] >gp:[GI:e1183221:g2633555] [LN:BSUB0007] [AC:Z99110:AL009126] [GN:yjdD] [FN:unknown] [OR:Bacillus subtilis] [DB:genpept-bct1] [DE:Bacillus subtilis complete genome (section 7 of 21): from 1194391to 1411140.] [NT:similar to fructose phosphotransferase system] [LE:77806] [RE:79575] [DI:direct]

| ORF Name | NTID | AAID | NT Length | AA Length | score | probability |
|---|---|---|---|---|---|---|
| AI7503000985_13089052_c3_2246 | 831 | 4603 | 126 | 41 | | |

Description
NO-HIT

| ORF Name | NTID | AAID | NT Length | AA Length | score | probability |
|---|---|---|---|---|---|---|
| AI7503000985_1350051_c3_2086 | 832 | 4604 | 915 | 304 | 1245 | 8.7e-127 |

Description
gp:[GI:g4574118] [LN:AF009415] [AC:AF009415] [PN:choline transporter] [GN:cudT] [OR:Staphylococcus xylosus] [DB:genpept-bct2] [DE:Staphylococcus xylosus choline transporter (cudT), putativeregulatory protein (cudC), glycine betaine aldehyde dehydrogenase(cudA), and choline dehydrogenase (cudB) genes, complete cds.] [NT:CudT] [LE:811] [RE:2433] [DI:direct]

| ORF Name | NTID | AAID | NT Length | AA Length | score | probability |
|---|---|---|---|---|---|---|
| AI7503000985_1351687_c1_1515 | 833 | 4605 | 906 | 301 | 739 | 3.6e-73 |

Description
gp:[GI:g1644433] [LN:SAU31175] [AC:U31175] [PN:D-specific D-2-hydroxyacid dehydrogenase] [GN:ddh] [OR:Staphylococcus aureus] [DB:genpept-bct1] [DE:Staphylococcus aureus D-specific D-2-hydroxyacid dehydrogenase(ddh) gene, complete cds.] [NT:36.7 kDa protein; similar to NAD+-linked D-LDH,] [LE:259] [RE:1251] [DI:direct]

| ORF Name | NTID | AAID | NT Length | AA Length | score | probability |
|---|---|---|---|---|---|---|
| AI7503000985_1359635_f3_1248 | 834 | 4606 | 471 | 156 | 297 | 2.5e-26 |

Description
pir:[LN:F69870] [AC:F69870 ] [PN:general stress protein homolog ykzA] [GN:ykzA ] [CL:hypothetical protein yklA] [OR:Bacillus subtilis] [DB:pir2]
>gp:[GI:e1181516:g2632036] [LN:BSAJ2571] [AC:AJ002571] [PN:YknA] [GN:yknA] [FN:unknown] [OR:Bacillus subtilis] [DB:genpept-bct1] [DE:Bacillus subtilis 168 56 kb DNA fragment between xlyA and ykoR.] [NT:homologous to OsmC from Escherichia coli] [LE:34145] [RE:34555] [DI:direct] >gp:[GI:e1183336:g2633670] [LN:BSUB0007] [AC:Z99110:AL009126] [GN:ykzA] [FN:unknown] [OR:Bacillus subtilis] [DB:genpept-bct1] [DE:Bacillus subtilis complete genome (section 7 of 21): from 1194391to 1411140.] [NT:alternate gene name: yzzE; similar to general] [LE:187094] [RE:187504] [DI:direct]

| ORF Name | NTID | AAID | NT Length | AA Length | score | probability |
|---|---|---|---|---|---|---|
| AI7503000985_1366012_f1_356 | 835 | 4607 | 213 | 70 | 81 | 0.014 |

Description
sp:[LN:PF2R_HUMAN] [AC:P43088] [GN:PTGFR] [OR:HOMO SAPIENS] [SR:,HUMAN] [DE:RECEPTOR) (PGF2 ALPHA RECEPTOR)] [SP:P43088] [DB:swissprot] >pir:[LN:A49973] [AC:A49973 ] [PN:prostanoid FP receptor] [GN:PTGFR:FP ] [CL:prostaglandin E receptor EP1] [OR:Homo sapiens] [SR:, man] [DB:pir2] [MP:1p31.1-1p31.1 ]

| ORF Name | NTID | AAID | NT Length | AA Length | score | probability |
|---|---|---|---|---|---|---|
| AI7503000985_13678300_f1_40 | 836 | 4608 | 165 | 54 | | |

Description
NO-HIT

| ORF Name | NTID | AAID | NT Length | AA Length | score | probability |
|---|---|---|---|---|---|---|
| AI7503000985_13711588_f2_551 | 837 | 4609 | 285 | 94 | 81 | 0.0019 |

Description
pir:[LN:S53365] [AC:S53365 ] [PN:mucin 5AC (clone CEL2)] [GN:MUC5AC ] [OR:Homo sapiens] [SR:, man] [DB:pir2] [MP:11p15.5-11p15.5 ]

| ORF Name | NTID | AAID | NT Length | AA Length | score | probability |
|---|---|---|---|---|---|---|
| AI7503000985_1376926_c3_2008 | 838 | 4610 | 849 | 282 | 438 | 2.9e-41 |

Description
gp:[GI:g3127079] [LN:AF061070] [AC:AF061070] [PN:PtxC] [GN:ptxC] [OR:Pseudomonas stutzeri] [DB:genpept-bct2] [DE:Pseudomonas stutzeri Orf117 (orf117), Orf86 (orf86) genes, completecds; and ptxABCDE operon, partial sequence.] [NT:putative inner membrane component of] [LE:3217] [RE:4044] [DI:direct]

| ORF Name | NTID | AAID | NT Length | AA Length | score | probability |
|---|---|---|---|---|---|---|
| AI7503000985_13796876_f2_710 | 839 | 4611 | 180 | 59 | | |

Description
NO-HIT

| ORF Name | NTID | AAID | NT Length | AA Length | score | probability |
|---|---|---|---|---|---|---|
| AI7503000985_13835462_c3_2043 | 840 | 4612 | 1449 | 482 | 1386 | 1.0e-141 |

Description
gp:[GI:e1299584:g3687418] [LN:BLY17554] [AC:Y17554] [PN:permease] [GN:arcD] [OR:Bacillus licheniformis] [DB:genpept-bct1] [DE:Bacillus licheniformis arcA, arcB, arcC and arcD genes.] [LE:2579] [RE:3985] [DI:direct]

| ORF Name | NTID | AAID | NT Length | AA Length | score | probability |
|---|---|---|---|---|---|---|
| AI7503000985_13843910_c1_1637 | 841 | 4613 | 216 | 71 | 258 | 3.9e-22 |

Description
gp:[GI:e1429613:g4756156] [LN:A67169] [AC:A67169] [PN:NART GENE] [FN:NITRATE TRANSPORT] [OR:Staphylococcus carnosus] [DB:genpept-pat] [DE:Sequence 9 from Patent EP0805205.] [LE:538] [RE:1704] [DI:direct] >gp:[GI:g2529402] [LN:SCU40014] [AC:U40014] [PN:nitrate transporter] [GN:narT] [OR:Staphylococcus carnosus] [SR:Staphylococcus carnosus strain=TM300] [DB:genpept-bct2] [DE:Staphylococcus carnosus nitrate transporter (narT) gene, completecds.] [NT:NarT] [LE:90] [RE:1256] [DI:direct]

| ORF Name | NTID | AAID | NT Length | AA Length | score | probability |
|---|---|---|---|---|---|---|
| AI7503000985_13866433_f2_661 | 842 | 4614 | 138 | 45 | | |

Description
NO-HIT

| ORF Name | NTID | AAID | NT Length | AA Length | score | probability |
|---|---|---|---|---|---|---|
| AI7503000985_13869827_f3_1087 | 843 | 4615 | 2385 | 794 | 2176 | 1.9e-225 |

Description
pir:[LN:E70041] [AC:E70041 ] [PN:probable copper-transporting ATPase, yvgX] [GN:yvgX ] [CL:Bacillus probable copper-transporting ATPase yvgX:ATPase nucleotide-binding domain homology:ATPase transduction domain homology:heavy-metal-associated homology] [OR:Bacillus subtilis] [EC:3.6.1.-] [DB:pir1] >gp:[GI:e1186038:g2635863] [LN:BSUB0018] [AC:Z99121:AL009126] [GN:yvgX] [FN:unknown] [OR:Bacillus subtilis] [DB:genpept-bct1] [DE:Bacillus subtilis complete genome (section 18 of 21): from 3399551to 3609060.] [NT:similar to heavy metal-transporting ATPase] [LE:40633] [RE:43044] [DI:complement]

| ORF Name | NTID | AAID | NT Length | AA Length | score | probability |
|---|---|---|---|---|---|---|
| AI7503000985_13955288_f1_5 | 844 | 4616 | 165 | 54 | | |

Description
NO-HIT

| ORF Name | NTID | AAID | NT Length | AA Length | score | probability |
|---|---|---|---|---|---|---|
| AI7503000985_14113806_f2_559 | 845 | 4617 | 126 | 41 | | |

Description
NO-HIT

| ORF_Name | NTID | AAID | NT Length | AA Length | score | probability |
|---|---|---|---|---|---|---|
| AI7503000985_14222942_f2_747 | 846 | 4618 | 138 | 45 | | |

Description
NO-HIT

| ORF_Name | NTID | AAID | NT Length | AA Length | score | probability |
|---|---|---|---|---|---|---|
| AI7503000985_1440890_f1_362 | 847 | 4619 | 339 | 112 | | |

Description
NO-HIT

| ORF_Name | NTID | AAID | NT Length | AA Length | score | probability |
|---|---|---|---|---|---|---|
| AI7503000985_14454393_c3_2148 | 848 | 4620 | 144 | 47 | | |

Description
NO-HIT

| ORF_Name | NTID | AAID | NT Length | AA Length | score | probability |
|---|---|---|---|---|---|---|
| AI7503000985_14460882_c1_1400 | 849 | 4621 | 177 | 58 | 198 | 7.8e-16 |

Description
gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF_Name | NTID | AAID | NT Length | AA Length | score | probability |
|---|---|---|---|---|---|---|
| AI7503000985_14460882_c3_1975 | 850 | 4622 | 177 | 58 | 242 | 1.7e-20 |

Description
gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF_Name | NTID | AAID | NT Length | AA Length | score | probability |
|---|---|---|---|---|---|---|
| AI7503000985_14460882_c3_2098 | 851 | 4623 | 210 | 69 | 264 | 7.9e-23 |

Description
gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF_Name | NTID | AAID | NT Length | AA Length | score | probability |
|---|---|---|---|---|---|---|
| AI7503000985_14460882_c3_2112 | 852 | 4624 | 177 | 58 | 226 | 8.4e-19 |

Description
gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF Name | NTID | AAID | NT Length | AA Length | score | probability |
|---|---|---|---|---|---|---|
| AI7503000985_14460932_f1_34 | 853 | 4625 | 177 | 58 | 208 | 6.8e-17 |

Description
gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF Name | NTID | AAID | NT Length | AA Length | score | probability |
|---|---|---|---|---|---|---|
| AI7503000985_14460932_f2_467 | 854 | 4626 | 177 | 58 | 196 | 1.3e-15 |

Description
gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF Name | NTID | AAID | NT Length | AA Length | score | probability |
|---|---|---|---|---|---|---|
| AI7503000985_14460932_f3_1045 | 855 | 4627 | 177 | 58 | 218 | 5.9e-18 |

Description
gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF Name | NTID | AAID | NT Length | AA Length | score | probability |
|---|---|---|---|---|---|---|
| AI7503000985_14480312_c1_1349 | 856 | 4628 | 1308 | 435 | 588 | 3.6e-57 |

Description
pir:[LN:F69581] [AC:F69581 ] [PN:acetoin dehydrogenase E2 component (dihydrolipoamide acetyltra) acoC] [GN:acoC ] [CL:dihydrolipoamide acetyltransferase: lipoyl/biotin-binding homology] [OR:Bacillus subtilis] [DB:pir2]
>gp:[GI:e1182798:g2633132] [LN:BSUB0005] [AC:Z99108:AL009126] [PN:acetoin dehydrogenase E2 component] [GN:acoC] [OR:Bacillus subtilis] [DB:genpept-bct1] [DE:Bacillus subtilis complete genome (section 5 of 21): from 802821 to1011250.] [NT:alternate gene name: yfjI] [LE:77735] [RE:78931] [DI:direct] >gp:[GI:d1025206:g2780393] [LN:D78509] [AC:D78509] [PN:YfjI] [OR:Bacillus subtilis] [SR:Bacillus subtilis (strain:AC327) DNA] [DB:genpept-bct1] [DE:Bacillus subtilis YfjG-YfjR genes, complete cds.] [LE:7394] [RE:8590] [DI:complement]

| ORF Name | NTID | AAID | NT Length | AA Length | score | probability |
|---|---|---|---|---|---|---|
| AI7503000985_14490756_f1_295 | 857 | 4629 | 177 | 58 | | |

Description
NO-HIT

| ORF Name | NTID | AAID | NT Length | AA Length | score | probability |
|---|---|---|---|---|---|---|
| AI7503000985_14492125_f3_1310 | 858 | 4630 | 141 | 46 | | |

Description
NO-HIT

| ORF Name | NTID | AAID | NT Length | AA Length | score | probability |
|---|---|---|---|---|---|---|
| AI7503000985_14495712_c1_1593 | 859 | 4631 | 297 | 98 | 109 | 5.0e-06 |

Description
gp:[GI:g4894301] [LN:AF065404] [AC:AF065404] [PN:pXO1-85] [OR:Bacillus anthracis] [DB:genpept-bct2] [DE:Bacillus anthracis virulence plasmid PX01, complete sequence.] [LE:99636] [RE:100319] [DI:direct]

| ORF Name | NTID | AAID | NT Length | AA Length | score | probability |
|---|---|---|---|---|---|---|
| AI7503000985_14534387_f3_1231 | 860 | 4632 | 225 | 74 | 91 | 0.00017 |

Description
gp:[GI:g1778751] [LN:SLU73444] [AC:U73444] [PN:SLUSH A] [GN:slushA] [FN:mediates haemolytic activity] [OR:Staphylococcus lugdunensis] [DB:genpept-bct1] [DE:Staphylococcus lugdunensis SLUSH A (slushA), SLUSH B (slushB), andhemolysin (slushC) genes, complete cds.] [LE:570] [RE:701] [DI:direct]

| ORF Name | NTID | AAID | NT Length | AA Length | score | probability |
|---|---|---|---|---|---|---|
| AI7503000985_14552215_c3_2231 | 861 | 4633 | 192 | 63 | | |

Description
NO-HIT

| ORF Name | NTID | AAID | NT Length | AA Length | score | probability |
|---|---|---|---|---|---|---|
| AI7503000985_14562760_f1_359 | 862 | 4634 | 141 | 46 | | |

Description
NO-HIT

| ORF Name | NTID | AAID | NT Length | AA Length | score | probability |
|---|---|---|---|---|---|---|
| AI7503000985_14565637_f2_883 | 863 | 4635 | 132 | 43 | | |

Description
NO-HIT

| ORF Name | NTID | AAID | NT Length | AA Length | score | probability |
|---|---|---|---|---|---|---|
| AI7503000985_14626432_c2_1687 | 864 | 4636 | 2421 | 806 | 1387 | 7.8e-142 |

Description
sp:[LN:SECA_STAAU] [AC:O06446] [GN:SECA] [OR:STAPHYLOCOCCUS AUREUS] [DE:PREPROTEIN TRANSLOCASE SECA SUBUNIT] [SP:O06446] [DB:swissprot] >gp:[GI:g2078390] [LN:SAU97062] [AC:U97062] [PN:SecA] [GN:secA] [FN:secretion] [OR:Staphylococcus aureus] [DB:genpept-bct1] [DE:Staphylococcus aureus NCTC 8325 SecA (secA) gene, complete cds.] [LE:440] [RE:2971] [DI:direct]

| ORF Name | NTID | AAID | NT Length | AA Length | score | probability |
|---|---|---|---|---|---|---|
| AI7503000985_14644037_c3_2056 | 865 | 4637 | 1575 | 524 | 401 | 2.8e-40 |

Description
sp:[LN:YBJT_ECOLI] [AC:P75822] [GN:YBJT] [OR:ESCHERICHIA COLI] [DE:HYPOTHETICAL 53.7 KD PROTEIN IN ARTP-POXB INTERGENIC REGION] [SP:P75822] [DB:swissprot]

| ORF Name | NTID | AAID | NT Length | AA Length | score | probability |
|---|---|---|---|---|---|---|
| AI7503000985_14650312_c3_2045 | 866 | 4638 | 1170 | 389 | 319 | 1.2e-28 |

Description
gp:[GI:e1423961:g4584121] [LN:BCE7788] [AC:AJ007788] [GN:capA] [OR:Bacillus cereus] [DB:genpept-bct1] [DE:Bacillus cereus ilvD, ilvA, capA genes, orf4, orf5 and orf6,partial.] [NT:related sequence M24150] [LE:2729] [RE:3832] [DI:complement]

| ORF Name | NTID | AAID | NT Length | AA Length | score | probability |
|---|---|---|---|---|---|---|
| AI7503000985_14662577_c3_1984 | 867 | 4639 | 537 | 178 | | |

Description
NO-HIT

| ORF Name | NTID | AAID | NT Length | AA Length | score | probability |
|---|---|---|---|---|---|---|
| AI7503000985_14720378_c3_2022 | 868 | 4640 | 726 | 241 | 292 | 8.5e-26 |

Description
pir:[LN:D70380] [AC:D70380 ] [PN:hypothetical protein aq_928] [GN:aq_928 ] [OR:Aquifex aeolicus] [DB:pir2] >gp:[GI:g2983456] [LN:AE000714] [AC:AE000714:AE000657] [PN:putative protein] [GN:aq_928] [OR:Aquifex aeolicus] [DB:genpept-bct2] [DE:Aquifex aeolicus section 46 of 109 of the complete genome.] [LE:6398] [RE:6988] [DI:direct]

| ORF Name | NTID | AAID | NT Length | AA Length | score | probability |
|---|---|---|---|---|---|---|
| AI7503000985_14725887_f3_1312 | 869 | 4641 | 183 | 60 | | |

Description
NO-HIT

| ORF Name | NTID | AAID | NT Length | AA Length | score | probability |
|---|---|---|---|---|---|---|
| AI7503000985_14729702_c2_1699 | 870 | 4642 | 2031 | 676 | 288 | 7.6e-22 |

Description
gp:[GI:g4322670] [LN:AF094508] [AC:AF094508] [PN:dentin phosphoryn] [OR:Homo sapiens] [SR:human] [DB:genpept-pri4] [DE:Homo sapiens dentin phosphoryn mRNA, complete cds.] [LE:<1] [RE:2367] [DI:direct]

| ORF Name | NTID | AAID | NT Length | AA Length | score | probability |
|---|---|---|---|---|---|---|
| AI7503000985_14742887_c2_1735 | 871 | 4643 | 606 | 201 | | |

Description
NO-HIT

| ORF Name | NTID | AAID | NT Length | AA Length | score | probability |
|---|---|---|---|---|---|---|
| AI7503000985_14742937_c1_1449 | 872 | 4644 | 1203 | 400 | 94 | 0.0033 |

Description
gp:[GI:g2935567] [LN:AF049856] [AC:AF049856] [PN:M protein] [GN:emm] [OR:Streptococcus pyogenes] [DB:genpept-bct2] [DE:Streptococcus pyogenes strain SS1457 M protein (emm) gene, partialcds.] [LE:<1] [RE:>403] [DI:direct]

| ORF Name | NTID | AAID | NT Length | AA Length | score | probability |
|---|---|---|---|---|---|---|
| AI7503000985_14843762_f3_1171 | 873 | 4645 | 141 | 46 | | |

Description
NO-HIT

| ORF Name | NTID | AAID | NT Length | AA Length | score | probability |
|---|---|---|---|---|---|---|
| AI7503000985_14851551_f1_417 | 874 | 4646 | 993 | 330 | 1143 | 5.6e-116 |

Description gp:[GI:g2565150] [LN:LLU92974] [AC:U92974:M90760:M90761] [PN:unknown] [OR:Lactococcus lactis] [DB:genpept-bct1] [DE:Lactococcus lactis unknown gene, partial cds, and HisC (hisC),unknown, HisG (hisG), unknown, HisB (hisB), unknown, HisH (hish),HisA (hisA), HisF (hisF), HisIE (hisIE), unknown, unknown, LeuA(leuA), LeuB (leuB), LeuC (leuC), LeuD (leuD), unknown, IlvD(ilvD), IlvB (ilvB), IlvN, IlvC (ilvC), IlvA (ilvA), AldB (aldB)and aldR (aldR) genes, complete cds.] [NT:ORF14] [LE:10850] [RE:11809] [DI:complement]

| ORF Name | NTID | AAID | NT Length | AA Length | score | probability |
|---|---|---|---|---|---|---|
| AI7503000985_14851713_c2_1650 | 875 | 4647 | 966 | 321 | 941 | 1.4e-94 |

Description pir:[LN:D69581] [AC:D69581 ] [PN:acetoin dehydrogenase E1 component (TPP-dependent alpha subuni) acoA] [GN:acoA ] [CL:pyruvate dehydrogenase (lipoamide) alpha chain: thiamine pyrophosphate-binding domain homology] [OR:Bacillus subtilis] [DB:pir2] >gp:[GI:e1182796:g2633130] [LN:BSUB0005] [AC:Z99108:AL009126] [PN:acetoin dehydrogenase E1 component] [GN:acoA] [OR:Bacillus subtilis] [DB:genpept-bct1] [DE:Bacillus subtilis complete genome (section 5 of 21): from 802821 to1011250.] [NT:alternate gene name: yfjK] [LE:75688] [RE:76689] [DI:direct] >gp:[GI:d1025208:g2780395] [LN:D78509] [AC:D78509] [PN:YfjK] [OR:Bacillus subtilis] [SR:Bacillus subtilis (strain:AC327) DNA] [DB:genpept-bct1] [DE:Bacillus subtilis YfjG-YfjR genes, complete cds.] [LE:9636] [RE:10637] [DI:complement] >gp:[GI:g2957146] [LN:AF006075] [AC:AF006075] [PN:TPP-dependent acetoin dehydrogenase, E1] [GN:acoA] [OR:Bacillus subtilis] [DB:genpept-bct2] [DE:Bacillus subtilis acetoin dehydrogenase enzyme system gene cluster,ribosomal protein L6-like protein gene, partial cds, TPP-dependentacetoin dehydrogenase, E1 alpha-subunit (acoA), TPP-dependentacetoin dehydrogenase, E1 beta-subunit (acoB), dihydrolipoamideacetyltransferase (acoC) and dihydrolipoamide dehydrogenase (acoL)genes, complete cds, and regulatory protein (acoR) gene, partialcds.] [NT:alpha subunit of the E1 component of the acetoin] [LE:825] [RE:1826] [DI:direct] >gp:[GI:g2957146] [LN:AF006075] [AC:AF006075] [PN:TPP-dependent acetoin dehydrogenase, E1] [GN:acoA] [OR:Bacillus subtilis] [DB:genpept] [DE:Bacillus subtilis acetoin dehydrogenase enzyme system gene cluster,ribosomal protein L6-like protein gene, partial cds, TPP-dependentacetoin dehydrogenase, E1 alpha-subunit (acoA), TPP-dependentacetoin dehydrogenase, E1 beta-subunit (acoB), dihydrolipoamideacetyltransferase (acoC) and dihydrolipoamide dehydrogenase (acoL)genes, complete cds, and regulatory protein (acoR) gene, partialcds.] [NT:alpha subunit of the E1 component of the acetoin] [LE:825] [RE:1826] [DI:direct]

| ORF Name | NTID | AAID | NT Length | AA Length | score | probability |
|---|---|---|---|---|---|---|
| AI7503000985_14879667_c2_1781 | 876 | 4648 | 867 | 288 | 735 | 9.7e-73 |

Description sp:[LN:PANC_BACSU] [AC:P52998] [GN:PANC] [OR:BACILLUS SUBTILIS] [EC:6.3.2.1] [DE:(PANTOATE ACTIVATING ENZYME)] [SP:P52998] [DB:swissprot] >pir:[LN:H69671] [AC:H69671 ] [PN:pantothenate synthetase panC] [GN:panC ] [CL:pantoate--beta-alanine ligase] [OR:Bacillus subtilis] [DB:pir2] >gp:[GI:g1146241] [LN:BACYPIA] [AC:L47709] [PN:pantothenate synthetase] [GN:panC] [FN:pantothenic acid biosynthesis] [OR:Bacillus subtilis] [DB:genpept-bct1] [EC:6.3.2.1] [DE:Bacillus subtilis (clone YAC15-6B) ypiABF genes, qcrABC genes,ypjABCDEFGHI genes, birA gene, panBCD genes, dinG gene, ypmB gene,aspB gene, asnS gene, dnaD gene, nth gene and ypoC gene, completecds's.] [NT:40.8% of identity to the Escherichia coli] [LE:14128] [RE:14988] [DI:direct] >gp:[GI:e1183687:g2634660] [LN:BSUB0012] [AC:Z99115:AL009126] [PN:pantothenate synthetase] [GN:panC] [FN:pantothenate biosynthesis] [OR:Bacillus subtilis] [DB:genpept-bct1] [EC:6.3.2.1] [DE:Bacillus subtilis complete genome (section 12 of 21): from 2195541to 2409220.] [SP:P52998] [LE:156679] [RE:157539] [DI:complement]

| ORF Name | NTID | AAID | NT Length | AA Length | score | probability |
|---|---|---|---|---|---|---|
| AI7503000985_14880051_f1_116 | 877 | 4649 | 1971 | 656 | 2450 | 1.8e-254 |

Description
pir:[LN:C69621] [AC:C69621 ] [PN:fructose-bisphosphatase,] [GN:fbp:yydE ] [CL:Bacillus subtilis fructose-bisphosphatase: phosphoesterase core homology] [OR:Bacillus subtilis] [EC:3.1.3.11] [DB:pir1] >gp:[GI:d1011939:g1064791] [LN:BACGNTZA] [AC:D78193] [GN:yydE] [OR:Bacillus subtilis] [SR:Bacillus subtilis (strain:168) DNA] [DB:genpept-bct1] [DE:Bacillus subtilis 36kb sequence between gntZ and trnY genesencoding 34 ORFs.] [LE:9575] [RE:11590] [DI:direct] >gp:[GI:e1184745:g2636566] [LN:BSUB0021] [AC:Z99124:AL009126] [PN:fructose-1,6-bisphosphatase] [GN:fbp] [FN:gluconeogenesis] [OR:Bacillus subtilis] [DB:genpept-bct1] [EC:3.1.3.11] [DE:Bacillus subtilis complete genome (section 21 of 21): from 3999281to 4214814.] [NT:alternate gene name: yydE] [LE:127957] [RE:129972] [DI:direct]

| ORF Name | NTID | AAID | NT Length | AA Length | score | probability |
|---|---|---|---|---|---|---|
| AI7503000985_14881250_f3_1040 | 878 | 4650 | 999 | 332 | 1407 | 5.9e-144 |

Description
gp:[GI:g1644433] [LN:SAU31175] [AC:U31175] [PN:D-specific D-2-hydroxyacid dehydrogenase] [GN:ddh] [OR:Staphylococcus aureus] [DB:genpept-bct1] [DE:Staphylococcus aureus D-specific D-2-hydroxyacid dehydrogenase(ddh) gene, complete cds.] [NT:36.7 kDa protein; similar to NAD+-linked D-LDH,] [LE:259] [RE:1251] [DI:direct]

| ORF Name | NTID | AAID | NT Length | AA Length | score | probability |
|---|---|---|---|---|---|---|
| AI7503000985_14881908_c1_1494 | 879 | 4651 | 213 | 70 | 75 | 0.042 |

Description
gp:[GI:g4406247] [LN:AF105113] [AC:AF105113] [PN:putative oligosaccharide repeat unit] [GN:cps19AJ] [OR:Streptococcus pneumoniae] [DB:genpept-bct2] [DE:Streptococcus pneumoniae type 19A putative oligosaccharide repeatunit transporter (cps19AJ) gene, partial cds; UDP-N-acetylglucosamine-2-epimerase (cps19AK), glucose-1-phosphate thymidylyltransferase (cps19AL), dTDP-4-keto-6-deoxyglucose-3,5-epimerase(cps19AM), dTDP-glucose-4,6-dehydratase (cps19AN), anddTDP-L-rhamnose synthase (cps19AO) genes, complete cds; and AliA(aliA) gene, partial cds.] [NT:Cps19AJ] [LE:<1] [RE:818] [DI:direct]

| ORF Name | NTID | AAID | NT Length | AA Length | score | probability |
|---|---|---|---|---|---|---|
| AI7503000985_14901578_c3_2235 | 880 | 4652 | 888 | 295 | 598 | 3.2e-58 |

Description
pir:[LN:B69772] [AC:B69772 ] [PN:conserved hypothetical protein ydbO] [GN:ydbO ] [CL:conserved hypothetical protein MJ0449] [OR:Bacillus subtilis] [DB:pir2] >gp:[GI:d1020044:g1881264] [LN:AB001488] [AC:AB001488] [GN:ydbO] [OR:Bacillus subtilis] [SR:Bacillus subtilis (strain:168) DNA] [DB:genpept-bct1] [DE:Bacillus subtilis genome sequence, 148 kb sequence of the regionbetween 35 and 47 degree.] [NT:FUNCTION UNKNOWN, SIMILAR PRODUCT IN B. SUBTILIS] [LE:39929] [RE:40801] [DI:direct] >gp:[GI:e1182420:g2632754] [LN:BSUB0003] [AC:Z99106:AL009126] [GN:ydbO] [FN:unknown] [OR:Bacillus subtilis] [DB:genpept-bct1] [DE:Bacillus subtilis complete genome (section 3 of 21): from 402751 to611850.] [NT:similar to hypothetical proteins] [LE:103673] [RE:104545] [DI:direct]

| ORF Name | NTID | AAID | NT Length | AA Length | score | probability |
|---|---|---|---|---|---|---|
| AI7503000985_14931501_c2_1790 | 881 | 4653 | 1062 | 353 | 802 | 7.7e-80 |

Description
pir:[LN:E71373] [AC:E71373 ] [PN:probable regulatory protein (pfoS/R)] [GN:TP0038 ]
[OR:Treponema pallidum subsp. pallidum] [SR:, syphilis spirochete] [DB:pir2]
>gp:[GI:g3322295] [LN:AE001189] [AC:AE001189:AE000520] [PN:regulatory protein (pfoS/R)]
[GN:TP0038] [OR:Treponema pallidum] [DB:genpept-bct2] [DE:Treponema pallidum section 5
of 87 of the complete genome.] [NT:similar to GP:1354775 percent identity: 100.00;]
[LE:1177] [RE:2229] [DI:complement]

| ORF Name | NTID | AAID | NT Length | AA Length | score | probability |
|---|---|---|---|---|---|---|
| AI7503000985_14979713_c1_1590 | 882 | 4654 | 483 | 160 | 251 | 1.9e-21 |

Description
sp:[LN:YORZ_LISMO] [AC:P33385] [OR:LISTERIA MONOCYTOGENES] [DE:REGION (ORFZ)]
[SP:P33385] [DB:swissprot] >pir:[LN:F43868] [AC:F43868 ] [PN:ORFZ] [OR:Listeria
monocytogenes] [DB:pir2] >gp:[GI:g149647] [LN:LISACTLDH] [AC:M82881] [OR:Listeria
monocytogenes] [SR:Listeria monocytogenes (strain L028) DNA] [DB:genpept-bct1]
[DE:Listeria monocytogenes lecithinase, lactate dehydrogenase (actA)gene complete cds,
(plcB) gene complete cds, (ldh) gene completecds.] [NT:ORFZ] [LE:3582] [RE:4043]
[DI:direct]

| ORF Name | NTID | AAID | NT Length | AA Length | score | probability |
|---|---|---|---|---|---|---|
| AI7503000985_15052187_f3_1188 | 883 | 4655 | 123 | 40 | | |

Description
NO-HIT

| ORF Name | NTID | AAID | NT Length | AA Length | score | probability |
|---|---|---|---|---|---|---|
| AI7503000985_15052188_f2_697 | 884 | 4656 | 141 | 46 | | |

Description
NO-HIT

| ORF Name | NTID | AAID | NT Length | AA Length | score | probability |
|---|---|---|---|---|---|---|
| AI7503000985_15126592_f3_1294 | 885 | 4657 | 1086 | 361 | 1831 | 7.0e-189 |

Description
pir:[LN:S77610] [AC:S77610 ] [PN:probable intercellular adhesion protein C:icaC
protein] [GN:icaC ] [OR:Staphylococcus epidermidis] [DB:pir2] >gp:[GI:g1161382]
[LN:SEU43366] [AC:U43366] [PN:IcaC] [GN:icaC] [OR:Staphylococcus epidermidis]
[DB:genpept-bct2] [DE:Staphylococcus epidermidis operon mediating intercellular
adhesion:IcaR, IcaA, IcaD, IcaB, and IcaC genes, complete cds.] [LE:3121] [RE:4188]
[DI:direct]

| ORF Name | NTID | AAID | NT Length | AA Length | score | probability |
|---|---|---|---|---|---|---|
| AI7503000985_1537_c1_1639 | 886 | 4658 | 153 | 50 | 89 | 0.00073 |

Description
sp:[LN:YDGI_BACSU] [AC:P96707] [GN:YDGI] [OR:BACILLUS SUBTILIS] [EC:1.-.-.-]
[DE:PUTATIVE NAD(P)H NITROREDUCTASE YDGI,] [SP:P96707] [DB:swissprot] >pir:[LN:C69783]
[AC:C69783 ] [PN:NADH dehydrogenase homolog ydgI] [GN:ydgI ] [CL:nitroreductase]
[OR:Bacillus subtilis] [DB:pir2] >gp:[GI:d1020152:g1881372] [LN:AB001488] [AC:AB001488]
[GN:ydgI] [OR:Bacillus subtilis] [SR:Bacillus subtilis (strain:168) DNA]
[DB:genpept-bct1] [DE:Bacillus subtilis genome sequence, 148 kb sequence of the
regionbetween 35 and 47 degree.] [NT:SIMILAR TO NITROREDUCTASE.] [LE:145410]
[RE:146039] [DI:complement] >gp:[GI:e1182545:g2632879] [LN:BSUB0004]
[AC:Z99107:AL009126] [GN:ydgI] [FN:unknown] [OR:Bacillus subtilis] [DB:genpept-bct1]
[DE:Bacillus subtilis complete genome (section 4 of 21): from 600701 to813890.]
[NT:similar to NADH dehydrogenase] [SP:P96707] [LE:11206] [RE:11835] [DI:complement]

| ORF Name | NTID | AAID | NT Length | AA Length | score | probability |
|---|---|---|---|---|---|---|
| AI7503000985_156387_c1_1367 | 887 | 4659 | 138 | 45 | | |

Description
NO-HIT

| ORF Name | NTID | AAID | NT Length | AA Length | score | probability |
|---|---|---|---|---|---|---|
| AI7503000985_15671925_c3_2051 | 888 | 4660 | 138 | 45 | | |

Description
NO-HIT

| ORF Name | NTID | AAID | NT Length | AA Length | score | probability |
|---|---|---|---|---|---|---|
| AI7503000985_157093_c2_1947 | 889 | 4661 | 147 | 48 | | |

Description
NO-HIT

| ORF Name | NTID | AAID | NT Length | AA Length | score | probability |
|---|---|---|---|---|---|---|
| AI7503000985_15711457_f3_919 | 890 | 4662 | 201 | 66 | | |

Description
NO-HIT

| ORF Name | NTID | AAID | NT Length | AA Length | score | probability |
|---|---|---|---|---|---|---|
| AI7503000985_157513_c3_2168 | 891 | 4663 | 156 | 51 | | |

Description
NO-HIT

| ORF Name | NTID | AAID | NT Length | AA Length | score | probability |
|---|---|---|---|---|---|---|
| AI7503000985_15752187_f2_664 | 892 | 4664 | 162 | 53 | | |

Description
NO-HIT

| ORF Name | NTID | AAID | NT Length | AA Length | score | probability |
|---|---|---|---|---|---|---|
| AI7503000985_157807_c1_1613 | 893 | 4665 | 1584 | 527 | 1780 | 1.8e-183 |

Description
gp:[GI:e316580:g2791907] [LN:SSK11MECA] [AC:Y13094] [GN:CTORF585] [OR:Staphylococcus sciuri] [DB:genpept-bct1] [DE:S.sciuri mecA gene, strain K11 (792).] [LE:<1] [RE:1757] [DI:complement]

| ORF Name | NTID | AAID | NT Length | AA Length | score | probability |
|---|---|---|---|---|---|---|
| AI7503000985_15814001_f1_269 | 894 | 4666 | 153 | 50 | | |

Description
NO-HIT

| ORF Name | NTID | AAID | NT Length | AA Length | score | probability |
|---|---|---|---|---|---|---|
| AI7503000985_158411_c3_2104 | 895 | 4667 | 993 | 330 | 870 | 4.8e-87 |

Description
sp:[LN:LDH_BACSU] [AC:P13714] [GN:LDH:LCTE] [OR:BACILLUS SUBTILIS] [EC:1.1.1.27] [DE:L-LACTATE DEHYDROGENASE,] [SP:P13714] [DB:swissprot]

| ORF Name | NTID | AAID | NT Length | AA Length | score | probability |
|---|---|---|---|---|---|---|
| AI7503000985_15894527_f3_1275 | 896 | 4668 | 267 | 88 | | |

Description
NO-HIT

| ORF Name | NTID | AAID | NT Length | AA Length | score | probability |
|---|---|---|---|---|---|---|
| AI7503000985_15914762_f1_251 | 897 | 4669 | 579 | 192 | 654 | 3.7e-64 |

Description
gp:[GI:g4574119] [LN:AF009415] [AC:AF009415] [PN:putative regulatory protein] [GN:cudC] [OR:Staphylococcus xylosus] [DB:genpept-bct2] [DE:Staphylococcus xylosus choline transporter (cudT), putativeregulatory protein (cudC), glycine betaine aldehyde dehydrogenase(cudA), and choline dehydrogenase (cudB) genes, complete cds.] [NT:CudC] [LE:2604] [RE:3164] [DI:complement]

| ORF Name | NTID | AAID | NT Length | AA Length | score | probability |
|---|---|---|---|---|---|---|
| AI7503000985_16048828_c3_2224 | 898 | 4670 | 261 | 86 | | |

Description
NO-HIT

| ORF Name | NTID | AAID | NT Length | AA Length | score | probability |
|---|---|---|---|---|---|---|
| AI7503000985_164715_c3_2251 | 899 | 4671 | 951 | 316 | 786 | 3.8e-78 |

Description
gp:[GI:g4433641] [LN:AF029224] [AC:AF029224:AF029225] [PN:SirB] [GN:sirB] [OR:Staphylococcus carnosus] [DB:genpept-bct2] [DE:Staphylococcus carnosus nir and nar operons, complete sequences.] [NT:similar to C-terminus of Esherichia coli CysG.] [LE:5079] [RE:6032] [DI:direct]

| ORF Name | NTID | AAID | NT Length | AA Length | score | probability |
|---|---|---|---|---|---|---|
| AI7503000985_16600062_f1_117 | 900 | 4672 | 132 | 43 | | |

Description
NO-HIT

| ORF Name | NTID | AAID | NT Length | AA Length | score | probability |
|---|---|---|---|---|---|---|
| AI7503000985_16689067_c1_1368 | 901 | 4673 | 597 | 198 | 470 | 1.2e-44 |

Description
sp:[LN:HIS7_LACLA] [AC:Q02134] [GN:HISB] [OR:LACTOCOCCUS LACTIS]
[SR:,SUBSPLACTIS:STREPTOCOCCUS LACTIS] [EC:4.2.1.19] [DE:IMIDAZOLEGLYCEROL-PHOSPHATE
DEHYDRATASE, (IGPD)] [SP:Q02134] [DB:swissprot] >pir:[LN:G45734] [AC:G45734:C36890 ]
[PN:HisB] [CL:imidazoleglycerol-phosphate dehydratase: imidazoleglycerol-phosphate
dehydratase homology] [OR:Lactococcus lactis subsp. lactis] [DB:pir2] >gp:[GI:g2565143]
[LN:LLU92974] [AC:U92974:M90760:M90761] [PN:HisB] [GN:hisB] [OR:Lactococcus lactis]
[DB:genpept-bct1] [DE:Lactococcus lactis unknown gene, partial cds, and HisC
(hisC),unknown, HisG (hisG), unknown, HisB (hisB), unknown, HisH (hish),HisA (hisA),
HisF (hisF), HisIE (hisIE), unknown, unknown, LeuA(leuA), LeuB (leuB), LeuC (leuC),
LeuD (leuD), unknown, IlvD(ilvD), IlvB (ilvB), IlvN, IlvC (ilvC), IlvA (ilvA), AldB
(aldB)and aldR (aldR) genes, complete cds.] [NT:dehydratase] [LE:5869] [RE:6471]
[DI:direct]

| ORF Name | NTID | AAID | NT Length | AA Length | score | probability |
|---|---|---|---|---|---|---|
| AI7503000985_16798125_c2_1862 | 902 | 4674 | 441 | 146 | 154 | 2.6e-10 |

Description
sp:[LN:GUDT_BACSU] [AC:P42237] [GN:YCBE] [OR:BACILLUS SUBTILIS] [DE:PROBABLE GLUCARATE
TRANSPORTER] [SP:P42237] [DB:swissprot] >pir:[LN:H69752] [AC:H69752 ] [PN:probalble
glucarate transporter] [GN:ycbE ] [CL:hexuronate transporter] [OR:Bacillus subtilis]
[DB:pir2] >gp:[GI:d1007040:g709999] [LN:BACYCB20] [AC:D30808] [PN:glucarate
dehydratase] [GN:ycbE] [OR:Bacillus subtilis] [SR:Bacillus subtilis (strain:168TrpC2)
DNA] [DB:genpept-bct1] [DE:Bacillus subtilis DNA around 20 degrees region of
chromosomecontaining yckA-T genes.] [LE:3924] [RE:5291] [DI:direct]
>gp:[GI:e1182200:g2632534] [LN:BSUB0002] [AC:Z99105:AL009126] [GN:ycbE] [FN:unknown]
[OR:Bacillus subtilis] [DB:genpept-bct1] [DE:Bacillus subtilis complete genome (section
2 of 21): from 194651 to415810.] [NT:similar to glucarate transporter] [SP:P42237]
[LE:75738] [RE:77105] [DI:direct]

| ORF Name | NTID | AAID | NT Length | AA Length | score | probability |
|---|---|---|---|---|---|---|
| AI7503000985_16802312_c3_2228 | 903 | 4675 | 138 | 45 | | |

Description
NO-HIT

| ORF Name | NTID | AAID | NT Length | AA Length | score | probability |
|---|---|---|---|---|---|---|
| AI7503000985_16834377_c2_1861 | 904 | 4676 | 147 | 48 | | |

Description
NO-HIT

| ORF Name | NTID | AAID | NT Length | AA Length | score | probability |
|---|---|---|---|---|---|---|
| AI7503000985_16838207_f1_122 | 905 | 4677 | 288 | 95 | 175 | 2.1e-13 |

Description
sp:[LN:YJDJ_ECOLI] [AC:P39274] [GN:YJDJ] [OR:ESCHERICHIA COLI] [DE:HYPOTHETICAL 10.5 KD
PROTEIN IN DCUB-LYSU INTERGENIC REGION (O90A)] [SP:P39274] [DB:swissprot]
>pir:[LN:S56356] [AC:S56356:F65222 ] [PN:hypothetical 10.5K protein (dcub-lysu
intergenic region):hypothetical protein o90a] [GN:yjdJ ] [OR:Escherichia coli]
[DB:pir2] >gp:[GI:g536972] [LN:ECOUW93] [AC:U14003] [OR:Escherichia coli]
[DB:genpept-bct1] [DE:Escherichia coli K-12 chromosomal region from 92.8 to 00.1
minutes.] [NT:ORF_o90a] [LE:42913] [RE:43185] [DI:direct] >gp:[GI:g1790569]
[LN:AE000485] [AC:AE000485:U00096] [PN:orf, hypothetical protein] [GN:yjdJ] [FN:orf;
Unknown] [OR:Escherichia coli] [DB:genpept-bct2] [DE:Escherichia coli K-12 MG1655
section 375 of 400 of the completegenome.] [NT:o90a; 100 pct identical amino acid
sequence and] [LE:6496] [RE:6768] [DI:direct]

| ORF Name | NTID | AAID | NT Length | AA Length | score | probability |
|---|---|---|---|---|---|---|
| AI7503000985_17010952_c3_2147 | 906 | 4678 | 864 | 287 | 639 | 1.4e-62 |

Description
pir:[LN:G70080] [AC:G70080 ] [PN:conserved hypothetical protein yxkD] [GN:yxkD ]
[CL:conserved hypothetical protein yitT] [OR:Bacillus subtilis] [DB:pir2]
>gp:[AC:e1186383:g2636419] [LN:BSUB0020] [AC:Z99123:AL009126] [GN:yxkD] [FN:unknown]
[OR:Bacillus subtilis] [DB:genpept-bct1] [DE:Bacillus subtilis complete genome (section
20 of 21): from 3798401to 4010550.] [NT:similar to hypothetical proteins] [LE:188319]
[RE:189155] [DI:complement] >gp:[GI:d1012387:g1783243] [LN:D83026] [AC:D83026:D45911]
[GN:yxkD] [OR:Bacillus subtilis] [SR:Bacillus subtilis (strain:BGSC 1A1) DNA]
[DB:genpept-bct1] [DE:Bacillus subtilis genome sequence covering lic-cel region.]
[NT:homologous to jojC gene product (B. subtilis;] [LE:35310] [RE:36146] [DI:direct]

| ORF Name | NTID | AAID | NT Length | AA Length | score | probability |
|---|---|---|---|---|---|---|
| AI7503000985_179010_c3_2136 | 907 | 4679 | 546 | 181 | 344 | 2.6e-31 |

Description
sp:[LN:OGT_HAEIN] [AC:P44687] [GN:OGT:DAT1:HI0402] [OR:HAEMOPHILUS INFLUENZAE]
[EC:2.1.1.63] [DE:ALKYLTRANSFERASE)] [SP:P44687] [DB:swissprot] >pir:[LN:G64065]
[AC:G64065 ] [PN:methylated-DNA--protein-cysteine S-methyltransferase homolog ]
[CL:methylated-DNA--protein-cysteine
S-methyltransferase:methylated-DNA--protein-cysteine S-methyltransferase homology]
[OR:Haemophilus influenzae] [DB:pir2] >gp:[GI:g1573373] [LN:U32723] [AC:U32723:L42023]
[PN:methylated-DNA--protein-cysteine] [GN:HI0402] [OR:Haemophilus influenzae Rd]
[DB:genpept-bct2] [DE:Haemophilus influenzae Rd section 38 of 163 of the complete
genome.] [NT:similar to SP:P11742 GB:X15659 PID:39876] [LE:9611] [RE:10183] [DI:direct]

| ORF Name | NTID | AAID | NT Length | AA Length | score | probability |
|---|---|---|---|---|---|---|
| AI7503000985_181885_c3_2161 | 908 | 4680 | 132 | 43 | | |

Description
NO-HIT

| ORF_Name | NTID | AAID | NT Length | AA Length | score | probability |
|---|---|---|---|---|---|---|
| AI7503000985_194003_f1_134 | 909 | 4681 | 165 | 54 | 55 | 0.025 |

Description sp:[LN:RK19_GUITH] [AC:O78409] [GN:RPL19] [OR:GUILLARDIA THETA] [SR:,CRYPTOMONAS PHI] [DE:CHLOROPLAST 50S RIBOSOMAL PROTEIN L19] [SP:O78409] [DB:swissprot] >gp:[GI:g3602933] [LN:AF041468] [AC:AF041468:X14171:X62349:X51511:X14504:X52158:X52912:X56806:M7654 7] [PN:ribosomal protein L19] [GN:rpl19] [OR:Chloroplast Guillardia theta] [SR:Guillardia theta] [DB:genpept-pln2] [DE:Guillardia theta complete plastid genome.] [LE:181] [RE:573] [DI:complement]

| ORF_Name | NTID | AAID | NT Length | AA Length | score | probability |
|---|---|---|---|---|---|---|
| AI7503000985_19531436_c3_2069 | 910 | 4682 | 1365 | 454 | 120 | 4.7e-05 |

Description gp:[GI:g1813493] [LN:BFU64314] [AC:U64314] [PN:hydrophobic protein] [OR:Bacillus firmus] [DB:genpept-bct1] [DE:Bacillus firmus putative hydrophobic protein gene, partial cds.] [NT:similar to Bacillus subtilis putative protein] [LE:193] [RE:>795] [DI:direct]

| ORF_Name | NTID | AAID | NT Length | AA Length | score | probability |
|---|---|---|---|---|---|---|
| AI7503000985_19562805_c3_2135 | 911 | 4683 | 213 | 70 | 69 | 0.036 |

Description sp:[LN:VNB_INBMF] [AC:P16200] [GN:NB] [OR:INFLUENZA B VIRUS] [SR:B/MEMPHIS/3/89,] [DE:NB GLYCOPROTEIN] [SP:P16200] [DB:swissprot] >pir:[LN:A36825] [AC:A36825 ] [PN:NB glycoprotein] [CL:influenza B virus NB glycoprotein] [OR:influenza B virus] [DB:pir1] [MP:segment 6 ] >gp:[GI:g325221] [LN:FLBNAE] [AC:M30635] [OR:Influenza B virus] [SR:Influenza B/Memphis/3/89, cDNA to viral RNA] [DB:genpept-vrl] [DE:Influenza B/Memphis/3/89, neuraminidase and NB (seg 6) RNA,complete cds.] [NT:NB protein] [LE:16] [RE:315] [DI:direct]

| ORF_Name | NTID | AAID | NT Length | AA Length | score | probability |
|---|---|---|---|---|---|---|
| AI7503000985_19564702_c3_2073 | 912 | 4684 | 477 | 158 | 397 | 6.3e-37 |

Description sp:[LN:GSHZ_NICSY] [AC:P30708] [OR:NICOTIANA SYLVESTRIS] [SR:,WOOD TOBACCO] [EC:1.11.1.9] [DE:GLUTATHIONE PEROXIDASE HOMOLOG 6P229,] [SP:P30708] [DB:swissprot] >pir:[LN:S20501] [AC:S20501 ] [PN:glutathione peroxidase homolog] [CL:glutathione peroxidase] [OR:Nicotiana sylvestris] [SR:, wood tobacco] [DB:pir2] >gp:[GI:g19739] [LN:NS6P229] [AC:X60219] [OR:Nicotiana sylvestris] [SR:wood tobacco] [DB:genpept-pln1] [DE:N.sylvestris mRNA for 6P229 polypeptide homologous to animalglutathione peroxidases.] [NT:homologous to animal glutathione peroxidases] [SP:P30708] [LE:154] [RE:663] [DI:direct]

| ORF_Name | NTID | AAID | NT Length | AA Length | score | probability |
|---|---|---|---|---|---|---|
| AI7503000985_19585877_c1_1478 | 913 | 4685 | 1212 | 403 | 834 | 3.1e-83 |

Description pir:[LN:H69817] [AC:H69817 ] [PN:aminoacylase homolog yhaA] [GN:yhaA ] [CL:hippurate hydrolase] [OR:Bacillus subtilis] [DB:pir2] >gp:[GI:e1183009:g2633343] [LN:BSUB0006] [AC:Z99109:AL009126] [GN:yhaA] [FN:unknown] [OR:Bacillus subtilis] [DB:genpept-bct1] [DE:Bacillus subtilis complete genome (section 6 of 21): from 999501 to1209940.] [NT:similar to aminoacylase] [LE:80123] [RE:81313] [DI:complement]

| ORF_Name | NTID | AAID | NT Length | AA Length | score | probability |
|---|---|---|---|---|---|---|
| AI7503000985_19694050_f3_1299 | 914 | 4686 | 147 | 48 | | |

Description
NO-HIT

| ORF_Name | NTID | AAID | NT Length | AA Length | score | probability |
|---|---|---|---|---|---|---|
| AI7503000985_197090_c2_1776 | 915 | 4687 | 183 | 60 | | |

Description
NO-HIT

| ORF_Name | NTID | AAID | NT Length | AA Length | score | probability |
|---|---|---|---|---|---|---|
| AI7503000985_19709637_c1_1576 | 916 | 4688 | 147 | 48 | | |

Description
NO-HIT

| ORF_Name | NTID | AAID | NT Length | AA Length | score | probability |
|---|---|---|---|---|---|---|
| AI7503000985_19720642_c2_1710 | 917 | 4689 | 1296 | 431 | 525 | 1.7e-50 |

Description
gp:[GI:e1358508:g3980137] [LN:LMO34616] [AC:AJ007319] [PN:succinyl-diaminopimelate desuccinylase] [GN:dapE] [OR:Listeria monocytogenes] [DB:genpept-bct1] [DE:Listeria monocytogenes ascB, inlG, inlH, inlE, dapE genes.] [LE:5533] [RE:6672] [DI:direct]

| ORF_Name | NTID | AAID | NT Length | AA Length | score | probability |
|---|---|---|---|---|---|---|
| AI7503000985_197312_c2_1804 | 918 | 4690 | 873 | 290 | 813 | 5.2e-81 |

Description
sp:[LN:YHDF_BACSU] [AC:O07575] [GN:YHDF] [OR:BACILLUS SUBTILIS] [EC:1.-.-.-] [DE:(EC 1.-.-.-)] [SP:O07575] [DB:swissprot] >pir:[LN:D69825] [AC:D69825 ] [PN:glucose 1-dehydrogenase homolog yhdF] [GN:yhdF ] [CL:short-chain alcohol dehydrogenase homology] [OR:Bacillus subtilis] [DB:pir2] >gp:[GI:e1182946:g2633280] [LN:BSUB0006] [AC:Z99109:AL009126] [GN:yhdF] [FN:unknown] [OR:Bacillus subtilis] [DB:genpept-bct1] [DE:Bacillus subtilis complete genome (section 6 of 21): from 999501 to1209940.] [NT:similar to glucose 1-dehydrogenase] [SP:O07575] [LE:22211] [RE:23080] [DI:direct] >gp:[GI:e1191878:g2226201] [LN:BSY14082] [AC:Y14082] [PN:hypothetical protein] [GN:yhdF] [OR:Bacillus subtilis] [DB:genpept-bct1] [DE:Bacillus subtilis chromosomal DNA, region 72 to 75 degrees: spoVRto sspB.] [NT:Similarity to glucose and ribitol dehydrogenase] [SP:O07575] [LE:8859] [RE:9728] [DI:direct]

| ORF_Name | NTID | AAID | NT Length | AA Length | score | probability |
|---|---|---|---|---|---|---|
| AI7503000985_19781305_f1_20 | 919 | 4691 | 123 | 40 | | |

Description
NO-HIT

| ORF_Name | NTID | AAID | NT Length | AA Length | score | probability |
|---|---|---|---|---|---|---|
| AI7503000985_19787788_f3_1311 | 920 | 4692 | 156 | 51 | | |

Description
NO-HIT

| ORF_Name | NTID | AAID | NT Length | AA Length | score | probability |
|---|---|---|---|---|---|---|
| AI7503000985_19929586_c3_2180 | 921 | 4693 | 198 | 65 | | |

Description
NO-HIT

| ORF_Name | NTID | AAID | NT Length | AA Length | score | probability |
|---|---|---|---|---|---|---|
| AI7503000985_20081538_f1_158 | 922 | 4694 | 123 | 40 | | |

Description
NO-HIT

| ORF_Name | NTID | AAID | NT Length | AA Length | score | probability |
|---|---|---|---|---|---|---|
| AI7503000985_20167186_c2_1958 | 923 | 4695 | 156 | 51 | 229 | 4.0e-19 |

Description
gp:[GI:g4096799] [LN:SCU40158] [AC:U40158] [OR:Staphylococcus carnosus] [DB:genpept-bct2] [DE:Staphylococcus carnosus response regulator-like protein (orfx)gene, partial cds.] [NT:orfx; function unknown; similar to response] [LE:<1] [RE:560] [DI:direct]

| ORF_Name | NTID | AAID | NT Length | AA Length | score | probability |
|---|---|---|---|---|---|---|
| AI7503000985_20317_c2_1727 | 924 | 4696 | 2088 | 695 | 431 | 8.4e-38 |

Description
sp:[LN:TAGF_BACSU] [AC:P13485] [GN:TAGF:RODC:TAG3] [OR:BACILLUS SUBTILIS] [DE:TEICHOIC ACID BIOSYNTHESIS PROTEIN F] [SP:P13485] [DB:swissprot] >pir:[LN:S06049] [AC:S06049:G69720 ] [PN:probable CDPglycerol glycerophosphotransferase, :CDP-glycerol:polyglycerol phosphate glycero-phosphotransferase tagF:rodC protein:teichoic-acid synthase] [GN:rodC:tag-3:tagF ] [OR:Bacillus subtilis] [EC:2.7.8.12] [DB:pir2] [MP:310 degrees ] >gp:[GI:g40100] [LN:BSRODC] [AC:X15200] [OR:Bacillus subtilis] [DB:genpept-bct1] [DE:Bacillus subtilis rodC operon.] [NT:rodC (tag3) polypeptide (AA 1-746)] [SP:P13485] [LE:2178] [RE:4418] [DI:direct] >gp:[GI:e1184478:g2636098] [LN:BSUB0019] [AC:Z99122:AL009126] [PN:CDP-glycerol:polyglycerol phosphate] [GN:tagF] [FN:teichoic acid biosynthesis] [OR:Bacillus subtilis] [DB:genpept-bct1] [DE:Bacillus subtilis complete genome (section 19 of 21): from 3597091to 3809700.] [NT:alternate gene name: rodC] [SP:P13485] [LE:78129] [RE:80369] [DI:complement] >gp:[GI:e1184478:g2636098] [LN:BSUB0019] [AC:Z99122:AL009126] [PN:CDP-glycerol:polyglycerol phosphate] [GN:tagF] [FN:teichoic acid biosynthesis] [OR:Bacillus subtilis] [DB:genpept] [DE:Bacillus subtilis complete genome (section 19 of 21): from 3597091to 3809700.] [NT:alternate gene name: rodC] [SP:P13485] [LE:78129] [RE:80369] [DI:complement]

| ORF_Name | NTID | AAID | NT Length | AA Length | score | probability |
|---|---|---|---|---|---|---|
| AI7503000985_20323403_f3_1320 | 925 | 4697 | 141 | 46 | | |

Description
NO-HIT

| ORF_Name | NTID | AAID | NT Length | AA Length | score | probability |
|---|---|---|---|---|---|---|
| AI7503000985_20335260_c3_2081 | 926 | 4698 | 1881 | 626 | 2151 | 8.6e-223 |

Description
gp:[GI:g4098081] [LN:LLU73336] [AC:U73336] [PN:anaerobic ribonucleotide reductase] [GN:nrdD] [OR:Lactococcus lactis] [DB:genpept-bct2] [DE:Lactococcus lactis anaerobic ribonucleotide reductase (nrdD) andanaerobic ribonucleotide reductase activator protein (nrdG) genes,complete cds.] [NT:NrdD] [LE:167] [RE:2410] [DI:direct]

| ORF Name | NTID | AAID | NT Length | AA Length | score | probability |
|---|---|---|---|---|---|---|
| AI7503000985_20360885_f3_1003 | 927 | 4699 | 1683 | 560 | 906 | 7.3e-91 |

Description
sp:[LN:YHXB_BACSU] [AC:P18159] [GN:YHXB] [OR:BACILLUS SUBTILIS] [EC:5.4.2.8]
[DE:PROBABLE PHOSPHOMANNOMUTASE, (PMM)] [SP:P18159] [DB:swissprot] >pir:[LN:C69835]
[AC:C69835:D45868:S18566 ] [PN:phosphomannomutase homolog yhxB:hypothetical protein
(glpD 3' region)] [GN:yhxB ] [OR:Bacillus subtilis] [DB:pir2]
>gp:[GI:e1182920:g2633254] [LN:BSUB0005] [AC:Z99108:AL009126] [GN:yhxB] [FN:unknown]
[OR:Bacillus subtilis] [DB:genpept-bct1] [DE:Bacillus subtilis complete genome (section
5 of 21): from 802821 to1011250.] [NT:similar to phosphomannomutase] [SP:P18159]
[LE:203459] [RE:205156] [DI:direct] >gp:[GI:e1182932:g2633266] [LN:BSUB0006]
[AC:Z99109:AL009126] [GN:yhxB] [FN:unknown] [OR:Bacillus subtilis] [DB:genpept-bct1]
[DE:Bacillus subtilis complete genome (section 6 of 21): from 999501 to1209940.]
[NT:similar to phosphomannomutase] [SP:P18159] [LE:6779] [RE:8476] [DI:direct]
>gp:[GI:e324943:g2226139] [LN:BSY14079] [AC:Y14079] [PN:hypothetical protein] [GN:yhxB]
[OR:Bacillus subtilis] [DB:genpept-bct1] [DE:Bacillus subtilis chromosomal DNA, region
75 degrees: glpPFKDoperon and downstream.] [NT:see EMBL M34393 and Swiss Prot P18159.;
This could] [SP:P18159] [LE:6427] [RE:8124] [DI:direct]

| ORF Name | NTID | AAID | NT Length | AA Length | score | probability |
|---|---|---|---|---|---|---|
| AI7503000985_20410307_f2_684 | 928 | 4700 | 126 | 41 | | |

Description
NO-HIT

| ORF Name | NTID | AAID | NT Length | AA Length | score | probability |
|---|---|---|---|---|---|---|
| AI7503000985_20413202_f1_47 | 929 | 4701 | 1152 | 383 | 961 | 1.1e-96 |

Description
sp:[LN:YHAD_ECOLI] [AC:P23524] [GN:YHAD] [OR:ESCHERICHIA COLI] [DE:HYPOTHETICAL 39.1 KD
PROTEIN IN RNPB-SOHA INTERGENIC REGION (ORF 3)] [SP:P23524] [DB:swissprot]

| ORF Name | NTID | AAID | NT Length | AA Length | score | probability |
|---|---|---|---|---|---|---|
| AI7503000985_20433135_c3_2142 | 930 | 4702 | 801 | 266 | 151 | 1.4e-10 |

Description
gp:[GI:d1011987:g1402529] [LN:D78257] [AC:D78257] [PN:ORF8] [GN:orf8] [OR:Enterococcus
faecalis] [SR:Enterococcus faecalis plasmid:pYI17 DNA] [DB:genpept-bct1]
[DE:Enterococcus faecalis plasmid pYI17 genes for BacA, BacB, ORF3,ORF4, ORF5, ORF6,
ORF7, ORF8, ORF9, ORF10, ORF11,partial cds.] [LE:1899] [RE:2261] [DI:complement]

| ORF Name | NTID | AAID | NT Length | AA Length | score | probability |
|---|---|---|---|---|---|---|
| AI7503000985_20484386_f2_470 | 931 | 4703 | 129 | 42 | | |

Description
NO-HIT

| ORF Name | NTID | AAID | NT Length | AA Length | score | probability |
|---|---|---|---|---|---|---|
| AI7503000985_20507625_c3_2004 | 932 | 4704 | 1011 | 336 | 244 | 1.0e-20 |

Description
gp:[GI:g3127078] [LN:AF061070] [AC:AF061070] [PN:PtxB] [GN:ptxB] [OR:Pseudomonas
stutzeri] [DB:genpept-bct2] [DE:Pseudomonas stutzeri Orf117 (orf117), Orf86 (orf86)
genes, completecds; and ptxABCDE operon, partial sequence.] [NT:putative binding
protein component of] [LE:2345] [RE:3208] [DI:direct]

| ORF Name | NTID | AAID | NT Length | AA Length | score | probability |
|---|---|---|---|---|---|---|
| AI7503000985_20509637_c3_2110 | 933 | 4705 | 1335 | 444 | 311 | 8.2e-28 |

Description
gp:[GI:g3676414] [LN:AF051917] [AC:AF051917:L19570] [PN:unknown] [OR:Staphylococcus aureus] [DB:genpept-bct2] [DE:Staphylococcus aureus plasmid pSK41, complete sequence.] [NT:Orf423] [LE:755] [RE:2026] [DI:direct]

| ORF Name | NTID | AAID | NT Length | AA Length | score | probability |
|---|---|---|---|---|---|---|
| AI7503000985_20509637_c3_2186 | 934 | 4706 | 1545 | 514 | 1655 | 3.1e-170 |

Description
sp:[LN:GNTK_BACLI] [AC:P46834] [GN:GNTK] [OR:BACILLUS LICHENIFORMIS] [EC:2.7.1.12] [DE:GLUCONOKINASE, (GLUCONATE KINASE)] [SP:P46834] [DB:swissprot] >pir:[LN:JC2304] [AC:JC2304 ] [PN:gluconate kinase,:gntK protein] [GN:gntK ] [CL:xylulokinase] [OR:Bacillus licheniformis] [EC:2.7.-.-] [DB:pir2] >gp:[GI:d1007073:g563951] [LN:BACGNTBL] [AC:D31631] [PN:gluconate kinase] [GN:gntK] [OR:Bacillus licheniformis] [SR:Bacillus licheniformis (strain:BGSC5A2) DNA] [DB:genpept-bct1] [DE:Bacillus licheniformis DNA for hypothetical protein and Gntproteins.] [LE:1725] [RE:3266] [DI:direct]

| ORF Name | NTID | AAID | NT Length | AA Length | score | probability |
|---|---|---|---|---|---|---|
| AI7503000985_20515643_f3_1130 | 935 | 4707 | 141 | 46 | | |

Description
NO-HIT

| ORF Name | NTID | AAID | NT Length | AA Length | score | probability |
|---|---|---|---|---|---|---|
| AI7503000985_20524067_c1_1622 | 936 | 4708 | 639 | 212 | 231 | 2.5e-19 |

Description
pir:[LN:C70041] [AC:C70041 ] [PN:conserved hypothetical protein yvgV] [GN:yvgV ] [OR:Bacillus subtilis] [DB:pir2] >gp:[GI:e1186036:g2635861] [LN:BSUB0018] [AC:Z99121:AL009126] [GN:yvgV] [FN:unknown] [OR:Bacillus subtilis] [DB:genpept-bct1] [DE:Bacillus subtilis complete genome (section 18 of 21): from 3399551to 3609060.] [NT:similar to hypothetical proteins] [LE:37577] [RE:38245] [DI:complement]

| ORF Name | NTID | AAID | NT Length | AA Length | score | probability |
|---|---|---|---|---|---|---|
| AI7503000985_20589568_c1_1392 | 937 | 4709 | 1557 | 518 | 282 | 1.1e-21 |

Description sp:[LN:TAGE_BACSU] [AC:P13484] [GN:TAGE:RODD:GTAA] [OR:BACILLUS SUBTILIS] [EC:2.4.1.52] [DE:(EC 2.4.1.52) (TEICHOIC ACID BIOSYNTHESIS PROTEIN E)] [SP:P13484] [DB:swissprot] >pir:[LN:S06048] [AC:S06048:F69720 ] [PN:poly(glycerol-phosphate) alpha-glucosyltransferase, tagE:probable rodD protein:UDP-glucose--polyglycerol phosphate glucosyltransferase tagE] [GN:tagE:rodD ] [OR:Bacillus subtilis] [EC: 2.4.1.52] [DB:pir2] [MP:310 degrees ] >gp:[GI:g580920] [LN:BSRODC] [AC:X15200] [OR:Bacillus subtilis] [DB:genpept-bct1] [DE:Bacillus subtilis rodC operon.] [NT:rodD (gtaA) polypeptide (AA 1-673)] [SP:P13484] [LE:157] [RE:2178] [DI:direct] >gp:[GI:e1184479:g2636099] [LN:BSUB0019] [AC:Z99122:AL009126] [PN:UDP-glucose:polyglycerol phosphate] [GN:tagE] [FN:teichoic acid biosynthesis] [OR:Bacillus subtilis] [DB:genpept-bct1] [EC:2.4.1.52] [DE:Bacillus subtilis complete genome (section 19 of 21): from 3597091to 3809700.] [NT:alternate gene name: rodD, gtaA, gtaD] [SP:P13484] [LE:80369] [RE:82390] [DI:complement] >gp:[GI:e1184479:g2636099] [LN:BSUB0019] [AC:Z99122:AL009126] [PN:UDP-glucose:polyglycerol phosphate] [GN:tagE] [FN:teichoic acid biosynthesis] [OR:Bacillus subtilis] [DB:genpept] [EC:2.4.1.52] [DE:Bacillus subtilis complete genome (section 19 of 21): from 3597091to 3809700.] [NT:alternate gene name: rodD, gtaA, gtaD] [SP:P13484] [LE:80369] [RE:82390] [DI:complement]

| ORF Name | NTID | AAID | NT Length | AA Length | score | probability |
|---|---|---|---|---|---|---|
| AI7503000985_2068937_f3_1191 | 938 | 4710 | 1539 | 512 | 1041 | 3.6e-105 |

Description pir:[LN:C69676] [AC:C69676:B39096:S16904:I39952:S18269 ] [PN:alkaline phosphatase, III precursor:alkaline phosphatase B (phoB)] [GN:phoB:phoAIII ] [CL:alkaline phosphatase] [OR:Bacillus subtilis] [EC:3.1.3.1] [DB:pir2] >gp:[GI:e1182553:g2632887] [LN:BSUB0004] [AC:Z99107:AL009126] [PN:alkaline phosphatase III] [GN:phoB] [OR:Bacillus subtilis] [DB:genpept-bct1] [EC:3.1.3.1] [DE:Bacillus subtilis complete genome (section 4 of 21): from 600701 to813890.] [NT:alternate gene name: phoAIII] [SP:P19405] [LE:19113] [RE:20501] [DI:complement] >gp:[GI:d1020477:g1945090] [LN:D88802] [AC:D88802] [GN:phoB] [OR:Bacillus subtilis] [SR:Bacillus subtilis (sub_species:Marburg, strain:168, isolate:JH642] [DB:genpept-bct1] [DE:Bacillus subtilis DNA for phoB-rrnE-groESL region, complete cds.] [NT:B. subtilis alkaline phosphatase IIIA; P19405] [LE:6115] [RE:7503] [DI:complement]

| ORF Name | NTID | AAID | NT Length | AA Length | score | probability |
|---|---|---|---|---|---|---|
| AI7503000985_20822287_c1_1574 | 939 | 4711 | 684 | 227 | 563 | 1.6e-54 |

Description sp:[LN:GNTR_BACSU] [AC:P10585] [GN:GNTR] [OR:BACILLUS SUBTILIS] [DE:GLUCONATE OPERON TRANSCRIPTIONAL REPRESSOR (P28 PROTEIN)] [SP:P10585] [DB:swissprot] >pir:[LN:C26190] [AC:C26190:A23537:E69636:S10723 ] [PN:transcription repressor of gluconate operon gntR:gnt operon regulatory protein] [GN:gntR ] [OR:Bacillus subtilis] [DB:pir2] >gp:[GI:d1022429:g563933] [LN:AB005554] [AC:AB005554:D45242:D31629] [PN:gluconate operon repressor] [GN:gntR] [OR:Bacillus subtilis] [SR:Bacillus subtilis (strain:BGSC 1A1) DNA] [DB:genpept-bct1] [DE:Bacillus subtilis genomic DNA, 36 kb region between gnt and ioloperons.] [NT:PROSITE; PS00043; HTH_GNTR_FAMILY; see SWISS_PROT] [LE:4516] [RE:5247] [DI:complement] >gp:[GI:g143014] [LN:BACGNT] [AC:J02584:M24505] [PN:gnt repressor] [OR:Bacillus subtilis] [SR:Bacillus subtilis (strain Marburg 168) DNA] [DB:genpept-bct1] [DE:B.subtilis (gluconate operon) gntR, gntK and gntP genes encodinggnt repressor, gluconate kinase and permease, and gntZ gene.] [LE:236] [RE:967] [DI:direct] >gp:[GI:e1184731:g2636552] [LN:BSUB0021] [AC:Z99124:AL009126] [PN:transcriptional regulator (GntR family)] [GN:gntR] [FN:negative regulation of the gluconate operon] [OR:Bacillus subtilis] [DB:genpept-bct1] [DE:Bacillus subtilis complete genome (section 21 of 21): from 3999281to 4214814.] [SP:P10585] [LE:113345] [RE:114076] [DI:direct]

| ORF Name | NTID | AAID | NT Length | AA Length | score | probability |
|---|---|---|---|---|---|---|
| AI7503000985_20892325_c1_1389 | 940 | 4712 | 156 | 51 | | |

Description

NO-HIT

| ORF Name | NTID | AAID | NT Length | AA Length | score | probability |
|---|---|---|---|---|---|---|
| AI7503000985_210885_f2_690 | 941 | 4713 | 222 | 73 | | |

Description

NO-HIT

| ORF Name | NTID | AAID | NT Length | AA Length | score | probability |
|---|---|---|---|---|---|---|
| AI7503000985_2125000_f1_305 | 942 | 4714 | 126 | 41 | | |

Description

NO-HIT

| ORF Name | NTID | AAID | NT Length | AA Length | score | probability |
|---|---|---|---|---|---|---|
| AI7503000985_2136712_c3_2211 | 943 | 4715 | 1197 | 398 | 469 | 1.5e-44 |

Description pir:[LN:H69784] [AC:H69784 ] [PN:chloramphenicol resistance protein homolog ydhL] [GN:ydhL ] [CL:Streptomyces lividans chloramphenicol resistance protein] [OR:Bacillus subtilis] [DB:pir2] >gp:[GI:e1182559:g2632893] [LN:BSUB0004] [AC:Z99107:AL009126] [GN:ydhL] [FN:unknown] [OR:Bacillus subtilis] [DB:genpept-bct1] [DE:Bacillus subtilis complete genome (section 4 of 21): from 600701 to813890.] [NT:similar to chloramphenicol resistance protein] [LE:24142] [RE:25419] [DI:complement] >gp:[GI:d1020483:g1945096] [LN:D88802] [AC:D88802] [GN:ydhL] [OR:Bacillus subtilis] [SR:Bacillus subtilis (sub_species:Marburg, strain:168, isolate:JH642] [DB:genpept-bct1] [DE:Bacillus subtilis DNA for phoB-rrnE-groESL region, complete cds.] [NT:S. lividans chloramphenicol resistance protein;] [LE:11144] [RE:12421] [DI:complement]

| ORF Name | NTID | AAID | NT Length | AA Length | score | probability |
|---|---|---|---|---|---|---|
| AI7503000985_214026_c2_1767 | 944 | 4716 | 129 | 42 | | |

Description
NO-HIT

| ORF Name | NTID | AAID | NT Length | AA Length | score | probability |
|---|---|---|---|---|---|---|
| AI7503000985_2148428_f2_892 | 945 | 4717 | 123 | 40 | | |

Description
NO-HIT

| ORF Name | NTID | AAID | NT Length | AA Length | score | probability |
|---|---|---|---|---|---|---|
| AI7503000985_21493827_c2_1719 | 946 | 4718 | 129 | 42 | | |

Description
NO-HIT

| ORF Name | NTID | AAID | NT Length | AA Length | score | probability |
|---|---|---|---|---|---|---|
| AI7503000985_21515707_f3_1084 | 947 | 4719 | 198 | 65 | | |

Description
NO-HIT

| ORF Name | NTID | AAID | NT Length | AA Length | score | probability |
|---|---|---|---|---|---|---|
| AI7503000985_21517012_c2_1722 | 948 | 4720 | 411 | 136 | 289 | 1.8e-25 |

Description
gp:[GI:g2318065] [LN:AF012532] [AC:AF012532] [PN:YeeE] [GN:yeeE] [OR:Bacillus subtilis] [DB:genpept-bct1] [DE:Bacillus subtilis strain 168 trpC2 YefA (yefA) gene, partial cds,and YefB (yefB), YefC (yefC), YeeA (yeeA), YeeB (yeeB), YeeC(yeeC), YeeD (yeeD), YeeE (yeeE) and YeeF (yeeF) genes, completecds.] [LE:8308] [RE:9417] [DI:complement]

| ORF Name | NTID | AAID | NT Length | AA Length | score | probability |
|---|---|---|---|---|---|---|
| AI7503000985_21523377_f3_1042 | 949 | 4721 | 171 | 56 | | |

Description
NO-HIT

| ORF Name | NTID | AAID | NT Length | AA Length | score | probability |
|---|---|---|---|---|---|---|
| AI7503000985_21563751_f3_1315 | 950 | 4722 | 237 | 78 | | |

Description
NO-HIT

| ORF Name | NTID | AAID | NT Length | AA Length | score | probability |
|---|---|---|---|---|---|---|
| AI7503000985_21579561_c2_1962 | 951 | 4723 | 123 | 40 | | |

Description
NO-HIT

| ORF Name | NTID | AAID | NT Length | AA Length | score | probability |
|---|---|---|---|---|---|---|
| AI7503000985_21604040_c1_1522 | 952 | 4724 | 2028 | 675 | 1295 | 4.4e-132 |

Description
sp:[LN:FEOB_METJA] [AC:Q57986] [GN:MJ0566] [OR:METHANOCOCCUS JANNASCHII] [DE:FERROUS IRON TRANSPORT PROTEIN B HOMOLOG] [SP:Q57986] [DB:swissprot] >pir:[LN:F64370] [AC:F64370 ] [PN:ferrous iron transport protein B] [CL:ferrous iron transport protein B:translation elongation factor Tu homology] [OR:Methanococcus jannaschii] [DB:pir2] [MP:REV504509-502503 ] >gp:[GI:g1591272] [LN:U67505] [AC:U67505:L77117] [PN:ferrous iron transport protein B (feoB)] [GN:MJ0566] [OR:Methanococcus jannaschii] [DB:genpept-bct2] [DE:Methanococcus jannaschii section 47 of 150 of the complete genome.] [NT:similar to SP:P33650 PID:606344 PID:1199515] [LE:10027] [RE:12033] [DI:complement]

| ORF Name | NTID | AAID | NT Length | AA Length | score | probability |
|---|---|---|---|---|---|---|
| AI7503000985_21664126_c2_1712 | 953 | 4725 | 1083 | 360 | 1138 | 1.9e-115 |

Description
gp:[GI:e1299583:g3687417] [LN:BLY17554] [AC:Y17554] [PN:ornithine carbamoyltransferase] [GN:arcB] [OR:Bacillus licheniformis] [DB:genpept-bct1] [EC:2.1.3.3] [DE:Bacillus licheniformis arcA, arcB, arcC and arcD genes.] [LE:1518] [RE:2525] [DI:direct]

| ORF Name | NTID | AAID | NT Length | AA Length | score | probability |
|---|---|---|---|---|---|---|
| AI7503000985_21674062_c1_1615 | 954 | 4726 | 135 | 44 | | |

Description
NO-HIT

| ORF Name | NTID | AAID | NT Length | AA Length | score | probability |
|---|---|---|---|---|---|---|
| AI7503000985_21678217_c2_1764 | 955 | 4727 | 123 | 40 | | |

Description
NO-HIT

| ORF Name | NTID | AAID | NT Length | AA Length | score | probability |
|---|---|---|---|---|---|---|
| AI7503000985_21687963_c1_1426 | 956 | 4728 | 477 | 158 | 192 | 3.4e-15 |

Description
gp:[GI:g4980875] [LN:AE001717] [AC:AE001717:AE000512] [PN:arginine repressor] [GN:TM0371] [OR:Thermotoga maritima] [DB:genpept-bct2] [DE:Thermotoga maritima section 29 of 136 of the complete genome.] [NT:similar to GB:M27869 SP:P17893 PID:142450] [LE:2550] [RE:3008] [DI:direct] >gp:[GI:e1489641:g5102818] [LN:TMA132286] [AC:AJ132286] [PN:arginine repressor] [GN:argR] [FN:regulation of arginine biosynthesis genes] [OR:Thermotoga maritima] [DB:genpept] [DE:Thermotoga maritima argR gene, strain MSB8.] [LE:1] [RE:459] [DI:direct]

| ORF Name | NTID | AAID | NT Length | AA Length | score | probability |
|---|---|---|---|---|---|---|
| AI7503000985_21759718_f1_181 | 957 | 4729 | 297 | 98 | 76 | 0.044 |

Description
gp:[GI:g4049770] [LN:AF063866] [AC:AF063866] [PN:ORF MSV254 leucine rich repeat gene family] [GN:MSV254] [OR:Melanoplus sanguinipes entomopoxvirus] [DB:genpept-vrl] [DE:Melanoplus sanguinipes entomopoxvirus, complete genome.] [LE:220798] [RE:221799] [DI:direct]

| ORF Name | NTID | AAID | NT Length | AA Length | score | probability |
|---|---|---|---|---|---|---|
| AI7503000985_21774087_c3_2111 | 958 | 4730 | 732 | 243 | 336 | 1.8e-30 |

Description
sp:[LN:Y882_HAEIN] [AC:P44068] [GN:HI0882] [OR:HAEMOPHILUS INFLUENZAE] [DE:HYPOTHETICAL PROTEIN HI0882] [SP:P44068] [DB:swissprot] >pir:[LN:E64015] [AC:E64015 ] [PN:hypothetical protein HI0882] [OR:Haemophilus influenzae] [DB:pir2] >gp:[GI:g1573906] [LN:U32770] [AC:U32770:L42023] [PN:H. influenzae predicted coding region HI0882] [GN:HI0882] [OR:Haemophilus influenzae Rd] [DB:genpept-bct2] [DE:Haemophilus influenzae Rd section 85 of 163 of the complete genome.] [NT:hypothetical protein; identified by GeneMark;] [LE:1177] [RE:1914] [DI:direct]

| ORF Name | NTID | AAID | NT Length | AA Length | score | probability |
|---|---|---|---|---|---|---|
| AI7503000985_22275052_f1_248 | 959 | 4731 | 135 | 44 | | |

Description
NO-HIT

| ORF Name | NTID | AAID | NT Length | AA Length | score | probability |
|---|---|---|---|---|---|---|
| AI7503000985_22296927_f1_418 | 960 | 4732 | 168 | 55 | | |

Description
NO-HIT

| ORF Name | NTID | AAID | NT Length | AA Length | score | probability |
|---|---|---|---|---|---|---|
| AI7503000985_22304578_c2_1792 | 961 | 4733 | 138 | 45 | | |

Description
NO-HIT

| ORF Name | NTID | AAID | NT Length | AA Length | score | probability |
|---|---|---|---|---|---|---|
| AI7503000985_22345265_f1_27 | 962 | 4734 | 189 | 62 | | |

Description
NO-HIT

| ORF Name | NTID | AAID | NT Length | AA Length | score | probability |
|---|---|---|---|---|---|---|
| AI7503000985_22380343_f2_827 | 963 | 4735 | 1983 | 660 | 363 | 2.3e-30 |

Description
sp:[LN:ALYS_ENTFA] [AC:P37710] [OR:ENTEROCOCCUS FAECALIS] [SR:,STREPTOCOCCUS FAECALIS] [EC:3.5.1.28] [DE:AUTOLYSIN, (N-ACETYLMURAMOYL-L-ALANINE AMIDASE)] [SP:P37710] [DB:swissprot] >pir:[LN:A38109] [AC:A38109 ] [PN:autolysin] [OR:Enterococcus faecalis] [DB:pir2] >gp:[GI:g829194] [LN:STRHYDROLA] [AC:M58002] [PN:bacterial cell wall hydrolase] [OR:Streptococcus faecalis] [SR:Streptococcus faecalis DNA] [DB:genpept-bct1] [DE:Streptococcus faecalis bacterial cell wall hydrolase gene, completecds.] [LE:536] [RE:2551] [DI:direct]

| ORF Name | NTID | AAID | NT Length | AA Length | score | probability |
|---|---|---|---|---|---|---|
| AI7503000985_2242136_c3_2048 | 964 | 4736 | 684 | 227 | 583 | 1.2e-56 |

Description
gp:[GI:e303881:g1850807] [LN:CPCPEAA] [AC:X71844] [PN:putative transposase] [OR:Clostridium perfringens] [DB:genpept-bct1] [DE:C.perfringens uapC, cpe, and nadC genes.] [LE:2477] [RE:2932] [DI:direct]

| ORF Name | NTID | AAID | NT Length | AA Length | score | probability |
|---|---|---|---|---|---|---|
| AI7503000985_22453186_f3_989 | 965 | 4737 | 159 | 52 | | |

Description
NO-HIT

| ORF Name | NTID | AAID | NT Length | AA Length | score | probability |
|---|---|---|---|---|---|---|
| AI7503000985_22460302_c1_1511 | 966 | 4738 | 756 | 251 | 334 | 3.0e-30 |

Description
gp:[GI:g2735514] [LN:SCU96108] [AC:U96108] [PN:SceA precursor] [GN:sceA]
[OR:Staphylococcus carnosus] [DB:genpept-bct2] [DE:Staphylococcus carnosus
(3R)-hydroxymyristoyl acyl carrier proteindehydrase homolog (fabZ) gene, partial cds,
YwpF homolog,single-strand binding protein homolog (ssb), SceD precursor (sceD),SceA
precursor (sceA) and SceE precursor (sceE) genes, completecds, and TenA homolog (tenA)
gene, partial cds.] [NT:secreted protein] [LE:2736] [RE:3449] [DI:direct]

| ORF Name | NTID | AAID | NT Length | AA Length | score | probability |
|---|---|---|---|---|---|---|
| AI7503000985_22656300_f2_881 | 967 | 4739 | 1542 | 513 | 1508 | 1.2e-154 |

Description
gp:[GI:d1039113:g4514332] [LN:AB013369] [AC:AB013369] [OR:Bacillus halodurans]
[SR:Bacillus halodurans (strain:C-125) DNA] [DB:genpept-bct1] [DE:Bacillus halodurans
C-125 yesT and comEC genes, partial andcomplete cds.] [NT:unknown] [LE:4328] [RE:5830]
[DI:direct]

| ORF Name | NTID | AAID | NT Length | AA Length | score | probability |
|---|---|---|---|---|---|---|
| AI7503000985_22735877_f3_1047 | 968 | 4740 | 141 | 46 | | |

Description
NO-HIT

| ORF Name | NTID | AAID | NT Length | AA Length | score | probability |
|---|---|---|---|---|---|---|
| AI7503000985_23438751_f2_550 | 969 | 4741 | 228 | 75 | | |

Description
NO-HIT

| ORF Name | NTID | AAID | NT Length | AA Length | score | probability |
|---|---|---|---|---|---|---|
| AI7503000985_234432_c1_1440 | 970 | 4742 | 150 | 49 | | |

Description
NO-HIT

| ORF Name | NTID | AAID | NT Length | AA Length | score | probability |
|---|---|---|---|---|---|---|
| AI7503000985_23445387_c3_1998 | 971 | 4743 | 195 | 64 | | |

Description
NO-HIT

| ORF Name | NTID | AAID | NT Length | AA Length | score | probability |
|---|---|---|---|---|---|---|
| AI7503000985_23468942_f1_79 | 972 | 4744 | 1101 | 366 | 928 | 3.4e-93 |

Description
pir:[LN:A69984] [AC:A69984 ] [PN:endo-1,4-beta-glucanase homolog ysdC] [GN:ysdC ]
[CL:thermophilic aminopeptidase I alpha chain] [OR:Bacillus subtilis] [DB:pir2]
>gp:[GI:e1184131:g2635347] [LN:BSUB0015] [AC:Z99118:AL009126] [GN:ysdC] [FN:unknown]
[OR:Bacillus subtilis] [DB:genpept-bct1] [DE:Bacillus subtilis complete genome (section
15 of 21): from 2795131to 3013540.] [NT:similar to endo-1,4-beta-glucanase] [LE:154199]
[RE:155284] [DI:complement] >gp:[GI:e1165304:g1770012] [LN:BSZ75208] [AC:Z75208]
[PN:hypothetical protein] [GN:ysdC] [OR:Bacillus subtilis] [DB:genpept-bct1]
[DE:B.subtilis genomic sequence 89009bp.] [NT:homology to celA of Clostridium
thermocellum and] [LE:14623] [RE:15708] [DI:direct]

| ORF Name | NTID | AAID | NT Length | AA Length | score | probability |
|---|---|---|---|---|---|---|
| AI7503000985_23475251_c2_1952 | 973 | 4745 | 141 | 46 | | |

Description
NO-HIT

| ORF Name | NTID | AAID | NT Length | AA Length | score | probability |
|---|---|---|---|---|---|---|
| AI7503000985_23475325_c1_1479 | 974 | 4746 | 159 | 52 | | |

Description
NO-HIT

| ORF Name | NTID | AAID | NT Length | AA Length | score | probability |
|---|---|---|---|---|---|---|
| AI7503000985_23476503_f3_1228 | 975 | 4747 | 189 | 62 | | |

Description
NO-HIT

| ORF Name | NTID | AAID | NT Length | AA Length | score | probability |
|---|---|---|---|---|---|---|
| AI7503000985_23476702_c1_1496 | 976 | 4748 | 882 | 293 | 595 | 6.6e-58 |

Description
sp:[LN:YWBI_BACSU] [AC:P39592] [GN:YWBI:IPA-24D] [OR:BACILLUS SUBTILIS]
[DE:HYPOTHETICAL TRANSCRIPTIONAL REGULATOR IN THIK-EPR INTERGENIC REGION] [SP:P39592]
[DB:swissprot] >pir:[LN:S39679] [AC:S39679:G70051 ] [PN:transcription regulator homolog
ywbI:protein ipa-24d] [GN:ywbI ] [CL:probable transcription regulator lsyR]
[OR:Bacillus subtilis] [DB:pir2] >gp:[GI:g413948] [LN:BSGENR] [AC:X73124] [GN:ipa-24d]
[OR:Bacillus subtilis] [DB:genpept-bct1] [DE:B.subtilis genomic region (325 to 333).]
[SP:P39592] [LE:24460] [RE:25365] [DI:direct] >gp:[GI:e1186330:g2636366] [LN:BSUB0020]
[AC:Z99123:AL009126] [GN:ywbI] [FN:unknown] [OR:Bacillus subtilis] [DB:genpept-bct1]
[DE:Bacillus subtilis complete genome (section 20 of 21): from 3798401to 4010550.]
[NT:alternate gene name: ipa-24d; similar to] [SP:P39592] [LE:132594] [RE:133499]
[DI:complement]

| ORF Name | NTID | AAID | NT Length | AA Length | score | probability |
|---|---|---|---|---|---|---|
| AI7503000985_23479702_c3_2053 | 977 | 4749 | 273 | 90 | | |

Description
NO-HIT

| ORF Name | NTID | AAID | NT Length | AA Length | score | probability |
|---|---|---|---|---|---|---|
| AI7503000985_23480467_c1_1549 | 978 | 4750 | 912 | 303 | 862 | 3.4e-86 |

Description
pir:[LN:G69879] [AC:G69879 ] [PN:L-serine dehydratase homolog ylpA] [GN:ylpA ]
[OR:Bacillus subtilis] [DB:pir2] >gp:[GI:e1185177:g2633958] [LN:BSUB0009]
[AC:Z99112:AL009126] [GN:ylpA] [FN:unknown] [OR:Bacillus subtilis] [DB:genpept-bct1]
[DE:Bacillus subtilis complete genome (section 9 of 21): from 1598421to 1807200.]
[NT:similar to L-serine dehydratase] [LE:59909] [RE:60811] [DI:direct]
>gp:[GI:e323528:g2337815] [LN:BSY13937] [AC:Y13937] [PN:putative YhaP protein]
[GN:ylpA] [FN:unknown] [OR:Bacillus subtilis] [DB:genpept-bct1] [DE:Bacillus subtilis
genomic DNA from the spoVM region.] [LE:21681] [RE:22583] [DI:direct]

| ORF Name | NTID | AAID | NT Length | AA Length | score | probability |
|---|---|---|---|---|---|---|
| AI7503000985_235205_c2_1845 | 979 | 4751 | 138 | 45 | | |

Description
NO-HIT

| ORF Name | NTID | AAID | NT Length | AA Length | score | probability |
|---|---|---|---|---|---|---|
| AI7503000985_23553275_f3_1064 | 980 | 4752 | 126 | 41 | | |

Description
NO-HIT

| ORF Name | NTID | AAID | NT Length | AA Length | score | probability |
|---|---|---|---|---|---|---|
| AI7503000985_23556338_c1_1568 | 981 | 4753 | 303 | 100 | 170 | 7.2e-13 |

Description
sp:[LN:YCNE_BACSU] [AC:P94425] [GN:YCNE] [OR:BACILLUS SUBTILIS] [DE:HYPOTHETICAL 10.9
KD PROTEIN IN PHRC-GDH INTERGENIC REGION] [SP:P94425] [DB:swissprot] >pir:[LN:A69764]
[AC:A69764 ] [PN:conserved hypothetical protein ycnE] [GN:ycnE ] [OR:Bacillus subtilis]
[DB:pir2] >gp:[GI:e1182354:g2632688] [LN:BSUB0003] [AC:Z99106:AL009126] [GN:ycnE]
[FN:unknown] [OR:Bacillus subtilis] [DB:genpept-bct1] [DE:Bacillus subtilis complete
genome (section 3 of 21): from 402751 to611850.] [NT:similar to hypothetical proteins]
[SP:P94425] [LE:36112] [RE:36399] [DI:complement] >gp:[GI:d1009654:g1805457]
[LN:D50453] [AC:D50453] [GN:ycnE] [OR:Bacillus subtilis] [SR:Bacillus subtilis
(strain:168 trpC2) DNA] [DB:genpept-bct1] [DE:Bacillus subtilis DNA for 25-36 degree
region containing theamyE-srfA region, complete cds.] [LE:118515] [RE:118802]
[DI:complement]

| ORF Name | NTID | AAID | NT Length | AA Length | score | probability |
|---|---|---|---|---|---|---|
| AI7503000985_23593800_c1_1493 | 982 | 4754 | 942 | 313 | 141 | 8.3e-08 |

Description
pir:[LN:D69778] [AC:D69778 ] [PN:hypothetical protein ydeJ] [GN:ydeJ ] [OR:Bacillus
subtilis] [DB:pir2] >gp:[GI:d1020110:g1881330] [LN:AB001488] [AC:AB001488] [GN:ydeJ]
[OR:Bacillus subtilis] [SR:Bacillus subtilis (strain:168) DNA] [DB:genpept-bct1]
[DE:Bacillus subtilis genome sequence, 148 kb sequence of the regionbetween 35 and 47
degree.] [NT:FUNCTION UNKNOWN.] [LE:102509] [RE:103168] [DI:complement]
>gp:[GI:e1182488:g2632822] [LN:BSUB0003] [AC:Z99106:AL009126] [GN:ydeJ] [FN:unknown]
[OR:Bacillus subtilis] [DB:genpept-bct1] [DE:Bacillus subtilis complete genome (section
3 of 21): from 402751 to611850.] [LE:166254] [RE:166913] [DI:complement]

| ORF Name | NTID | AAID | NT Length | AA Length | score | probability |
|---|---|---|---|---|---|---|
| AI7503000985_23595262_f2_695 | 983 | 4755 | 123 | 40 | | |

Description
NO-HIT

| ORF Name | NTID | AAID | NT Length | AA Length | score | probability |
|---|---|---|---|---|---|---|
| AI7503000985_23595312_f3_948 | 984 | 4756 | 132 | 43 | | |

Description
NO-HIT

| ORF Name | NTID | AAID | NT Length | AA Length | score | probability |
|---|---|---|---|---|---|---|
| AI7503000985_23600412_f3_960 | 985 | 4757 | 1242 | 413 | 546 | 1.0e-52 |

Description
pir:[LN:E69783] [AC:E69783 ] [PN:bicyclomycin resistance protein homolog ydgK] [GN:ydgK
] [CL:bicyclomycin resistance protein] [OR:Bacillus subtilis] [DB:pir2]
>gp:[GI:d1020154:g1881374] [LN:AB001488] [AC:AB001488] [GN:ydgK] [OR:Bacillus subtilis]
[SR:Bacillus subtilis (strain:168) DNA] [DB:genpept-bct1] [DE:Bacillus subtilis genome
sequence, 148 kb sequence of the regionbeween 35 and 47 degree.] [NT:SIMILAR TO
BICYCLOMYCIN RESISTANCE PROTEIN.] [LE:146860] [RE:148068] [DI:direct]
>gp:[GI:e1182547:g2632881] [LN:BSUB0004] [AC:Z99107:AL009126] [GN:ydgK] [FN:unknown]
[OR:Bacillus subtilis] [DB:genpept-bct1] [DE:Bacillus subtilis complete genome (section
4 of 21): from 600701 to813890.] [NT:similar to bicyclomycin resistance protein]
[LE:12656] [RE:13864] [DI:direct]

| ORF Name | NTID | AAID | NT Length | AA Length | score | probability |
|---|---|---|---|---|---|---|
| AI7503000985_23600752_f1_215 | 986 | 4758 | 240 | 79 | 73 | 0.014 |

Description
pir:[LN:S69592] [AC:S69592 ] [PN:hypothetical protein YDR509w] [OR:Saccharomyces
cerevisiae] [DB:pir2] [MP:4R ]

| ORF Name | NTID | AAID | NT Length | AA Length | score | probability |
|---|---|---|---|---|---|---|
| AI7503000985_23602015_c2_1892 | 987 | 4759 | 687 | 228 | 374 | 1.7e-34 |

Description
sp:[LN:YBBL_ECOLI] [AC:P77279] [GN:YBBL] [OR:ESCHERICHIA COLI] [DE:HYPOTHETICAL ABC
TRANSPORTER ATP-BINDING PROTEIN YBBL] [SP:P77279] [DB:swissprot] >pir:[LN:A64780]
[AC:A64780 ] [PN:probable ABC-type transport protein ybbL:probable ABC transporter,
ATP-binding protein ybbL] [GN:ybbL ] [CL:ATP-binding cassette homology] [OR:Escherichia
coli] [DB:pir2] >gp:[GI:g1773172] [LN:ECU82664] [AC:U82664] [OR:Escherichia coli]
[DB:genpept-bct1] [DE:Escherichia coli minutes 9 to 11 genomic sequence.]
[NT:hypothetical protein] [LE:95367] [RE:96044] [DI:direct] >gp:[GI:g1786698]
[LN:AE000155] [AC:AE000155:U00096] [PN:putative ATP-binding component of a transport]
[GN:ybbL] [FN:putative transport; Not classified] [OR:Escherichia coli]
[DB:genpept-bct2] [DE:Escherichia coli K-12 MG1655 section 45 of 400 of the
completegenome.] [NT:o225; This 225 aa ORF is 32 pct identical (7 gaps)] [LE:4439]
[RE:5116] [DI:direct]

| ORF Name | NTID | AAID | NT Length | AA Length | score | probability |
|---|---|---|---|---|---|---|
| AI7503000985_23604052_f1_209 | 988 | 4760 | 318 | 105 | 81 | 0.0020 |

Description sp:[LN:YE1A_METJA] [AC:P81328] [GN:MJ1417.1] [OR:METHANOCOCCUS JANNASCHII] [DE:HYPOTHETICAL PROTEIN MJ1417.1] [SP:P81328] [DB:swissprot] >gp:[GI:g2826408] [LN:U67582] [AC:U67582:L77117] [PN:M. jannaschii predicted coding region MJ1417.1] [GN:MJ1417.1] [OR:Methanococcus jannaschii] [DB:genpept-bct2] [DE:Methanococcus jannaschii section 124 of 150 of the complete genome.] [NT:Brute Force ORF; identified by GeneMark; putative] [LE:4562] [RE:4999] [DI:direct]

| ORF Name | NTID | AAID | NT Length | AA Length | score | probability |
|---|---|---|---|---|---|---|
| AI7503000985_23620252_c1_1606 | 989 | 4761 | 138 | 45 | | |

Description
NO-HIT

| ORF Name | NTID | AAID | NT Length | AA Length | score | probability |
|---|---|---|---|---|---|---|
| AI7503000985_23625005_c3_2103 | 990 | 4762 | 138 | 45 | | |

Description
NO-HIT

| ORF Name | NTID | AAID | NT Length | AA Length | score | probability |
|---|---|---|---|---|---|---|
| AI7503000985_23631311_c2_1820 | 991 | 4763 | 297 | 98 | | |

Description
NO-HIT

| ORF Name | NTID | AAID | NT Length | AA Length | score | probability |
|---|---|---|---|---|---|---|
| AI7503000985_23635926_f2_538 | 992 | 4764 | 144 | 47 | | |

Description
NO-HIT

| ORF Name | NTID | AAID | NT Length | AA Length | score | probability |
|---|---|---|---|---|---|---|
| AI7503000985_23636343_c1_1383 | 993 | 4765 | 813 | 270 | 409 | 3.4e-38 |

Description sp:[LN:PHNE_ECOLI] [AC:P16683:Q47479:P76792:Q47716] [GN:PHNE] [OR:ESCHERICHIA COLI] [DE:PHOSPHONATES TRANSPORT SYSTEM PERMEASE PROTEIN PHNE] [SP:P16683:Q47479:P76792:Q47716] [DB:swissprot] >pir:[LN:F35718] [AC:F35718:A42732:S56332:S56331:G65219:F65219 ] [PN:phnE protein:hypothetical protein b4103] [GN:phnE ] [CL:phnE protein] [OR:Escherichia coli] [DB:pir1] >gp:[GI:g147198] [LN:ECOPHNAQ] [AC:J05260] [OR:Escherichia coli] [SR:E.coli (strain B) DNA] [DB:genpept-bct1] [DE:E.coli psiD locus containing alkylphosphonate uptake (phn) genes Athrough Q, complete cds.] [NT:phnE protein] [LE:6227] [RE:7057] [DI:direct]

| ORF Name | NTID | AAID | NT Length | AA Length | score | probability |
|---|---|---|---|---|---|---|
| AI7503000985_23642942_c3_2087 | 994 | 4766 | 231 | 76 | | |

Description
NO-HIT

| ORF Name | NTID | AAID | NT Length | AA Length | score | probability |
|---|---|---|---|---|---|---|
| AI7503000985_23649187_c3_2050 | 995 | 4767 | 2637 | 878 | 227 | 9.2e-15 |

Description
gp:[GI:g4049717] [LN:AF063866] [AC:AF063866] [PN:ORF MSV156 hypothetical protein] [GN:MSV156] [OR:Melanoplus sanguinipes entomopoxvirus] [DB:genpept-vrl] [DE:Melanoplus sanguinipes entomopoxvirus, complete genome.] [LE:140126] [RE:143509] [DI:direct]

| ORF Name | NTID | AAID | NT Length | AA Length | score | probability |
|---|---|---|---|---|---|---|
| AI7503000985_23672518_f3_1031 | 996 | 4768 | 1011 | 336 | 529 | 6.5e-51 |

Description
pir:[LN:F69659] [AC:F69659 ] [PN:molybdopterin biosynthesis protein moeB] [GN:moeB ] [OR:Bacillus subtilis] [DB:pir2] >gp:[GI:e1185017:g2633798] [LN:BSUB0008] [AC:Z99111:AL009126] [PN:molybdopterin biosynthesis protein] [GN:moeB] [OR:Bacillus subtilis] [DB:genpept-bct1] [DE:Bacillus subtilis complete genome (section 8 of 21): from 1394791to 1603020.] [LE:100770] [RE:101789] [DI:direct] >gp:[GI:g3282111] [LN:AF012285] [AC:AF012285:AF012284:U51911] [PN:molybdopterin biosynthesis protein MoeB] [GN:moeB] [OR:Bacillus subtilis] [DB:genpept-bct2] [DE:Bacillus subtilis mobA-nprE gene region.] [NT:member of the moeB/hesA/thiF family; similar to] [LE:1258] [RE:2277] [DI:direct]

| ORF Name | NTID | AAID | NT Length | AA Length | score | probability |
|---|---|---|---|---|---|---|
| AI7503000985_23680300_f1_330 | 997 | 4769 | 948 | 315 | | |

Description
NO-HIT

| ORF Name | NTID | AAID | NT Length | AA Length | score | probability |
|---|---|---|---|---|---|---|
| AI7503000985_23710811_c1_1425 | 998 | 4770 | 159 | 52 | | |

Description
NO-HIT

| ORF Name | NTID | AAID | NT Length | AA Length | score | probability |
|---|---|---|---|---|---|---|
| AI7503000985_23828253_f1_81 | 999 | 4771 | 156 | 51 | | |

Description
NO-HIT

| ORF Name | NTID | AAID | NT Length | AA Length | score | probability |
|---|---|---|---|---|---|---|
| AI7503000985_23866552_f2_815 | 1000 | 4772 | 141 | 46 | | |

Description
NO-HIT

| ORF Name | NTID | AAID | NT Length | AA Length | score | probability |
|---|---|---|---|---|---|---|
| AI7503000985_23868887_c2_1828 | 1001 | 4773 | 189 | 62 | | |

Description
NO-HIT

| ORF Name | NTID | AAID | NT Length | AA Length | score | probability |
|---|---|---|---|---|---|---|
| AI7503000985_24015687_c1_1476 | 1002 | 4774 | 1521 | 506 | 2197 | 1.1e-227 |

Description
gp:[GI:g4574120] [LN:AF009415] [AC:AF009415] [PN:glycine betaine aldehyde dehydrogenase] [GN:cudA] [OR:Staphylococcus xylosus] [DB:genpept-bct2] [DE:Staphylococcus xylosus choline transporter (cudT), putativeregulatory protein (cudC), glycine betaine aldehyde dehydrogenase(cudA), and choline dehydrogenase (cudB) genes, complete cds.] [NT:CudA] [LE:3363] [RE:4856] [DI:direct]

| ORF Name | NTID | AAID | NT Length | AA Length | score | probability |
|---|---|---|---|---|---|---|
| AI7503000985_24019026_f1_390 | 1003 | 4775 | 156 | 51 | | |

Description
NO-HIT

| ORF Name | NTID | AAID | NT Length | AA Length | score | probability |
|---|---|---|---|---|---|---|
| AI7503000985_24022177_c1_1575 | 1004 | 4776 | 1389 | 462 | 1499 | 1.1e-153 |

Description
sp:[LN:GNTP_BACSU] [AC:P12012] [GN:GNTP] [OR:BACILLUS SUBTILIS] [DE:GLUCONATE PERMEASE] [SP:P12012] [DB:swissprot] >pir:[LN:A26190] [AC:A26190:D69636 ] [PN:gluconate permease gntP] [GN:gntP ] [CL:D-serine permease] [OR:Bacillus subtilis] [DB:pir2] >gp:[GI:d1022427:g563931] [LN:AB005554] [AC:AB005554:D45242:D31629] [PN:gluconate permease] [GN:gntP] [OR:Bacillus subtilis] [SR:Bacillus subtilis (strain:BGSC 1A1) DNA] [DB:genpept-bct1] [DE:Bacillus subtilis genomic DNA, 36 kb region between gnt and iooperons.] [NT:homologs are found in E. coli and H. influenzae;] [LE:1607] [RE:2953] [DI:complement] >gp:[GI:g143016] [LN:BACGNT] [AC:J02584:M24505] [PN:permease] [OR:Bacillus subtilis] [SR:Bacillus subtilis (strain Marburg 168) DNA] [DB:genpept-bct1] [DE:B.subtilis (gluconate operon) gntR, gntK and gntP genes encodinggnt repressor, gluconate kinase and permease, and gntZ gene.] [LE:2530] [RE:3876] [DI:direct] >gp:[GI:e1184733:g2636554] [LN:BSUB0021] [AC:Z99124:AL009126] [PN:gluconate permease] [GN:gntP] [FN:gluconate utilization] [OR:Bacillus subtilis] [DB:genpept-bct1] [DE:Bacillus subtilis complete genome (section 21 of 21): from 3999281to 4214814.] [SP:P12012] [LE:115639] [RE:116985] [DI:direct]

| ORF Name | NTID | AAID | NT Length | AA Length | score | probability |
|---|---|---|---|---|---|---|
| AI7503000985_24070155_f2_878 | 1005 | 4777 | 495 | 164 | 280 | 1.6e-24 |

Description
pir:[LN:A69849] [AC:A69849 ] [PN:hypothetical protein yjdF] [GN:yjdF ] [OR:Bacillus subtilis] [DB:pir2] >gp:[GI:e1183223:g2633557] [LN:BSUB0007] [AC:Z99110:AL009126] [GN:yjdF] [FN:unknown] [OR:Bacillus subtilis] [DB:genpept-bct1] [DE:Bacillus subtilis complete genome (section 7 of 21): from 1194391to 1411140.] [LE:80891] [RE:81373] [DI:direct]

| ORF Name | NTID | AAID | NT Length | AA Length | score | probability |
|---|---|---|---|---|---|---|
| AI7503000985_24087760_c2_1742 | 1006 | 4778 | 903 | 300 | 665 | 2.5e-65 |

Description
pir:[LN:F69997] [AC:F69997 ] [PN:hypothetical protein ytnM] [GN:ytnM ] [OR:Bacillus subtilis] [DB:pir2] >gp:[GI:e1184177:g2635393] [LN:BSUB0015] [AC:Z99118:AL009126] [GN:ytnM] [FN:unknown] [OR:Bacillus subtilis] [DB:genpept-bct1] [DE:Bacillus subtilis complete genome (section 15 of 21): from 2795131to 3013540.] [LE:202739] [RE:203641] [DI:complement] >gp:[GI:e1185801:g2635412] [LN:BSUB0016] [AC:Z99119:AL009126] [GN:ytnM] [FN:unknown] [OR:Bacillus subtilis] [DB:genpept-bct1] [DE:Bacillus subtilis complete genome (section 16 of 21): from 2997771to 3213410.] [LE:99] [RE:1001] [DI:complement] >gp:[GI:g2293257] [LN:AF008220] [AC:AF008220] [PN:YtnM] [GN:ytnM] [OR:Bacillus subtilis] [DB:genpept-bct2] [DE:Bacillus subtilis rrnB-dnaB genomic region.] [NT:similar to a hypothetical protein] [LE:179426] [RE:180328] [DI:direct]

| ORF Name | NTID | AAID | NT Length | AA Length | score | probability |
|---|---|---|---|---|---|---|
| AI7503000985_24095327_c2_1770 | 1007 | 4779 | 135 | 44 | | |

Description
NO-HIT

| ORF Name | NTID | AAID | NT Length | AA Length | score | probability |
|---|---|---|---|---|---|---|
| AI7503000985_24101701_c1_1485 | 1008 | 4780 | 1542 | 513 | 1542 | 2.9e-158 |

Description
gp:[GI:d1039113:g4514332] [LN:AB013369] [AC:AB013369] [OR:Bacillus halodurans] [SR:Bacillus halodurans (strain:C-125) DNA] [DB:genpept-bct1] [DE:Bacillus halodurans C-125 yesT and comEC genes, partial andcomplete cds.] [NT:unknown] [LE:4328] [RE:5830] [DI:direct]

| ORF Name | NTID | AAID | NT Length | AA Length | score | probability |
|---|---|---|---|---|---|---|
| AI7503000985_24220260_c3_2109 | 1009 | 4781 | 1056 | 351 | 121 | 0.00034 |

Description
gp:[GI:e316518:g2230824] [LN:DDSTATFIR] [AC:Y13097] [PN:STAT protein] [GN:dstA] [FN:regulates stalk cell differentiation] [OR:Dictyostelium discoideum] [DB:genpept-inv1] [DE:D.discoideum mRNA for stat protein, first finger stage.] [LE:507] [RE:2630] [DI:direct]

| ORF Name | NTID | AAID | NT Length | AA Length | score | probability |
|---|---|---|---|---|---|---|
| AI7503000985_24220290_f2_582 | 1010 | 4782 | 1482 | 493 | 935 | 6.2e-94 |

Description
sp:[LN:ALDA_ECOLI] [AC:P25553] [GN:ALDA:ALD] [OR:ESCHERICHIA COLI] [EC:1.2.1.22] [DE:ALDEHYDE DEHYDROGENASE A, (LACTALDEHYDE DEHYDROGENASE)] [SP:P25553] [DB:swissprot]

| ORF Name | NTID | AAID | NT Length | AA Length | score | probability |
|---|---|---|---|---|---|---|
| AI7503000985_24224037_c2_1825 | 1011 | 4783 | 144 | 47 | | |

Description
NO-HIT

| ORF Name | NTID | AAID | NT Length | AA Length | score | probability |
|---|---|---|---|---|---|---|
| AI7503000985_24225015_f3_1098 | 1012 | 4784 | 168 | 55 | | |

Description
NO-HIT

| ORF_Name | NTID | AAID | NT Length | AA Length | score | probability |
|---|---|---|---|---|---|---|
| AI7503000985_24225015_f3_1127 | 1013 | 4785 | 141 | 46 | | |

Description
NO-HIT

| ORF_Name | NTID | AAID | NT Length | AA Length | score | probability |
|---|---|---|---|---|---|---|
| AI7503000985_24226577_c3_2184 | 1014 | 4786 | 834 | 277 | 153 | 9.4e-11 |

Description
sp:[LN:MERR_BACSR] [AC:P22853] [GN:MERR] [OR:BACILLUS SP] [SR:RC607,] [DE:MERCURIC RESISTANCE OPERON REGULATORY PROTEIN] [SP:P22853] [DB:swissprot] >pir:[LN:A32227] [AC:A32227 ] [PN:hypothetical protein 1 (mer operon)] [CL:transcription repressor glnR] [OR:Bacillus sp.] [DB:pir2] >gp:[GI:e301549:g2995399] [LN:BMMERAR2] [AC:Y09907] [PN:regulatory protein] [GN:merR] [OR:Bacillus megaterium] [DB:genpept-bct1] [DE:Bacillus megaterium ORF2, ORF3, ORF4, merR and merA genes.] [LE:574] [RE:972] [DI:direct] >gp:[GI:g1129093] [LN:AF138877] [AC:AF138877:M22708:M22709:AH003258] [PN:mercury resistance operon negative regulator] [GN:merR1] [OR:Bacillus sp. RC607] [DB:genpept-bct2] [DE:Bacillus sp. RC607 mercury resistance operon, complete sequence.] [LE:827] [RE:1225] [DI:direct]

| ORF_Name | NTID | AAID | NT Length | AA Length | score | probability |
|---|---|---|---|---|---|---|
| AI7503000985_24250177_c1_1630 | 1015 | 4787 | 714 | 237 | 653 | 4.7e-64 |

Description
gp:[GI:e1429599:g4756153] [LN:A67161] [AC:A67161] [FN:NARJ GENE] [OR:Staphylococcus carnosus] [DB:genpept-pat] [DE:Sequence 1 from Patent EP0805205.] [NT:unnamed protein product] [LE:9374] [RE:9949] [DI:direct] >gp:[GI:g3929524] [LN:AF029224] [AC:AF029224:AF029225] [PN:NarJ] [GN:narJ] [OR:Staphylococcus carnosus] [DB:genpept-bct2] [DE:Staphylococcus carnosus nir and nar operons, complete sequences.] [NT:similar to Escherichia coli nitrate reductases NRA] [LE:11559] [RE:12134] [DI:direct]

| ORF_Name | NTID | AAID | NT Length | AA Length | score | probability |
|---|---|---|---|---|---|---|
| AI7503000985_24251251_c2_1868 | 1016 | 4788 | 129 | 42 | | |

Description
NO-HIT

| ORF_Name | NTID | AAID | NT Length | AA Length | score | probability |
|---|---|---|---|---|---|---|
| AI7503000985_24251400_f2_508 | 1017 | 4789 | 792 | 263 | 721 | 2.9e-71 |

Description
gp:[GI:g1854577] [LN:STALYTS] [AC:L42945] [GN:lytR] [OR:Staphylococcus aureus] [DB:genpept-bct1] [DE:Staphylococcus aureus lytS and lytR genes, complete cds.] [LE:1849] [RE:2589] [DI:direct]

| ORF_Name | NTID | AAID | NT Length | AA Length | score | probability |
|---|---|---|---|---|---|---|
| AI7503000985_24251635_f3_1143 | 1018 | 4790 | 123 | 40 | | |

Description
NO-HIT

| ORF Name | NTID | AAID | NT Length | AA Length | score | probability |
|---|---|---|---|---|---|---|
| AI7503000985_24261062_c1_1458 | 1019 | 4791 | 1773 | 590 | 1994 | 3.7e-206 |

Description
pir:[LN:F70040] [AC:F70040 ] [PN:sulfite reductase homolog yvgQ] [GN:yvgQ ] [CL:sulfite reductase (ferredoxin)] [OR:Bacillus subtilis] [DB:pir2] >gp:[GI:e1186031:g2635856] [LN:BSUB0018] [AC:Z99121:AL009126] [GN:yvgQ] [FN:unknown] [OR:Bacillus subtilis] [DB:genpept-bct1] [DE:Bacillus subtilis complete genome (section 18 of 21): from 3399551to 3609060.] [NT:similar to sulfite reductase] [LE:30110] [RE:31825] [DI:complement]

| ORF Name | NTID | AAID | NT Length | AA Length | score | probability |
|---|---|---|---|---|---|---|
| AI7503000985_24269812_f1_414 | 1020 | 4792 | 627 | 208 | 285 | 4.7e-25 |

Description
gp:[GI:e1312907:g3355681] [LN:SC1C2] [AC:AL031124] [PN:hypothetical protein SC1C2.14c] [GN:SC1C2.14c] [OR:Streptomyces coelicolor] [DB:genpept-bct1] [DE:Streptomyces coelicolor cosmid 1C2.] [NT:SC1C2.14c, unknown, len: 185 aa; similar to] [LE:14959] [RE:15516] [DI:complement]

| ORF Name | NTID | AAID | NT Length | AA Length | score | probability |
|---|---|---|---|---|---|---|
| AI7503000985_24273375_c2_1749 | 1021 | 4793 | 600 | 199 | 789 | 1.8e-78 |

Description
gp:[GI:g4574118] [LN:AF009415] [AC:AF009415] [PN:choline transporter] [GN:cudT] [OR:Staphylococcus xylosus] [DB:genpept-bct2] [DE:Staphylococcus xylosus choline transporter (cudT), putativeregulatory protein (cudC), glycine betaine aldehyde dehydrogenase(cudA), and choline dehydrogenase (cudB) genes, complete cds.] [NT:CudT] [LE:811] [RE:2433] [DI:direct]

| ORF Name | NTID | AAID | NT Length | AA Length | score | probability |
|---|---|---|---|---|---|---|
| AI7503000985_24275187_f2_858 | 1022 | 4794 | 129 | 42 | | |

Description
NO-HIT

| ORF Name | NTID | AAID | NT Length | AA Length | score | probability |
|---|---|---|---|---|---|---|
| AI7503000985_24303775_f2_444 | 1023 | 4795 | 165 | 54 | | |

Description
NO-HIT

| ORF Name | NTID | AAID | NT Length | AA Length | score | probability |
|---|---|---|---|---|---|---|
| AI7503000985_24304187_c2_1728 | 1024 | 4796 | 153 | 50 | | |

Description
NO-HIT

| ORF Name | NTID | AAID | NT Length | AA Length | score | probability |
|---|---|---|---|---|---|---|
| AI7503000985_24304712_f1_311 | 1025 | 4797 | 1674 | 557 | 1015 | 2.1e-102 |

Description
sp:[LN:DCIP_ENTCL] [AC:P23234] [GN:IPDC] [OR:ENTEROBACTER CLOACAE] [EC:4.1.1.74] [DE:DECARBOXYLASE)] [SP:P23234] [DB:swissprot] >pir:[LN:S16013] [AC:S16013 ] [PN:indolepyruvate decarboxylase,] [CL:acetolactate synthase large chain:thiamine pyrophosphate-binding domain homology] [OR:Enterobacter cloacae] [EC:4.1.1.-] [DB:pir2] >gp:[GI:d1014947:g216677] [LN:ENTIPDC] [AC:D90214] [OR:Enterobacter cloacae] [SR:E. cloacae (strain FERM BP-1529) genomic DNA] [DB:genpept-bct1] [DE:E. cloacae gene for indolepyruvate decarboxylase.] [NT:indolepyruvate decarboxylase] [LE:31] [RE:1689] [DI:direct]

| ORF Name | NTID | AAID | NT Length | AA Length | score | probability |
|---|---|---|---|---|---|---|
| AI7503000985_24333286_f2_802 | 1026 | 4798 | 126 | 41 | | |

Description
NO-HIT

| ORF Name | NTID | AAID | NT Length | AA Length | score | probability |
|---|---|---|---|---|---|---|
| AI7503000985_24337791_c3_2068 | 1027 | 4799 | 1113 | 370 | | |

Description
NO-HIT

| ORF Name | NTID | AAID | NT Length | AA Length | score | probability |
|---|---|---|---|---|---|---|
| AI7503000985_24337807_c3_2076 | 1028 | 4800 | 1890 | 629 | 1795 | 4.6e-185 |

Description
pir:[LN:G70040] [AC:G70040 ] [PN:sulfite reductase homolog yvgR] [GN:yvgR ] [CL:sulfite reductase (NADPH):flavodoxin homology: NADPH--ferrihemoprotein reductase homology] [OR:Bacillus subtilis] [DB:pir2] >gp:[GI:e1186032:g2635857] [LN:BSUB0018] [AC:Z99121:AL009126] [GN:yvgR] [FN:unknown] [OR:Bacillus subtilis] [DB:genpept-bct1] [DE:Bacillus subtilis complete genome (section 18 of 21): from 3399551to 3609060.] [NT:similar to sulfite reductase] [LE:31851] [RE:33668] [DI:complement]

| ORF Name | NTID | AAID | NT Length | AA Length | score | probability |
|---|---|---|---|---|---|---|
| AI7503000985_24338217_c2_1747 | 1029 | 4801 | 597 | 198 | 372 | 2.8e-34 |

Description
gp:[GI:g4098082] [LN:LLU73336] [AC:U73336] [PN:anaerobic ribonucleotide reductase activator] [GN:nrdG] [OR:Lactococcus lactis] [DB:genpept-bct2] [DE:Lactococcus lactis anaerobic ribonucleotide reductase (nrdD) andanaerobic ribonucleotide reductase activator protein (nrdG) genes,complete cds.] [NT:NrdG] [LE:2413] [RE:3012] [DI:direct]

| ORF Name | NTID | AAID | NT Length | AA Length | score | probability |
|---|---|---|---|---|---|---|
| AI7503000985_24351562_f3_1230 | 1030 | 4802 | 255 | 84 | | |

Description
NO-HIT

| ORF Name | NTID | AAID | NT Length | AA Length | score | probability |
|---|---|---|---|---|---|---|
| AI7503000985_24353390_c2_1882 | 1031 | 4803 | 696 | 231 | 421 | 1.8e-39 |

Description
pir:[LN:S76993] [AC:S76993 ] [PN:hypothetical protein] [CL:ribitol
dehydrogenase:short-chain alcohol dehydrogenase homology] [OR:Synechocystis sp.]
[SR:PCC 6803, , PCC 6803] [SR:PCC 6803, ] [DB:pir2] >gp:[GI:d1011336:g1001805]
[LN:SYCSLRG] [AC:D64005:AB001339] [PN:hypothetical protein] [OR:Synechocystis sp.]
[SR:Synechocystis sp. (strain:PCC6803) DNA] [DB:genpept-bct1] [DE:Synechocystis sp.
PCC6803 complete genome, 24/27, 3002966-3138603.] [NT:ORF_ID:slr0315] [LE:34344]
[RE:35078] [DI:direct]

| ORF Name | NTID | AAID | NT Length | AA Length | score | probability |
|---|---|---|---|---|---|---|
| AI7503000985_24353392_c2_1954 | 1032 | 4804 | 2409 | 802 | 3358 | 0.0 |

Description
gp:[GI:e1429587:g4756149] [LN:A67161] [AC:A67161] [PN:NIRB GENE] [OR:Staphylococcus
carnosus] [DB:genpept-pat] [DE:Sequence 1 from Patent EP0805205.] [NT:unnamed protein
product] [LE:181] [RE:2586] [DI:direct] >gp:[GI:g4433639] [LN:AF029224]
[AC:AF029224:AF029225] [PN:NirB] [GN:nirB] [OR:Staphylococcus carnosus]
[DB:genpept-bct2] [DE:Staphylococcus carnosus nir and nar operons, complete sequences.]
[NT:similar to Escherichia coli NADH-dependent nitrite] [LE:2366] [RE:4771] [DI:direct]

| ORF Name | NTID | AAID | NT Length | AA Length | score | probability |
|---|---|---|---|---|---|---|
| AI7503000985_24406542_f3_1293 | 1033 | 4805 | 339 | 112 | 513 | 3.2e-49 |

Description
gp:[GI:g2914128] [LN:SEU43366] [AC:U43366] [PN:IcaD] [GN:icaD] [OR:Staphylococcus
epidermidis] [DB:genpept-bct2] [DE:Staphylococcus epidermidis operon mediating
intercellular adhesion:IcaR, IcaA, IcaD, IcaB, and IcaC genes, complete cds.] [LE:1963]
[RE:2268] [DI:direct]

| ORF Name | NTID | AAID | NT Length | AA Length | score | probability |
|---|---|---|---|---|---|---|
| AI7503000985_24406952_c1_1434 | 1034 | 4806 | 447 | 148 | 188 | 8.9e-15 |

Description
sp:[LN:PETP_RHOCA] [AC:P31078] [GN:PETP] [OR:RHODOBACTER CAPSULATUS]
[SR:,RHODOPSEUDOMONAS CAPSULATA] [DE:PETP PROTEIN] [SP:P31078] [DB:swissprot]
>pir:[LN:S22631] [AC:S22631:S21001 ] [PN:petP protein] [GN:petP ] [OR:Rhodobacter
capsulatus] [DB:pir2] >gp:[GI:e49248:g1333802] [LN:RCPETPR] [AC:Z12113:S42067]
[PN:protein of unknown function] [GN:petP] [OR:Rhodobacter capsulatus]
[DB:genpept-bct1] [DE:R.capsulatus petP, petR, and fbcF genes.] [NT:part of the petPR
operon in front of fbc operon] [SP:P31078] [LE:199] [RE:699] [DI:direct}

| ORF Name | NTID | AAID | NT Length | AA Length | score | probability |
|---|---|---|---|---|---|---|
| AI7503000985_24415887_c2_1761 | 1035 | 4807 | 927 | 308 | 123 | 2.7e-05 |

Description
gp:[GI:g3955198] [LN:AF022796] [AC:AF022796] [PN:ModA] [GN:modA] [OR:Staphylococcus
carnosus] [DB:genpept-bct2] [DE:Staphylococcus carnosus molybdenum cofactor
biosynthetic genecluster, complete sequence.] [NT:molybdate-binding lipoprotein of the]
[LE:109] [RE:894] [DI:direct]

| ORF_Name | NTID | AAID | NT Length | AA Length | score | probability |
|---|---|---|---|---|---|---|
| AI7503000985_24416068_c1_1624 | 1036 | 4808 | 549 | 182 | 528 | 8.3e-51 |

Description
pir:[LN:C69996] [AC:C69996 ] [PN:conserved hypothetical protein ytmI] [GN:ytmI ]
[OR:Bacillus subtilis] [DB:pir2] >gp:[GI:e1184188:g2635404] [LN:BSUB0015]
[AC:Z99118:AL009126] [GN:ytmI] [FN:unknown] [OR:Bacillus subtilis] [DB:genpept-bct1]
[DE:Bacillus subtilis complete genome (section 15 of 21): from 2795131to 3013540.]
[NT:similar to hypothetical proteins from B. subtilis] [LE:212192] [RE:212728]
[DI:complement] >gp:[GI:e1185812:g2635423] [LN:BSUB0016] [AC:Z99119:AL009126] [GN:ytmI]
[FN:unknown] [OR:Bacillus subtilis] [DB:genpept-bct1] [DE:Bacillus subtilis complete
genome (section 16 of 21): from 2997771to 3213410.] [NT:similar to hypothetical
proteins from B. subtilis] [LE:9552] [RE:10088] [DI:complement] >gp:[GI:g2293246]
[LN:AF008220] [AC:AF008220] [PN:YtmI] [GN:ytmI] [OR:Bacillus subtilis]
[DB:genpept-bct2] [DE:Bacillus subtilis rrnB-dnaB genomic region.] [NT:similar to a
hypothetical 19 kD protein from B.] [LE:170339] [RE:170875] [DI:direct]

| ORF_Name | NTID | AAID | NT Length | AA Length | score | probability |
|---|---|---|---|---|---|---|
| AI7503000985_24421937_c3_1999 | 1037 | 4809 | 1269 | 422 | 778 | 2.7e-77 |

Description
pir:[LN:B69801] [AC:B69801 ] [PN:chloramphenicol resistance protein homolog yfhI]
[GN:yfhI ] [CL:Streptomyces lividans chloramphenicol resistance protein] [OR:Bacillus
subtilis] [DB:pir2] >gp:[GI:e1182844:g2633178] [LN:BSUB0005] [AC:Z99108:AL009126]
[GN:yfhI] [FN:unknown] [OR:Bacillus subtilis] [DB:genpept-bct1] [DE:Bacillus subtilis
complete genome (section 5 of 21): from 802821 to1011250.] [NT:similar to antibiotic
resistance protein] [LE:123573] [RE:124766] [DI:direct]

| ORF_Name | NTID | AAID | NT Length | AA Length | score | probability |
|---|---|---|---|---|---|---|
| AI7503000985_24429663_c1_1444 | 1038 | 4810 | 933 | 310 | 326 | 2.1e-29 |

Description
sp:[LN:YXDK_BACSU] [AC:P42422] [GN:YXDK:B65E] [OR:BACILLUS SUBTILIS] [EC:2.7.3.-]
[DE:(EC 2.7.3.-)] [SP:P42422] [DB:swissprot] >pir:[LN:H70073] [AC:H70073 ]
[PN:two-component sensor histidine kinase homolog yxdK] [GN:yxdK ] [OR:Bacillus
subtilis] [DB:pir2] >gp:[GI:d1003811:g709992] [LN:BACIOLO] [AC:D14399] [PN:hypothetical
protein] [GN:B65E] [OR:Bacillus subtilis] [SR:Bacillus subtilis (strain:BGSC 1A1 (168
trpC2)) DNA] [DB:genpept-bct1] [DE:Bacillus subtilis 15 kb chromosome segment contains
the iol operon.] [NT:homologous to sensor protein BvgC, His protein] [LE:11893]
[RE:12870] [DI:direct] >gp:[GI:e1184690:g2636511] [LN:BSUB0021] [AC:Z99124:AL009126]
[GN:yxdK] [FN:unknown] [OR:Bacillus subtilis] [DB:genpept-bct1] [DE:Bacillus subtilis
complete genome (section 21 of 21): from 3999281to 4214814.] [NT:similar to
two-component sensor histidine kinase] [SP:P42422] [LE:70819] [RE:71796]
[DI:complement]

| ORF_Name | NTID | AAID | NT Length | AA Length | score | probability |
|---|---|---|---|---|---|---|
| AI7503000985_24432327_c2_1777 | 1039 | 4811 | 1665 | 554 | 1633 | 6.7e-168 |

Description
gp:[GI:g473902] [LN:LACALS] [AC:L16975] [PN:alpha-acetolactate synthase] [GN:als]
[OR:Lactococcus lactis] [SR:Lactococcus lactis (strain DSM 20384, sub_species lactis)
DNA] [DB:genpept-bct1] [DE:Lactococcus lactis alpha-acetolactate synthase (als) gene,
completecds.] [LE:1232] [RE:2896] [DI:direct] >gp:[GI:g809618] [LN:A23961] [AC:A23961]
[PN:alpha-acetolactate synthase] [OR:Lactococcus lactis] [DB:genpept-pat] [DE:L. lactis
alpha-acetolactate synthase gene.] [LE:550] [RE:2214] [DI:direct]

| ORF Name | NTID | AAID | NT Length | AA Length | score | probability |
|---|---|---|---|---|---|---|
| AI7503000985_24500300_c1_1462 | 1040 | 4812 | 1206 | 401 | 1208 | 7.3e-123 |

Description
pir:[LN:B69877] [AC:B69877 ] [PN:sulfate adenylyltransferase homolog ylnB] [GN:ylnB ] [CL:Synechocystis sulfate adenylyltransferase: sulfate adenylyltransferase homology] [OR:Bacillus subtilis] [DB:pir2] >gp:[GI:e332185:g2462958] [LN:BSPYREYLO] [AC:AJ000974] [PN:putative sulfate adenylyltransferase] [GN:ylnB] [OR:Bacillus subtilis] [DB:genpept-bct1] [DE:Bacillus subtilis pyrE to yloA gene region.] [LE:2374] [RE:3522] [DI:direct] >gp:[GI:e1185151:g2633932] [LN:BSUB0009] [AC:Z99112:AL009126] [GN:ylnB] [FN:unknown] [OR:Bacillus subtilis] [DB:genpept-bct1] [DE:Bacillus subtilis complete genome (section 9 of 21): from 1598421to 1807200.] [NT:similar to sulfate adenylyltransferase] [LE:33187] [RE:34335] [DI:direct]

| ORF Name | NTID | AAID | NT Length | AA Length | score | probability |
|---|---|---|---|---|---|---|
| AI7503000985_245443_c1_1548 | 1041 | 4813 | 696 | 231 | 375 | 1.4e-34 |

Description
pir:[LN:F69879] [AC:F69879 ] [PN:phosphoglycerate dehydrogenase homolog yloW] [GN:yloW ] [OR:Bacillus subtilis] [DB:pir2] >gp:[GI:e1185176:g2633957] [LN:BSUB0009] [AC:Z99112:AL009126] [GN:yloW] [FN:unknown] [OR:Bacillus subtilis] [DB:genpept-bct1] [DE:Bacillus subtilis complete genome (section 9 of 21): from 1598421to 1807200.] [NT:similar to phosphoglycerate dehydrogenase] [LE:59221] [RE:59883] [DI:direct] >gp:[GI:e323511:g2337814] [LN:BSY13937] [AC:Y13937] [PN:putative YhaQ protein] [GN:yloW] [FN:unknown] [OR:Bacillus subtilis] [DB:genpept-bct1] [DE:Bacillus subtilis genomic DNA from the spoVM region.] [LE:20993] [RE:21655] [DI:direct]

| ORF Name | NTID | AAID | NT Length | AA Length | score | probability |
|---|---|---|---|---|---|---|
| AI7503000985_24611567_c2_1831 | 1042 | 4814 | 1074 | 357 | 478 | 1.7e-45 |

Description
pir:[LN:S36209] [AC:S36209 ] [PN:dep protein precursor] [GN:dep ] [OR:Bacillus anthracis] [DB:pir2] >gp:[GI:d1003632:g436034] [LN:BACDEP] [AC:D14037] [PN:ORF] [GN:dep] [OR:Bacillus anthracis] [SR:Bacillus anthracis (strain:Davis) plasmid:pTE702 DNA] [DB:genpept-bct1] [DE:Bacillus anthracis plasmid pTE702 dep gene for ORF, complete cds.] [LE:252] [RE:1652] [DI:direct]

| ORF Name | NTID | AAID | NT Length | AA Length | score | probability |
|---|---|---|---|---|---|---|
| AI7503000985_24617025_c1_1339 | 1043 | 4815 | 243 | 80 | | |

Description
NO-HIT

| ORF Name | NTID | AAID | NT Length | AA Length | score | probability |
|---|---|---|---|---|---|---|
| AI7503000985_24617262_c1_1501 | 1044 | 4816 | 825 | 274 | 690 | 5.7e-68 |

Description sp:[LN:PANB_BACSU] [AC:P52996] [GN:PANB] [OR:BACILLUS SUBTILIS] [EC:2.1.2.11] [DE:(KETOPANTOATE HYDROXYMETHYLTRANSFERASE)] [SP:P52996] [DB:swissprot] >pir:[LN:G69671] [AC:G69671 ] [PN:ketopantoate hydroxymethyltransferase panB] [GN:panB ] [CL:3-methyl-2-oxobutanoate hydroxymethyltransferase] [OR:Bacillus subtilis] [DB:pir2] >gp:[GI:g1146240] [LN:BACYPIA] [AC:L47709] [PN:ketopantoate hydroxymethyltransferase] [GN:panB] [FN:pantothenic acid biosynthesis] [OR:Bacillus subtilis] [DB:genpept-bct1] [EC:2.1.2.11] [DE:Bacillus subtilis (clone YAC15-6B) ypiABF genes, qcrABC genes,ypjABCDEFGHI genes, birA gene, panBCD genes, dinG gene, ypmB gene,aspB gene, asnS gene, dnaD gene, nth gene and ypoC gene, completecds's.] [NT:47.1% of identity to the 3-methyl-2-oxobutanoate] [LE:13293] [RE:14126] [DI:direct] >gp:[GI:e1183688:g2634661] [LN:BSUB0012] [AC:Z99115:AL009126] [PN:ketopantoate hydroxymethyltransferase] [GN:panB] [FN:pantothenate biosynthesis] [OR:Bacillus subtilis] [DB:genpept-bct1] [EC:2.1.2.11] [DE:Bacillus subtilis complete genome (section 12 of 21): from 2195541to 2409220.] [SP:P52996] [LE:157541] [RE:158374] [DI:complement]

| ORF Name | NTID | AAID | NT Length | AA Length | score | probability |
|---|---|---|---|---|---|---|
| AI7503000985_24640910_c2_1654 | 1045 | 4817 | 519 | 172 | | |

Description

NO-HIT

| ORF Name | NTID | AAID | NT Length | AA Length | score | probability |
|---|---|---|---|---|---|---|
| AI7503000985_24641932_c2_1734 | 1046 | 4818 | 672 | 223 | 500 | 7.7e-48 |

Description gp:[GI:g4104595] [LN:AF036964] [AC:AF036964] [PN:putative response regulator] [GN:rrp1] [OR:Lactobacillus sakei] [DB:genpept-bct2] [DE:Lactobacillus sake putative response regulator (rrp1) and putativehistidine kinase (hpk1) genes, complete cds.] [NT:Rrp1; member of a two-component regulatory system] [LE:2112] [RE:2786] [DI:direct]

| ORF Name | NTID | AAID | NT Length | AA Length | score | probability |
|---|---|---|---|---|---|---|
| AI7503000985_24643930_c3_2138 | 1047 | 4819 | 696 | 231 | 399 | 3.9e-37 |

Description sp:[LN:YOHK_ECOLI] [AC:P33373] [GN:YOHK] [OR:ESCHERICHIA COLI] [DE:HYPOTHETICAL 24.5 KD PROTEIN IN PBPG-CDD INTERGENIC REGION] [SP:P33373] [DB:swissprot] >pir:[LN:E64982] [AC:E64982 ] [PN:yohK protein] [GN:yohK ] [CL:yohK protein] [OR:Escherichia coli] [DB:pir2] >gp:[GI:g1788464] [LN:AE000303] [AC:AE000303:U00096] [PN:putative seritonin transporter] [GN:yohK] [FN:putative transport; Not classified] [OR:Escherichia coli] [DB:genpept-bct2] [DE:Escherichia coli K-12 MG1655 section 193 of 400 of the completegenome.] [NT:o231; residues 10295 are 100 pct identical to] [LE:6088] [RE:6783] [DI:direct]

| ORF Name | NTID | AAID | NT Length | AA Length | score | probability |
|---|---|---|---|---|---|---|
| AI7503000985_24646963_c3_2072 | 1048 | 4820 | 1350 | 449 | 1703 | 2.6e-175 |

Description gp:[GI:e315090:g2791905] [LN:SSK3MECA1] [AC:Y13052] [GN:ORF454] [OR:Staphylococcus sciuri] [DB:genpept-bct1] [DE:S.sciuri mecA1 gene, strain K3(MM2).] [LE:4208] [RE:5572] [DI:direct]

| ORF Name | NTID | AAID | NT Length | AA Length | score | probability |
|---|---|---|---|---|---|---|
| AI7503000985_24648377_c3_2261 | 1049 | 4821 | 1146 | 381 | 1301 | 1.0e-132 |

Description gp:[GI:e1429613:g4756156] [LN:A67169] [AC:A67169] [PN:NART GENE] [FN:NITRATE TRANSPORT] [OR:Staphylococcus carnosus] [DB:genpept-pat] [DE:Sequence 9 from Patent EP0805205.] [LE:538] [RE:1704] [DI:direct] >gp:[GI:g2529402] [LN:SCU40014] [AC:U40014] [PN:nitrate transporter] [GN:narT] [OR:Staphylococcus carnosus] [SR:Staphylococcus carnosus strain=TM300] [DB:genpept-bct2] [DE:Staphylococcus carnosus nitrate transporter (narT) gene, completecds.] [NT:NarT] [LE:90] [RE:1256] [DI:direct]

| ORF Name | NTID | AAID | NT Length | AA Length | score | probability |
|---|---|---|---|---|---|---|
| AI7503000985_24648502_c3_2088 | 1050 | 4822 | 468 | 155 | 228 | 5.1e-19 |

Description sp:[LN:YHGC_BACSU] [AC:P38049] [GN:YHGC] [OR:BACILLUS SUBTILIS] [DE:HYPOTHETICAL 18.8 KD PROTEIN IN ECSC-PBPF INTERGENIC REGION] [SP:P38049] [DB:swissprot] >pir:[LN:B40614] [AC:B40614:F69832 ] [PN:conserved hypothetical protein yhgC:hypothetical protein X (pbpF 5' region)] [GN:yhgC ] [OR:Bacillus subtilis] [DB:pir2] >gp:[GI:g304160] [LN:BACPBPF] [AC:L10630] [OR:Bacillus subtilis] [SR:Bacillus subtilis (strain W168) DNA] [DB:genpept-bct1] [DE:Bacillus subtilis penicillin-binding protein (pbpF) gene, 5' end.] [NT:product unknown] [LE:247] [RE:747] [DI:complement] >gp:[GI:e1183012:g2633346] [LN:BSUB0006] [AC:Z99109:AL009126] [GN:yhgC] [FN:unknown] [OR:Bacillus subtilis] [DB:genpept-bct1] [DE:Bacillus subtilis complete genome (section 6 of 21): from 999501 to1209940.] [NT:alternate gene name: yixC; similar to hypothetical] [SP:P38049] [LE:83202] [RE:83702] [DI:complement] >gp:[GI:e325006:g2226228] [LN:BSY14083] [AC:Y14083] [PN:Hypothetical protein] [GN:yixC] [OR:Bacillus subtilis] [DB:genpept-bct1] [DE:Bacillus subtilis chromosomal DNA, region 76-78 degrees: betweenglyB-aprE.] [NT:See Swiss Prot P38049; YIXC_BACSU] [SP:P38049] [LE:3061] [RE:3561] [DI:complement]

| ORF Name | NTID | AAID | NT Length | AA Length | score | probability |
|---|---|---|---|---|---|---|
| AI7503000985_24648551_f2_791 | 1051 | 4823 | 174 | 57 | 108 | 6.6e-06 |

Description gp:[GI:g1022725] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF2] [LE:394] [RE:1083] [DI:complement] >gp:[GI:g295162] [LN:STAMECRA] [AC:L14017] [OR:Staphylococcus aureus] [SR:Staphylococcus aureus (strain COL) DNA] [DB:genpept-bct1] [DE:Staphylococcus aureus methicillin-resistance protein (mecR) geneand unknown ORF, complete cds.] [NT:unknown ORF1; putative] [LE:1492] [RE:2181] [DI:complement]

| ORF Name | NTID | AAID | NT Length | AA Length | score | probability |
|---|---|---|---|---|---|---|
| AI7503000985_24652312_f1_419 | 1052 | 4824 | 1617 | 538 | 1137 | 2.4e-115 |

Description gp:[GI:g4835822] [LN:AF102174] [AC:AF102174] [PN:glycine betaine transporter BetL] [GN:betL] [OR:Listeria monocytogenes] [DB:genpept-bct2] [DE:Listeria monocytogenes glycine betaine transporter BetL (betL)gene, complete cds.] [LE:209] [RE:1732] [DI:direct]

| ORF Name | NTID | AAID | NT Length | AA Length | score | probability |
|---|---|---|---|---|---|---|
| AI7503000985_24665957_c3_2149 | 1053 | 4825 | 1494 | 497 | 1335 | 2.5e-136 |

Description
sp:[LN:XYLB_BACSU] [AC:P39211] [GN:XYLB] [OR:BACILLUS SUBTILIS] [EC:2.7.1.17] [DE:XYLULOSE KINASE, (XYLULOKINASE)] [SP:P39211] [DB:swissprot] >pir:[LN:D69735] [AC:D69735 ] [PN:xylulose kinase xylB] [GN:xylB ] [CL:xylulokinase] [OR:Bacillus subtilis] [DB:pir2] >gp:[GI:g1750125] [LN:BSU66480] [AC:U66480] [PN:xylulose kinase] [GN:xylB] [OR:Bacillus subtilis] [DB:genpept-bct1] [DE:Bacillus subtilis SpoVK (spoVK), YnbA (ynbA), YnbB (ynbB), GlnR(glnR), glutamine synthetase (glnA), YnaA (ynaA), YnaB (ynaB), YnaC(ynaC), YnaD (ynaD), YnaE (ynaE), YnaF (ynaF), YnaG (ynaG), YnaH(ynaH), YnaI (ynaI), YnaJ (ynaJ), xylan beta-1,4-xylosidase (xynB),xylose repressor (xylR), xylose isomerase (xylA), xylulose kinase(xylB), YncB (yncB), YncC (yncC), YncD (yncD) and YncE (yncE)genes, complete cds.] [LE:19399] [RE:20898] [DI:direct] >gp:[GI:e1183420:g2634145] [LN:BSUB0010] [AC:Z99113:AL009126] [PN:xylulose kinase] [GN:xylB] [FN:xylose metabolism] [OR:Bacillus subtilis] [DB:genpept-bct1] [EC:2.7.1.17] [DE:Bacillus subtilis complete genome (section 10 of 21): from 1781201to 2014980.] [NT:alternate gene name: yncA] [SP:P39211] [LE:111450] [RE:112949] [DI:direct]

| ORF Name | NTID | AAID | NT Length | AA Length | score | probability |
|---|---|---|---|---|---|---|
| AI7503000985_24720257_f1_131 | 1054 | 4826 | 138 | 45 | | |

Description
NO-HIT

| ORF Name | NTID | AAID | NT Length | AA Length | score | probability |
|---|---|---|---|---|---|---|
| AI7503000985_24722175_c1_1538 | 1055 | 4827 | 1101 | 366 | 353 | 2.9e-32 |

Description
pir:[LN:H70069] [AC:H70069 ] [PN:capsular polyglutamate biosynthesis homolog ywtB] [GN:ywtB ] [OR:Bacillus subtilis] [DB:pir2] >gp:[GI:e1184494:g2636113] [LN:BSUB0019] [AC:Z99122:AL009126] [GN:ywtB] [FN:unknown] [OR:Bacillus subtilis] [DB:genpept-bct1] [DE:Bacillus subtilis complete genome (section 19 of 21): from 3597091to 3809700.] [NT:similar to capsular polyglutamate biosynthesis] [LE:99788] [RE:100930] [DI:complement] >gp:[GI:e308090:g1894767] [LN:BSZ92954] [AC:Z92954] [GN:ywtB] [OR:Bacillus subtilis] [DB:genpept-bct1] [DE:B.subtilis yws[A,B,C,D,E,F,G] and gerBC genes.] [NT:product highly similar to Bacillus anthracis CapA] [LE:1552] [RE:2694] [DI:direct] >gp:[GI:e1184494:g2636113] [LN:BSUB0019] [AC:Z99122:AL009126] [GN:ywtB] [FN:unknown] [OR:Bacillus subtilis] [DB:genpept] [DE:Bacillus subtilis complete genome (section 19 of 21): from 3597091to 3809700.] [NT:similar to capsular polyglutamate biosynthesis] [LE:99788] [RE:100930] [DI:complement]

| ORF Name | NTID | AAID | NT Length | AA Length | score | probability |
|---|---|---|---|---|---|---|
| AI7503000985_24730438_c2_1833 | 1056 | 4828 | 420 | 139 | 374 | 1.7e-34 |

Description
gp:[GI:g4959403] [LN:AF115391] [AC:AF115391] [PN:ribose permease RbsD] [GN:rbsD] [OR:Lactobacillus sakei] [DB:genpept-bct2] [DE:Lactobacillus sakei LaaA (laaA) gene, partial cds; LaaB (laaB),putative acetate kinase AckA (ackA), LaaC (laaC) genes, completecds; rbs operon, complete sequence; and LaaE (laaE) gene, partialcds.] [LE:4035] [RE:4430] [DI:direct]

| ORF Name | NTID | AAID | NT Length | AA Length | score | probability |
|---|---|---|---|---|---|---|
| AI7503000985_24797140_c2_1871 | 1057 | 4829 | 900 | 299 | 145 | 7.3e-08 |

Description
sp:[LN:ESTE_PSEFL] [AC:P22862] [OR:PSEUDOMONAS FLUORESCENS] [EC:3.1.1.2] [DE:ARYLESTERASE, (ARYL-ESTER HYDROLASE)] [SP:P22862] [DB:swissprot]

| ORF Name | NTID | AAID | NT Length | AA Length | score | probability |
|---|---|---|---|---|---|---|
| AI7503000985_24797900_c1_1361 | 1058 | 4830 | 213 | 70 | | |

Description
NO-HIT

| ORF Name | NTID | AAID | NT Length | AA Length | score | probability |
|---|---|---|---|---|---|---|
| AI7503000985_24812502_c1_1521 | 1059 | 4831 | 126 | 41 | | |

Description
NO-HIT

| ORF Name | NTID | AAID | NT Length | AA Length | score | probability |
|---|---|---|---|---|---|---|
| AI7503000985_24814838_c2_1789 | 1060 | 4832 | 870 | 289 | 350 | 6.1e-32 |

Description
pir:[LN:S76790] [AC:S76790 ] [PN:hypothetical protein] [CL:hypothetical protein b1725]
[OR:Synechocystis sp.] [SR:PCC 6803, , PCC 6803] [SR:PCC 6803, ] [DB:pir2]
>gp:[GI:d1019435:g1653791] [LN:D90916] [AC:D90916:AB001339] [PN:hypothetical protein]
[OR:Synechocystis sp.] [SR:Synechocystis sp. (strain:PCC6803) DNA] [DB:genpept-bct1]
[DE:Synechocystis sp. PCC6803 complete genome, 26/27, 3270710-3418851.]
[NT:ORF_ID:slr1563] [LE:99350] [RE:100237] [DI:direct]

| ORF Name | NTID | AAID | NT Length | AA Length | score | probability |
|---|---|---|---|---|---|---|
| AI7503000985_24817202_c1_1512 | 1061 | 4833 | 1809 | 602 | 799 | 2.3e-116 |

Description
pir:[LN:C69975] [AC:C69975 ] [PN:acyltransferase homolog yrhL] [GN:yrhL ] [OR:Bacillus
subtilis] [DB:pir2] >gp:[GI:g1934616] [LN:BSU93874] [AC:U93874] [PN:hypothetical
protein YrhL] [GN:yrhL] [OR:Bacillus subtilis] [DB:genpept-bct1] [DE:Bacillus subtilis
cysteine synthase (yrhA), cystathioninegamma-lyase (yrhB), YrhC (yrhC), YrhD (yrhD),
formate dehydrogenasechain A (yrhE), YrhF (yrhF), formate dehydrogenase (yrhG),
YrhH(yrhH), regulatory protein (yrhI), cytochrome P450 102 (yrhJ), YrhK(yrhK),
hypothetical protein YrhL (yrhL), putative anti-SigV factor(yrhM), RNA polymerase sigma
factor SigV (sigV) and YrhO (yrhO)genes, complete cds, and YrhP (yrhP) gene, partial
cds.] [NT:similar to Haemophilus influenzae hypothetical] [LE:13904] [RE:15808]
[DI:complement] >gp:[GI:e1183944:g2635160] [LN:BSUB0014] [AC:Z99117:AL009126] [GN:yrhL]
[FN:unknown] [OR:Bacillus subtilis] [DB:genpept-bct1] [DE:Bacillus subtilis complete
genome (section 14 of 21): from 2599451to 2812870.] [NT:similar to acyltransferase]
[LE:171138] [RE:173042] [DI:direct]

| ORF Name | NTID | AAID | NT Length | AA Length | score | probability |
|---|---|---|---|---|---|---|
| AI7503000985_24855337_c2_1957 | 1062 | 4834 | 693 | 230 | 1003 | 3.8e-101 |

Description
gp:[GI:e1429602:g4756154] [LN:A67161] [AC:A67161] [FN:NARI GENE] [OR:Staphylococcus
carnosus] [DB:genpept-pat] [DE:Sequence 1 from Patent EP0805205.] [NT:unnamed protein
product] [LE:9942] [RE:10625] [DI:direct] >gp:[GI:g3929525] [LN:AF029224]
[AC:AF029224:AF029225] [PN:NarI] [GN:narI] [OR:Staphylococcus carnosus]
[DB:genpept-bct2] [DE:Staphylococcus carnosus nir and nar operons, complete sequences.]
[NT:similar to Escherichia coli nitrate reductases NRA] [LE:12127] [RE:12810]
[DI:direct]

| ORF_Name | NTID | AAID | NT Length | AA Length | score | probability |
|---|---|---|---|---|---|---|
| AI7503000985_250178_c3_2162 | 1063 | 4835 | 234 | 77 | 82 | 0.0015 |

Description
pir:[LN:E70557] [AC:E70557 ] [PN:hypothetical protein Rv1615] [GN:Rv1615 ]
[OR:Mycobacterium tuberculosis] [DB:pir2] >gp:[GI:e316881:g2113899] [LN:MTCY01B2]
[AC:Z95554:AL123456] [PN:hypothetical protein Rv1615] [GN:Rv1615] [OR:Mycobacterium
tuberculosis] [DB:genpept-bct1] [DE:Mycobacterium tuberculosis H37Rv complete genome;
segment 72/162.] [NT:Rv1615, (MTCY01B2.07), len: 146. Function: unknown] [LE:7451]
[RE:7891] [DI:direct]

| ORF_Name | NTID | AAID | NT Length | AA Length | score | probability |
|---|---|---|---|---|---|---|
| AI7503000985_2507950_f1_199 | 1064 | 4836 | 216 | 71 | | |

Description
NO-HIT

| ORF_Name | NTID | AAID | NT Length | AA Length | score | probability |
|---|---|---|---|---|---|---|
| AI7503000985_251_f1_433 | 1065 | 4837 | 153 | 50 | | |

Description
NO-HIT

| ORF_Name | NTID | AAID | NT Length | AA Length | score | probability |
|---|---|---|---|---|---|---|
| AI7503000985_25398426_f1_211 | 1066 | 4838 | 198 | 65 | | |

Description
NO-HIT

| ORF_Name | NTID | AAID | NT Length | AA Length | score | probability |
|---|---|---|---|---|---|---|
| AI7503000985_25413577_f3_1032 | 1067 | 4839 | 129 | 42 | | |

Description
NO-HIT

| ORF_Name | NTID | AAID | NT Length | AA Length | score | probability |
|---|---|---|---|---|---|---|
| AI7503000985_25429700_c2_1683 | 1068 | 4840 | 1356 | 451 | 158 | 1.8e-08 |

Description
gp:[GI:e332306:g2462111] [LN:BCY11138] [AC:Y11138] [GN:ORF1] [OR:Bacillus cereus]
[DB:genpept-bct1] [DE:B.cereus DNA for ORF1, ORF2 and ORF3 (2402 bp).] [NT:shows weak
homology to C. elegans cosmid C33A12 ORF] [LE:156] [RE:1373] [DI:direct]

| ORF_Name | NTID | AAID | NT Length | AA Length | score | probability |
|---|---|---|---|---|---|---|
| AI7503000985_25431558_f1_63 | 1069 | 4841 | 705 | 234 | 855 | 1.9e-85 |

Description
gp:[GI:g1575026] [LN:SAU52961] [AC:U52961] [PN:LrgB] [GN:lrgB] [OR:Staphylococcus
aureus] [SR:Staphylococcus aureus strain=NCTC 8325-4] [DB:genpept-bct2]
[DE:Staphylococcus aureus holin-like protein LrgA (lrgA) and LrgB(lrgB) genes, complete
cds.] [NT:LytSR-regulated gene; similar to E.coli yohK] [LE:805] [RE:1506] [DI:direct]

| ORF Name | NTID | AAID | NT Length | AA Length | score | probability |
|---|---|---|---|---|---|---|
| AI7503000985_25433452_f1_61 | 1070 | 4842 | 1791 | 596 | 1867 | 1.1e-192 |

Description
gp:[GI:g862312] [LN:STALYTS] [AC:L42945] [GN:lytS] [OR:Staphylococcus aureus] [DB:genpept-bct1] [DE:Staphylococcus aureus lytS and lytR genes, complete cds.] [LE:92] [RE:1846] [DI:direct]

| ORF Name | NTID | AAID | NT Length | AA Length | score | probability |
|---|---|---|---|---|---|---|
| AI7503000985_25570262_f1_358 | 1071 | 4843 | 144 | 47 | | |

Description
NO-HIT

| ORF Name | NTID | AAID | NT Length | AA Length | score | probability |
|---|---|---|---|---|---|---|
| AI7503000985_25578215_c2_1740 | 1072 | 4844 | 543 | 180 | 483 | 4.9e-46 |

Description
gp:[GI:e316582:g2791909] [LN:SSK11MECA] [AC:Y13094] [GN:ORF141] [OR:Staphylococcus sciuri] [DB:genpept-bct1] [DE:S.sciuri mecA gene, strain K11 (792).] [LE:4489] [RE:4914] [DI:direct]

| ORF Name | NTID | AAID | NT Length | AA Length | score | probability |
|---|---|---|---|---|---|---|
| AI7503000985_2557962_f2_698 | 1073 | 4845 | 1377 | 458 | 953 | 7.7e-96 |

Description
sp:[LN:NAOX_ENTFA] [AC:P37061] [GN:NOX] [OR:ENTEROCOCCUS FAECALIS] [SR:,STREPTOCOCCUS FAECALIS] [EC:1.6.99.3] [DE:NADH OXIDASE, (NOXASE)] [SP:P37061] [DB:swissprot] >pir:[LN:S26965] [AC:S26965 ] [PN:NADH oxidase] [CL:NADH peroxidase] [OR:Enterococcus faecalis] [DB:pir2] >gp:[GI:g47045] [LN:SFNOXAA] [AC:X68847:S45681] [PN:NADH oxidase] [GN:nox] [OR:Enterococcus faecalis] [DB:genpept-bct1] [DE:S.faecalis nox gene for NADH oxidase.] [SP:P37061] [LE:88] [RE:1428] [DI:direct]

| ORF Name | NTID | AAID | NT Length | AA Length | score | probability |
|---|---|---|---|---|---|---|
| AI7503000985_25580425_f1_74 | 1074 | 4846 | 135 | 44 | | |

Description
NO-HIT

| ORF Name | NTID | AAID | NT Length | AA Length | score | probability |
|---|---|---|---|---|---|---|
| AI7503000985_25585932_c1_1598 | 1075 | 4847 | 276 | 91 | 254 | 9.0e-22 |

Description
gp:[GI:d1039105:g4514322] [LN:AB013367] [AC:AB013367] [PN:YdeI] [GN:ydeI] [OR:Bacillus halodurans] [SR:Bacillus halodurans (strain:C-125) DNA] [DB:genpept-bct1] [DE:Bacillus halodurans C-125 ydeI gene, complete cds.] [LE:276] [RE:869] [DI:direct]

| ORF Name | NTID | AAID | NT Length | AA Length | score | probability |
|---|---|---|---|---|---|---|
| AI7503000985_25600015_c3_2090 | 1076 | 4848 | 1632 | 543 | 1561 | 2.9e-160 |

Description
pir:[LN:E69989] [AC:E69989 ] [PN:acetate--CoA ligase, ytcI] [GN:ytcI ] [CL:acetate--CoA ligase homology] [OR:Bacillus subtilis] [EC:6.2.1.1] [DB:pir2] >gp:[GI:e1185829:g2635440] [LN:BSUB0016] [AC:Z99119:AL009126] [GN:ytcI] [FN:unknown] [OR:Bacillus subtilis] [DB:genpept-bct1] [DE:Bacillus subtilis complete genome (section 16 of 21): from 2997771to 3213410.] [NT:similar to acetate-CoA ligase] [LE:24979] [RE:26574] [DI:complement] >gp:[GI:g2293232] [LN:AF008220] [AC:AF008220] [PN:YtcI] [GN:ytcI] [OR:Bacillus subtilis] [DB:genpept-bct2] [DE:Bacillus subtilis rrnB-dnaB genomic region.] [NT:putative acetate CoA-ligase] [LE:153853] [RE:155448] [DI:direct]

| ORF Name | NTID | AAID | NT Length | AA Length | score | probability |
|---|---|---|---|---|---|---|
| AI7503000985_25626875_f2_653 | 1077 | 4849 | 147 | 48 | | |

Description
NO-HIT

| ORF Name | NTID | AAID | NT Length | AA Length | score | probability |
|---|---|---|---|---|---|---|
| AI7503000985_25666427_f3_1335 | 1078 | 4850 | 306 | 101 | 84 | 0.0061 |

Description
sp:[LN:SSUA_BACSU] [AC:P40400] [GN:SSUA] [OR:BACILLUS SUBTILIS] [DE:PUTATIVE ALIPHATIC SULFONATES BINDING PROTEIN PRECURSOR] [SP:P40400] [DB:swissprot] >pir:[LN:I39927] [AC:I39927:C69817 ] [PN:ABC transporter (binding lipoprotein) homolog ygbA] [GN:ygbA ] [OR:Bacillus subtilis] [DB:pir2] >gp:[GI:g438472] [LN:BACORFKLM] [AC:L16808] [OR:Bacillus subtilis] [SR:Bacillus subtilis (individual_isolate MS11) (library: Tn91] [DB:genpept-bct1] [DE:Bacillus subtilis orfK, orfL and orfM, complete cds's.] [NT:Likely N-terminal signal sequence, followed by] [LE:69] [RE:1067] [DI:direct] >gp:[GI:e1182873:g2633207] [LN:BSUB0005] [AC:Z99108:AL009126] [GN:ygbA] [FN:unknown] [OR:Bacillus subtilis] [DB:genpept-bct1] [DE:Bacillus subtilis complete genome (section 5 of 21): from 802821 to1011250.] [NT:alternate gene name: yzeA; similar to ABC] [SP:P40400] [LE:158868] [RE:159866] [DI:direct] >gp:[GI:e308630:g1903039] [LN:BSZ93102] [AC:Z93102] [PN:hypothetical 36.3 kd lipoprotein precursor] [GN:yzeA] [OR:Bacillus subtilis] [DB:genpept-bct1] [DE:B.subtilis yga[L,M,N,O,P,Q,R,S,T], yzdB and yze[A,C} genes.] [NT:homology to nitrate transport protein precursor] [SP:P40400] [LE:1194] [RE:2192] [DI:direct]

| ORF Name | NTID | AAID | NT Length | AA Length | score | probability |
|---|---|---|---|---|---|---|
| AI7503000985_25961087_f1_123 | 1079 | 4851 | 813 | 270 | 399 | 3.9e-37 |

Description
sp:[LN:YFIE_BACSU] [AC:P54721] [GN:YFIE] [OR:BACILLUS SUBTILIS] [DE:HYPOTHETICAL 31.5 KD PROTEIN IN GLVBC 3'REGION] [SP:P54721] [DB:swissprot] >pir:[LN:H69802] [AC:H69802 ] [PN:conserved hypothetical protein yfiE] [GN:yfiE ] [OR:Bacillus subtilis] [DB:pir2] >gp:[GI:e1182814:g2633148] [LN:BSUB0005] [AC:Z99108:AL009126] [GN:yfiE] [FN:unknown] [OR:Bacillus subtilis] [DB:genpept-bct1] [DE:Bacillus subtilis complete genome (section 5 of 21): from 802821 to1011250.] [NT:similar to hypothetical proteins from B. subtilis] [SP:P54721] [LE:94696] [RE:95553] [DI:direct] >gp:[GI:d1009744:g1486247] [LN:D50543] [AC:D50543] [PN:unknown] [GN:yfiE] [FN:unknown] [OR:Bacillus subtilis] [SR:Bacillus subtilis (strain:168, haplotype:haploid) DNA] [DB:genpept-bct1] [DE:Bacillus subtilis DNA for 76-degree region, complete cds.] [LE:8372] [RE:9229] [DI:direct]

| ORF_Name | NTID | AAID | NT Length | AA Length | score | probability |
|---|---|---|---|---|---|---|
| AI7503000985_25970952_f1_316 | 1080 | 4852 | 141 | 46 | | |

Description
NO-HIT

| ORF_Name | NTID | AAID | NT Length | AA Length | score | probability |
|---|---|---|---|---|---|---|
| AI7503000985_26017278_c1_1441 | 1081 | 4853 | 132 | 43 | | |

Description
NO-HIT

| ORF_Name | NTID | AAID | NT Length | AA Length | score | probability |
|---|---|---|---|---|---|---|
| AI7503000985_26179777_c1_1558 | 1082 | 4854 | 1818 | 605 | 522 | 3.6e-50 |

Description
pir:[LN:S75742] [AC:S75742 ] [PN:hypothetical protein sll0556] [OR:Synechocystis sp.] [SR:PCC 6803, , PCC 6803] [SR:PCC 6803, ] [DB:pir2] >gp:[GI:d1011128:g1001236] [LN:SYCSLLE] [AC:D64003:AB001339] [PN:hypothetical protein] [OR:Synechocystis sp.] [SR:Synechocystis sp. (strain:PCC6803) DNA] [DB:genpept-bct1] [DE:Synechocystis sp. PCC6803 complete genome, 22/27, 2755703-2868766.] [NT:ORF_ID:sll0556] [LE:45438] [RE:47333] [DI:complement]

| ORF_Name | NTID | AAID | NT Length | AA Length | score | probability |
|---|---|---|---|---|---|---|
| AI7503000985_26188837_c1_1601 | 1083 | 4855 | 975 | 324 | 838 | 1.2e-83 |

Description
pir:[LN:A69670] [AC:A69670 ] [PN:choline ABC transporter (choline-binding protein) opuBC] [GN:opuBC ] [OR:Bacillus subtilis] [DB:pir2] >gp:[GI:e1186059:g2635884] [LN:BSUB0018] [AC:Z99121:AL009126] [PN:choline ABC transporter (choline-binding] [GN:opuBC] [FN:high affinity transport of choline] [OR:Bacillus subtilis] [DB:genpept-bct1] [DE:Bacillus subtilis complete genome (section 18 of 21): from 3399551to 3609060.] [NT:alternate gene name: proX] [LE:60016] [RE:60936] [DI:complement] >gp:[GI:g2293449] [LN:AF008930] [AC:AF008930] [PN:choline binding protein precursor] [GN:opuBC] [OR:Bacillus subtilis] [DB:genpept-bct2] [DE:Bacillus subtilis choline transport system including ATPase(opuBA), transmembrane protein (opuBB), choline binding proteinprecursor (opuBC) and transmembrane protein (opuBD) genes, completecds; and unknown gene.] [NT:part of choline uptake system; OpuBC; lipoprotein] [LE:2708] [RE:3628] [DI:direct]

| ORF_Name | NTID | AAID | NT Length | AA Length | score | probability |
|---|---|---|---|---|---|---|
| AI7503000985_26207537_f3_1201 | 1084 | 4856 | 129 | 42 | | |

Description
NO-HIT

| ORF_Name | NTID | AAID | NT Length | AA Length | score | probability |
|---|---|---|---|---|---|---|
| AI7503000985_26213885_c3_2215 | 1085 | 4857 | 132 | 43 | | |

Description
NO-HIT

| ORF Name | NTID | AAID | NT Length | AA Length | score | probability |
|---|---|---|---|---|---|---|
| AI7503000985_26220077_f2_445 | 1086 | 4858 | 447 | 148 | 259 | 2.7e-22 |

Description
pir:[LN:E69857] [AC:E69857 ] [PN:conserved hypothetical protein ykmA] [GN:ykmA ]
[OR:Bacillus subtilis] [DB:pir2] >gp:[GI:e1181515:g2632035] [LN:BSAJ2571] [AC:AJ002571]
[PN:YkmA] [GN:ykmA] [FN:unknown] [OR:Bacillus subtilis] [DB:genpept-bct1] [DE:Bacillus
subtilis 168 56 kb DNA fragment between xlyA and ykoR.] [LE:33559] [RE:34002]
[DI:complement] >gp:[GI:e1183335:g2633669] [LN:BSUB0007] [AC:Z99110:AL009126] [GN:ykmA]
[FN:unknown] [OR:Bacillus subtilis] [DB:genpept-bct1] [DE:Bacillus subtilis complete
genome (section 7 of 21): from 1194391to 1411140.] [NT:similar to hypothetical
proteins] [LE:186508] [RE:186951] [DI:complement]

| ORF Name | NTID | AAID | NT Length | AA Length | score | probability |
|---|---|---|---|---|---|---|
| AI7503000985_26353411_c1_1391 | 1087 | 4859 | 576 | 191 | | |

Description
NO-HIT

| ORF Name | NTID | AAID | NT Length | AA Length | score | probability |
|---|---|---|---|---|---|---|
| AI7503000985_26380265_c3_2042 | 1088 | 4860 | 1263 | 420 | 1291 | 1.2e-131 |

Description
gp:[GI:e1299582:g3687416] [LN:BLY17554] [AC:Y17554] [PN:arginine deiminase] [GN:arcA]
[OR:Bacillus licheniformis] [DB:genpept-bct1] [EC:3.5.3.6] [DE:Bacillus licheniformis
arcA, arcB, arcC and arcD genes.] [LE:248] [RE:1489] [DI:direct]

| ORF Name | NTID | AAID | NT Length | AA Length | score | probability |
|---|---|---|---|---|---|---|
| AI7503000985_26383512_c1_1506 | 1089 | 4861 | 1398 | 465 | 1195 | 1.7e-121 |

Description
sp:[LN:YDGF_BACSU] [AC:P96704] [GN:YDGF] [OR:BACILLUS SUBTILIS] [DE:HYPOTHETICAL
TRANSPORT PROTEIN IN EXPZ-DINB INTERGENIC REGION] [SP:P96704] [DB:swissprot]
>pir:[LN:H69782] [AC:H69782 ] [PN:amino acid ABC transporter (permease) homolog ydgF]
[GN:ydgF ] [CL:arginine permease] [OR:Bacillus subtilis] [DB:pir2]
>gp:[GI:d1020148:g1881368] [LN:AB001488] [AC:AB001488] [GN:ydgF] [OR:Bacillus subtilis]
[SR:Bacillus subtilis (strain:168) DNA] [DB:genpept-bct1] [DE:Bacillus subtilis genome
sequence, 148 kb sequence of the regionbetween 35 and 47 degree.] [NT:PROBABLE AMINO
ACID TRANSPORT PERMIASE.] [LE:139917] [RE:141293] [DI:complement]
>gp:[GI:e1182528:g2632862] [LN:BSUB0003] [AC:Z99106:AL009126] [GN:ydgF] [FN:unknown]
[OR:Bacillus subtilis] [DB:genpept-bct1] [DE:Bacillus subtilis complete genome (section
3 of 21): from 402751 to611850.] [NT:similar to amino acid ABC transporter (permease)]
[SP:P96704] [LE:203663] [RE:205039] [DI:complement] >gp:[GI:e1182541:g2632875]
[LN:BSUB0004] [AC:Z99107:AL009126] [GN:ydgF] [FN:unknown] [OR:Bacillus subtilis]
[DB:genpept-bct1] [DE:Bacillus subtilis complete genome (section 4 of 21): from 600701
to813890.] [NT:similar to amino acid ABC transporter (permease)] [SP:P96704] [LE:5713]
[RE:7089] [DI:complement]

| ORF Name | NTID | AAID | NT Length | AA Length | score | probability |
|---|---|---|---|---|---|---|
| AI7503000985_26385928_f2_900 | 1090 | 4862 | 1437 | 478 | 1441 | 1.5e-147 |

Description
pir:[LN:F69811] [AC:F69811 ] [PN:2-oxoglutarate/malate translocator homolog yflS]
[GN:yflS ] [CL:2-oxoglutarate/malate translocator] [OR:Bacillus subtilis] [DB:pir2]
>gp:[GI:e1182747:g2633081] [LN:BSUB0005] [AC:Z99108:AL009126] [GN:yflS] [FN:unknown]
[OR:Bacillus subtilis] [DB:genpept-bct1] [DE:Bacillus subtilis complete genome (section
5 of 21): from 802821 to1011250.] [NT:similar to 2-oxoglutarate/malate translocator]
[LE:26070] [RE:27506] [DI:direct] >gp:[GI:d1023175:g2443241] [LN:D86417] [AC:D86417]
[PN:YflS] [OR:Bacillus subtilis] [SR:Bacillus subtilis (strain:AC327) DNA]
[DB:genpept-bct1] [DE:Bacillus subtilis 35.7 kb genomic DNA, 70-73 degree
region,complete cds.] [LE:21015] [RE:22451] [DI:complement]

| ORF Name | NTID | AAID | NT Length | AA Length | score | probability |
|---|---|---|---|---|---|---|
| AI7503000985_26429800_f2_605 | 1091 | 4863 | 126 | 41 | | |

Description
NO-HIT

| ORF Name | NTID | AAID | NT Length | AA Length | score | probability |
|---|---|---|---|---|---|---|
| AI7503000985_26449187_c1_1436 | 1092 | 4864 | 129 | 42 | | |

Description
NO-HIT

| ORF Name | NTID | AAID | NT Length | AA Length | score | probability |
|---|---|---|---|---|---|---|
| AI7503000985_26571937_f2_570 | 1093 | 4865 | 789 | 262 | 838 | 1.2e-83 |

Description
pir:[LN:D69845] [AC:D69845 ] [PN:thiamin biosynthesis homolog yjbT] [GN:yjbT ]
[CL:thiamine biosynthesis protein thiG] [OR:Bacillus subtilis] [DB:pir2]
>gp:[GI:e1183189:g2633523] [LN:BSUB0007] [AC:Z99110:AL009126] [GN:yjbT] [FN:unknown]
[OR:Bacillus subtilis] [DB:genpept-bct1] [DE:Bacillus subtilis complete genome (section
7 of 21): from 1194391to 1411140.] [NT:similar to thiamin biosynthesis] [LE:50122]
[RE:50892] [DI:direct]

| ORF Name | NTID | AAID | NT Length | AA Length | score | probability |
|---|---|---|---|---|---|---|
| AI7503000985_26595641_f2_572 | 1094 | 4866 | 621 | 206 | 416 | 6.1e-39 |

Description
sp:[LN:APL_LACLA] [AC:Q48630] [GN:APL] [OR:LACTOCOCCUS LACTIS]
[SR:,SUBSP LACTIS:STREPTOCOCCUS LACTIS] [DE:ALKALINE PHOSPHATASE LIKE PROTEIN]
[SP:Q48630] [DB:swissprot] >pir:[LN:S39339] [AC:S39339 ] [PN:alkaline phosphatase-like
protein] [CL:probable alkaline phosphatase yngC] [OR:Lactococcus lactis] [DB:pir2]
>gp:[GI:g435296] [LN:LLALPHLP] [AC:Z29065] [PN:alkaline phosphatase like protein]
[GN:apl] [OR:Lactococcus lactis] [DB:genpept-bct1] [DE:L.lactis (MG1363) apl gene for
alkaline phosphatase like protein.] [SP:Q48630] [LE:339] [RE:1067] [DI:direct]

| ORF Name | NTID | AAID | NT Length | AA Length | score | probability |
|---|---|---|---|---|---|---|
| AI7503000985_26600425_f3_1300 | 1095 | 4867 | 792 | 263 | 220 | 3.6e-18 |

Description sp:[LN:ARY1_MOUSE] [AC:P50294] [GN:AAC1:NAT1] [OR:MUS MUSCULUS] [SR:,MOUSE]
[EC:2.3.1.5] [DE:ARYLAMINE N-ACETYLTRANSFERASE 1, (NAT-1)] [SP:P50294] [DB:swissprot]
>gp:[GI:g1045651] [LN:MMNAT1] [AC:U37119] [PN:arylamine N-acetyltransferase] [GN:NAT1]
[OR:Mus musculus] [SR:house mouse strain=C3H/HeJ] [DB:genpept-rod] [DE:Mus musculus
arylamine N-acetyltransferase (NAT1) gene, completecds.] [LE:1] [RE:873] [DI:direct]
>gp:[GI:g1008568] [LN:MMU35885] [AC:U35885] [PN:N-acetyltransferase NAT-1] [OR:Mus
musculus] [SR:house mouse strain=C57B16] [DB:genpept-rod] [DE:Mus musculus
N-acetyltransferase NAT-1 mRNA, complete cds.] [LE:217] [RE:1089] [DI:direct]

| ORF Name | NTID | AAID | NT Length | AA Length | score | probability |
|---|---|---|---|---|---|---|
| AI7503000985_26605001_c3_2206 | 1096 | 4868 | 825 | 274 | 686 | 1.5e-67 |

Description sp:[LN:YXBG_BACSU] [AC:P46331] [GN:YXBG:E3BR] [OR:BACILLUS SUBTILIS] [EC:1.-.-.-]
[DE:(EC 1.-.-.-)] [SP:P46331] [DB:swissprot] >pir:[LN:B70073] [AC:B70073 ] [PN:glucose
1-dehydrogenase homolog yxbG] [GN:yxbG ] [CL:short-chain alcohol dehydrogenase
homology] [DB:pir2] >gp:[GI:d1022451:g904199] [LN:AB005554]
[AC:AB005554:D45242:D31629] [PN:probable oxidoreductase] [GN:yxbG] [OR:Bacillus
subtilis] [SR:Bacillus subtilis (strain:BGSC 1A1) DNA] [DB:genpept-bct1] [EC:1.1.1.47]
[DE:Bacillus subtilis genomic DNA, 36 kb region between gnt and ioloperons.]
[NT:conserved universally] [LE:26446] [RE:27234] [DI:complement]
>gp:[GI:e1184709:g2636530] [LN:BSUB0021] [AC:Z99124:AL009126] [GN:yxbG] [FN:unknown]
[OR:Bacillus subtilis] [DB:genpept-bct1] [DE:Bacillus subtilis complete genome (section
21 of 21): from 3999281to 4214814.] [NT:alternate gene name: yxaU; similar to glucose]
[SP:P46331] [LE:91359] [RE:92147] [DI:direct]

| ORF Name | NTID | AAID | NT Length | AA Length | score | probability |
|---|---|---|---|---|---|---|
| AI7503000985_26672512_c1_1554 | 1097 | 4869 | 192 | 63 | 48 | 0.048 |

Description gp:[GI:g2444136] [LN:U88974] [AC:U88974] [PN:ORF56] [OR:Streptococcus thermophilus
temperate bacteriophage O1205] [DB:genpept-phg] [DE:Streptococcus thermophilus
temperate bacteriophage O1205, completegenome.] [LE:42158] [RE:42484] [DI:direct]

| ORF Name | NTID | AAID | NT Length | AA Length | score | probability |
|---|---|---|---|---|---|---|
| AI7503000985_266877_f2_877 | 1098 | 4870 | 450 | 149 | 285 | 4.7e-25 |

Description pir:[LN:F69653] [AC:F69653 ] [PN:transcription regulator lrpC] [GN:lrpC ] [OR:Bacillus
subtilis] [DB:pir2] >gp:[GI:e1182391:g2632725] [LN:BSUB0003] [AC:Z99106:AL009126]
[PN:transcriptional regulator (Lrp/AsnC family)] [GN:lrpC] [OR:Bacillus subtilis]
[DB:genpept-bct1] [DE:Bacillus subtilis complete genome (section 3 of 21): from 402751
to611850.] [NT:alternate gene name: ydaI] [LE:72862] [RE:73296] [DI:direct]

| ORF Name | NTID | AAID | NT Length | AA Length | score | probability |
|---|---|---|---|---|---|---|
| AI7503000985_26751431_c3_1973 | 1099 | 4871 | 1062 | 353 | 1037 | 9.6e-105 |

Description pir:[LN:E69581] [AC:E69581 ] [PN:acetoin dehydrogenase E1 component (TPP-dependent beta
subunit) acoB] [GN:acoB ] [CL:pyruvate dehydrogenase (lipoamide) beta chain]
[OR:Bacillus subtilis] [DB:pir2] >gp:[GI:e1182797:g2633131] [LN:BSUB0005]
[AC:Z99108:AL009126] [PN:acetoin dehydrogenase E1 component] [GN:acoB] [OR:Bacillus
subtilis] [DB:genpept-bct1] [DE:Bacillus subtilis complete genome (section 5 of 21):
from 802821 to1011250.] [NT:alternate gene name: yfjJ] [LE:76693] [RE:77721]
[DI:direct] >gp:[GI:d1025207:g2780394] [LN:D78509] [AC:D78509] [PN:YfjJ] [OR:Bacillus
subtilis] [SR:Bacillus subtilis (strain:AC327) DNA] [DB:genpept-bct1] [DE:Bacillus
subtilis YfjG-YfjR genes, complete cds.] [LE:8604] [RE:9632] [DI:complement]
>gp:[GI:g2245638] [LN:AF006075] [AC:AF006075] [PN:TPP-dependent acetoin dehydrogenase,
E1] [GN:acoB] [OR:Bacillus subtilis] [DB:genpept-bct2] [DE:Bacillus subtilis acetoin
dehydrogenase enzyme system gene cluster,ribosomal protein L6-like protein gene,
partial cds, TPP-dependentacetoin dehydrogenase, E1 alpha-subunit (acoA),
TPP-dependentacetoin dehydrogenase, E1 beta-subunit (acoB),
dihydrolipoamideacetyltransferase (acoC) and dihydrolipoamide dehydrogenase
(acoL)genes, complete cds, and regulatory protein (acoR) gene, partialcds.] [NT:beta
subunit of the E1 component of the acetoin] [LE:1830] [RE:2858] [DI:direct]
>gp:[GI:g2245638] [LN:AF006075] [AC:AF006075] [PN:TPP-dependent acetoin dehydrogenase,
E1] [GN:acoB] [OR:Bacillus subtilis] [DB:genpept] [DE:Bacillus subtilis acetoin
dehydrogenase enzyme system gene cluster,ribosomal protein L6-like protein gene,
partial cds, TPP-dependentacetoin dehydrogenase, E1 alpha-subunit (acoA),
TPP-dependentacetoin dehydrogenase, E1 beta-subunit (acoB),
dihydrolipoamideacetyltransferase (acoC) and dihydrolipoamide dehydrogenase
(acoL)genes, complete cds, and regulatory protein (acoR) gene, partialcds.] [NT:beta
subunit of the E1 component of the acetoin] [LE:1830] [RE:2858] [DI:direct]

| ORF Name | NTID | AAID | NT Length | AA Length | score | probability |
|---|---|---|---|---|---|---|
| AI7503000985_26751887_c1_1608 | 1100 | 4872 | 954 | 317 | 297 | 2.5e-26 |

Description sp:[LN:APBA_AQUAE] [AC:O67619] [GN:APBA:AQ_1727] [OR:AQUIFEX AEOLICUS] [EC:1.1.1.169]
[DE:REDUCTASE] (KPA REDUCTASE)] [SP:O67619] [DB:swissprot] >pir:[LN:A70449] [AC:A70449
] [PN:hypothetical protein aq_1727] [GN:aq_1727 ] [OR:Aquifex aeolicus] [DB:pir2]
>gp:[GI:g2984043] [LN:AE000753] [AC:AE000753:AE000657] [PN:putative protein]
[GN:aq_1727] [OR:Aquifex aeolicus] [DB:genpept-bct2] [DE:Aquifex aeolicus section 85 of
109 of the complete genome.] [LE:5968] [RE:6900] [DI:complement]

| ORF Name | NTID | AAID | NT Length | AA Length | score | probability |
|---|---|---|---|---|---|---|
| AI7503000985_273452_c2_1815 | 1101 | 4873 | 1278 | 425 | 800 | 1.2e-79 |

Description sp:[LN:HMDH_ARCFU] [AC:O28538] [GN:HMGA:AF1736] [OR:ARCHAEOGLOBUS FULGIDUS]
[EC:1.1.1.34] [DE:REDUCTASE)] [SP:O28538] [DB:swissprot] >pir:[LN:G69466] [AC:G69466 ]
[PN:3-hydroxy-3-methylglutaryl-coenzyme A reductase (mvaA) homolog] [OR:Archaeoglobus
fulgidus] [DB:pir2] >gp:[GI:g2648815] [LN:AE000983] [AC:AE000983:AE000782]
[PN:3-hydroxy-3-methylglutaryl-coenzyme A reductase] [GN:AF1736] [OR:Archaeoglobus
fulgidus] [DB:genpept-bct2] [DE:Archaeoglobus fulgidus section 124 of 172 of the
complete genome.] [NT:similar to SP:P13702 GB:M29727 GB:M31807 PID:151259] [LE:7093]
[RE:8403] [DI:complement]

| ORF Name | NTID | AAID | NT Length | AA Length | score | probability |
|---|---|---|---|---|---|---|
| AI7503000985_2735807_c3_1983 | 1102 | 4874 | 138 | 45 | | |

Description
NO-HIT

| ORF Name | NTID | AAID | NT Length | AA Length | score | probability |
|---|---|---|---|---|---|---|
| AI7503000985_2739050_c2_1816 | 1103 | 4875 | 927 | 308 | 583 | 1.2e-56 |

Description
sp:[LN:YWBI_BACSU] [AC:P39592] [GN:YWBI:IPA-24D] [OR:BACILLUS SUBTILIS]
[DE:HYPOTHETICAL TRANSCRIPTIONAL REGULATOR IN THIK-EPR INTERGENIC REGION] [SP:P39592]
[DB:swissprot] >pir:[LN:S39679] [AC:S39679:G70051 ] [PN:transcription regulator homolog
ywbI:protein ipa-24d] [GN:ywbI ] [CL:probable transcription regulator lsyR]
[OR:Bacillus subtilis] [DB:pir2] >gp:[GI:g413948] [LN:BSGENR] [AC:X73124] [GN:ipa-24d]
[OR:Bacillus subtilis] [DB:genpept-bct1] [DE:B.subtilis genomic region (325 to 333).]
[SP:P39592] [LE:24460] [RE:25365] [DI:direct] >gp:[GI:e1186330:g2636366] [LN:BSUB0020]
[AC:Z99123:AL009126] [GN:ywbI] [FN:unknown] [OR:Bacillus subtilis] [DB:genpept-bct1]
[DE:Bacillus subtilis complete genome (section 20 of 21): from 3798401to 4010550.]
[NT:alternate gene name: ipa-24d; similar to] [SP:P39592] [LE:132594] [RE:133499]
[DI:complement]

| ORF Name | NTID | AAID | NT Length | AA Length | score | probability |
|---|---|---|---|---|---|---|
| AI7503000985_2739561_f1_99 | 1104 | 4876 | 1440 | 479 | 1505 | 2.5e-154 |

Description
sp:[LN:GLPT_BACSU] [AC:P37948] [GN:GLPT] [OR:BACILLUS SUBTILIS] [DE:PERMEASE)]
[SP:P37948] [DB:swissprot] >pir:[LN:I40417] [AC:I40417:F69634:S37250 ]
[PN:glycerol-3-phosphate transport protein glpT:glycerol-3-phosphate permease glpT]
[GN:glpT ] [CL:hexose phosphate transport protein uhpT] [OR:Bacillus subtilis]
[DB:pir2] >gp:[GI:d1034077:g3599636] [LN:AB006424] [AC:AB006424] [GN:ybeE] [OR:Bacillus
subtilis] [SR:Bacillus subtilis (strain:168) DNA] [DB:genpept-bct1] [DE:Bacillus
subtilis genomic DNA, 70 kb region between 17 and 23degree.] [LE:36984] [RE:38318]
[DI:complement] >gp:[GI:g403372] [LN:BSGLPTQ] [AC:Z26522] [PN:glycerol 3-phosphate
permease] [GN:glpT] [FN:uptake of glycerol 3-phosphate] [OR:Bacillus subtilis]
[DB:genpept-bct1] [DE:B.subtilis glpT and glpQ genes for glycerol 3-phosphate
permeaseand glycerophosphoryl diester phosphodiesterase.] [SP:P37948] [LE:315]
[RE:1649] [DI:direct] >gp:[GI:e1182166:g2632500] [LN:BSUB0002] [AC:Z99105:AL009126]
[PN:glycerol-3-phosphate permease] [GN:glpT] [FN:uptake of glycerol-3-phosphate]
[OR:Bacillus subtilis] [DB:genpept-bct1] [DE:Bacillus subtilis complete genome (section
2 of 21): from 194651 to415810.] [NT:alternate gene name: ybeE] [SP:P37948] [LE:39333]
[RE:40667] [DI:complement]

| ORF Name | NTID | AAID | NT Length | AA Length | score | probability |
|---|---|---|---|---|---|---|
| AI7503000985_2760930_f1_121 | 1105 | 4877 | 189 | 62 | | |

Description
NO-HIT

| ORF Name | NTID | AAID | NT Length | AA Length | score | probability |
|---|---|---|---|---|---|---|
| AI7503000985_2767577_c3_2139 | 1106 | 4878 | 135 | 44 | | |

Description
NO-HIT

| ORF Name | NTID | AAID | NT Length | AA Length | score | probability |
|---|---|---|---|---|---|---|
| AI7503000985_2790936_f2_823 | 1107 | 4879 | 954 | 317 | 834 | 3.1e-83 |

Description
sp:[LN:MANA_STRMU] [AC:Q59935] [GN:PMI] [OR:STREPTOCOCCUS MUTANS] [EC:5.3.1.8] [DE:(PMI) (PHOSPHOHEXOMUTASE)] [SP:Q59935] [DB:swissprot] >gp:[GI:d1004537:g451216] [LN:STRPMI] [AC:D16594] [PN:Mannosephosphate Isomerase] [GN:pmi] [OR:Streptococcus mutans] [SR:Streptococcus mutans (strain:GS-5) DNA] [DB:genpept-bct1] [EC:5.3.1.8] [DE:S.mutans pmi gene for mannosephosphate isomerase (complete cds) andscrK gene for fructokinase (partial cds).] [LE:241] [RE:1191] [DI:direct]

| ORF Name | NTID | AAID | NT Length | AA Length | score | probability |
|---|---|---|---|---|---|---|
| AI7503000985_2814000_c3_2159 | 1108 | 4880 | 156 | 51 | | |

Description
NO-HIT

| ORF Name | NTID | AAID | NT Length | AA Length | score | probability |
|---|---|---|---|---|---|---|
| AI7503000985_2819803_c3_1966 | 1109 | 4881 | 363 | 120 | 206 | 1.1e-16 |

Description
gp:[GI:e1312399:g3341642] [LN:VCH231123] [AC:AJ231123] [GN:z61r] [OR:Vibrio cholerae] [DB:genpept-bct1] [DE:Vibrio cholerae z61r gene.] [LE:47] [RE:388] [DI:direct]

| ORF Name | NTID | AAID | NT Length | AA Length | score | probability |
|---|---|---|---|---|---|---|
| AI7503000985_2823562_c3_2100 | 1110 | 4882 | 1365 | 454 | 909 | 3.5e-91 |

Description
pir:[LN:A71026] [AC:A71026 ] [PN:probable aminotransferase] [GN:PH1501 ] [OR:Pyrococcus horikoshii] [DB:pir2] >gp:[GI:d1031552:g3257926] [LN:AP000006] [AC:AP000006:AB005215:AB009510:AB009511:AB009512:AB009513:AB009514] [PN:438aa long hypothetical aminotransferase] [GN:PH1501] [OR:Pyrococcus horikoshii] [SR:Pyrococcus horikoshii (strain:OT3) DNA, clone:Pyrococcus horikoshi] [DB:genpept-bct1] [DE:Pyrococcus horikoshii OT3 genomic DNA, 1166001-1485000 nt. position(6/7).] [NT:similar to owl:D5045389 percent identity: 38.287 in] [LE:170905] [RE:172221] [DI:direct]

| ORF Name | NTID | AAID | NT Length | AA Length | score | probability |
|---|---|---|---|---|---|---|
| AI7503000985_2853431_f2_504 | 1111 | 4883 | 195 | 64 | | |

Description
NO-HIT

| ORF Name | NTID | AAID | NT Length | AA Length | score | probability |
|---|---|---|---|---|---|---|
| AI7503000985_2854787_c1_1553 | 1112 | 4884 | 126 | 41 | | |

Description
NO-HIT

| ORF_Name | NTID | AAID | NT Length | AA Length | score | probability |
|---|---|---|---|---|---|---|
| AI7503000985_2867961_c2_1846 | 1113 | 4885 | 963 | 320 | 410 | 2.7e-38 |

Description
pir:[LN:A69756] [AC:A69756 ] [PN:adhesion protein homolog ycdH] [GN:ycdH ] [CL:adhesin B] [OR:Bacillus subtilis] [DB:pir2] >gp:[GI:d1023108:g2415736] [LN:AB000617] [AC:AB000617] [PN:YcdH] [GN:ycdH] [OR:Bacillus subtilis] [SR:Bacillus subtilis (strain:168 trpC2) DNA] [DB:genpept-bct1] [DE:Bacillus subtilis genomic DNA, 22 to 25 degree region, completecds.] [NT:homologue of adhesion protein precursor of] [LE:21421] [RE:22380] [DI:direct] >gp:[GI:e1182237:g2632571] [LN:BSUB0002] [AC:Z99105:AL009126] [GN:ycdH] [FN:unknown] [OR:Bacillus subtilis] [DB:genpept-bct1] [DE:Bacillus subtilis complete genome (section 2 of 21): from 194651 to415810.] [NT:similar to adhesion protein] [LE:113236] [RE:114195] [DI:direct]

| ORF_Name | NTID | AAID | NT Length | AA Length | score | probability |
|---|---|---|---|---|---|---|
| AI7503000985_29304552_c3_2150 | 1114 | 4886 | 138 | 45 | | |

Description
NO-HIT

| ORF_Name | NTID | AAID | NT Length | AA Length | score | probability |
|---|---|---|---|---|---|---|
| AI7503000985_29352312_c3_2063 | 1115 | 4887 | 765 | 254 | 617 | 3.1e-60 |

Description
sp:[LN:YXDL_BACSU] [AC:P42423] [GN:YXDL:B65F] [OR:BACILLUS SUBTILIS] [DE:HYPOTHETICAL ABC TRANSPORTER ATP-BINDING PROTEIN IN IDH 3'REGION] [SP:P42423] [DB:swissprot] >pir:[LN:A70074] [AC:A70074 ] [PN:ABC transporter (ATP-binding protein) homolog yxdL] [GN:yxdL ] [CL:ATP-binding cassette homology] [OR:Bacillus subtilis] [DB:pir2] >gp:[GI:d1003812:g709993] [LN:BACIOLO] [AC:D14399] [PN:hypothetical protein] [GN:B65F] [OR:Bacillus subtilis] [SR:Bacillus subtilis (strain:BGSC 1A1 (168 trpC2)) DNA] [DB:genpept-bct1] [DE:Bacillus subtilis 15 kb chromosome segment contains the iol operon.] [NT:homologous to cell division protein FtsE of E.] [LE:13014] [RE:13787] [DI:direct] >gp:[GI:e1184689:g2636510] [LN:BSUB0021] [AC:Z99124:AL009126] [GN:yxdL] [FN:unknown] [OR:Bacillus subtilis] [DB:genpept-bct1] [DE:Bacillus subtilis complete genome (section 21 of 21): from 3999281to 4214814.] [NT:similar to ABC transporter (ATP-binding protein)] [SP:P42423] [LE:69902] [RE:70675] [DI:complement] >gp:[GI:d1008911:g1408484] [LN:D45912] [AC:D45912] [GN:yxdL] [OR:Bacillus subtilis] [SR:Bacillus subtilis (strain:BGSC 1A1 (Marburg 168; trpC2)) DNA] [DB:genpept-bct1] [DE:Bacillus subtilis genome sequence between the iol and hut operon,partial and complete cds.] [NT:homologous to FtsE protein of E. coli, belonging to] [LE:801] [RE:1574] [DI:direct]

| ORF_Name | NTID | AAID | NT Length | AA Length | score | probability |
|---|---|---|---|---|---|---|
| AI7503000985_29375307_f2_499 | 1116 | 4888 | 135 | 44 | | |

Description
NO-HIT

| ORF Name | NTID | AAID | NT Length | AA Length | score | probability |
|---|---|---|---|---|---|---|
| AI7503000985_29400332_c1_1571 | 1117 | 4889 | 417 | 138 | 309 | 1.3e-27 |

Description pir:[LN:C69770] [AC:C69770 ] [PN:hypothetical protein ydaT] [GN:ydaT ] [OR:Bacillus subtilis] [DB:pir2] >gp:[GI:d1020028:g1881248] [LN:AB001488] [AC:AB001488] [GN:ydaT] [OR:Bacillus subtilis] [SR:Bacillus subtilis (strain:168) DNA] [DB:genpept-bct1] [DE:Bacillus subtilis genome sequence, 148 kb sequence of the regionbetween 35 and 47 degree.] [NT:FUNCTION UNKNOWN.] [LE:26046] [RE:26498] [DI:complement] >gp:[GI:e1182404:g2632738] [LN:BSUB0003] [AC:Z99106:AL009126] [GN:ydaT] [FN:unknown] [OR:Bacillus subtilis] [DB:genpept-bct1] [DE:Bacillus subtilis complete genome (section 3 of 21): from 402751 to611850.] [LE:89790] [RE:90242] [DI:complement]

| ORF Name | NTID | AAID | NT Length | AA Length | score | probability |
|---|---|---|---|---|---|---|
| AI7503000985_29493827_f2_872 | 1118 | 4890 | 165 | 54 | | |

Description

NO-HIT

| ORF Name | NTID | AAID | NT Length | AA Length | score | probability |
|---|---|---|---|---|---|---|
| AI7503000985_29503403_f2_788 | 1119 | 4891 | 126 | 41 | | |

Description

NO-HIT

| ORF Name | NTID | AAID | NT Length | AA Length | score | probability |
|---|---|---|---|---|---|---|
| AI7503000985_29532827_f2_477 | 1120 | 4892 | 243 | 80 | | |

Description

NO-HIT

| ORF Name | NTID | AAID | NT Length | AA Length | score | probability |
|---|---|---|---|---|---|---|
| AI7503000985_29695327_c2_1739 | 1121 | 4893 | 750 | 249 | | |

Description

NO-HIT

| ORF Name | NTID | AAID | NT Length | AA Length | score | probability |
|---|---|---|---|---|---|---|
| AI7503000985_29955003_c2_1894 | 1122 | 4894 | 129 | 42 | | |

Description

NO-HIT

| ORF Name | NTID | AAID | NT Length | AA Length | score | probability |
|---|---|---|---|---|---|---|
| AI7503000985_3007827_c2_1943 | 1123 | 4895 | 789 | 262 | 605 | 5.8e-59 |

Description pir:[LN:E69761] [AC:E69761:I40450:S52381 ] [PN:probable glutamine ABC transporter] [GN:yckK ] [CL:lysine-arginine-ornithine-binding protein] [OR:Bacillus subtilis] [DB:pir2] >gp:[GI:e1182313:g2632647] [LN:BSUB0002] [AC:Z99105:AL009126] [GN:yckK] [FN:unknown] [OR:Bacillus subtilis] [DB:genpept-bct1] [DE:Bacillus subtilis complete genome (section 2 of 21): from 194651 to415810.] [NT:similar to glutamine ABC transporter] [LE:215587] [RE:216393] [DI:complement] >gp:[GI:e1182328:g2632662] [LN:BSUB0003] [AC:Z99106:AL009126] [GN:yckK] [FN:unknown] [OR:Bacillus subtilis] [DB:genpept-bct1] [DE:Bacillus subtilis complete genome (section 3 of 21): from 402751 to611850.] [NT:similar to glutamine ABC transporter] [LE:7487] [RE:8293] [DI:complement] >gp:[GI:d1009629:g1805432] [LN:D50453] [AC:D50453] [PN:homologue of glutamine-binding periplasmic] [GN:yckK] [OR:Bacillus subtilis] [SR:Bacillus subtilis (strain:168 trpC2) DNA] [DB:genpept-bct1] [DE:Bacillus subtilis DNA for 25-36 degree region containing theamyE-srfA region, complete cds.] [LE:89890] [RE:90696] [DI:complement]

| ORF Name | NTID | AAID | NT Length | AA Length | score | probability |
|---|---|---|---|---|---|---|
| AI7503000985_30078378_c1_1437 | 1124 | 4896 | 165 | 54 | | |

Description

NO-HIT

| ORF Name | NTID | AAID | NT Length | AA Length | score | probability |
|---|---|---|---|---|---|---|
| AI7503000985_3009382_c3_1965 | 1125 | 4897 | 531 | 176 | | |

Description

NO-HIT

| ORF Name | NTID | AAID | NT Length | AA Length | score | probability |
|---|---|---|---|---|---|---|
| AI7503000985_30095011_f1_179 | 1126 | 4898 | 135 | 44 | | |

Description

NO-HIT

| ORF Name | NTID | AAID | NT Length | AA Length | score | probability |
|---|---|---|---|---|---|---|
| AI7503000985_30133562_c1_1399 | 1127 | 4899 | 1191 | 396 | 306 | 2.8e-27 |

Description sp:[LN:YYBF_BACSU] [AC:P37498] [GN:YYBF] [OR:BACILLUS SUBTILIS] [DE:HYPOTHETICAL 44.2 KD PROTEIN IN COTF-TETB INTERGENIC REGION] [SP:P37498] [DB:swissprot] >pir:[LN:S65991] [AC:S65991:A70087 ] [PN:membrane protein yybF] [GN:yybF ] [CL:probable antibiotic resistance protein yybF] [OR:Bacillus subtilis] [DB:pir2] >gp:[GI:d1005739:g467351] [LN:BAC180K] [AC:D26185] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:27159] [RE:28373] [DI:complement] >gp:[GI:e1184792:g2636613] [LN:BSUB0021] [AC:Z99124:AL009126] [GN:yybF] [FN:unknown] [OR:Bacillus subtilis] [DB:genpept-bct1] [DE:Bacillus subtilis complete genome (section 21 of 21): from 3999281to 4214814.] [NT:similar to antibiotic resistance protein] [SP:P37498] [LE:179091] [RE:180305] [DI:complement]

| ORF Name | NTID | AAID | NT Length | AA Length | score | probability |
|---|---|---|---|---|---|---|
| AI7503000985_302_f2_645 | 1128 | 4900 | 162 | 53 | | |

Description

NO-HIT

| ORF Name | NTID | AAID | NT Length | AA Length | score | probability |
|---|---|---|---|---|---|---|
| AI7503000985_30360925_f2_901 | 1129 | 4901 | 642 | 213 | 204 | 2.0e-16 |

Description
sp:[LN:Y357_HAEIN] [AC:P44658] [GN:HI0357] [OR:HAEMOPHILUS INFLUENZAE] [DE:PUTATIVE THIAMINE BIOSYNTHESIS PROTEIN HI0357] [SP:P44658] [DB:swissprot] >pir:[LN:C64063] [AC:C64063 ] [PN:hypothetical protein HI0357] [OR:Haemophilus influenzae] [DB:pir2] >gp:[GI:g1573325] [LN:U32720] [AC:U32720:L42023] [PN:thiamine biosynthesis protein, putative] [GN:HI0357] [OR:Haemophilus influenzae Rd] [DB:genpept-bct2] [DE:Haemophilus influenzae Rd section 35 of 163 of the complete genome.] [NT:similar to SP:P42883 SP:P43534 SP:P47183] [LE:3006] [RE:3950] [DI:direct]

| ORF Name | NTID | AAID | NT Length | AA Length | score | probability |
|---|---|---|---|---|---|---|
| AI7503000985_30367767_f1_56 | 1130 | 4902 | 1533 | 510 | 342 | 5.9e-31 |

Description
pir:[LN:D71235] [AC:D71235 ] [PN:hypothetical protein PH0142] [GN:PH0142 ] [OR:Pyrococcus horikoshii] [DB:pir2] >gp:[GI:d1030154:g3256528] [LN:AP000001] [AC:AP000001:AB009465:AB009464:AB009466:AB009467:AB009468:AB009469] [PN:289aa long hypothetical protein] [GN:PH0142] [OR:Pyrococcus horikoshii] [SR:Pyrococcus horikoshii (strain:OT3) DNA] [DB:genpept-bct1] [DE:Pyrococcus horikoshii OT3 genomic DNA, 1-287000 nt. position (1/7).] [NT:motif=soybean trypsin inhibitor (Kunitz) protease] [LE:124718] [RE:125587] [DI:direct]

| ORF Name | NTID | AAID | NT Length | AA Length | score | probability |
|---|---|---|---|---|---|---|
| AI7503000985_30470325_c3_2181 | 1131 | 4903 | 1953 | 650 | 425 | 8.1e-38 |

Description
pir:[LN:A70027] [AC:A70027 ] [PN:conserved hypothetical protein yvaC] [GN:yvaC ] [OR:Bacillus subtilis] [DB:pir2] >gp:[GI:e1186043:g2635868] [LN:BSUB0018] [AC:Z99121:AL009126] [GN:yvaC] [FN:unknown] [OR:Bacillus subtilis] [DB:genpept-bct1] [DE:Bacillus subtilis complete genome (section 18 of 21): from 3399551to 3609060.] [NT:similar to hypothetical proteins] [LE:45749] [RE:47644] [DI:complement]

| ORF Name | NTID | AAID | NT Length | AA Length | score | probability |
|---|---|---|---|---|---|---|
| AI7503000985_30651577_c3_2155 | 1132 | 4904 | 612 | 203 | 88 | 0.00087 |

Description
pir:[LN:G70065] [AC:G70065 ] [PN:hypothetical protein ywpE] [GN:ywpE ] [OR:Bacillus subtilis] [DB:pir2] >gp:[GI:e1184540:g2636159] [LN:BSUB0019] [AC:Z99122:AL009126] [GN:ywpE] [FN:unknown] [OR:Bacillus subtilis] [DB:genpept-bct1] [DE:Bacillus subtilis complete genome (section 19 of 21): from 3597091to 3809700.] [LE:143698] [RE:144006] [DI:complement] >gp:[GI:e289144:g1763706] [LN:BSZ83337] [AC:Z83337] [GN:ywpE] [OR:Bacillus subtilis] [DB:genpept-bct1] [DE:B.subtilis mbl, flh[O,P], rapD, ywp[B,C,D,E,F,G,H,I,J] and ywqAgenes.] [LE:5315] [RE:5623] [DI:direct] >gp:[GI:e1184540:g2636159] [LN:BSUB0019] [AC:Z99122:AL009126] [GN:ywpE] [FN:unknown] [OR:Bacillus subtilis] [DB:genpept] [DE:Bacillus subtilis complete genome (section 19 of 21): from 3597091to 3809700.] [LE:143698] [RE:144006] [DI:complement]

| ORF Name | NTID | AAID | NT Length | AA Length | score | probability |
|---|---|---|---|---|---|---|
| AI7503000985_31490687_f3_1096 | 1133 | 4905 | 141 | 46 | | |

Description
NO-HIT

| ORF_Name | NTID | AAID | NT Length | AA Length | score | probability |
|---|---|---|---|---|---|---|
| AI7503000985_31517587_c2_1663 | 1134 | 4906 | 129 | 42 | | |

Description
NO-HIT

| ORF_Name | NTID | AAID | NT Length | AA Length | score | probability |
|---|---|---|---|---|---|---|
| AI7503000985_3157062_c1_1475 | 1135 | 4907 | 174 | 57 | | |

Description
NO-HIT

| ORF_Name | NTID | AAID | NT Length | AA Length | score | probability |
|---|---|---|---|---|---|---|
| AI7503000985_31693_c2_1716 | 1136 | 4908 | 699 | 232 | 128 | 7.1e-08 |

Description
pir:[LN:JH0364] [AC:JH0364 ] [PN:hypothetical protein 176 (SAGP 5' region)]
[OR:Streptococcus pyogenes] [DB:pir2]

| ORF_Name | NTID | AAID | NT Length | AA Length | score | probability |
|---|---|---|---|---|---|---|
| AI7503000985_31720942_f2_813 | 1137 | 4909 | 576 | 191 | | |

Description
NO-HIT

| ORF_Name | NTID | AAID | NT Length | AA Length | score | probability |
|---|---|---|---|---|---|---|
| AI7503000985_31755012_c1_1340 | 1138 | 4910 | 978 | 325 | 886 | 9.6e-89 |

Description
pir:[LN:E70070] [AC:E70070 ] [PN:metabolite transport protein homolog ywtG] [GN:ywtG ]
[CL:glucose transport protein] [OR:Bacillus subtilis] [DB:pir2]
>gp:[GI:e1184489:g2636109] [LN:BSUB0019] [AC:Z99122:AL009126] [GN:ywtG] [FN:unknown]
[OR:Bacillus subtilis] [DB:genpept-bct1] [DE:Bacillus subtilis complete genome (section
19 of 21): from 3597091to 3809700.] [NT:similar to metabolite transport protein]
[LE:94500] [RE:95873] [DI:complement] >gp:[GI:e308095:g1894771] [LN:BSZ92954]
[AC:Z92954] [GN:ywtG] [OR:Bacillus subtilis] [DB:genpept-bct1] [DE:B.subtilis
yws[A,B,C,D,E,F,G] and gerBC genes.] [NT:product highly similar to metabolite
transport] [LE:6609] [RE:7982] [DI:direct] >gp:[GI:e1184489:g2636109] [LN:BSUB0019]
[AC:Z99122:AL009126] [GN:ywtG] [FN:unknown] [OR:Bacillus subtilis] [DB:genpept]
[DE:Bacillus subtilis complete genome (section 19 of 21): from 3597091to 3809700.]
[NT:similar to metabolite transport protein] [LE:94500] [RE:95873] [DI:complement]

| ORF_Name | NTID | AAID | NT Length | AA Length | score | probability |
|---|---|---|---|---|---|---|
| AI7503000985_3182927_c2_1673 | 1139 | 4911 | 2082 | 693 | 3598 | 0.0 |

Description
gp:[GI:g2981225] [LN:AF053006] [AC:AF053006] [PN:lipase precursor] [GN:geh1]
[OR:Staphylococcus epidermidis] [DB:genpept-bct2] [DE:Staphylococcus epidermidis lipase
precursor (geh1) gene, completecds.] [LE:148] [RE:2214] [DI:direct]

| ORF_Name | NTID | AAID | NT Length | AA Length | score | probability |
|---|---|---|---|---|---|---|
| AI7503000985_32205143_c2_1642 | 1140 | 4912 | 168 | 55 | | |

Description
NO-HIT

| ORF Name | NTID | AAID | NT Length | AA Length | score | probability |
|---|---|---|---|---|---|---|
| AI7503000985_32220202_f2_708 | 1141 | 4913 | 123 | 40 | | |

Description
NO-HIT

| ORF Name | NTID | AAID | NT Length | AA Length | score | probability |
|---|---|---|---|---|---|---|
| AI7503000985_32221012_c1_1567 | 1142 | 4914 | 471 | 156 | 114 | 4.6e-06 |

Description
sp:[LN:NPT4_HUMAN] [AC:O00476] [GN:SLC17A4:NPT4] [OR:HOMO SAPIENS] [SR:,HUMAN]
[DE:COTRANSPORTER 4) (NA(+)/PI COTRANSPORTER 4)] [SP:O00476] [DB:swissprot]
>gp:[GI:g2062692] [LN:HSU90545] [AC:U90545] [PN:sodium phosphate transporter] [GN:NPT4]
[OR:Homo sapiens] [SR:human] [DB:genpept-pri2] [DE:Human sodium phosphate transporter
(NPT4) mRNA, complete cds.] [LE:377] [RE:1582] [DI:direct]

| ORF Name | NTID | AAID | NT Length | AA Length | score | probability |
|---|---|---|---|---|---|---|
| AI7503000985_32614078_f2_539 | 1143 | 4915 | 150 | 49 | | |

Description
NO-HIT

| ORF Name | NTID | AAID | NT Length | AA Length | score | probability |
|---|---|---|---|---|---|---|
| AI7503000985_32664093_f2_568 | 1144 | 4916 | 627 | 208 | 142 | 6.7e-10 |

Description
pir:[LN:G70418] [AC:G70418 ] [PN:probable thiamine phosphate synthase 2] [GN:thiE1 ]
[CL:probable thiamin-phosphate pyrophosphorylase: thiamin-phosphate pyrophosphorylase
homology] [OR:Aquifex aeolicus] [DB:pir2] >gp:[GI:g2983767] [LN:AE000736]
[AC:AE000736:AE000657] [PN:thiamine phosphate synthase] [GN:thiE1] [OR:Aquifex
aeolicus] [DB:genpept-bct2] [DE:Aquifex aeolicus section 68 of 109 of the complete
genome.] [LE:15292] [RE:15852] [DI:complement]

| ORF Name | NTID | AAID | NT Length | AA Length | score | probability |
|---|---|---|---|---|---|---|
| AI7503000985_33203385_c3_1997 | 1145 | 4917 | 597 | 198 | 967 | 2.5e-97 |

Description
gp:[GI:g2978430] [LN:SEU43366] [AC:U43366] [PN:IcaR] [GN:icaR] [OR:Staphylococcus
epidermidis] [DB:genpept-bct2] [DE:Staphylococcus epidermidis operon mediating
intercellular adhesion:IcaR, IcaA, IcaD, IcaB, and IcaC genes, complete cds.] [LE:39]
[RE:596] [DI:complement]

| ORF Name | NTID | AAID | NT Length | AA Length | score | probability |
|---|---|---|---|---|---|---|
| AI7503000985_33209682_c2_1718 | 1146 | 4918 | 123 | 40 | | |

Description
NO-HIT

| ORF Name | NTID | AAID | NT Length | AA Length | score | probability |
|---|---|---|---|---|---|---|
| AI7503000985_33211092_f3_I123 | 1147 | 4919 | 471 | 156 | 72 | 0.030 |

Description sp:[LN:VL02_VARV] [AC:P33041] [GN:L2R:M2R] [OR:VARIOLA VIRUS] [DE:PROTEIN L2] [SP:P33041] [DB:swissprot] >pir:[LN:S33088] [AC:S33088:H36844 ] [PN:L2R protein:M2R protein] [CL:vaccinia virus F3 protein] [OR:variola virus] [DB:pir2] >gp:[GI:g262433] [LN:S55844] [AC:S55844] [GN:L2R] [OR:Variola major virus] [SR:Variola major virus India-1967] [DB:genpept-vrl] [DE:G9R...H7R [variola major virus, India-1967, Genomic, 19 genes,18029 nt].] [NT:This sequence comes from Fig. 2.] [LE:1860] [RE:2123] [DI:direct] >gp:[GI:g438992] [LN:VARCG] [AC:L22579] [OR:Variola major virus] [SR:Variola major virus (strain Bangladesh-1975) DNA] [DB:genpept-vrl] [DE:Variola major virus (strain Bangladesh-1975) complete genome.] [NT:homolog of vaccinia virus CDS L2R; putative] [LE:69256] [RE:69519] [DI:direct] >gp:[GI:g297254] [LN:VVCGAA] [AC:X69198] [GN:M2R] [OR:Variola virus] [DB:genpept-vrl] [DE:Variola virus DNA complete genome.] [SP:P33041] [LE:68623] [RE:68886] [DI:direct] >gp:[GI:g62350] [LN:VVHINDQKH] [AC:X67119] [GN:L2R COP] [OR:Variola virus] [DB:genpept-vrl] [DE:Variola virus (HindIII-Q,K,H,M,L,I,F genome fragment) genes.] [SP:P33041] [LE:18508] [RE:18771] [DI:direct] >gp:[GI:e92818:g1143683] [LN:VVL8R] [AC:X76267] [OR:Variola virus] [DB:genpept-vrl] [DE:Variola virus (Garcia-1966) L8R,I1L,I3R,I2L,I4L,I5R,I5.5R,I6R,I7L,I8R,I9R,N1R,N2R,N3L,N4R and N5R genes.] [NT:ORF13R] [SP:P33041] [LE:10592] [RE:10855] [DI:direct]

| ORF Name | NTID | AAID | NT Length | AA Length | score | probability |
| --- | --- | --- | --- | --- | --- | --- |
| AI7503000985_33219007_f3_1152 | 1148 | 4920 | 375 | 124 | | |

Description

NO-HIT

| ORF Name | NTID | AAID | NT Length | AA Length | score | probability |
| --- | --- | --- | --- | --- | --- | --- |
| AI7503000985_33241093_c2_1806 | 1149 | 4921 | 1557 | 518 | 1634 | 5.2e-168 |

Description pir:[LN:A69759] [AC:A69759 ] [PN:1-pyrroline-5-carboxylate dehydrogenase homolog ycgN] [GN:ycgN ] [CL:aldehyde dehydrogenase (NAD+):aldehyde dehydrogenase homology] [OR:Bacillus subtilis] [DB:pir2] >gp:[GI:e1182273:g2632607] [LN:BSUB0002] [AC:Z99105:AL009126] [GN:ycgN] [FN:unknown] [OR:Bacillus subtilis] [DB:genpept-bct1] [DE:Bacillus subtilis complete genome (section 2 of 21): from 194651 to415810.] [NT:similar to 1-pyrroline-5-carboxylate dehydrogenase] [LE:150401] [RE:151948] [DI:direct] >gp:[GI:d1009590:g1805393] [LN:D50453] [AC:D50453] [PN:68% identity protein to] [GN:ycgN] [OR:Bacillus subtilis] [SR:Bacillus subtilis (strain:168 trpC2) DNA] [DB:genpept-bct1] [DE:Bacillus subtilis DNA for 25-36 degree region containing theamyE-srfA region, complete cds.] [LE:24702] [RE:26249] [DI:direct]

| ORF Name | NTID | AAID | NT Length | AA Length | score | probability |
| --- | --- | --- | --- | --- | --- | --- |
| AI7503000985_33242842_c1_1579 | 1150 | 4922 | 2871 | 956 | 315 | 2.0e-24 |

Description pir:[LN:S59797] [AC:S59797 ] [PN:hypothetical protein YDR332w:hypothetical protein D9798.1] [CL:unassigned DEAD/H box helicases:DEAD/H box helicase homology] [OR:Saccharomyces cerevisiae] [DB:pir2] [MP:4R ]

| ORF Name | NTID | AAID | NT Length | AA Length | score | probability |
| --- | --- | --- | --- | --- | --- | --- |
| AI7503000985_33250287_c1_1513 | 1151 | 4923 | 156 | 51 | | |

Description

NO-HIT

| ORF_Name | NTID | AAID | NT Length | AA Length | score | probability |
|---|---|---|---|---|---|---|
| AI7503000985_33304082_f1_387 | 1152 | 4924 | 129 | 42 | | |

Description
NO-HIT

| ORF_Name | NTID | AAID | NT Length | AA Length | score | probability |
|---|---|---|---|---|---|---|
| AI7503000985_33359381_c2_1697 | 1153 | 4925 | 210 | 69 | | |

Description
NO-HIT

| ORF_Name | NTID | AAID | NT Length | AA Length | score | probability |
|---|---|---|---|---|---|---|
| AI7503000985_33391337_c2_1891 | 1154 | 4926 | 864 | 287 | 168 | 2.1e-12 |

Description
gp:[GI:g4894301] [LN:AF065404] [AC:AF065404] [PN:pXO1-85] [OR:Bacillus anthracis]
[DB:genpept-bct2] [DE:Bacillus anthracis virulence plasmid PX01, complete sequence.]
[LE:99636] [RE:100319] [DI:direct]

| ORF_Name | NTID | AAID | NT Length | AA Length | score | probability |
|---|---|---|---|---|---|---|
| AI7503000985_33595087_c2_1645 | 1155 | 4927 | 141 | 46 | | |

Description
NO-HIT

| ORF_Name | NTID | AAID | NT Length | AA Length | score | probability |
|---|---|---|---|---|---|---|
| AI7503000985_33620176_c3_2091 | 1156 | 4928 | 858 | 285 | 494 | 3.3e-47 |

Description
gp:[GI:d1020251:g1943993] [LN:AB001896] [AC:AB001896] [GN:orf30] [OR:Staphylococcus aureus] [SR:Staphylococcus aureus (strain:912) DNA] [DB:genpept-bct1]
[DE:Staphylococcus aureus DNA for sigma70 operon, complete cds.] [LE:1501] [RE:2310]
[DI:direct]

| ORF_Name | NTID | AAID | NT Length | AA Length | score | probability |
|---|---|---|---|---|---|---|
| AI7503000985_33837817_c1_1431 | 1157 | 4929 | 129 | 42 | | |

Description
NO-HIT

| ORF_Name | NTID | AAID | NT Length | AA Length | score | probability |
|---|---|---|---|---|---|---|
| AI7503000985_33985007_f3_1266 | 1158 | 4930 | 153 | 50 | | |

Description
NO-HIT

| ORF_Name | NTID | AAID | NT Length | AA Length | score | probability |
|---|---|---|---|---|---|---|
| AI7503000985_33988778_f2_888 | 1159 | 4931 | 660 | 219 | 636 | 3.0e-62 |

Description
pir:[LN:JC4511] [AC:JC4511 ] [PN:pyroglutamyl-peptidase I,:bacterial pyrrolidone
carboxyl peptidase (PYRase)] [GN:pcp ] [OR:Staphylococcus aureus] [EC:3.4.19.3]
[DB:pir2] >gp:[GI:g790573] [LN:SAU19770] [AC:U19770] [PN:pyrrolidone carboxyl
peptidase] [GN:pcp] [OR:Staphylococcus aureus] [DB:genpept-bct1] [DE:Staphylococcus
aureus pyrrolidone carboxyl peptidase (pcp) gene,complete cds.] [NT:pyrase] [LE:204]
[RE:842] [DI:direct]

| ORF_Name | NTID | AAID | NT Length | AA Length | score | probability |
|---|---|---|---|---|---|---|
| AI7503000985_34016937_c1_1600 | 1160 | 4932 | 1383 | 460 | 1178 | 1.1e-119 |

Description
pir:[LN:C69670] [AC:C69670 ] [PN:glycine betaine/carnitine/choline ABC transporter (ATP-bindin) opuCA] [GN:opuCA ] [CL:glycine betaine/proline transport protein proV: ATP-binding cassette homology:CBS homology] [OR:Bacillus subtilis] [DB:pir2] >gp:[GI:g2271389] [LN:AF009352] [AC:AF009352] [PN:ATPase] [GN:opuCA] [OR:Bacillus subtilis] [DB:genpept-bct1] [DE:Bacillus subtilis osmoprotectant transport system OpuC includingATPase (opuCA), transmembrane protein (opuCB), osmoprotectantbinding protein precursor (opuCC) and transmembrane protein (opuCD)genes, complete cds.] [NT:OpuCA; part of the osmoprotectant transport system] [LE:860] [RE:2002] [DI:direct] >gp:[GI:e1186071:g2635896] [LN:BSUB0018] [AC:Z99121:AL009126] [PN:glycine betaine/carnitine/choline ABC] [GN:opuCA] [FN:high affinity transport of glycine betaine,] [OR:Bacillus subtilis] [DB:genpept-bct1] [DE:Bacillus subtilis complete genome (section 18 of 21): from 3399551to 3609060.] [NT:alternate gene name: yvbE] [LE:69373] [RE:70515] [DI:complement]

| ORF_Name | NTID | AAID | NT Length | AA Length | score | probability |
|---|---|---|---|---|---|---|
| AI7503000985_34021912_c2_1736 | 1161 | 4933 | 123 | 40 | | |

Description
NO-HIT

| ORF_Name | NTID | AAID | NT Length | AA Length | score | probability |
|---|---|---|---|---|---|---|
| AI7503000985_3402312_c1_1529 | 1162 | 4934 | 1761 | 586 | 1316 | 2.6e-134 |

Description
pir:[LN:G69769] [AC:G69769 ] [PN:pyruvate oxidase homolog ydaP] [GN:ydaP ] [CL:acetolactate synthase large chain:thiamine pyrophosphate-binding domain homology] [OR:Bacillus subtilis] [DB:pir2] >gp:[GI:d1020024:g1881244] [LN:AB001488] [AC:AB001488] [GN:ydaP] [OR:Bacillus subtilis] [SR:Bacillus subtilis (strain:168) DNA] [DB:genpept-bct1] [DE:Bacillus subtilis genome sequence, 148 kb sequence of the regionbetween 35 and 47 degree.] [NT:SIMILAR TO PYRUVATE OXIDASE AND ACETOLACTATE] [LE:21889] [RE:23613] [DI:direct] >gp:[GI:e1182400:g2632734] [LN:BSUB0003] [AC:Z99106:AL009126] [GN:ydaP] [FN:unknown] [OR:Bacillus subtilis] [DB:genpept-bct1] [DE:Bacillus subtilis complete genome (section 3 of 21): from 402751 to611850.] [NT:similar to pyruvate oxidase] [LE:85633] [RE:87357] [DI:direct]

| ORF_Name | NTID | AAID | NT Length | AA Length | score | probability |
|---|---|---|---|---|---|---|
| AI7503000985_34033563_c1_1627 | 1163 | 4935 | 327 | 108 | 388 | 5.7e-36 |

Description
gp:[GI:e1429590:g4756150] [LN:A67161] [AC:A67161] [FN:NIRD GENE] [OR:Staphylococcus carnosus] [DB:genpept-pat] [DE:Sequence 1 from Patent EP0805205.] [NT:unnamed protein product] [LE:2589] [RE:2903] [DI:direct] >gp:[GI:g4433640] [LN:AF029224] [AC:AF029224:AF029225] [PN:NirD] [GN:nirD] [OR:Staphylococcus carnosus] [DB:genpept-bct2] [DE:Staphylococcus carnosus nir and nar operons, complete sequences.] [NT:similar to Escherichia coli NADH-dependent nitrite] [LE:4774] [RE:5088] [DI:direct]

| ORF_Name | NTID | AAID | NT Length | AA Length | score | probability |
|---|---|---|---|---|---|---|
| AI7503000985_34094136_f1_408 | 1164 | 4936 | 156 | 51 | | |

Description
NO-HIT

| ORF Name | NTID | AAID | NT Length | AA Length | score | probability |
|---|---|---|---|---|---|---|
| AI7503000985_34157807_f2_816 | 1165 | 4937 | 147 | 48 | | |

Description
NO-HIT

| ORF Name | NTID | AAID | NT Length | AA Length | score | probability |
|---|---|---|---|---|---|---|
| AI7503000985_34194002_c2_1941 | 1166 | 4938 | 711 | 236 | 657 | 1.8e-64 |

Description
sp:[LN:PMGY_ZYMMO] [AC:P30798] [GN:PGM] [OR:ZYMOMONAS MOBILIS] [EC:5.4.2.1]
[DE:(BPG-DEPENDENT PGAM)] [SP:P30798] [DB:swissprot] >pir:[LN:C40649] [AC:C40649 ]
[PN:phosphoglycerate mutase,] [CL:phosphoglycerate mutase:phosphoglycerate mutase
homology] [OR:Zymomonas mobilis] [EC:5.4.2.1] [DB:pir2] >gp:[GI:g155611] [LN:ZMOPGMA]
[AC:L09651] [PN:phosphoglyceromutase] [GN:pgm] [OR:Zymomonas mobilis] [SR:Zymomonas
mobilis (strain CP4) DNA] [DB:genpept-bct1] [DE:Zymomonas mobilis phosphoglyceromutase
(pgm) gene, complete cds,and 2-hydroxyacid dehydrogenase homologue (ddh) gene, 5' end.]
[LE:317] [RE:1003] [DI:direct]

| ORF Name | NTID | AAID | NT Length | AA Length | score | probability |
|---|---|---|---|---|---|---|
| AI7503000985_34197318_f3_1128 | 1167 | 4939 | 903 | 300 | 1117 | 3.2e-113 |

Description
pir:[LN:A49943] [AC:A49943:S33358 ] [PN:fructose-bisphosphate aldolase,]
[OR:Staphylococcus carnosus] [EC:4.1.2.13] [DB:pir2] >gp:[GI:g297874] [LN:SCFDA]
[AC:X71729] [PN:fructose-bisphosphate aldolase] [GN:fda] [OR:Staphylococcus carnosus]
[DB:genpept-bct1] [EC:4.1.2.13] [DE:S.carnosus fda gene.] [SP:Q07159] [LE:667]
[RE:1557] [DI:direct]

| ORF Name | NTID | AAID | NT Length | AA Length | score | probability |
|---|---|---|---|---|---|---|
| AI7503000985_34273436_f2_498 | 1168 | 4940 | 855 | 284 | 372 | 2.8e-34 |

Description
sp:[LN:YQJG_BACSU] [AC:P54544] [GN:YQJG] [OR:BACILLUS SUBTILIS] [DE:PRECURSOR]
[SP:P54544] [DB:swissprot] >pir:[LN:G69963] [AC:G69963 ] [PN:lipoprotein SpoIIIJ-like
homolog yqjG] [GN:yqjG ] [CL:stage III sporulation protein:stage III sporulation
protein homology] [OR:Bacillus subtilis] [DB:pir2] >gp:[GI:d1013293:g1303958]
[LN:BACJH642] [AC:D84432:D82370] [PN:YqjG] [OR:Bacillus subtilis] [SR:Bacillus subtilis
(strain:JH642(trpC2 PheA1)) DNA] [DB:genpept-bct1] [DE:Bacillus subtilis DNA, 283 Kb
region containing skin element.] [LE:234919] [RE:235746] [DI:complement]
>gp:[GI:e1185657:g2634823] [LN:BSUB0013] [AC:Z99116:AL009126] [GN:yqjG] [FN:unknown]
[OR:Bacillus subtilis] [DB:genpept-bct1] [DE:Bacillus subtilis complete genome (section
13 of 21): from 2395261to 2613730.] [NT:similar to lipoprotein SpoIIIJ-like]
[SP:P54544] [LE:87873] [RE:88700] [DI:direct]

| ORF Name | NTID | AAID | NT Length | AA Length | score | probability |
|---|---|---|---|---|---|---|
| AI7503000985_34385012_f2_465 | 1169 | 4941 | 1362 | 453 | 364 | 6.0e-40 |

Description
pir:[LN:S62194] [AC:S62194 ] [PN:hypothetical protein 4] [CL:dipeptide transport
protein] [OR:Methanosarcina barkeri] [DB:pir2] >gp:[GI:e212291:g1124957] [LN:MBFMDSUBS]
[AC:X93084] [GN:orf4] [OR:Methanosarcina barkeri] [DB:genpept-bct1] [DE:M.barkeri fmdE,
fmdF, fmdA, fmdC, fmdD, fmdB, orf4, orf3, orf2, andorf1 genes.] [LE:<1] [RE:1588]
[DI:complement]

| ORF Name | NTID | AAID | NT Length | AA Length | score | probability |
|---|---|---|---|---|---|---|
| AI7503000985_34410843_c2_1690 | 1170 | 4942 | 1431 | 476 | | |

Description
NO-HIT

| ORF Name | NTID | AAID | NT Length | AA Length | score | probability |
|---|---|---|---|---|---|---|
| AI7503000985_34412952_c3_2210 | 1171 | 4943 | 783 | 260 | 580 | 2.6e-56 |

Description
sp:[LN:YBBM_ECOLI] [AC:P77307] [GN:YBBM] [OR:ESCHERICHIA COLI] [DE:HYPOTHETICAL 28.2 KD PROTEIN IN USHA-TESA INTERGENIC REGION] [SP:P77307] [DB:swissprot]

| ORF Name | NTID | AAID | NT Length | AA Length | score | probability |
|---|---|---|---|---|---|---|
| AI7503000985_34414192_c3_2229 | 1172 | 4944 | 831 | 276 | 113 | 0.00012 |

Description
pir:[LN:F69104] [AC:F69104 ] [PN:3',5'-cyclic-nucleotide phosphodiesterase, cpdA homolog MTH178:Icc related protein] [GN:MTH178 ] [CL:3',5'-cyclic-nucleotide phosphodiesterase cpdA: 3',5'-cyclic-nucleotide phosphodiesterase cpdA homology:phosphoesterase core homology] [OR:Methanobacterium thermoautotrophicum] [EC:3.1.4.17] [DB:pir1] >gp:[GI:g2621221] [LN:AE000805] [AC:AE000805:AE000666] [PN:Icc related protein] [GN:MTH178] [OR:Methanobacterium thermoautotrophicum] [DB:genpept-bct1] [DE:Methanobacterium thermoautotrophicum from bases 114371 to 125512(section 11 of 148) of the complete genome.] [NT:Function Code:10.02 - Metabolism of Macromolecules,] [LE:10465] [RE:11055] [DI:direct]

| ORF Name | NTID | AAID | NT Length | AA Length | score | probability |
|---|---|---|---|---|---|---|
| AI7503000985_34430428_c2_1949 | 1173 | 4945 | 375 | 124 | 83 | 0.0051 |

Description
pir:[LN:C69776] [AC:C69776 ] [PN:hypothetical protein yddJ] [GN:yddJ ] [OR:Bacillus subtilis] [DB:pir2] >gp:[GI:d1020089:g1881309] [LN:AB001488] [AC:AB001488] [GN:yddJ] [OR:Bacillus subtilis] [SR:Bacillus subtilis (strain:168) DNA] [DB:genpept-bct1] [DE:Bacillus subtilis genome sequence, 148 kb sequence of the regionbetween 35 and 47 degree.] [NT:FUNCTION UNKNOWN.] [LE:78831] [RE:79211] [DI:direct] >gp:[GI:e1182465:g2632799] [LN:BSUB0003] [AC:Z99106:AL009126] [GN:yddJ] [FN:unknown] [OR:Bacillus subtilis] [DB:genpept-bct1] [DE:Bacillus subtilis complete genome (section 3 of 21): from 402751 to611850.] [LE:142576] [RE:142956] [DI:direct]

| ORF Name | NTID | AAID | NT Length | AA Length | score | probability |
|---|---|---|---|---|---|---|
| AI7503000985_34554692_f1_62 | 1174 | 4946 | 474 | 157 | 403 | 1.5e-37 |

Description
gp:[GI:g1575025] [LN:SAU52961] [AC:U52961] [PN:holin-like protein LrgA] [GN:lrgA] [OR:Staphylococcus aureus] [SR:Staphylococcus aureus strain=NCTC 8325-4] [DB:genpept-bct2] [DE:Staphylococcus aureus holin-like protein LrgA (lrgA) and LrgB(lrgB) genes, complete cds.] [NT:LytSR-regulated gene; similar to E.coli yohJ] [LE:369] [RE:812] [DI:direct]

| ORF Name | NTID | AAID | NT Length | AA Length | score | probability |
|---|---|---|---|---|---|---|
| AI7503000985_34585317_c2_1938 | 1175 | 4947 | 1491 | 496 | 130 | 2.6e-05 |

Description
gp:[GI:g454844] [LN:SCMP48EGG] [AC:M74170] [OR:Schistosoma mansoni] [SR:Schistosoma mansoni (strain NMRI) female adult worm DNA] [DB:genpept-inv1] [DE:Schistosoma mansoni p48 eggshell protein gene, complete cds.] [NT:ORF 3] [LE:687] [RE:1868] [DI:complement]

| ORF Name | NTID | AAID | NT Length | AA Length | score | probability |
|---|---|---|---|---|---|---|
| AI7503000985_34617937_f3_1227 | 1176 | 4948 | 525 | 174 | 223 | 1.3e-17 |

Description
gp:[GI:g2952545] [LN:AF051898] [AC:AF051898] [PN:coronin binding protein] [GN:DB10] [OR:Dictyostelium discoideum] [DB:genpept-inv1] [DE:Dictyostelium discoideum coronin binding protein (DB10) mRNA,complete cds.] [LE:108] [RE:1790] [DI:direct]

| ORF Name | NTID | AAID | NT Length | AA Length | score | probability |
|---|---|---|---|---|---|---|
| AI7503000985_34647150_c1_1439 | 1177 | 4949 | 1356 | 451 | 274 | 1.6e-23 |

Description
gp:[GI:g2570198] [LN:LSU54556] [AC:U54556] [PN:microfilarial sheath protein SHP3] [GN:shp3] [OR:Litomosoides sigmodontis] [DB:genpept-inv1] [DE:Litomosoides sigmodontis microfilarial sheath proteins SHP3a(shp3a) and SHP3 (shp3) genes, complete cds.] [NT:structural protein; similar to shp3 genes from] [LE:7991:8260] [RE:8047:9219] [DI:directJoin]

| ORF Name | NTID | AAID | NT Length | AA Length | score | probability |
|---|---|---|---|---|---|---|
| AI7503000985_35193950_c2_1811 | 1178 | 4950 | 489 | 162 | | |

Description
NO-HIT

| ORF Name | NTID | AAID | NT Length | AA Length | score | probability |
|---|---|---|---|---|---|---|
| AI7503000985_35317188_c2_1684 | 1179 | 4951 | 6414 | 2137 | 2779 | 2.4e-289 |

Description
gp:[GI:g3929312] [LN:AF100426] [AC:AF100426] [PN:fimbriae-associated protein Fap1] [GN:fap1] [OR:Streptococcus parasanguinis] [DB:genpept-bct2] [DE:Streptococcus parasanguis fimbriae-associated protein Fap1 (fap1)gene, complete cds.] [NT:invovled in fimbriae assembly and fimbriae-mediated] [LE:284] [RE:7996] [DI:direct]

| ORF Name | NTID | AAID | NT Length | AA Length | score | probability |
|---|---|---|---|---|---|---|
| AI7503000985_35433438_f3_1030 | 1180 | 4952 | 1137 | 378 | 420 | 2.3e-39 |

Description
sp:[LN:GLOX_BACSU] [AC:O31616] [GN:YJBR] [OR:BACILLUS SUBTILIS] [EC:1.5.3.-] [DE:GLYCINE OXIDASE,] [SP:O31616] [DB:swissprot] >pir:[LN:B69845] [AC:B69845 ] [PN:sarcosine oxidase homolog yjbR] [GN:yjbR ] [OR:Bacillus subtilis] [DB:pir2] >gp:[GI:e1183187:g2633521] [LN:BSUB0007] [AC:Z99110:AL009126] [GN:yjbR] [FN:unknown] [OR:Bacillus subtilis] [DB:genpept-bct1] [DE:Bacillus subtilis complete genome (section 7 of 21): from 1194391to 1411140.] [NT:similar to sarcosine oxidase] [SP:O31616] [LE:48816] [RE:49925] [DI:direct]

| ORF_Name | NTID | AAID | NT Length | AA Length | score | probability |
|---|---|---|---|---|---|---|
| AI7503000985_35449093_c2_1668 | 1181 | 4953 | 831 | 276 | 103 | 0.0069 |

Description sp:[LN:YHI3_LACLA] [AC:Q02147] [OR:LACTOCOCCUS LACTIS] [SR:,SUBSPLACTIS:STREPTOCOCCUS LACTIS] [DE:HYPOTHETICAL 38.0 KD PROTEIN IN HISC-HISG INTERGENIC REGION (ORF3)] [SP:Q02147] [DB:swissprot] >pir:[LN:C45734] [AC:C45734 ] [PN:histidyl-tRNA synthetase homolog] [OR:Lactococcus lactis subsp. lactis] [DB:pir2] >gp:[GI:g2565140] [LN:LLU92974] [AC:U92974:M90760:M90761] [PN:unknown] [OR:Lactococcus lactis] [DB:genpept-bct1] [DE:Lactococcus lactis unknown gene, partial cds, and HisC (hisC),unknown, HisG (hisG), unknown, HisB (hisB), unknown, HisH (hish),HisA (hisA), HisF (hisF), HisIE (hisIE), unknown, unknown, LeuA(leuA), LeuB (leuB), LeuC (leuC), LeuD (leuD), unknown, IlvD(ilvD), IlvB (ilvB), IlvN, IlvC (ilvC), IlvA (ilvA), AldB (aldB)and aldR (aldR) genes, complete cds.] [NT:ORF2; potential regulator; similar to histidyl-tRNA] [LE:2146] [RE:3132] [DI:direct]

| ORF_Name | NTID | AAID | NT Length | AA Length | score | probability |
|---|---|---|---|---|---|---|
| AI7503000985_35687_f2_812 | 1182 | 4954 | 162 | 53 | | |

Description
NO-HIT

| ORF_Name | NTID | AAID | NT Length | AA Length | score | probability |
|---|---|---|---|---|---|---|
| AI7503000985_35817137_f3_1254 | 1183 | 4955 | 156 | 51 | | |

Description
NO-HIT

| ORF_Name | NTID | AAID | NT Length | AA Length | score | probability |
|---|---|---|---|---|---|---|
| AI7503000985_35993802_c2_1685 | 1184 | 4956 | 1584 | 527 | | |

Description
NO-HIT

| ORF_Name | NTID | AAID | NT Length | AA Length | score | probability |
|---|---|---|---|---|---|---|
| AI7503000985_35995316_f1_393 | 1185 | 4957 | 1257 | 418 | 2160 | 9.6e-224 |

Description pir:[LN:S77608] [AC:S77608 ] [PN:probable intercellular adhesion protein A:glycosyltransferase:icaA protein] [GN:icaA ] [OR:Staphylococcus epidermidis] [DB:pir2] >gp:[GI:g1161380] [LN:SEU43366] [AC:U43366] [PN:IcaA] [GN:icaA] [OR:Staphylococcus epidermidis] [DB:genpept-bct2] [DE:Staphylococcus epidermidis operon mediating intercellular adhesion:IcaR, IcaA, IcaD, IcaB, and IcaC genes, complete cds.] [LE:761] [RE:1999] [DI:direct]

| ORF Name | NTID | AAID | NT Length | AA Length | score | probability |
|---|---|---|---|---|---|---|
| AI7503000985_36127302_c2_1875 | 1186 | 4958 | 888 | 295 | 1058 | 5.7e-107 |

Description sp:[LN:GTAB_BACSU] [AC:Q05852] [GN:GTAB] [OR:BACILLUS SUBTILIS] [EC:2.7.7.9]
[DE:(GENERAL STRESS PROTEIN 33) (GSP33)] [SP:Q05852] [DB:swissprot] >pir:[LN:A40650]
[AC:A40650:B69638 ] [PN:UTP--glucose-1-phosphate uridylyltransferase,:UDP-glucose
pyrophosphorylase] [GN:gtaB ] [CL:Escherichia coli UTP--glucose-1-phosphate
uridylyltransferase] [OR:Bacillus subtilis] [EC:2.7.7.9] [DB:pir1] >gp:[GI:g289287]
[LN:BACGTABX] [AC:L12272] [PN:UDP-glucose pyrophosphorylase] [GN:gtaB] [OR:Bacillus
subtilis] [SR:Bacillus subtilis (strain 168, sub_species Marburg) DNA]
[DB:genpept-bct1] [EC:2.7.7.9] [DE:Bacillus subtilis UDP-glucose pyrophosphorylase
(gtaB) gene,complete cds.] [NT:similar to UDP-glucose pyrophosphorylase of] [LE:120]
[RE:998] [DI:direct] >gp:[GI:g405623] [LN:BSLYTGTA] [AC:Z22516] [PN:UDP-glucose
pyrophosphorylase] [GN:gtaB] [OR:Bacillus subtilis] [DB:genpept-bct1] [EC:2.7.7.9]
[DE:B.subtilis lytR, orfX, and gtaB genes.] [NT:similar to other procaryotic
UDP-glucose] [SP:Q05852] [LE:1581] [RE:2459] [DI:direct] >gp:[GI:e1184473:g2636093]
[LN:BSUB0019] [AC:Z99122:AL009126] [PN:UTP-glucose-1-phosphate uridylyltransferase]
[GN:gtaB] [FN:glucosylation of teichoic acid] [OR:Bacillus subtilis] [DB:genpept-bct1]
[EC:2.7.7.9] [DE:Bacillus subtilis complete genome (section 19 of 21): from 3597091to
3809700.] [SP:Q05852] [LE:67599] [RE:68477] [DI:direct] >gp:[GI:e1184473:g2636093]
[LN:BSUB0019] [AC:Z99122:AL009126] [PN:UTP-glucose-1-phosphate uridylyltransferase]
[GN:gtaB] [FN:glucosylation of teichoic acid] [OR:Bacillus subtilis] [DB:genpept]
[EC:2.7.7.9] [DE:Bacillus subtilis complete genome (section 19 of 21): from 3597091to
3809700.] [SP:Q05852] [LE:67599] [RE:68477] [DI:direct]

| ORF Name | NTID | AAID | NT Length | AA Length | score | probability |
|---|---|---|---|---|---|---|
| AI7503000985_36134678_c3_2220 | 1187 | 4959 | 699 | 232 | 674 | 2.8e-66 |

Description pir:[LN:F69670] [AC:F69670 ] [PN:glycine betaine/carnitine/choline ABC transporter
(membrane p) opuCD] [GN:opuCD ] [CL:glycine betaine/carnitine/choline ABC transporter]
[OR:Bacillus subtilis] [DB:pir2] >gp:[GI:g2271392] [LN:AF009352] [AC:AF009352]
[PN:transmembrane protein] [GN:opuCD] [OR:Bacillus subtilis] [DB:genpept-bct1]
[DE:Bacillus subtilis osmoprotectant transport system OpuC includingATPase (opuCA),
transmembrane protein (opuCB), osmoprotectantbinding protein precursor (opuCC) and
transmembrane protein (opuCD)genes, complete cds.] [NT:OpuCD; part of the
osmoprotectant transport system] [LE:3627] [RE:4316] [DI:direct]
>gp:[GI:e1186068:g2635893] [LN:BSUB0018] [AC:Z99121:AL009126] [PN:glycine
betaine/carnitine/choline ABC] [GN:opuCD] [FN:high affinity transport of glycine
betaine,] [OR:Bacillus subtilis] [DB:genpept-bct1] [DE:Bacillus subtilis complete
genome (section 18 of 21): from 3399551to 3609060.] [NT:alternate gene name: yvbB]
[LE:67059] [RE:67748] [DI:complement]

| ORF Name | NTID | AAID | NT Length | AA Length | score | probability |
|---|---|---|---|---|---|---|
| AI7503000985_36142510_c1_1394 | 1188 | 4960 | 132 | 43 | | |

Description

NO-HIT

| ORF Name | NTID | AAID | NT Length | AA Length | score | probability |
|---|---|---|---|---|---|---|
| AI7503000985_36151692_c2_1840 | 1189 | 4961 | 681 | 226 | 671 | 5.8e-66 |

Description
sp:[LN:YFKO_BACSU] [AC:O34475] [GN:YFKO] [OR:BACILLUS SUBTILIS] [EC:1.-.-.-]
[DE:PUTATIVE NAD(P)H NITROREDUCTASE YFKO,] [SP:O34475] [DB:swissprot] >pir:[LN:B69809]
[AC:B69809 ] [PN:NAD(P)H-flavin oxidoreductase homolog yfkO] [GN:yfkO ]
[CL:nitroreductase] [OR:Bacillus subtilis] [DB:pir2] >gp:[GI:e1182773:g2633107]
[LN:BSUB0005] [AC:Z99108:AL009126] [GN:yfkO] [PN:unknown] [OR:Bacillus subtilis]
[DB:genpept-bct1] [DE:Bacillus subtilis complete genome (section 5 of 21): from 802821
to1011250.] [NT:similar to NAD(P)H-flavin oxidoreductase] [SP:O34475] [LE:51099]
[RE:51764] [DI:direct] >gp:[GI:d1024284:g2626827] [LN:D83967] [AC:D83967] [PN:YfkO]
[OR:Bacillus subtilis] [SR:Bacillus subtilis (strain:AC327) DNA] [DB:genpept-bct1]
[DE:Bacillus subtilis genomic DNA, 74 degree region.] [LE:16157] [RE:16822]
[DI:complement]

| ORF Name | NTID | AAID | NT Length | AA Length | score | probability |
|---|---|---|---|---|---|---|
| AI7503000985_36205285_c2_1717 | 1190 | 4962 | 780 | 259 | 284 | 6.0e-25 |

Description
sp:[LN:XYNC_CALSA] [AC:P23553] [GN:XYNC] [OR:CALDOCELLUM SACCHAROLYTICUM]
[SR:,CALDICELLULOSIRUPTOR SACCHAROLYTICUS] [EC:3.1.-.-] [DE:ACETYL ESTERASE,
(ACETYLXYLOSIDASE)] [SP:P23553] [DB:swissprot] >pir:[LN:B37202] [AC:B37202 ]
[PN:acetylesterase, (XynC)] [OR:Caldocellum saccharolyticum] [EC:3.1.1.6] [DB:pir2]
>gp:[GI:g144297] [LN:CDCXYNAB] [AC:M34459] [OR:Caldicellulosiruptor saccharolyticus]
[SR:C.saccharolyticum DNA, clone pNZ1400] [DB:genpept-bct1] [DE:C.saccharolyticum
xylanase A (XynA), beta-xylosidase (XynB) andacetyl esterase (XynC) genes, complete
cds.] [NT:acetyl esterase (XynC)] [LE:1257] [RE:2057] [DI:direct] >gp:[GI:g2645420]
[LN:AF005383] [AC:AF005383] [PN:acetylxylosidase] [GN:XynC] [OR:Caldicellulosiruptor
saccharolyticus] [DB:genpept-bct2] [DE:Caldicellulosiruptor saccharolyticus putative
transport protein(XynG), putative transport protein (XynH), xylanase (XynF),xylanase
(XynE), xylanase (XynD), xylanase (XynA), acetylxylosidase(XynC) and xylanase (XynB)
genes, complete cds.] [LE:13673] [RE:14473] [DI:direct]

| ORF Name | NTID | AAID | NT Length | AA Length | score | probability |
|---|---|---|---|---|---|---|
| AI7503000985_36214052_c3_1981 | 1191 | 4963 | 999 | 332 | 169 | 1.3e-10 |

Description
sp:[LN:Y31K_SULAC] [AC:P46218] [OR:SULFOLOBUS ACIDOCALDARIUS] [DE:HYPOTHETICAL 31.5 KD
PROTEIN] [SP:P46218] [DB:swissprot] >gp:[GI:g458265] [LN:SAU05664] [AC:U05664]
[OR:Sulfolobus acidocaldarius] [DB:genpept-bct1] [DE:Sulfolobus acidocaldarius RNA
polymerase subunit homolog gene,complete cds.] [NT:homologous to Swiss-Prot Accession
Number P20435:] [LE:61] [RE:888] [DI:direct]

| ORF Name | NTID | AAID | NT Length | AA Length | score | probability |
|---|---|---|---|---|---|---|
| AI7503000985_36225250_c2_1711 | 1192 | 4964 | 1542 | 513 | 2622 | 1.1e-272 |

Description
sp:[LN:SEPA_STAEP] [AC:P43148] [GN:SEPA] [OR:STAPHYLOCOCCUS EPIDERMIDIS] [EC:3.4.24.-]
[DE:EXTRACELLULAR ELASTASE PRECURSOR, (SEPP1)] [SP:P43148] [DB:swissprot]
>pir:[LN:A40659] [AC:A40659 ] [PN:elastase, SepP1] [OR:Staphylococcus epidermidis]
[EC:3.4.24.-] [DB:pir2] >gp:[GI:g396259] [LN:SESEPP1A] [AC:X69957] [PN:protease]
[GN:SepP1] [OR:Staphylococcus epidermidis] [DB:genpept-bct1] [DE:S.epidermis gene for
protease.] [SP:P43148] [LE:164] [RE:1687] [DI:direct]

| ORF Name | NTID | AAID | NT Length | AA Length | score | probability |
|---|---|---|---|---|---|---|
| AI7503000985_36228252_c3_1990 | 1193 | 4965 | 777 | 258 | 678 | 1.1e-66 |

Description
sp:[LN:HIS6_BACSU] [AC:O34727] [GN:HISF] [OR:BACILLUS SUBTILIS] [DE:HISF PROTEIN (CYCLASE)] [SP:O34727] [DB:swissprot] >pir:[LN:B69641] [AC:B69641 ] [PN:HisF cyclase-like protein hisF] [GN:hisF ] [CL:cyclase hisF] [OR:Bacillus subtilis] [DB:pir2] >gp:[GI:e1186175:g2636000] [LN:BSUB0018] [AC:Z99121:AL009126] [PN:HisF cyclase-like protein] [GN:hisF] [FN:synthesis of D-erythro-imidazole glycerol] [OR:Bacillus subtilis] [DB:genpept-bct1] [DE:Bacillus subtilis complete genome (section 18 of 21): from 3399551to 3609060.] [SP:O34727] [LE:183072] [RE:183830] [DI:complement] >gp:[GI:g2618870] [LN:AF017113] [AC:AF017113] [PN:cyclase] [GN:hisF] [OR:Bacillus subtilis] [DB:genpept-bct2] [DE:Bacillus subtilis 300-304 degree genomic sequence.] [NT:HisF protein] [LE:44003] [RE:44761] [DI:direct]

| ORF Name | NTID | AAID | NT Length | AA Length | score | probability |
|---|---|---|---|---|---|---|
| AI7503000985_36366326_c2_1646 | 1194 | 4966 | 771 | 256 | 409 | 3.4e-38 |

Description
pir:[LN:B69906] [AC:B69906 ] [PN:rarD protein homolog yojE] [GN:yojE ] [CL:Escherichia coli rarD protein] [OR:Bacillus subtilis] [DB:pir2] >gp:[GI:e1185420:g2634341] [LN:BSUB0011] [AC:Z99114:AL009126] [GN:yojE] [FN:unknown] [OR:Bacillus subtilis] [DB:genpept-bct1] [DE:Bacillus subtilis complete genome (section 11 of 21): from 2000171to 2207900.] [NT:similar to hypothetical proteins] [LE:122204] [RE:122995] [DI:complement] >gp:[GI:g3169320] [LN:AF026147] [AC:AF026147] [PN:YojD] [GN:yojD] [FN:unknown] [OR:Bacillus subtilis] [DB:genpept-bct2] [DE:Bacillus subtilis YojA (yojA), YojB (yojB), YojC (yojC), YojD(yojD), YojE (yojE), YojF (yojF), YojG (yojG), YojH (yojH), YojI(yojI), YojJ (yojJ), YojK (yojK), YojL (yojL), YojM (yojM), YojN(yojN), and YojO (yojO) genes, complete cds; and OdhA (odhA) gene,partial cds.] [NT:similar to Escherichia coli RarD protein:] [LE:2270] [RE:3061] [DI:direct]

| ORF Name | NTID | AAID | NT Length | AA Length | score | probability |
|---|---|---|---|---|---|---|
| AI7503000985_36617832_c1_1459 | 1195 | 4967 | 801 | 266 | 758 | 3.5e-75 |

Description
sp:[LN:SUMT_BACME] [AC:P29928] [GN:COBA] [OR:BACILLUS MEGATERIUM] [EC:2.1.1.107] [DE:METHYLASE) (SUMT) (UROPORPHYRINOGEN III METHYLASE) (UROM)] [SP:P29928] [DB:swissprot] >pir:[LN:A42479] [AC:A42479 ] [PN:S-adenosyl-L-methionine uroporphyrinogen III methyltransferase] [CL:S-adenosyl-L-methionine uroporphyrinogen methyltransferase] [OR:Bacillus megaterium] [DB:pir2] >gp:[GI:g142695] [LN:BACCOBA] [AC:M62881] [PN:S-adenosyl-L-methionine:uroporphyrinogen III] [GN:COBA] [OR:Bacillus megaterium] [SR:Bacillus megaterium DNA] [DB:genpept-bct1] [DE:Bacillus megaterium S-adenosy-L-methionine:uroporphyrinogen IIImethyltransferase (COBA) gene, complete cds.] [NT:ATCC #1078] [LE:119] [RE:835] [DI:direct]

| ORF Name | NTID | AAID | NT Length | AA Length | score | probability |
|---|---|---|---|---|---|---|
| AI7503000985_38876_f2_481 | 1196 | 4968 | 147 | 48 | | |

Description
NO-HIT

| ORF Name | NTID | AAID | NT Length | AA Length | score | probability |
|---|---|---|---|---|---|---|
| AI7503000985_3906718_f1_67 | 1197 | 4969 | 1065 | 354 | 747 | 5.2e-74 |

Description pir:[LN:H69789] [AC:H69789 ] [PN:L-iditol 2-dehydrogenase, homolog ydjL:sorbitol dehydrogenase homolog] [GN:ydjL ] [CL:alcohol dehydrogenase:long-chain alcohol dehydrogenase homology] [OR:Bacillus subtilis] [EC:1.1.1.14] [DB:pir1]
>gp:[GI:d1023636:g2522016] [LN:AB007638] [AC:AB007638] [PN:dehydrogenase] [GN:ydjL] [OR:Bacillus subtilis] [SR:Bacillus subtilis (strain:Marburg 168) DNA] [DB:genpept-bct1] [DE:Bacillus subtilis genomic DNA containing gutA to cotA region, 48degree.] [NT:putative] [LE:9403] [RE:10443] [DI:complement]
>gp:[GI:e1182603:g2632937] [LN:BSUB0004] [AC:Z99107:AL009126] [GN:ydjL] [FN:unknown] [OR:Bacillus subtilis] [DB:genpept-bct1] [DE:Bacillus subtilis complete genome (section 4 of 21): from 600701 to813890.] [NT:similar to L-iditol 2-dehydrogenase] [LE:76928] [RE:77968] [DI:complement]

| ORF Name | NTID | AAID | NT Length | AA Length | score | probability |
|---|---|---|---|---|---|---|
| AI7503000985_3909376_c2_1681 | 1198 | 4970 | 396 | 131 | 244 | 1.0e-20 |

Description pir:[LN:H64716] [AC:H64716 ] [PN:ABC transporter, ATP-binding protein] [CL:ATP-binding cassette homology] [OR:Helicobacter pylori] [DB:pir2] >gp:[GI:g2314761] [LN:AE000655] [AC:AE000655:AE000511] [PN:ABC transporter, ATP-binding protein (abc)] [GN:HP1576] [OR:Helicobacter pylori 26695] [DB:genpept-bct2] [DE:Helicobacter pylori 26695 section 133 of 134 of the completegenome.] [NT:similar to GB:L42023 SP:P44785 PID:1005459] [LE:1828] [RE:2811] [DI:direct]

| ORF Name | NTID | AAID | NT Length | AA Length | score | probability |
|---|---|---|---|---|---|---|
| AI7503000985_3910675_f3_1222 | 1199 | 4971 | 234 | 77 | 57 | 0.0048 |

Description gp:[GI:g3293452] [LN:AF069160] [AC:AF069160] [PN:NADH dehydrogenase 1] [FN:respiratory enzyme] [OR:Mitochondrion Aphidius ervi] [SR:Aphidius ervi] [DB:genpept-inv1] [DE:Aphidius ervi NADH dehydrogenase 1 gene, mitochondrial geneencoding mitochondrial protein, partial cds.] [LE:<1] [RE:>465] [DI:direct] >gp:[GI:g3293458] [LN:AF069163] [AC:AF069163] [PN:NADH dehydrogenase 1] [FN:respiratory enzyme] [OR:Mitochondrion Aphidius picipes] [SR:Aphidius picipes] [DB:genpept-inv1] [DE:Aphidius picipes NADH dehydrogenase 1 gene, mitochondrial geneencoding mitochondrial protein, partial cds.] [LE:<1] [RE:>465] [DI:direct] >gp:[GI:g3293460] [LN:AF069164] [AC:AF069164] [PN:NADH dehydrogenase 1] [FN:respiratory enzyme] [OR:Mitochondrion Aphidius pisivorus] [SR:Aphidius pisivorus] [DB:genpept-inv1] [DE:Aphidius pisivorus NADH dehydrogenase 1 gene, mitochondrial geneencoding mitochondrial protein, partial cds.] [LE:<1] [RE:>465] [DI:direct] >gp:[GI:g3293464] [LN:AF069166] [AC:AF069166] [PN:NADH dehydrogenase 1] [FN:respiratory enzyme] [OR:Mitochondrion Aphidius sonchi] [SR:Aphidius sonchi] [DB:genpept-inv1] [DE:Aphidius sonchi NADH dehydrogenase 1 gene, mitochondrial geneencoding mitochondrial protein, partial cds.] [LE:<1] [RE:>465] [DI:direct]

| ORF Name | NTID | AAID | NT Length | AA Length | score | probability |
|---|---|---|---|---|---|---|
| AI7503000985_3923842_c2_1832 | 1200 | 4972 | 891 | 296 | 876 | 1.1e-87 |

Description gp:[GI:g4959402] [LN:AF115391] [AC:AF115391] [PN:putative ribose transporter RbsU] [GN:rbsU] [OR:Lactobacillus sakei] [DB:genpept-bct2] [DE:Lactobacillus sakei LaaA (laaA) gene, partial cds; LaaB (laaB),putative acetate kinase AckA (ackA), LaaC (laaC) genes, completecds; rbs operon, complete sequence; and LaaE (laaE) gene, partialcds.] [LE:3130] [RE:4014] [DI:direct]

| ORF Name | NTID | AAID | NT Length | AA Length | score | probability |
|---|---|---|---|---|---|---|
| AI7503000985_3928162_f2_665 | 1201 | 4973 | 141 | 46 | | |

Description
NO-HIT

| ORF Name | NTID | AAID | NT Length | AA Length | score | probability |
|---|---|---|---|---|---|---|
| AI7503000985_3928416_f1_170 | 1202 | 4974 | 123 | 40 | | |

Description
NO-HIT

| ORF Name | NTID | AAID | NT Length | AA Length | score | probability |
|---|---|---|---|---|---|---|
| AI7503000985_3933177_f2_683 | 1203 | 4975 | 126 | 41 | | |

Description
NO-HIT

| ORF Name | NTID | AAID | NT Length | AA Length | score | probability |
|---|---|---|---|---|---|---|
| AI7503000985_3941078_f1_114 | 1204 | 4976 | 324 | 107 | 110 | 1.6e-06 |

Description
pir:[LN:C69845] [AC:C69845 ] [PN:hypothetical protein yjbS] [GN:yjbS ] [OR:Bacillus subtilis] [DB:pir2] >gp:[GI:e1183188:g2633522] [LN:BSUB0007] [AC:Z99110:AL009126] [GN:yjbS] [FN:unknown] [OR:Bacillus subtilis] [DB:genpept-bct1] [DE:Bacillus subtilis complete genome (section 7 of 21): from 1194391to 1411140.] [LE:49925] [RE:50125] [DI:direct]

| ORF Name | NTID | AAID | NT Length | AA Length | score | probability |
|---|---|---|---|---|---|---|
| AI7503000985_3941436_f1_6 | 1205 | 4977 | 150 | 49 | | |

Description
NO-HIT

| ORF Name | NTID | AAID | NT Length | AA Length | score | probability |
|---|---|---|---|---|---|---|
| AI7503000985_3953400_f1_314 | 1206 | 4978 | 195 | 64 | 49 | 0.017 |

Description
sp:[LN:RFA1_KLEPN] [AC:Q48475] [GN:RFBA] [OR:KLEBSIELLA PNEUMONIAE] [DE:O-ANTIGEN EXPORT SYSTEM PERMEASE PROTEIN RFBA] [SP:Q48475] [DB:swissprot] >pir:[LN:S60882] [AC:S60882 ] [PN:integral membrane O-antigen translocator protein rfbA] [GN:rfbA ] [CL:integral membrane O-antigen translocator protein rfbA] [OR:Klebsiella pneumoniae] [DB:pir2] >gp:[GI:g567182] [LN:KPNRFBA] [AC:L31775] [PN:integral membrane O-antigen translocator] [GN:wzm] [OR:Klebsiella pneumoniae] [DB:genpept-bct2] [DE:Klebsiella pneumoniae integral membrane O-antigen translocatorprotein (wzm) and ATP-binding protein (wzt) genes, complete cds;and WbbM (wbbM) gene, partial cds.] [NT:similar to kpsM (E. coli), bexA (H. influenzae),] [LE:324] [RE:1103] [DI:direct]

| ORF Name | NTID | AAID | NT Length | AA Length | score | probability |
|---|---|---|---|---|---|---|
| AI7503000985_4004643_f3_1285 | 1207 | 4979 | 201 | 66 | | |

Description
NO-HIT

| ORF Name | NTID | AAID | NT Length | AA Length | score | probability |
|---|---|---|---|---|---|---|
| AI7503000985_4069643_c3_2243 | 1208 | 4980 | 480 | 159 | 160 | 8.2e-12 |

Description
gp:[GI:e1310302:g3294247] [LN:SC7C7] [AC:AL031031] [PN:hypothetical protein SC7C7.14] [GN:SC7C7.14] [OR:Streptomyces coelicolor] [DB:genpept-bct1] [DE:Streptomyces coelicolor cosmid 7C7.] [NT:SC7C7.14, unknown, len: 161 aa] [LE:24125] [RE:24610] [DI:direct]

| ORF Name | NTID | AAID | NT Length | AA Length | score | probability |
|---|---|---|---|---|---|---|
| AI7503000985_4079552_f2_696 | 1209 | 4981 | 630 | 209 | 87 | 0.0012 |

Description
gp:[GI:g252560] [LN:S44068S2] [AC:S44069] [GN:VP4/VP2] [OR:Hepatitis A virus] [SR:Hepatitis A virus LSH/S] [DB:genpept-vrl] [DE:VP1...3C/3D [hepatitis A virus HAV, LSH/S, Genomic, 6 genes, 266nt, segment 2 of 7].] [NT:This sequence comes from Fig. 3.] [LE:1] [RE:266] [DI:direct]

| ORF Name | NTID | AAID | NT Length | AA Length | score | probability |
|---|---|---|---|---|---|---|
| AI7503000985_4079626_f1_336 | 1210 | 4982 | 192 | 63 | 70 | 0.018 |

Description
sp:[LN:UTMP_BOVIN] [AC:P46201] [OR:BOS TAURUS] [SR:,BOVINE] [DE:UTERINE MILK PROTEIN PRECURSOR (UTMP)] [SP:P46201] [DB:swissprot] >gp:[GI:g438481] [LN:BOVSPIS] [AC:L22095] [PN:serine proteinase inhibitor precursor] [OR:Bos taurus] [DB:genpept-mam] [DE:Bos taurus uterine milk protein precursor, mRNA, complete cds.] [NT:uterine milk protein] [LE:19] [RE:1398] [DI:direct]

| ORF Name | NTID | AAID | NT Length | AA Length | score | probability |
|---|---|---|---|---|---|---|
| AI7503000985_4084635_f2_483 | 1211 | 4983 | 141 | 46 | | |

Description
NO-HIT

| ORF Name | NTID | AAID | NT Length | AA Length | score | probability |
|---|---|---|---|---|---|---|
| AI7503000985_4084717_f3_961 | 1212 | 4984 | 621 | 206 | 110 | 0.00027 |

Description
pir:[LN:B70045] [AC:B70045 ] [PN:hypothetical protein yvpB] [GN:yvpB ] [OR:Bacillus subtilis] [DB:pir2] >gp:[GI:e1186182:g2636007] [LN:BSUB0018] [AC:Z99121:AL009126] [GN:yvpB] [FN:unknown] [OR:Bacillus subtilis] [DB:genpept-bct1] [DE:Bacillus subtilis complete genome (section 18 of 21): from 3399551to 3609060.] [LE:189121] [RE:189873] [DI:direct] >gp:[GI:g2618863] [LN:AF017113] [AC:AF017113] [PN:YvpB] [GN:yvpB] [OR:Bacillus subtilis] [DB:genpept-bct2] [DE:Bacillus subtilis 300-304 degree genomic sequence.] [LE:37960] [RE:38712] [DI:complement]

| ORF Name | NTID | AAID | NT Length | AA Length | score | probability |
|---|---|---|---|---|---|---|
| AI7503000985_4093932_f1_69 | 1213 | 4985 | 135 | 44 | | |

Description
NO-HIT

| ORF Name | NTID | AAID | NT Length | AA Length | score | probability |
|---|---|---|---|---|---|---|
| AI7503000985_4094703_c1_1446 | 1214 | 4986 | 2022 | 673 | 224 | 3.7e-21 |

Description
pir:[LN:B70001] [AC:B70001 ] [PN:ABC transporter (permease) homolog ytsD] [GN:ytsD ]
[OR:Bacillus subtilis] [DB:pir2] >gp:[GI:e1185910:g2635521] [LN:BSUB0016]
[AC:Z99119:AL009126] [GN:ytsD] [FN:unknown] [OR:Bacillus subtilis] [DB:genpept-bct1]
[DE:Bacillus subtilis complete genome (section 16 of 21): from 2997771to 3213410.]
[NT:similar to ABC transporter (permease)] [LE:110708] [RE:112648] [DI:complement]
>gp:[GI:g2293178] [LN:AF008220] [AC:AF008220] [PN:YtsD] [GN:ytsD] [OR:Bacillus
subtilis] [DB:genpept-bct2] [DE:Bacillus subtilis rrnB-dnaB genomic region.]
[NT:similarity to NADH dehydrogenase] [LE:67779] [RE:69719] [DI:direct]

| ORF Name | NTID | AAID | NT Length | AA Length | score | probability |
|---|---|---|---|---|---|---|
| AI7503000985_40966_c3_2016 | 1215 | 4987 | 1626 | 541 | | |

Description
NO-HIT

| ORF Name | NTID | AAID | NT Length | AA Length | score | probability |
|---|---|---|---|---|---|---|
| AI7503000985_4098518_f1_48 | 1216 | 4988 | 711 | 236 | 121 | 5.8e-08 |

Description
sp:[LN:ARP_PLAFA] [AC:P04931] [OR:PLASMODIUM FALCIPARUM] [DE:ASPARAGINE-RICH PROTEIN
(AG319) (ARP) (FRAGMENT)] [SP:P04931] [DB:swissprot] >pir:[LN:A23770] [AC:A23770 ]
[PN:asparagine-rich protein] [OR:Plasmodium falciparum] [DB:pir2] >gp:[GI:g160092]
[LN:PFAARP] [AC:M24328:X03716] [PN:asparagine-rich protein] [GN:Ag319] [OR:Plasmodium
falciparum] [SR:Plasmodium falciparum (Ghanaian isolate NF7) asexual bloodstage]
[DB:genpept-inv1] [DE:Plasmodium falciparum asparagine-rich protein (ARP), partial
cds.] [LE:1] [RE:1612] [DI:direct]

| ORF Name | NTID | AAID | NT Length | AA Length | score | probability |
|---|---|---|---|---|---|---|
| AI7503000985_4100453_c3_2260 | 1217 | 4989 | 1044 | 347 | 329 | 1.0e-29 |

Description
sp:[LN:DEGS_BACBR] [AC:P54663] [GN:DEGS] [OR:BACILLUS BREVIS] [EC:2.7.3.-] [DE:SENSOR
PROTEIN DEGS,] [SP:P54663] [DB:swissprot] >pir:[LN:I39834] [AC:I39834 ] [PN:protein
kinase] [GN:degS ] [CL:regulatory protein degS] [OR:Bacillus brevis] [DB:pir2]
>gp:[GI:g710495] [LN:BACDEGSU] [AC:L15444] [PN:protein kinase] [GN:degS]
[OR:Brevibacillus brevis] [SR:Bacillus brevis (strain Alk36) DNA] [DB:genpept-bct2]
[DE:Bacillus brevis protein kinase (degS) gene, complete cds;transcriptional activator
protein (degU) gene, complete cds.] [NT:putative] [LE:398] [RE:1558] [DI:direct]

| ORF Name | NTID | AAID | NT Length | AA Length | score | probability |
|---|---|---|---|---|---|---|
| AI7503000985_4100938_c2_1860 | 1218 | 4990 | 534 | 177 | 293 | 1.1e-25 |

Description
sp:[LN:GUDT_BACSU] [AC:P42237] [GN:YCBE] [OR:BACILLUS SUBTILIS] [DE:PROBABLE GLUCARATE
TRANSPORTER] [SP:P42237] [DB:swissprot] >pir:[LN:H69752] [AC:H69752 ] [PN:proballble
glucarate transporter] [GN:ycbE ] [CL:hexuronate transporter] [OR:Bacillus subtilis]
[DB:pir2] >gp:[GI:d1007040:g709999] [LN:BACYCB20] [AC:D30808] [PN:glucarate
dehydratase] [GN:ycbE] [OR:Bacillus subtilis] [SR:Bacillus subtilis (strain:168TrpC2)
DNA] [DB:genpept-bct1] [DE:Bacillus subtilis DNA around 20 degrees region of
chromosomecontaining yckA-T genes.] [LE:3924] [RE:5291] [DI:direct]
>gp:[GI:e1182200:g2632534] [LN:BSUB0002] [AC:Z99105:AL009126] [GN:ycbE] [FN:unknown]
[OR:Bacillus subtilis] [DB:genpept-bct1] [DE:Bacillus subtilis complete genome (section
2 of 21): from 194651 to415810.] [NT:similar to glucarate transporter] [SP:P42237]
[LE:75738] [RE:77105] [DI:direct]

| ORF_Name | NTID | AAID | NT Length | AA Length | score | probability |
|---|---|---|---|---|---|---|
| AI7503000985_4110712_c1_1353 | 1219 | 4991 | 591 | 196 | | |

Description
NO-HIT

| ORF_Name | NTID | AAID | NT Length | AA Length | score | probability |
|---|---|---|---|---|---|---|
| AI7503000985_4112527_f2_563 | 1220 | 4992 | 144 | 47 | | |

Description
NO-HIT

| ORF_Name | NTID | AAID | NT Length | AA Length | score | probability |
|---|---|---|---|---|---|---|
| AI7503000985_4112788_c1_1497 | 1221 | 4993 | 141 | 46 | | |

Description
NO-HIT

| ORF_Name | NTID | AAID | NT Length | AA Length | score | probability |
|---|---|---|---|---|---|---|
| AI7503000985_4148428_f1_160 | 1222 | 4994 | 1149 | 382 | 528 | 8.3e-51 |

Description
sp:[LN:ADH_ALCEU] [AC:P14940] [GN:ADH] [OR:ALCALIGENES EUTROPHUS] [EC:1.1.1.1]
[DE:ALCOHOL DEHYDROGENASE,] [SP:P14940] [DB:swissprot] >pir:[LN:A30196] [AC:A30196 ]
[PN:probable alcohol dehydrogenase,] [CL:alcohol dehydrogenase:long-chain alcohol
dehydrogenase homology] [OR:Alcaligenes eutrophus] [EC:1.1.1.1] [DB:pir1]
>gp:[GI:g141900] [LN:AFAADH] [AC:J03362] [OR:Ralstonia eutropha] [SR:A.eutrophus
(strain H16) DNA, clone SR18] [DB:genpept-bct1] [DE:A.eutrophus alcohol dehydrogenase
(ADH) gene, complete cds.] [NT:alcohol dehydrogenase (EC 1.1.1.1)] [LE:458] [RE:1558]
[DI:direct]

| ORF_Name | NTID | AAID | NT Length | AA Length | score | probability |
|---|---|---|---|---|---|---|
| AI7503000985_4164026_f2_793 | 1223 | 4995 | 162 | 53 | 118 | 9.1e-09 |

Description
pir:[LN:S68609] [AC:S68609 ] [PN:recombinase Sin] [CL:transposase repressor]
[OR:Staphylococcus aureus] [DB:pir2] >gp:[GI:g495089] [LN:STASINA] [AC:L23109]
[PN:recombinase] [GN:sin] [OR:Staphylococcus aureus] [SR:Staphylococcus aureus DNA;
Transposon Tn4002 (transposable elemen] [DB:genpept-bct1] [DE:Staphylococcus aureus
recombinase (sin) gene, complete cds.] [NT:putative] [LE:389] [RE:997] [DI:direct]

| ORF_Name | NTID | AAID | NT Length | AA Length | score | probability |
|---|---|---|---|---|---|---|
| AI7503000985_4167842_f2_530 | 1224 | 4996 | 201 | 66 | | |

Description
NO-HIT

| ORF_Name | NTID | AAID | NT Length | AA Length | score | probability |
|---|---|---|---|---|---|---|
| AI7503000985_4179635_c3_2003 | 1225 | 4997 | 126 | 41 | | |

Description
NO-HIT

| ORF Name | NTID | AAID | NT Length | AA Length | score | probability |
|---|---|---|---|---|---|---|
| AI7503000985_4303377_f2_610 | 1226 | 4998 | 270 | 89 | 81 | 0.0019 |

Description
gp:[GI:g4049784] [LN:AF063866] [AC:AF063866] [PN:ORF MSV234 hypthetical protein] [GN:MSV234] [OR:Melanoplus sanguinipes entomopoxvirus] [DB:genpept-vrl] [DE:Melanoplus sanguinipes entomopoxvirus, complete genome.] [LE:201477] [RE:201830] [DI:complement]

| ORF Name | NTID | AAID | NT Length | AA Length | score | probability |
|---|---|---|---|---|---|---|
| AI7503000985_4329453_c1_1533 | 1227 | 4999 | 336 | 111 | 220 | 3.6e-18 |

Description
pir:[LN:G69781] [AC:G69781 ] [PN:thioredoxin homolog ydfQ] [GN:ydfQ ] [OR:Bacillus subtilis] [DB:pir2] >gp:[GI:d1020138:g1881358] [LN:AB001488] [AC:AB001488] [GN:ydfQ] [OR:Bacillus subtilis] [SR:Bacillus subtilis (strain:168) DNA] [DB:genpept-bct1] [DE:Bacillus subtilis genome sequence, 148 kb sequence of the regionbetween 35 and 47 degree.] [NT:SIMILAR TO THIOREDOXIN.] [LE:131947] [RE:132285] [DI:direct] >gp:[GI:e1182517:g2632851] [LN:BSUB0003] [AC:Z99106:AL009126] [GN:ydfQ] [FN:unknown] [OR:Bacillus subtilis] [DB:genpept-bct1] [DE:Bacillus subtilis complete genome (section 3 of 21): from 402751 to611850.] [NT:similar to thioredoxin] [LE:195693] [RE:196031] [DI:direct]

| ORF Name | NTID | AAID | NT Length | AA Length | score | probability |
|---|---|---|---|---|---|---|
| AI7503000985_4334818_f2_854 | 1228 | 5000 | 1566 | 521 | 111 | 0.018 |

Description
pir:[LN:D71618] [AC:D71618 ] [PN:hypothetical protein PFB0285c] [GN:PFB0285c ] [OR:Plasmodium falciparum] [DB:pir2] >gp:[GI:g3845144] [LN:AE001385] [AC:AE001385:AE001362] [PN:hypothetical protein] [GN:PFB0285c] [OR:Plasmodium falciparum] [SR:malaria parasite P. falciparum] [DB:genpept-inv2] [DE:Plasmodium falciparum chromosome 2, section 22 of 73 of thecomplete sequence.] [NT:predicted by GlimmerM] [LE:303] [RE:4613] [DI:complement]

| ORF Name | NTID | AAID | NT Length | AA Length | score | probability |
|---|---|---|---|---|---|---|
| AI7503000985_4336088_c3_2078 | 1229 | 5001 | 624 | 207 | 283 | 7.6e-25 |

Description
pir:[LN:F69877] [AC:F69877 ] [PN:uroporphyrin-III C-methyltransferase homolog ylnF] [GN:ylnF ] [CL:Aquifex aeolicus siroheme synthase] [OR:Bacillus subtilis] [DB:pir2] >gp:[GI:e332189:g2462962] [LN:BSPYREYLO] [AC:AJ000974] [PN:YlnF protein] [GN:ylnF] [OR:Bacillus subtilis] [DB:genpept-bct1] [DE:Bacillus subtilis pyrE to yloA gene region.] [LE:5769] [RE:6257] [DI:direct] >gp:[GI:e1185155:g2633936] [LN:BSUB0009] [AC:Z99112:AL009126] [GN:ylnF] [FN:unknown] [OR:Bacillus subtilis] [DB:genpept-bct1] [DE:Bacillus subtilis complete genome (section 9 of 21): from 1598421to 1807200.] [NT:similar to uroporphyrin-III C-methyltransferase] [LE:36582] [RE:37070] [DI:direct]

| ORF Name | NTID | AAID | NT Length | AA Length | score | probability |
|---|---|---|---|---|---|---|
| AI7503000985_4379763_f3_1048 | 1230 | 5002 | 123 | 40 | | |

Description
NO-HIT

| ORF Name | NTID | AAID | NT Length | AA Length | score | probability |
|---|---|---|---|---|---|---|
| AI7503000985_4392767_c1_1619 | 1231 | 5003 | 435 | 144 | 196 | 8.0e-15 |

Description
gp:[GI:e1314293:g3395543] [LN:SC4A2] [AC:AL031182] [PN:putative sugar transferase]
[GN:SC4A2.10c] [OR:Streptomyces coelicolor] [DB:genpept-bct1] [DE:Streptomyces
coelicolor cosmid 4A2.] [NT:SC4A2.10c, probable sugar transferase, len: 478;] [LE:9579]
[RE:11015] [DI:complement]

| ORF Name | NTID | AAID | NT Length | AA Length | score | probability |
|---|---|---|---|---|---|---|
| AI7503000985_4459375_f2_830 | 1232 | 5004 | 207 | 68 | | |

Description
NO-HIT

| ORF Name | NTID | AAID | NT Length | AA Length | score | probability |
|---|---|---|---|---|---|---|
| AI7503000985_4487550_f3_980 | 1233 | 5005 | 1707 | 568 | 1408 | 4.7e-144 |

Description
pir:[LN:D69748] [AC:D69748:I40419 ] [PN:amino acid transporter homolog ybeC] [GN:ybeC ]
[OR:Bacillus subtilis] [DB:pir2] >gp:[GI:d1034075:g3599634] [LN:AB006424] [AC:AB006424]
[GN:ybeC] [OR:Bacillus subtilis] [SR:Bacillus subtilis (strain:168) DNA]
[DB:genpept-bct1] [DE:Bacillus subtilis genomic DNA, 70 kb region between 17 and
23degree.] [LE:34338] [RE:35957] [DI:direct] >gp:[GI:e1182164:g2632498] [LN:BSUB0002]
[AC:Z99105:AL009126] [GN:ybeC] [FN:unknown] [OR:Bacillus subtilis] [DB:genpept-bct1]
[DE:Bacillus subtilis complete genome (section 2 of 21): from 194651 to415810.]
[NT:similar to amino acid transporter] [LE:36687] [RE:38306] [DI:direct]

| ORF Name | NTID | AAID | NT Length | AA Length | score | probability |
|---|---|---|---|---|---|---|
| AI7503000985_4491713_f2_533 | 1234 | 5006 | 1542 | 513 | 416 | 6.1e-39 |

Description
pir:[LN:F64554] [AC:F64554 ] [PN:guanosine pentaphosphate phosphohydrolase]
[OR:Helicobacter pylori] [DB:pir2] >gp:[GI:g2313368] [LN:AE000546]
[AC:AE000546:AE000511] [PN:guanosine pentaphosphate phosphohydrolase] [GN:HP0278]
[OR:Helicobacter pylori 26695] [DB:genpept-bct2] [DE:Helicobacter pylori 26695 section
24 of 134 of the complete genome.] [NT:similar to GB:M87049 SP:P25552 GB:M83316
PID:148183] [LE:6964] [RE:8418] [DI:direct]

| ORF Name | NTID | AAID | NT Length | AA Length | score | probability |
|---|---|---|---|---|---|---|
| AI7503000985_4553166_f3_1122 | 1235 | 5007 | 174 | 57 | | |

Description
NO-HIT

| ORF Name | NTID | AAID | NT Length | AA Length | score | probability |
|---|---|---|---|---|---|---|
| AI7503000985_4574012_f1_208 | 1236 | 5008 | 1080 | 359 | 600 | 2.0e-58 |

Description
pir:[LN:JN0500] [AC:JN0500:S34967 ] [PN:dihydroorotate oxidase,,
mitochondrial:dihydroorotate dehydrogenase] [GN:dhod ] [CL:dihydroorotate oxidase]
[OR:Drosophila melanogaster] [EC:1.3.3.1] [DB:pir2]

| ORF_Name | NTID | AAID | NT Length | AA Length | score | probability |
|---|---|---|---|---|---|---|
| AI7503000985_4662_f2_689 | 1237 | 5009 | 318 | 105 | 84 | 0.0046 |

Description
gp:[GI:g4049856] [LN:AF063866] [AC:AF063866] [PN:ORF MSV064 hypothetical protein] [GN:MSV064] [OR:Melanoplus sanguinipes entomopoxvirus] [DB:genpept-vrl] [DE:Melanoplus sanguinipes entomopoxvirus, complete genome.] [LE:64316] [RE:65158] [DI:complement]

| ORF_Name | NTID | AAID | NT Length | AA Length | score | probability |
|---|---|---|---|---|---|---|
| AI7503000985_4687705_c2_1841 | 1238 | 5010 | 141 | 46 | | |

Description
NO-HIT

| ORF_Name | NTID | AAID | NT Length | AA Length | score | probability |
|---|---|---|---|---|---|---|
| AI7503000985_4687752_c1_1514 | 1239 | 5011 | 1185 | 394 | 773 | 9.1e-77 |

Description
pir:[LN:F69863] [AC:F69863 ] [PN:aspartate aminotransferase homolog ykrV] [GN:ykrV ] [CL:aspartate transaminase] [OR:Bacillus subtilis] [DB:pir2] >gp:[GI:e1184948:g2633729] [LN:BSUB0008] [AC:Z99111:AL009126] [GN:ykrV] [FN:unknown] [OR:Bacillus subtilis] [DB:genpept-bct1] [DE:Bacillus subtilis complete genome (section 8 of 21): from 1394791to 1603020.] [NT:similar to aspartate aminotransferase] [LE:30317] [RE:31513] [DI:direct]

| ORF_Name | NTID | AAID | NT Length | AA Length | score | probability |
|---|---|---|---|---|---|---|
| AI7503000985_4689390_c3_2124 | 1240 | 5012 | 147 | 48 | | |

Description
NO-HIT

| ORF_Name | NTID | AAID | NT Length | AA Length | score | probability |
|---|---|---|---|---|---|---|
| AI7503000985_4694163_c2_1791 | 1241 | 5013 | 144 | 47 | | |

Description
NO-HIT

| ORF_Name | NTID | AAID | NT Length | AA Length | score | probability |
|---|---|---|---|---|---|---|
| AI7503000985_4694652_c3_2199 | 1242 | 5014 | 135 | 44 | | |

Description
NO-HIT

| ORF_Name | NTID | AAID | NT Length | AA Length | score | probability |
|---|---|---|---|---|---|---|
| AI7503000985_4695451_f2_864 | 1243 | 5015 | 135 | 44 | | |

Description
NO-HIT

| ORF_Name | NTID | AAID | NT Length | AA Length | score | probability |
|---|---|---|---|---|---|---|
| AI7503000985_4698428_c2_1705 | 1244 | 5016 | 180 | 59 | | |

Description
NO-HIT

| ORF_Name | NTID | AAID | NT Length | AA Length | score | probability |
|---|---|---|---|---|---|---|
| AI7503000985_4705077_f2_880 | 1245 | 5017 | 123 | 40 | | |

Description
NO-HIT

| ORF_Name | NTID | AAID | NT Length | AA Length | score | probability |
|---|---|---|---|---|---|---|
| AI7503000985_4713377_f2_618 | 1246 | 5018 | 447 | 148 | 108 | 3.4e-05 |

Description
gp:[GI:e1407826:g4493896] [LN:PFMAL3P2] [AC:AL034558] [GN:MAL3P2.18] [OR:Plasmodium falciparum] [SR:malaria parasite P. falciparum] [DB:genpept-inv1] [DE:Plasmodium falciparum MAL3P2, complete sequence.] [NT:predicted using hexExon; MAL3P2.18 (PFC0245c),] [LE:84094] [RE:95895] [DI:complement]

| ORF_Name | NTID | AAID | NT Length | AA Length | score | probability |
|---|---|---|---|---|---|---|
| AI7503000985_4719775_c3_2182 | 1247 | 5019 | 744 | 247 | 434 | 7.6e-41 |

Description
sp:[LN:YWAC_BACSU] [AC:P39583] [GN:YWAC:IPA-7D] [OR:BACILLUS SUBTILIS] [DE:HYPOTHETICAL 24.6 KD PROTEIN IN DAE-TYRZ INTERGENIC REGION] [SP:P39583] [DB:swissprot] >pir:[LN:S39662] [AC:S39662:C70050 ] [PN:GTP-pyrophosphokinase homolog ywaC:protein ipa-7d] [GN:ywaC ] [CL:GTP pyrophosphokinase related protein] [OR:Bacillus subtilis] [DB:pir2] >gp:[GI:g413931] [LN:BSGENR] [AC:X73124] [GN:ipa-7d] [OR:Bacillus subtilis] [DB:genpept-bct1] [DE:B.subtilis genomic region (325 to 333).] [SP:P39583] [LE:6981] [RE:7613] [DI:direct] >gp:[GI:e1186347:g2636383] [LN:BSUB0020] [AC:Z99123:AL009126] [GN:ywaC] [FN:unknown] [OR:Bacillus subtilis] [DB:genpept-bct1] [DE:Bacillus subtilis complete genome (section 20 of 21): from 3798401to 4010550.] [NT:alternate gene name: ipa-7d; similar to] [SP:P39583] [LE:150346] [RE:150978] [DI:complement]

| ORF_Name | NTID | AAID | NT Length | AA Length | score | probability |
|---|---|---|---|---|---|---|
| AI7503000985_4719827_c3_1986 | 1248 | 5020 | 417 | 138 | | |

Description
NO-HIT

| ORF_Name | NTID | AAID | NT Length | AA Length | score | probability |
|---|---|---|---|---|---|---|
| AI7503000985_4720317_f2_475 | 1249 | 5021 | 1257 | 418 | 1659 | 1.2e-170 |

Description
gp:[GI:g4574233] [LN:AF106849] [AC:AF106849] [PN:FmhA] [GN:fmhA] [OR:Staphylococcus aureus] [DB:genpept-bct2] [DE:Staphylococcus aureus FmhA (fmhA) gene, complete cds.] [NT:similar to Staphylococcus aureus FemA and FemB] [LE:201] [RE:1451] [DI:direct]

| ORF_Name | NTID | AAID | NT Length | AA Length | score | probability |
|---|---|---|---|---|---|---|
| AI7503000985_4723510_c2_1759 | 1250 | 5022 | 2661 | 886 | 2374 | 2.0e-246 |

Description
sp:[LN:PODK_CLOSY] [AC:P22983] [GN:PPDK] [OR:CLOSTRIDIUM SYMBIOSUM] [SR:,BACTEROIDES SYMBIOSUS] [EC:2.7.9.1] [DE:DIKINASE)] [SP:P22983] [DB:swissprot]

| ORF Name | NTID | AAID | NT Length | AA Length | score | probability |
|---|---|---|---|---|---|---|
| AI7503000985_4725068_c3_2219 | 1251 | 5023 | 645 | 214 | 605 | 5.8e-59 |

Description pir:[LN:D69670] [AC:D69670 ] [PN:glycine betaine/carnitine/choline ABC transporter (membrane p) opuCB] [GN:opuCB ] [CL:glycine betaine/carnitine/choline ABC transporter] [OR:Bacillus subtilis] [DB:pir2] >gp:[GI:g2271390] [LN:AF009352] [AC:AF009352] [PN:transmembrane protein] [GN:opuCB] [OR:Bacillus subtilis] [DB:genpept-bct1] [DE:Bacillus subtilis osmoprotectant transport system OpuC includingATPase (opuCA), transmembrane protein (opuCB), osmoprotectantbinding protein precursor (opuCC) and transmembrane protein (opuCD)genes, complete cds.] [NT:OpuCB; part of the osmoprotectant transport system] [LE:2025] [RE:2678] [DI:direct] >gp:[GI:e1186070:g2635895] [LN:BSUB0018] [AC:Z99121:AL009126] [PN:glycine betaine/carnitine/choline ABC] [GN:opuCB] [FN:high affinity transport of glycine betaine,] [OR:Bacillus subtilis] [DB:genpept-bct1] [DE:Bacillus subtilis complete genome (section 18 of 21): from 3399551to 3609060.] [NT:alternate gene name: yvbD] [LE:68697] [RE:69350] [DI:complement]

| ORF Name | NTID | AAID | NT Length | AA Length | score | probability |
|---|---|---|---|---|---|---|
| AI7503000985_4726636_c1_1543 | 1252 | 5024 | 138 | 45 | | |

Description
NO-HIT

| ORF Name | NTID | AAID | NT Length | AA Length | score | probability |
|---|---|---|---|---|---|---|
| AI7503000985_4727187_c2_1702 | 1253 | 5025 | 2889 | 962 | 617 | 7.4e-58 |

Description sp:[LN:PIP_LACLA] [AC:P49022] [GN:PIP] [OR:LACTOCOCCUS LACTIS] [SR:,SUBSPLACTIS:STREPTOCOCCUS LACTIS] [DE:PHAGE INFECTION PROTEIN] [SP:P49022] [DB:swissprot] >gp:[GI:g308861] [LN:LACPIP] [AC:L14679] [GN:pip] [FN:required for phage infection] [OR:Lactococcus lactis] [SR:Lactococcus lactis (strain C2, sub_species lactis) DNA] [DB:genpept-bct1] [DE:Lactococcus lactis pip and gerC2 genes, complete cds's, and rrggene, 5' end of cds.] [NT:GTG start codon] [LE:391] [RE:3096] [DI:direct]

| ORF Name | NTID | AAID | NT Length | AA Length | score | probability |
|---|---|---|---|---|---|---|
| AI7503000985_4728187_c1_1365 | 1254 | 5026 | 234 | 77 | | |

Description
NO-HIT

| ORF Name | NTID | AAID | NT Length | AA Length | score | probability |
|---|---|---|---|---|---|---|
| AI7503000985_4735937_f3_1114 | 1255 | 5027 | 138 | 45 | | |

Description
NO-HIT

| ORF Name | NTID | AAID | NT Length | AA Length | score | probability |
|---|---|---|---|---|---|---|
| AI7503000985_4737550_c3_2248 | 1256 | 5028 | 759 | 252 | 387 | 7.3e-36 |

Description gp:[GI:g4433637] [LN:AF029224] [AC:AF029224:AF029225] [PN:NirR] [GN:nirR] [FN:involved in nitrite reduction] [OR:Staphylococcus carnosus] [DB:genpept-bct2] [DE:Staphylococcus carnosus nir and nar operons, complete sequences.] [LE:1184] [RE:1906] [DI:direct]

| ORF Name | NTID | AAID | NT Length | AA Length | score | probability |
|---|---|---|---|---|---|---|
| AI7503000985_4777217_c3_2257 | 1257 | 5029 | 1569 | 522 | 2425 | 7.9e-252 |

Description
gp:[GI:e1429596:g4756152] [LN:A67161] [AC:A67161] [FN:NARH GENE] [OR:Staphylococcus carnosus] [DB:genpept-pat] [DE:Sequence 1 from Patent EP0805205.] [NT:unnamed protein product] [LE:7804] [RE:9381] [DI:direct] >gp:[GI:g3929523] [LN:AF029224] [AC:AF029224:AF029225] [PN:NarH] [GN:narH] [OR:Staphylococcus carnosus] [DB:genpept-bct2] [DE:Staphylococcus carnosus nir and nar operons, complete sequences.] [NT:similar to Escherichia coli nitrate reductases NRA] [LE:9989] [RE:11566] [DI:direct]

| ORF Name | NTID | AAID | NT Length | AA Length | score | probability |
|---|---|---|---|---|---|---|
| AI7503000985_4787807_f3_984 | 1258 | 5030 | 210 | 69 | | |

Description
NO-HIT

| ORF Name | NTID | AAID | NT Length | AA Length | score | probability |
|---|---|---|---|---|---|---|
| AI7503000985_4814682_f3_1288 | 1259 | 5031 | 201 | 66 | | |

Description
NO-HIT

| ORF Name | NTID | AAID | NT Length | AA Length | score | probability |
|---|---|---|---|---|---|---|
| AI7503000985_4870907_f1_195 | 1260 | 5032 | 231 | 76 | | |

Description
NO-HIT

| ORF Name | NTID | AAID | NT Length | AA Length | score | probability |
|---|---|---|---|---|---|---|
| AI7503000985_4875316_c1_1545 | 1261 | 5033 | 141 | 46 | | |

Description
NO-HIT

| ORF Name | NTID | AAID | NT Length | AA Length | score | probability |
|---|---|---|---|---|---|---|
| AI7503000985_4875760_f1_255 | 1262 | 5034 | 135 | 44 | | |

Description
NO-HIT

| ORF Name | NTID | AAID | NT Length | AA Length | score | probability |
|---|---|---|---|---|---|---|
| AI7503000985_4876387_c3_2099 | 1263 | 5035 | 186 | 61 | | |

Description
NO-HIT

| ORF Name | NTID | AAID | NT Length | AA Length | score | probability |
|---|---|---|---|---|---|---|
| AI7503000985_4876932_c2_1733 | 1264 | 5036 | 249 | 82 | 74 | 0.013 |

Description
gp:[GI:g1255424] [LN:CELC33G8] [AC:U53154] [GN:C33G8.3] [OR:Caenorhabditis elegans] [DB:genpept-inv1] [DE:Caenorhabditis elegans cosmid C33G8.] [LE:27678:27899:28087] [RE:27848:27952:28290] [DI:directJoin]

| ORF Name | NTID | AAID | NT Length | AA Length | score | probability |
|---|---|---|---|---|---|---|
| AI7503000985_4878312_c2_1648 | 1265 | 5037 | 141 | 46 | | |

Description
NO-HIT

| ORF Name | NTID | AAID | NT Length | AA Length | score | probability |
|---|---|---|---|---|---|---|
| AI7503000985_4882893_c3_2012 | 1266 | 5038 | 1209 | 402 | 244 | 1.0e-27 |

Description
gp:[GI:d1039027:g4512424] [LN:AB017508] [AC:AB017508] [GN:secY] [OR:Bacillus halodurans] [SR:Bacillus halodurans (strain:C-125) DNA] [DB:genpept-bct1] [DE:Bacillus halodurans C-125 genomic DNA, 32 kb fragment, completecds.] [NT:secY homologue (identity of 70% to B. subtilis )] [LE:22481] [RE:23773] [DI:direct]

| ORF Name | NTID | AAID | NT Length | AA Length | score | probability |
|---|---|---|---|---|---|---|
| AI7503000985_4891002_c2_1834 | 1267 | 5039 | 1116 | 371 | 671 | 5.8e-66 |

Description
pir:[LN:A43577] [AC:A43577 ] [PN:regulatory protein pfoR] [OR:Clostridium perfringens] [DB:pir2]

| ORF Name | NTID | AAID | NT Length | AA Length | score | probability |
|---|---|---|---|---|---|---|
| AI7503000985_4980378_c1_1635 | 1268 | 5040 | 537 | 178 | 578 | 4.2e-56 |

Description
gp:[GI:g4096799] [LN:SCU40158] [AC:U40158] [OR:Staphylococcus carnosus] [DB:genpept-bct2] [DE:Staphylococcus carnosus response regulator-like protein (orfx)gene, partial cds.] [NT:orfx; function unknown; similar to response] [LE:<1] [RE:560] [DI:direct]

| ORF Name | NTID | AAID | NT Length | AA Length | score | probability |
|---|---|---|---|---|---|---|
| AI7503000985_5117137_c2_1827 | 1269 | 5041 | 459 | 152 | 499 | 9.8e-48 |

Description
pir:[LN:G70069] [AC:G70069 ] [PN:capsular polyglutamate biosynthesis homolog ywtA] [GN:ywtA ] [OR:Bacillus subtilis] [DB:pir2] >gp:[GI:e1184495:g2636114] [LN:BSUB0019] [AC:Z99122:AL009126] [GN:ywtA] [FN:unknown] [OR:Bacillus subtilis] [DB:genpept-bct1] [DE:Bacillus subtilis complete genome (section 19 of 21): from 3597091to 3809700.] [NT:similar to capsular polyglutamate biosynthesis] [LE:100949] [RE:101398] [DI:complement] >gp:[GI:e308089:g1894766] [LN:BSZ92954] [AC:Z92954] [GN:ywtA] [OR:Bacillus subtilis] [DB:genpept-bct1] [DE:B.subtilis yws[A,B,C,D,E,F,G] and gerBC genes.] [NT:product highly similar to Bacillus anthracis CapC] [LE:1084] [RE:1533] [DI:direct] >gp:[GI:e1184495:g2636114] [LN:BSUB0019] [AC:Z99122:AL009126] [GN:ywtA] [FN:unknown] [OR:Bacillus subtilis] [DB:genpept] [DE:Bacillus subtilis complete genome (section 19 of 21): from 3597091to 3809700.] [NT:similar to capsular polyglutamate biosynthesis] [LE:100949] [RE:101398] [DI:complement]

| ORF Name | NTID | AAID | NT Length | AA Length | score | probability |
|---|---|---|---|---|---|---|
| AI7503000985_5128425_f2_821 | 1270 | 5042 | 1878 | 625 | 477 | 2.1e-45 |

Description
pir:[LN:F69848] [AC:F69848 ] [PN:transcription antiterminator BglG family homolog yjdC] [GN:yjdC ] [CL:phosphotransferase system mannitol-specific enzyme II factor III homology] [OR:Bacillus subtilis] [DB:pir2] >gp:[GI:e1183220:g2633554] [LN:BSUB0007] [AC:Z99110:AL009126] [GN:yjdC] [FN:unknown] [OR:Bacillus subtilis] [DB:genpept-bct1] [DE:Bacillus subtilis complete genome (section 7 of 21): from 1194391to 1411140.] [NT:similar to transcriptional antiterminator (BglG] [LE:75712] [RE:77658] [DI:direct]

| ORF Name | NTID | AAID | NT Length | AA Length | score | probability |
|---|---|---|---|---|---|---|
| AI7503000985_5133562_f2_656 | 1271 | 5043 | 222 | 73 | 180 | 6.3e-14 |

Description pir:[LN:F70041] [AC:F70041 ] [PN:probable mercuric ion-binding protein yvgY:periplasmic mercuric ion-binding protein merP homolog] [GN:yvgY ] [CL:mercuric resistance operon regulatory protein: heavy-metal-associated homology] [OR:Bacillus subtilis] [DB:pir1] >gp:[GI:e1186039:g2635864] [LN:BSUB0018] [AC:Z99121:AL009126] [GN:yvgY] [FN:unknown] [OR:Bacillus subtilis] [DB:genpept-bct1] [DE:Bacillus subtilis complete genome (section 18 of 21): from 3399551to 3609060.] [NT:similar to mercuric transport protein] [LE:43125] [RE:43334] [DI:complement]

| ORF Name | NTID | AAID | NT Length | AA Length | score | probability |
|---|---|---|---|---|---|---|
| AI7503000985_5136002_c2_1691 | 1272 | 5044 | 366 | 121 | 136 | 2.9e-09 |

Description pir:[LN:C70043] [AC:C70043 ] [PN:hypothetical protein yvlA] [GN:yvlA ] [OR:Bacillus subtilis] [DB:pir2] >gp:[GI:e1186201:g2636026] [LN:BSUB0018] [AC:Z99121:AL009126] [GN:yvlA] [FN:unknown] [OR:Bacillus subtilis] [DB:genpept-bct1] [DE:Bacillus subtilis complete genome (section 18 of 21): from 3399551to 3609060.] [LE:207957] [RE:208283] [DI:complement] >gp:[GI:e1184419:g2636039] [LN:BSUB0019] [AC:Z99122:AL009126] [GN:yvlA] [FN:unknown] [OR:Bacillus subtilis] [DB:genpept-bct1] [DE:Bacillus subtilis complete genome (section 19 of 21): from 3597091to 3809700.] [LE:10417] [RE:10743] [DI:complement] >gp:[GI:g2618844] [LN:AF017113] [AC:AF017113] [PN:YvlA] [GN:yvlA] [OR:Bacillus subtilis] [DB:genpept-bct2] [DE:Bacillus subtilis 300-304 degree genomic sequence.] [LE:19550] [RE:19876] [DI:direct] >gp:[GI:e1184419:g2636039] [LN:BSUB0019] [AC:Z99122:AL009126] [GN:yvlA] [FN:unknown] [OR:Bacillus subtilis] [DB:genpept] [DE:Bacillus subtilis complete genome (section 19 of 21): from 3597091to 3809700.] [LE:10417] [RE:10743] [DI:complement]

| ORF Name | NTID | AAID | NT Length | AA Length | score | probability |
|---|---|---|---|---|---|---|
| AI7503000985_5203452_c3_1989 | 1273 | 5045 | 579 | 192 | 398 | 5.0e-37 |

Description sp:[LN:HIS5_LACLA] [AC:Q02132] [GN:HISH] [OR:LACTOCOCCUS LACTIS] [SR:,SUBSPLACTIS:STREPTOCOCCUS LACTIS] [EC:2.4.2.-] [DE:AMIDOTRANSFERASE HISH,] [SP:Q02132] [DB:swissprot] >pir:[LN:I45734] [AC:I45734 ] [PN:HisH] [CL:amidotransferase hisH] [OR:Lactococcus lactis subsp. lactis] [DB:pir2] >gp:[GI:g2565145] [LN:LLU92974] [AC:U92974:M90760:M90761] [PN:HisH] [GN:hish] [OR:Lactococcus lactis] [DB:genpept-bct1] [DE:Lactococcus lactis unknown gene, partial cds, and HisC (hisC),unknown, HisG (hisG), unknown, HisB (hisB), unknown, HisH (hish),HisA (hisA), HisF (hisF), HisIE (hisIE), unknown, unknown, LeuA(leuA), LeuB (leuB), LeuC (leuC), LeuD (leuD), unknown, IlvD(ilvD), IlvB (ilvB), IlvN, IlvC (ilvC), IlvA (ilvA), AldB (aldB)and aldR (aldR) genes, complete cds.] [NT:aminotransferase] [LE:7295] [RE:7903] [DI:direct]

| ORF Name | NTID | AAID | NT Length | AA Length | score | probability |
|---|---|---|---|---|---|---|
| AI7503000985_5281568_f3_1043 | 1274 | 5046 | 504 | 167 | 330 | 8.0e-30 |

Description pir:[LN:C64897] [AC:C64897 ] [PN:probable phosphinothricin N-acetyltransferase,] [CL:phosphinothricin N-acetyltransferase] [OR:Escherichia coli] [EC:2.3.1.-] [DB:pir2] >gp:[GI:g1787719] [LN:AE000241] [AC:AE000241:U00096] [PN:putative resistance protein] [GN:b1448] [FN:putative transport; Drug/analog sensitivity] [OR:Escherichia coli] [DB:genpept-bct2] [DE:Escherichia coli K-12 MG1655 section 131 of 400 of the completegenome.] [NT:f172; 38 pct identical (3 gaps) to 169 residues of] [LE:9570] [RE:10088] [DI:complement]

| ORF_Name | NTID | AAID | NT Length | AA Length | score | probability |
|---|---|---|---|---|---|---|
| AI7503000985_5290675_c3_2108 | 1275 | 5047 | 405 | 134 | 411 | 2.1e-38 |

Description sp:[LN:PAND_BACSU] [AC:P52999] [GN:PAND] [OR:BACILLUS SUBTILIS] [EC:4.1.1.11]
[DE:DECARBOXYLASE)] [SP:P52999] [DB:swissprot] >pir:[LN:A69672] [AC:A69672 ]
[PN:aspartate 1-decarboxylase panD] [GN:panD ] [CL:aspartate 1-decarboxylase]
[OR:Bacillus subtilis] [DB:pir2] >gp:[GI:g1146242] [LN:BACYPIA] [AC:L47709]
[PN:aspartate 1-decarboxylase] [GN:panD] [FN:pantothenic acid biosynthesis]
[OR:Bacillus subtilis] [DB:genpept-bct1] [EC:4.1.1.11] [DE:Bacillus subtilis (clone
YAC15-6B) ypiABF genes, qcrABC genes,ypjABCDEFGHI genes, birA gene, panBCD genes, dinG
gene, ypmB gene,aspB gene, asnS gene, dnaD gene, nth gene and ypoC gene,
completecds's.] [NT:48.3% of identity to the Escherichia coli aspartate] [LE:14990]
[RE:15373] [DI:direct] >gp:[GI:e1183686:g2634659] [LN:BSUB0012] [AC:Z99115:AL009126]
[PN:aspartate 1-decarboxylase] [GN:panD] [FN:pantothenate biosynthesis] [OR:Bacillus
subtilis] [DB:genpept-bct1] [EC:4.1.1.11] [DE:Bacillus subtilis complete genome
(section 12 of 21): from 2195541to 2409220.] [SP:P52999] [LE:156294] [RE:156677]
[DI:complement]

| ORF_Name | NTID | AAID | NT Length | AA Length | score | probability |
|---|---|---|---|---|---|---|
| AI7503000985_5314077_c1_1448 | 1276 | 5048 | 1593 | 530 | 1036 | 1.2e-104 |

Description sp:[LN:YIDK_ECOLI] [AC:P31448] [GN:YIDK] [OR:ESCHERICHIA COLI] [DE:HYPOTHETICAL 62.1 KD
PROTEIN IN EMRD-GLVG INTERGENIC REGION] [SP:P31448] [DB:swissprot] >pir:[LN:H65169]
[AC:H65169 ] [PN:hypothetical 62.1 kD protein in ilvo-ibpb intergenic region] [GN:yidK
] [OR:Escherichia coli] [DB:pir2] >gp:[GI:g290528] [LN:ECOUW82] [AC:L10328] [GN:f571]
[FN:unknown] [OR:Escherichia coli] [SR:Escherichia coli K12 strain MG1655; lambda
clones EC14-52] [DB:genpept-bct1] [DE:E. coli; the region from 81.5 to 84.5 minutes.]
[NT:similar to glucose transport proteins] [LE:47795] [RE:49510] [DI:complement]
>gp:[GI:g1790113] [LN:AE000445] [AC:AE000445:U00096] [PN:putative cotransporter]
[GN:yidK] [FN:putative transport; Not classified] [OR:Escherichia coli]
[DB:genpept-bct2] [DE:Escherichia coli K-12 MG1655 section 335 of 400 of the
completegenome.] [NT:f571; 100 pct identical to YIDK_ECOLI SW:] [LE:5576] [RE:7291]
[DI:complement]

| ORF_Name | NTID | AAID | NT Length | AA Length | score | probability |
|---|---|---|---|---|---|---|
| AI7503000985_53413_f2_855 | 1277 | 5049 | 1602 | 533 | 424 | 8.7e-40 |

Description pir:[LN:H64532] [AC:H64532 ] [PN:2',3'-cyclic-nucleotide 2'-phosphodiesterase,
precursor] [GN:HP0104 ] [CL:2',3'-cyclic-nucleotide 2'-phosphodiesterase:
2',3'-cyclic-nucleotide 2'-phosphodiesterase homology:phosphoesterase core homology]
[OR:Helicobacter pylori] [EC:3.1.4.16] [DB:pir1] >gp:[GI:g2313187] [LN:AE000532]
[AC:AE000532:AE000511] [PN:2',3'-cyclic-nucleotide 2'-phosphodiesterase] [GN:HP0104]
[OR:Helicobacter pylori 26695] [DB:genpept-bct2] [DE:Helicobacter pylori 26695 section
10 of 134 of the complete genome.] [NT:similar to GB:L42023 SP:P44764 PID:1004048]
[LE:3594] [RE:5339] [DI:complement]

| ORF Name | NTID | AAID | NT Length | AA Length | score | probability |
|---|---|---|---|---|---|---|
| AI7503000985_5369212_c3_2196 | 1278 | 5050 | 1509 | 502 | 430 | 5.4e-40 |

Description sp:[LN:TAGE_BACSU] [AC:P13484] [GN:TAGE:RODD:GTAA] [OR:BACILLUS SUBTILIS] [EC:2.4.1.52] [DE:(EC 2.4.1.52) (TEICHOIC ACID BIOSYNTHESIS PROTEIN E)] [SP:P13484] [DB:swissprot] >pir:[LN:S06048] [AC:S06048:F69720 ] [PN:poly(glycerol-phosphate) alpha-glucosyltransferase, tagE:probable rodD protein:UDP-glucose--polyglycerol phosphate glucosyltransferase tagE] [GN:tagE:rodD ] [OR:Bacillus subtilis] [EC: 2.4.1.52] [DB:pir2] [MP:310 degrees ] >gp:[GI:g580920] [LN:BSRODC] [AC:X15200] [OR:Bacillus subtilis] [DB:genpept-bct1] [DE:Bacillus subtilis rodC operon.] [NT:rodD (gtaA) polypeptide (AA 1-673)] [SP:P13484] [LE:157] [RE:2178] [DI:direct] >gp:[GI:e1184479:g2636099] [LN:BSUB0019] [AC:Z99122:AL009126] [PN:UDP-glucose:polyglycerol phosphate] [GN:tagE] [FN:teichoic acid biosynthesis] [OR:Bacillus subtilis] [DB:genpept-bct1] [EC:2.4.1.52] [DE:Bacillus subtilis complete genome (section 19 of 21): from 3597091to 3809700.] [NT:alternate gene name: rodD, gtaA, gtaD] [SP:P13484] [LE:80369] [RE:82390] [DI:complement] >gp:[GI:e1184479:g2636099] [LN:BSUB0019] [AC:Z99122:AL009126] [PN:UDP-glucose:polyglycerol phosphate] [GN:tagE] [FN:teichoic acid biosynthesis] [OR:Bacillus subtilis] [DB:genpept] [EC:2.4.1.52] [DE:Bacillus subtilis complete genome (section 19 of 21): from 3597091to 3809700.] [NT:alternate gene name: rodD, gtaA, gtaD] [SP:P13484] [LE:80369] [RE:82390] [DI:complement]

| ORF Name | NTID | AAID | NT Length | AA Length | score | probability |
|---|---|---|---|---|---|---|
| AI7503000985_54207_c1_1347 | 1279 | 5051 | 138 | 45 | | |

Description

NO-HIT

| ORF Name | NTID | AAID | NT Length | AA Length | score | probability |
|---|---|---|---|---|---|---|
| AI7503000985_56693_c1_1418 | 1280 | 5052 | 792 | 263 | 778 | 2.7e-77 |

Description gp:[GI:g2058476] [LN:BTU71200] [AC:U71200] [PN:acetoin reductase] [OR:Bos taurus] [DB:genpept-mam] [DE:Bos taurus acetoin reductase mRNA, complete cds.] [NT:similar to acetoin reductase of Klebsiella] [LE:51] [RE:824] [DI:direct]

| ORF Name | NTID | AAID | NT Length | AA Length | score | probability |
|---|---|---|---|---|---|---|
| AI7503000985_578162_f3_1226 | 1281 | 5053 | 177 | 58 | | |

Description

NO-HIT

| ORF Name | NTID | AAID | NT Length | AA Length | score | probability |
|---|---|---|---|---|---|---|
| AI7503000985_5867262_c1_1636 | 1282 | 5054 | 126 | 41 | | |

Description

NO-HIT

| ORF Name | NTID | AAID | NT Length | AA Length | score | probability |
|---|---|---|---|---|---|---|
| AI7503000985_5891075_f2_736 | 1283 | 5055 | 132 | 43 | | |

Description

NO-HIT

| ORF Name | NTID | AAID | NT Length | AA Length | score | probability |
|---|---|---|---|---|---|---|
| AI7503000985_5907177_f1_392 | 1284 | 5056 | 138 | 45 | | |

Description
NO-HIT

| ORF Name | NTID | AAID | NT Length | AA Length | score | probability |
|---|---|---|---|---|---|---|
| AI7503000985_5915653_f2_789 | 1285 | 5057 | 183 | 60 | | |

Description
NO-HIT

| ORF Name | NTID | AAID | NT Length | AA Length | score | probability |
|---|---|---|---|---|---|---|
| AI7503000985_595260_c2_1956 | 1286 | 5058 | 3780 | 1259 | 5568 | 0.0 |

Description
gp:[GI:e1429593:g4756151] [LN:A67161] [AC:A67161] [FN:NARG GENE] [OR:Staphylococcus carnosus] [DB:genpept-pat] [DE:Sequence 1 from Patent EP0805205.] [NT:unnamed protein product] [LE:4140] [RE:7814] [DI:direct] >gp:[GI:g3929522] [LN:AF029224] [AC:AF029224:AF029225] [PN:NarG] [GN:narG] [OR:Staphylococcus carnosus] [DB:genpept-bct2] [DE:Staphylococcus carnosus nir and nar operons, complete sequences.] [NT:similar to Escherichia coli nitrate reductases NRA] [LE:6325] [RE:9999] [DI:direct]

| ORF Name | NTID | AAID | NT Length | AA Length | score | probability |
|---|---|---|---|---|---|---|
| AI7503000985_5963300_f2_895 | 1287 | 5059 | 504 | 167 | 116 | 5.6e-06 |

Description
gp:[GI:d1044460:g5105361] [LN:AP000062] [AC:AP000062] [PN:213aa long hypothetical protein] [GN:APE1673] [OR:Aeropyrum pernix] [SR:Aeropyrum pernix (strain:K1) DNA] [DB:genpept] [DE:Aeropyrum pernix genomic DNA, section 5/7.] [LE:71354] [RE:71995] [DI:direct]

| ORF Name | NTID | AAID | NT Length | AA Length | score | probability |
|---|---|---|---|---|---|---|
| AI7503000985_5988786_f1_391 | 1288 | 5060 | 135 | 44 | | |

Description
NO-HIT

| ORF Name | NTID | AAID | NT Length | AA Length | score | probability |
|---|---|---|---|---|---|---|
| AI7503000985_6047827_c2_1778 | 1289 | 5061 | 705 | 234 | 569 | 3.8e-55 |

Description
gp:[GI:g2565161] [LN:LLU92974] [AC:U92974:M90760:M90761] [PN:AldB] [GN:aldB] [OR:Lactococcus lactis] [DB:genpept-bct1] [DE:Lactococcus lactis unknown gene, partial cds, and HisC (hisC),unknown, HisG (hisG), unknown, HisB (hisB), unknown, HisH (hish),HisA (hisA), HisF (hisF), HisIE (hisIE), unknown, unknown, LeuA(leuA), LeuB (leuB), LeuC (leuC), LeuD (leuD), unknown, IlvD(ilvD), IlvB (ilvB), IlvN, IlvC (ilvC), IlvA (ilvA), AldB (aldB)and aldR (aldR) genes, complete cds.] [NT:alpha-acetolactate decarboxylase] [LE:24488] [RE:25198] [DI:direct] >gp:[GI:g1699352] [LN:S82499] [AC:S82499] [PN:alpha-acetolactate decarboxylase] [GN:aldB] [OR:Lactococcus lactis] [SR:Lactococcus lactis NCDO2118 ssp. lactis] [DB:genpept-bct1] [DE:aldB=alpha-acetolactate decarboxylase [Lactococcus lactis, ssp.lactis, NCDO2118, Genomic, 840 nt].] [NT:This sequence comes from Fig. 2; AldB] [LE:98] [RE:808] [DI:direct]

| ORF Name | NTID | AAID | NT Length | AA Length | score | probability |
|---|---|---|---|---|---|---|
| AI7503000985_6070938_c1_1477 | 1290 | 5062 | 1773 | 590 | 2475 | 4.0e-257 |

Description
gp:[GI:g4574121] [LN:AF009415] [AC:AF009415] [PN:choline dehydrogenase] [GN:cudB] [OR:Staphylococcus xylosus] [DB:genpept-bct2] [DE:Staphylococcus xylosus choline transporter (cudT), putativeregulatory protein (cudC), glycine betaine aldehyde dehydrogenase(cudA), and choline dehydrogenase (cudB) genes, complete cds.] [NT:CudB] [LE:4915] [RE:6597] [DI:direct]

| ORF Name | NTID | AAID | NT Length | AA Length | score | probability |
|---|---|---|---|---|---|---|
| AI7503000985_6101063_c2_1925 | 1291 | 5063 | 138 | 45 | | |

Description
NO-HIT

| ORF Name | NTID | AAID | NT Length | AA Length | score | probability |
|---|---|---|---|---|---|---|
| AI7503000985_6101542_f2_836 | 1292 | 5064 | 132 | 43 | | |

Description
NO-HIT

| ORF Name | NTID | AAID | NT Length | AA Length | score | probability |
|---|---|---|---|---|---|---|
| AI7503000985_6132893_c3_2259 | 1293 | 5065 | 462 | 153 | | |

Description
NO-HIT

| ORF Name | NTID | AAID | NT Length | AA Length | score | probability |
|---|---|---|---|---|---|---|
| AI7503000985_6136050_c2_1807 | 1294 | 5066 | 246 | 81 | 80 | 0.0033 |

Description
gp:[GI:g4980536] [LN:AE001692] [AC:AE001692:AE000512] [PN:iron(II) transport protein A] [GN:TM0050] [OR:Thermotoga maritima] [DB:genpept-bct2] [DE:Thermotoga maritima section 4 of 136 of the complete genome.] [NT:similar to SP:P33649 PID:414746 PID:606343] [LE:81] [RE:545] [DI:direct]

| ORF Name | NTID | AAID | NT Length | AA Length | score | probability |
|---|---|---|---|---|---|---|
| AI7503000985_6136527_c1_1463 | 1295 | 5067 | 615 | 204 | 618 | 2.4e-60 |

Description
pir:[LN:C69877] [AC:C69877 ] [PN:adenylylsulfate kinase homolog ylnC] [GN:ylnC ] [CL:adenylylsulfate kinase:adenylylsulfate kinase homology] [OR:Bacillus subtilis] [DB:pir2] >gp:[GI:e332186:g2462959] [LN:BSPYREYLO] [AC:AJ000974] [PN:putative adenosine 5-phosphosulfate kinase] [GN:ylnC] [OR:Bacillus subtilis] [DB:genpept-bct1] [DE:Bacillus subtilis pyrE to yloA gene region.] [LE:3535] [RE:4128] [DI:direct]
>gp:[GI:e1185152:g2633933] [LN:BSUB0009] [AC:Z99112:AL009126] [GN:ylnC] [PN:unknown] [OR:Bacillus subtilis] [DB:genpept-bct1] [DE:Bacillus subtilis complete genome (section 9 of 21): from 1598421to 1807200.] [NT:similar to adenylylsulfate kinase] [LE:34348] [RE:34941] [DI:direct]

| ORF Name | NTID | AAID | NT Length | AA Length | score | probability |
|---|---|---|---|---|---|---|
| AI7503000985_6251592_c2_1940 | 1296 | 5068 | 150 | 49 | | |

Description
NO-HIT

| ORF Name | NTID | AAID | NT Length | AA Length | score | probability |
|---|---|---|---|---|---|---|
| AI7503000985_6289068_c2_1750 | 1297 | 5069 | 219 | 72 | 233 | 1.0e-18 |

Description
gp:[GI:g4574118] [LN:AF009415] [AC:AF009415] [PN:choline transporter] [GN:cudT]
[OR:Staphylococcus xylosus] [DB:genpept-bct2] [DE:Staphylococcus xylosus choline
transporter (cudT), putativeregulatory protein (cudC), glycine betaine aldehyde
dehydrogenase(cudA), and choline dehydrogenase (cudB) genes, complete cds.] [NT:CudT]
[LE:811] [RE:2433] [DI:direct]

| ORF Name | NTID | AAID | NT Length | AA Length | score | probability |
|---|---|---|---|---|---|---|
| AI7503000985_6369688_f2_562 | 1298 | 5070 | 915 | 304 | 130 | 5.9e-06 |

Description
gp:[GI:g4262225] [LN:ATAC006200] [AC:AC006200] [PN:putative phosphatidic acid
phosphatase] [GN:F10A8.6] [OR:Arabidopsis thaliana] [SR:thale cress] [DB:genpept-pln2]
[DE:Arabidopsis thaliana chromosome II BAC F10A8 genomic sequence,complete sequence.]
[LE:16778] [RE:17686] [DI:complement]

| ORF Name | NTID | AAID | NT Length | AA Length | score | probability |
|---|---|---|---|---|---|---|
| AI7503000985_6442202_f3_1033 | 1299 | 5071 | 1050 | 349 | 310 | 1.0e-27 |

Description
sp:[LN:YYAD_BACSU] [AC:P37520] [GN:YYAD] [OR:BACILLUS SUBTILIS] [DE:HYPOTHETICAL 37.7
KD PROTEIN IN RPSF-SPOOJ INTERGENIC REGION] [SP:P37520] [DB:swissprot] >pir:[LN:I40448]
[AC:I40448:S66018:C70084:S18084 ] [PN:conserved hypothetical protein yyaD (replication
origin region)] [GN:yyaD ] [OR:Bacillus subtilis] [DB:pir2] >gp:[GI:d1005766:g467378]
[LN:BAC180K] [AC:D26185] [PN:unknown] [OR:Bacillus subtilis] [SR:Bacillus subtilis
(sub_species:Marburg, strain:168) DNA] [DB:genpept-bct1] [DE:B. subtilis DNA, 180
kilobase region of replication origin.] [LE:51420] [RE:52436] [DI:complement]
>gp:[GI:g580907] [LN:BSORIGS] [AC:X62539] [OR:Bacillus subtilis] [DB:genpept-bct1]
[DE:B.subtilis genes rpmH, rnpA, 50kd, gidA and gidB.] [NT:unnamed protein product]
[SP:P37520] [LE:10964] [RE:11980] [DI:direct] >gp:[GI:e1184820:g2636641] [LN:BSUB0021]
[AC:Z99124:AL009126] [GN:yyaD] [FN:unknown] [OR:Bacillus subtilis] [DB:genpept-bct1]
[DE:Bacillus subtilis complete genome (section 21 of 21): from 3999281to 4214814.]
[NT:similar to hypothetical proteins from B. subtilis] [SP:P37520] [LE:203352]
[RE:204368] [DI:complement]

| ORF Name | NTID | AAID | NT Length | AA Length | score | probability |
|---|---|---|---|---|---|---|
| AI7503000985_651527_c1_1369 | 1300 | 5072 | 732 | 243 | 359 | 6.7e-33 |

Description
sp:[LN:HIS4_SYNY3] [AC:P74561] [GN:HISA:SLR0652] [OR:SYNECHOCYSTIS SP] [SR:PCC 6803,]
[EC:5.3.1.16] [DE:ISOMERASE,] [SP:P74561] [DB:swissprot] >pir:[LN:S76756] [AC:S76756 ]
[PN:hypothetical protein] [CL:N-(5'-phospho-D-ribosylformimino)-5-amino-1-
(5''-phosphoribosyl)-4-imidazolecarboxamide isomerase] [OR:Synechocystis sp.] [SR:PCC
6803, , PCC 6803] [SR:PCC 6803, ] [DB:pir2] >gp:[GI:d1019401:g1653757] [LN:D90916]
[AC:D90916:AB001339] [PN:phosphorybosilformimino-5-amino-] [GN:hisA] [OR:Synechocystis
sp.] [SR:Synechocystis sp. (strain:PCC6803) DNA] [DB:genpept-bct1] [DE:Synechocystis
sp. PCC6803 complete genome, 26/27, 3270710-3418851.] [NT:ORF_ID:slr0652] [LE:48572]
[RE:49342] [DI:direct]

| ORF Name | NTID | AAID | NT Length | AA Length | score | probability |
|---|---|---|---|---|---|---|
| AI7503000985_6522262_c2_1805 | 1301 | 5073 | 138 | 45 | | |

Description
NO-HIT

| ORF_Name | NTID | AAID | NT Length | AA Length | score | probability |
|---|---|---|---|---|---|---|
| AI7503000985_6642792_f3_978 | 1302 | 5074 | 147 | 48 | | |

Description
NO-HIT

| ORF_Name | NTID | AAID | NT Length | AA Length | score | probability |
|---|---|---|---|---|---|---|
| AI7503000985_6662875_f1_382 | 1303 | 5075 | 147 | 48 | | |

Description
NO-HIT

| ORF_Name | NTID | AAID | NT Length | AA Length | score | probability |
|---|---|---|---|---|---|---|
| AI7503000985_6678507_f1_253 | 1304 | 5076 | 207 | 68 | | |

Description
NO-HIT

| ORF_Name | NTID | AAID | NT Length | AA Length | score | probability |
|---|---|---|---|---|---|---|
| AI7503000985_6745327_f3_1336 | 1305 | 5077 | 144 | 47 | | |

Description
NO-HIT

| ORF_Name | NTID | AAID | NT Length | AA Length | score | probability |
|---|---|---|---|---|---|---|
| AI7503000985_6772250_c1_1380 | 1306 | 5078 | 141 | 46 | | |

Description
NO-HIT

| ORF_Name | NTID | AAID | NT Length | AA Length | score | probability |
|---|---|---|---|---|---|---|
| AI7503000985_6829635_c2_1695 | 1307 | 5079 | 132 | 43 | | |

Description
NO-HIT

| ORF_Name | NTID | AAID | NT Length | AA Length | score | probability |
|---|---|---|---|---|---|---|
| AI7503000985_6829812_c1_1542 | 1308 | 5080 | 948 | 315 | 795 | 4.2e-79 |

Description
gp:[GI:g4959404] [LN:AF115391] [AC:AF115391] [PN:ribokinase RbsK] [GN:rbsK]
[OR:Lactobacillus sakei] [DB:genpept-bct2] [DE:Lactobacillus sakei LaaA (laaA) gene,
partial cds; LaaB (laaB),putative acetate kinase AckA (ackA), LaaC (laaC) genes,
completecds; rbs operon, complete sequence; and LaaE (laaE) gene, partialcds.]
[LE:4450] [RE:5358] [DI:direct]

| ORF_Name | NTID | AAID | NT Length | AA Length | score | probability |
|---|---|---|---|---|---|---|
| AI7503000985_6837938_f1_376 | 1309 | 5081 | 3561 | 1186 | 198 | 2.1e-14 |

Description
sp:[LN:CDR1_HUMAN] [AC:P51861] [GN:CDR1] [OR:HOMO SAPIENS] [SR:,HUMAN]
[DE:CEREBELLAR-DEGENERATION-RELATED ANTIGEN 1 (CDR34)] [SP:P51861] [DB:swissprot]
>pir:[LN:A29770] [AC:A29770:A35640 ] [PN:cerebellar degeneration-related protein]
[GN:CDR1:CDR ] [OR:Homo sapiens] [SR:, man] [DB:pir2] [MP:Xq27.1-Xq27.2 ]

| ORF Name | NTID | AAID | NT Length | AA Length | score | probability |
|---|---|---|---|---|---|---|
| AI7503000985_6844012_c2_1748 | 1310 | 5082 | 1344 | 447 | 589 | 2.9e-57 |

Description sp:[LN:DCUA_ECOLI] [AC:P04539] [GN:DCUA:GENA] [OR:ESCHERICHIA COLI] [DE:ANAEROBIC C4-DICARBOXYLATE TRANSPORTER DCUA] [SP:P04539] [DB:swissprot] >pir:[LN:QQEC94] [AC:S56366:S57340:H65223:A04471:S08589 ] [PN:dicarboxylate membrane-transporter protein A:anaerobic c4-dicarboxylate transporter dcua:aspartase membrane transport protein genA] [GN:dcuA:genA ] [CL:dicarboxylate membrane-transporter protein A] [OR:Escherichia coli] [DB:pir1] [MP:94 min ] >gp:[GI:g510888] [LN:ECDUCA] [AC:X79887] [PN:dicarboxylate membrane-transporter protein] [GN:dcuB] [OR:Escherichia coli] [DB:genpept-bct1] [DE:E.coli dcuA gene.] [SP:P04539] [LE:129] [RE:1430] [DI:direct] >gp:[GI:g536982] [LN:ECOUW93] [AC:U14003] [GN:genA] [FN:membrane transport of aspartase] [OR:Escherichia coli] [DB:genpept-bct1] [DE:Escherichia coli K-12 chromosomal region from 92.8 to 00.1 minutes.] [LE:56300] [RE:57601] [DI:complement] >gp:[GI:g1790580] [LN:AE000486] [AC:AE000486:U00096] [PN:anaerobic dicarboxylate transport] [GN:dcuA] [FN:transport; Transport of small molecules:] [OR:Escherichia coli] [DB:genpept-bct2] [DE:Escherichia coli K-12 MG1655 section 376 of 400 of the completegenome.] [NT:f433; 100 pct identical amino acid sequence and] [LE:6845] [RE:8146] [DI:complement]

| ORF Name | NTID | AAID | NT Length | AA Length | score | probability |
|---|---|---|---|---|---|---|
| AI7503000985_6897133_f1_415 | 1311 | 5083 | 126 | 41 | 75 | 0.038 |

Description gp:[GI:g5306168] [LN:AF160864] [AC:AF160864] [PN:orf256] [GN:orf256] [OR:Mitochondrion Tetrahymena pyriformis] [SR:Tetrahymena pyriformis] [DB:genpept] [DE:Tetrahymena pyriformis mitochondrial DNA, complete genome.] [NT:Open reading frame ymf62 (CPGN)] [LE:40866] [RE:41636] [DI:direct]

| ORF Name | NTID | AAID | NT Length | AA Length | score | probability |
|---|---|---|---|---|---|---|
| AI7503000985_6928_c1_1546 | 1312 | 5084 | 843 | 280 | | |

Description

NO-HIT

| ORF Name | NTID | AAID | NT Length | AA Length | score | probability |
|---|---|---|---|---|---|---|
| AI7503000985_7039051_c3_2238 | 1313 | 5085 | 750 | 249 | 585 | 7.6e-57 |

Description sp:[LN:YCKJ_BACSU] [AC:P42200] [GN:YCKJ] [OR:BACILLUS SUBTILIS] [DE:PROBABLE AMINO-ACID ABC TRANSPORTER PERMEASE PROTEIN] [SP:P42200] [DB:swissprot] >pir:[LN:I40451] [AC:I40451:D69761:S52382 ] [PN:glutamine ABC transporter (permease) homolog yckJ:ABC-type transport system probable membrane spanning protein] [GN:yckJ ] [CL:histidine permease protein M] [OR:Bacillus subtilis] [DB:pir2] >gp:[GI:g666982] [LN:BSPAAT] [AC:X77636] [PN:putative membrane spanning subunit] [GN:ORF2] [OR:Bacillus subtilis] [DB:genpept-bct1] [DE:B.subtilis putative amino acid transporter gene.] [NT:potential ABC-transport system] [SP:P42200] [LE:909] [RE:1613] [DI:direct] >gp:[GI:e1182312:g2632646] [LN:BSUB0002] [AC:Z99105:AL009126] [GN:yckJ] [FN:unknown] [OR:Bacillus subtilis] [DB:genpept-bct1] [DE:Bacillus subtilis complete genome (section 2 of 21): from 194651 to415810.] [NT:similar to glutamine ABC transporter (permease)] [SP:P42200] [LE:214896] [RE:215600] [DI:complement] >gp:[GI:e1182327:g2632661] [LN:BSUB0003] [AC:Z99106:AL009126] [GN:yckJ] [FN:unknown] [OR:Bacillus subtilis] [DB:genpept-bct1] [DE:Bacillus subtilis complete genome (section 3 of 21): from 402751 to611850.] [NT:similar to glutamine ABC transporter (permease)] [SP:P42200] [LE:6796] [RE:7500] [DI:complement] >gp:[GI:d1009628:g1805431] [LN:D50453] [AC:D50453] [PN:homologue of glutamine transport system] [GN:yckJ] [OR:Bacillus subtilis] [SR:Bacillus subtilis (strain:168 trpC2) DNA] [DB:genpept-bct1] [DE:Bacillus subtilis DNA for 25-36 degree region containing theamyE-srfA region, complete cds.] [LE:89199] [RE:89903] [DI:complement]

| ORF Name | NTID | AAID | NT Length | AA Length | score | probability |
|---|---|---|---|---|---|---|
| AI7503000985_7227175_c3_2052 | 1314 | 5086 | 189 | 62 | | |

Description

NO-HIT

| ORF Name | NTID | AAID | NT Length | AA Length | score | probability |
|---|---|---|---|---|---|---|
| AI7503000985_7228517_c3_2197 | 1315 | 5087 | 411 | 136 | 191 | 4.3e-15 |

Description pir:[LN:A70556] [AC:A70556 ] [PN:probable mutator MutT protein or homolog] [GN:mutT2 ] [CL:mutT domain homology] [OR:Mycobacterium tuberculosis] [DB:pir2] >gp:[GI:e317133:g2117198] [LN:MTCI65] [AC:Z95584:AL123456] [PN:mutT2] [GN:mutT2] [OR:Mycobacterium tuberculosis] [DB:genpept-bct1] [DE:Mycobacterium tuberculosis H37Rv complete genome; segment 50/162.] [NT:Rv1160, (MTCI65.27), mutT, len: 141. Probable] [LE:24794] [RE:25219] [DI:direct]

| ORF Name | NTID | AAID | NT Length | AA Length | score | probability |
|---|---|---|---|---|---|---|
| AI7503000985_7234627_c1_1580 | 1316 | 5088 | 210 | 69 | | |

Description

NO-HIT

| ORF Name | NTID | AAID | NT Length | AA Length | score | probability |
|---|---|---|---|---|---|---|
| AI7503000985_7242128_c2_1926 | 1317 | 5089 | 345 | 114 | 352 | 3.7e-32 |

Description gp:[GI:e314909:g2073521] [LN:SSK1MECA] [AC:Y09223] [PN:hypothetical protein] [OR:Staphylococcus sciuri] [DB:genpept-bct1] [DE:S.sciuri mecA gene & ORF's 450, 145 & 179.] [NT:ORF450] [LE:<1] [RE:1351] [DI:complement]

| ORF Name | NTID | AAID | NT Length | AA Length | score | probability |
|---|---|---|---|---|---|---|
| AI7503000985_7243832_c2_1644 | 1318 | 5090 | 1722 | 573 | 684 | 2.4e-67 |

Description
gp:[GI:d1044599:g5105500] [LN:AP000062] [AC:AP000062] [PN:558aa long hypothetical protein] [GN:APE1810] [OR:Aeropyrum pernix] [SR:Aeropyrum pernix (strain:K1) DNA] [DB:genpept] [DE:Aeropyrum pernix genomic DNA, section 5/7.] [NT:motif=ATP/GTP-binding site motif A (P-loop)] [LE:155809] [RE:157485] [DI:direct]

| ORF Name | NTID | AAID | NT Length | AA Length | score | probability |
|---|---|---|---|---|---|---|
| AI7503000985_7245377_c1_1534 | 1319 | 5091 | 1002 | 333 | 258 | 3.4e-22 |

Description
sp:[LN:EST_ACICA] [AC:P18773] [GN:EST] [OR:ACINETOBACTER CALCOACETICUS] [EC:3.1.1.-] [DE:ESTERASE,] [SP:P18773] [DB:swissprot] >gp:[GI:g303953] [LN:ACCESTERAS] [AC:M24890:L20754] [PN:esterase] [OR:Acinetobacter calcoaceticus] [SR:Acinetobacter calcoaceticus ssp. lwoffii (strain RAG-1) DNA] [DB:genpept-bct1] [DE:Acinetobacter calcoaceticus esterase gene, complete cds.] [LE:1] [RE:912] [DI:direct]

| ORF Name | NTID | AAID | NT Length | AA Length | score | probability |
|---|---|---|---|---|---|---|
| AI7503000985_7301078_c3_2006 | 1320 | 5092 | 465 | 154 | 340 | 7.0e-31 |

Description
gp:[GI:g3114664] [LN:AF061267] [AC:AF061267] [PN:ATPase component HtxD] [GN:htxD] [OR:Pseudomonas stutzeri] [DB:genpept-bct2] [DE:Pseudomonas stutzeri putative alpha-ketoglutarate-dependenthypophosphite dioxygenase (htxA), binding protein component HtxB(htxB), inner membrane component HtxC (htxC), ATPase component HtxD(htxD), inner membrane component HtxE (htxE), putative C-P lyasesubunits HtxF (htxF), HtxG (htxG), and HtxH (htxH) genes, completecds; and putative C-P lyase subunit HtxI (htxI) gene, partial cds.] [NT:putative binding-protein-dependent hypophosphite] [LE:3996] [RE:5021] [DI:direct]

| ORF Name | NTID | AAID | NT Length | AA Length | score | probability |
|---|---|---|---|---|---|---|
| AI7503000985_783375_f2_893 | 1321 | 5093 | 147 | 48 | | |

Description
NO-HIT

| ORF Name | NTID | AAID | NT Length | AA Length | score | probability |
|---|---|---|---|---|---|---|
| AI7503000985_784387_c3_1970 | 1322 | 5094 | 1425 | 474 | 781 | 1.3e-77 |

Description
pir:[LN:G71641] [AC:G71641 ] [PN:dihydrolipoamide dehydrogenase (pdhD) RP805] [GN:pdhD:RP805 ] [CL:dihydrolipoamide dehydrogenase:dihydrolipoamide dehydrogenase homology] [OR:Rickettsia prowazekii] [DB:pir2] >gp:[GI:e1343076:g3861332] [LN:RPXX04] [AC:AJ235273:AJ235269] [PN:DIHYDROLIPOAMIDE DEHYDROGENASE (pdhD)] [GN:RP805] [OR:Rickettsia prowazekii] [DB:genpept-bct1] [DE:Rickettsia prowazekii strain Madrid E, complete genome; segment4/4.] [LE:137655] [RE:139034] [DI:complement]

| ORF Name | NTID | AAID | NT Length | AA Length | score | probability |
|---|---|---|---|---|---|---|
| AI7503000985_787677_f2_636 | 1323 | 5095 | 483 | 160 | 246 | 6.4e-21 |

Description
gp:[GI:g2735506] [LN:SCU96107] [AC:U96107] [PN:SceB precursor] [GN:sceB]
[OR:Staphylococcus carnosus] [DB:genpept-bct2] [DE:Staphylococcus carnosus
N5,N10-methylenetetrahydromethanopterinreductase homolog, SceB precursor (sceB) and
putative transmembraneprotein genes, complete cds, and putative Na+/H+ antiporter
NhaC(nhaC) gene, partial cds.] [NT:major secreted protein] [LE:1894] [RE:2685]
[DI:direct]

| ORF Name | NTID | AAID | NT Length | AA Length | score | probability |
|---|---|---|---|---|---|---|
| AI7503000985_798838_c3_1987 | 1324 | 5096 | 1260 | 419 | 845 | 2.1e-84 |

Description
pir:[LN:E70368] [AC:E70368 ] [PN:histidinol dehydrogenase] [GN:hisD ] [CL:histidinol
dehydrogenase:histidinol dehydrogenase homology] [OR:Aquifex aeolicus] [DB:pir2]
>gp:[GI:g2983343] [LN:AE000707] [AC:AE000707:AE000657] [PN:histidinol dehydrogenase]
[GN:hisD] [OR:Aquifex aeolicus] [DB:genpept-bct2] [DE:Aquifex aeolicus section 39 of
109 of the complete genome.] [LE:5716] [RE:6996] [DI:complement]

| ORF Name | NTID | AAID | NT Length | AA Length | score | probability |
|---|---|---|---|---|---|---|
| AI7503000985_823518_f1_169 | 1325 | 5097 | 225 | 74 | | |

Description
NO-HIT

| ORF Name | NTID | AAID | NT Length | AA Length | score | probability |
|---|---|---|---|---|---|---|
| AI7503000985_832561_c3_2102 | 1326 | 5098 | 138 | 45 | | |

Description
NO-HIT

| ORF Name | NTID | AAID | NT Length | AA Length | score | probability |
|---|---|---|---|---|---|---|
| AI7503000985_86088_f2_835 | 1327 | 5099 | 369 | 122 | 154 | 3.6e-11 |

Description
gp:[GI:g2735504] [LN:SCU96107] [AC:U96107] [OR:Staphylococcus carnosus]
[DB:genpept-bct2] [DE:Staphylococcus carnosus
N5,N10-methylenetetrahydromethanopterinreductase homolog, SceB precursor (sceB) and
putative transmembraneprotein genes, complete cds, and putative Na+/H+ antiporter
NhaC(nhaC) gene, partial cds.] [NT:Orf1] [LE:<1] [RE:185] [DI:complement]

| ORF Name | NTID | AAID | NT Length | AA Length | score | probability |
|---|---|---|---|---|---|---|
| AI7503000985_860917_f3_1170 | 1328 | 5100 | 201 | 66 | 56 | 0.0095 |

Description
pir:[LN:A71605] [AC:A71605 ] [PN:probable integral membrane protein PFB0845w]
[GN:PFB0845w ] [OR:Plasmodium falciparum] [DB:pir2] >gp:[GI:g3845291] [LN:AE001420]
[AC:AE001420:AE001362] [PN:predicted integral membrane protein] [GN:PFB0845w]
[OR:Plasmodium falciparum] [SR:malaria parasite P. falciparum] [DB:genpept-inv2]
[DE:Plasmodium falciparum chromosome 2, section 57 of 73 of thecomplete sequence.]
[NT:predicted by GlimmerM] [LE:9688] [RE:10611] [DI:direct]

| ORF_Name | NTID | AAID | NT Length | AA Length | score | probability |
|---|---|---|---|---|---|---|
| AI7503000985_867255_f1_235 | 1329 | 5101 | 153 | 50 | | |

Description
NO-HIT

| ORF_Name | NTID | AAID | NT Length | AA Length | score | probability |
|---|---|---|---|---|---|---|
| AI7503000985_882143_c2_1927 | 1330 | 5102 | 255 | 84 | | |

Description
NO-HIT

| ORF_Name | NTID | AAID | NT Length | AA Length | score | probability |
|---|---|---|---|---|---|---|
| AI7503000985_891000_c2_1906 | 1331 | 5103 | 147 | 48 | | |

Description
NO-HIT

| ORF_Name | NTID | AAID | NT Length | AA Length | score | probability |
|---|---|---|---|---|---|---|
| AI7503000985_895253_c3_2019 | 1332 | 5104 | 510 | 169 | 303 | 5.8e-27 |

Description
pir:[LN:E71960] [AC:E71960 ] [PN:probable peptide methionine sulfoxide reductase]
[GN:jhp0210 ] [OR:Helicobacter pylori] [SR:strain J99, , strain J99] [SR:strain J99, ]
[DB:pir2] >gp:[GI:g4154731] [LN:AE001459] [AC:AE001459:AE001439] [PN:putative PEPTIDE
METHIONINE SULFOXIDE REDUCTASE] [GN:jhp0210] [OR:Helicobacter pylori J99]
[DB:genpept-bct2] [DE:Helicobacter pylori, strain J99 section 20 of 132 of the
completegenome.] [NT:similar to H. pylori 26695 gene HP0224] [LE:4882] [RE:5961]
[DI:direct]

| ORF_Name | NTID | AAID | NT Length | AA Length | score | probability |
|---|---|---|---|---|---|---|
| AI7503000985_901377_c2_1785 | 1333 | 5105 | 327 | 108 | | |

Description
NO-HIT

| ORF_Name | NTID | AAID | NT Length | AA Length | score | probability |
|---|---|---|---|---|---|---|
| AI7503000985_901377_f2_596 | 1334 | 5106 | 129 | 42 | | |

Description
NO-HIT

| ORF_Name | NTID | AAID | NT Length | AA Length | score | probability |
|---|---|---|---|---|---|---|
| AI7503000985_953142_f1_219 | 1335 | 5107 | 954 | 317 | 228 | 5.1e-19 |

Description
sp:[LN:YOBS_MYCTU] [AC:Q50648] [GN:MTCY227.28C] [OR:MYCOBACTERIUM TUBERCULOSIS]
[DE:HYPOTHETICAL 26.2 KD PROTEIN CY227.28C] [SP:Q50648] [DB:swissprot] >pir:[LN:D70724]
[AC:D70724 ] [PN:hypothetical protein Rv2573] [GN:Rv2573 ] [OR:Mycobacterium
tuberculosis] [DB:pir2] >gp:[GI:e256179:g1478239] [LN:MTCY227] [AC:Z77724:AL123456]
[PN:hypothetical protein Rv2573] [GN:Rv2573] [OR:Mycobacterium tuberculosis]
[DB:genpept-bct1] [DE:Mycobacterium tuberculosis H37Rv complete genome; segment
114/162.] [NT:Rv2573, (MTCY227.28c), len: 246. Unknown but some] [SP:Q50648] [LE:5598]
[RE:6338] [DI:direct]

| ORF Name | NTID | AAID | NT Length | AA Length | score | probability |
|---|---|---|---|---|---|---|
| AI7503000985_953930_f2_838 | 1336 | 5108 | 132 | 43 | | |

Description
NO-HIT

| ORF Name | NTID | AAID | NT Length | AA Length | score | probability |
|---|---|---|---|---|---|---|
| AI7503000985_961562_c1_1401 | 1337 | 5109 | 186 | 61 | | |

Description
NO-HIT

| ORF Name | NTID | AAID | NT Length | AA Length | score | probability |
|---|---|---|---|---|---|---|
| AI7503000985_968800_c2_1796 | 1338 | 5110 | 804 | 267 | 1031 | 4.2e-104 |

Description
gp:[GI:e244971:g1340128] [LN:SA1234] [AC:X97985] [OR:Staphylococcus aureus] [DB:genpept-bct1] [DE:S.aureus orfs 1,2,3 & 4.] [NT:ORF1] [LE:537] [RE:1304] [DI:direct]

| ORF Name | NTID | AAID | NT Length | AA Length | score | probability |
|---|---|---|---|---|---|---|
| AI7503000985_9766375_f1_90 | 1339 | 5111 | 162 | 53 | | |

Description
NO-HIT

| ORF Name | NTID | AAID | NT Length | AA Length | score | probability |
|---|---|---|---|---|---|---|
| AI7503000985_9770801_f2_621 | 1340 | 5112 | 138 | 45 | | |

Description
NO-HIT

| ORF Name | NTID | AAID | NT Length | AA Length | score | probability |
|---|---|---|---|---|---|---|
| AI7503000985_978965_c3_2055 | 1341 | 5113 | 213 | 70 | | |

Description
NO-HIT

| ORF Name | NTID | AAID | NT Length | AA Length | score | probability |
|---|---|---|---|---|---|---|
| AI7503000985_986312_f2_447 | 1342 | 5114 | 168 | 55 | | |

Description
NO-HIT

| ORF Name | NTID | AAID | NT Length | AA Length | score | probability |
|---|---|---|---|---|---|---|
| AI7503000985_9875333_c1_1552 | 1343 | 5115 | 1533 | 510 | 1134 | 5.1e-115 |

Description
sp:[LN:DHAL_VIBCH] [AC:P23240] [GN:ALDA] [OR:VIBRIO CHOLERAE] [EC:1.2.1.3] [DE:ALDEHYDE DEHYDROGENASE,] [SP:P23240] [DB:swissprot] >gp:[GI:g155276] [LN:VIBTAGALDA] [AC:M60658] [PN:aldehyde dehydrogenase] [GN:aldA] [OR:Vibrio cholerae] [SR:V. cholerae DNA] [DB:genpept-bct1] [EC:1.2.1.3] [DE:Vibrio cholerae aldehyde dehydrogenase gene, complete cds, and tagAgene, 5' end.] [LE:419] [RE:1939] [DI:direct] >gp:[GI:g3004925] [LN:AF034434] [AC:AF034434] [PN:aldehyde dehydrogenase] [GN:aldA] [OR:Vibrio cholerae] [DB:genpept-bct2] [DE:Vibrio cholerae pathogenicity island, putative transposase,aldehyde dehydrogenase (aldA), toxR-activated gene A protein(tagA), putative inner membrane protein, and putative zincmetalloprotease genes, complete cds; and toxR-activated gene Dprotein (tagD) gene, partial cds.] [NT:AldA] [LE:2388] [RE:3908] [DI:complement]

| ORF Name | NTID | AAID | NT Length | AA Length | score | probability |
|---|---|---|---|---|---|---|
| AI7503000985_9928200_f1_189 | 1344 | 5116 | 159 | 52 | | |

Description
NO-HIT

| ORF Name | NTID | AAID | NT Length | AA Length | score | probability |
|---|---|---|---|---|---|---|
| AI7503000985_9944635_f2_631 | 1345 | 5117 | 135 | 44 | | |

Description
NO-HIT

| ORF Name | NTID | AAID | NT Length | AA Length | score | probability |
|---|---|---|---|---|---|---|
| AI7503000985_995300_f1_28 | 1346 | 5118 | 204 | 67 | 70 | 0.048 |

Description
gp:[GI:g1173895] [LN:PFU41075] [AC:U41075] [PN:p82] [GN:RAP-1] [OR:Plasmodium falciparum] [SR:malaria parasite strain=IndJ-1 (clone 1 of Indian isolate J)] [DB:genpept-inv2] [DE:Plasmodium falciparum strain IndJ-1 rhoptry-associated protein 1(RAP-1) gene, partial cds.] [NT:rhoptry-associated protein 1; localized to rhoptry] [LE:<1] [RE:>461] [DI:direct]

| ORF Name | NTID | AAID | NT Length | AA Length | score | probability |
|---|---|---|---|---|---|---|
| AI7503000985_9954012_f1_333 | 1347 | 5119 | 141 | 46 | | |

Description
NO-HIT

| ORF Name | NTID | AAID | NT Length | AA Length | score | probability |
|---|---|---|---|---|---|---|
| AI7503000986_10317307_f2_121 | 1348 | 5120 | 267 | 88 | 81 | 0.016 |

Description sp:[LN:TAGB_BACSU] [AC:P27621] [GN:TAGB] [OR:BACILLUS SUBTILIS] [DE:TEICHOIC ACID BIOSYNTHESIS PROTEIN B PRECURSOR] [SP:P27621] [DB:swissprot] >pir:[LN:C49757] [AC:C49757:C69720 ] [PN:polyglycerol phosphate techoic acid biosynthesis protein tagB ] [GN:tagB ] [OR:Bacillus subtilis] [DB:pir2] >gp:[GI:g143725] [LN:BACTAGABCD] [AC:M57497] [GN:tagB] [OR:Bacillus subtilis] [SR:B.subtilis (strain 168) DNA] [DB:genpept-bct1] [DE:B.subtilis tagA, tagB, tagC and tagD genes, complete cds.] [NT:putative] [LE:1603] [RE:2748] [DI:direct] >gp:[GI:e1184482:g2636102] [LN:BSUB0019] [AC:Z99122:AL009126] [GN:tagB] [FN:polyglycerol phosphate assembly and export] [OR:Bacillus subtilis] [DB:genpept-bct1] [DE:Bacillus subtilis complete genome (section 19 of 21): from 3597091to 3809700.] [SP:P27621] [LE:84143] [RE:85288] [DI:direct] >gp:[GI:e1184482:g2636102] [LN:BSUB0019] [AC:Z99122:AL009126] [GN:tagB] [FN:polyglycerol phosphate assembly and export] [OR:Bacillus subtilis] [DB:genpept] [DE:Bacillus subtilis complete genome (section 19 of 21): from 3597091to 3809700.] [SP:P27621] [LE:84143] [RE:85288] [DI:direct]

| ORF Name | NTID | AAID | NT Length | AA Length | score | probability |
|---|---|---|---|---|---|---|
| AI7503000986_10626525_f1_58 | 1349 | 5121 | 1023 | 340 | 810 | 1.1e-80 |

Description pir:[LN:E69831] [AC:E69831 ] [PN:conserved hypothetical protein yhfP] [GN:yhfP ] [CL:Bacillus subtilis conserved hypothetical protein yhfP] [OR:Bacillus subtilis] [DB:pir2] >gp:[GI:e1183034:g2633368] [LN:BSUB0006] [AC:Z99109:AL009126] [GN:yhfP] [FN:unknown] [OR:Bacillus subtilis] [DB:genpept-bct1] [DE:Bacillus subtilis complete genome (section 6 of 21): from 999501 to1209906.] [NT:similar to hypothetical proteins] [LE:106496] [RE:107488] [DI:direct] >gp:[GI:e324995:g2226252] [LN:BSY14084] [AC:Y14084] [PN:hypothetical protein] [GN:yhfP] [OR:Bacillus subtilis] [DB:genpept-bct1] [DE:B.subtilis chromosomal DNA, region 78-80 degrees: aprE to comK.] [NT:high similarity to yhdH from E.coli (Swiss Prot] [LE:924] [RE:1916] [DI:direct]

| ORF Name | NTID | AAID | NT Length | AA Length | score | probability |
|---|---|---|---|---|---|---|
| AI7503000986_10976625_c1_226 | 1350 | 5122 | 888 | 295 | 870 | 4.8e-87 |

Description sp:[LN:YHXD_BACSU] [AC:P40398:O07554] [GN:YHXD] [OR:BACILLUS SUBTILIS] [EC:1.-.-.-] [DE:(EC 1.-.-.-) (ORFY)] [SP:P40398:O07554] [DB:swissprot] >pir:[LN:E69835] [AC:E69835:S43612 ] [PN:ribitol dehydrogenase homolog yhxD] [GN:yhxD ] [CL:short-chain alcohol dehydrogenase homology] [OR:Bacillus subtilis] [DB:pir2] >gp:[GI:e1183045:g2633379] [LN:BSUB0006] [AC:Z99109:AL009126] [GN:yhxD] [FN:unknown] [OR:Bacillus subtilis] [DB:genpept-bct1] [DE:Bacillus subtilis complete genome (section 6 of 21): from 999501 to1209940.] [NT:similar to ribitol dehydrogenase] [SP:P40398] [LE:117706] [RE:118605] [DI:complement] >gp:[GI:e324973:g2226172] [LN:BSY14081] [AC:Y14081] [PN:hypothetical protein] [GN:yhxD] [OR:Bacillus subtilis] [DB:genpept-bct1] [DE:Bacillus subtilis chromosomal DNA, region 92 degrees: regionbetween comK and addAB.] [NT:bp 1-501 overlaps with bp 1525-1947 (end) from EMBL] [SP:P40398] [LE:1] [RE:900] [DI:complement]

| ORF Name | NTID | AAID | NT Length | AA Length | score | probability |
|---|---|---|---|---|---|---|
| AI7503000986_11114677_f2_73 | 1351 | 5123 | 204 | 67 | | |

Description

NO-HIT

| ORF Name | NTID | AAID | NT Length | AA Length | score | probability |
|---|---|---|---|---|---|---|
| AI7503000986_11740778_f2_80 | 1352 | 5124 | 216 | 71 | | |

Description
NO-HIT

| ORF Name | NTID | AAID | NT Length | AA Length | score | probability |
|---|---|---|---|---|---|---|
| AI7503000986_1207250_c3_313 | 1353 | 5125 | 480 | 159 | 89 | 0.032 |

Description
sp:[LN:ATP6_APIME] [AC:Q00275] [GN:ATP6] [OR:APIS MELLIFERA] [SR:,HONEYBEE]
[EC:3.6.1.34] [DE:ATP SYNTHASE A CHAIN, (PROTEIN 6)] [SP:Q00275] [DB:swissprot]
>pir:[LN:A42622] [AC:A42622:S52964 ] [PN:H+-transporting ATP synthase, chain 6]
[CL:H+-transporting ATP synthase protein 6] [OR:mitochondrion Apis mellifera] [SR:,
honeybee] [EC:3.6.1.34] [DB:pir2] >gp:[GI:g552442] [LN:AMFGENOM] [AC:L06178] [PN:ATPase
subunit 6] [OR:Mitochondrion Apis mellifera ligustica] [SR:common honeybee]
[DB:genpept-invl] [DE:Apis mellifera ligustica complete mitochondrial genome.]
[LE:4584] [RE:5264] [DI:direct] >gp:[GI:g552451] [LN:AMFMTATPAS] [AC:M87065]
[PN:adenosine triphosphatase 6] [GN:ATPase6] [OR:Mitochondrion Apis mellifera
ligustica] [SR:Mitochondrion Apis mellifera ligustica (organelle Mitochondrio]
[DB:genpept-invl] [DE:Apis mellifera mitochondrial adenosine triphosphatase 8
(ATPase8)gene, complete cds; adenosine triphosphatase 6 (ATPase6) gene,complete cds.]
[LE:141] [RE:821] [DI:direct]

| ORF Name | NTID | AAID | NT Length | AA Length | score | probability |
|---|---|---|---|---|---|---|
| AI7503000986_1290703_c1_227 | 1354 | 5126 | 141 | 46 | | |

Description
NO-HIT

| ORF Name | NTID | AAID | NT Length | AA Length | score | probability |
|---|---|---|---|---|---|---|
| AI7503000986_14644018_f1_39 | 1355 | 5127 | 969 | 322 | 324 | 3.4e-29 |

Description
gp:[GI:g2196513] [LN:SEU77778] [AC:U77778:U29130] [PN:putative membrane protein]
[GN:epiH] [FN:involved in epidermin secretion] [OR:Staphylococcus epidermidis]
[DB:genpept-bct1] [DE:Staphylococcus epidermidis plasmid pTue32 putative ABC
transportersubunits (epiG), (epiE), and (epiF), putative membrane protein(epiH), EpiT'
(epiT') and EpiT'' (epiT'') genes, complete cds.] [NT:EpiH] [LE:2615] [RE:3607]
[DI:direct]

| ORF Name | NTID | AAID | NT Length | AA Length | score | probability |
|---|---|---|---|---|---|---|
| AI7503000986_14647750_c2_238 | 1356 | 5128 | 141 | 46 | | |

Description
NO-HIT

| ORF Name | NTID | AAID | NT Length | AA Length | score | probability |
|---|---|---|---|---|---|---|
| AI7503000986_14656952_f2_93 | 1357 | 5129 | 633 | 210 | | |

Description
NO-HIT

| ORF_Name | NTID | AAID | NT Length | AA Length | score | probability |
|---|---|---|---|---|---|---|
| AI7503000986_15035952_f2_91 | 1358 | 5130 | 477 | 158 | | |

Description
NO-HIT

| ORF_Name | NTID | AAID | NT Length | AA Length | score | probability |
|---|---|---|---|---|---|---|
| AI7503000986_15117317_c2_243 | 1359 | 5131 | 2184 | 727 | 953 | 2.4e-102 |

Description
sp:[LN:TAGF_BACSU] [AC:P13485] [GN:TAGF:RODC:TAG3] [OR:BACILLUS SUBTILIS] [DE:TEICHOIC
ACID BIOSYNTHESIS PROTEIN F] [SP:P13485] [DB:swissprot] >pir:[LN:S06049]
[AC:S06049:G69720 ] [PN:probable CDPglycerol glycerophosphotransferase,
:CDP-glycerol:polyglycerol phosphate glycero-phosphotransferase tagF:rodC
protein:teichoic-acid synthase] [GN:rodC:tag-3:tagF ] [OR:Bacillus subtilis]
[EC:2.7.8.12] [DB:pir2] [MP:310 degrees ] >gp:[GI:g40100] [LN:BSRODC] [AC:X15200]
[OR:Bacillus subtilis] [DB:genpept-bct1] [DE:Bacillus subtilis rodC operon.] [NT:rodC
(tag3) polypeptide (AA 1-746)] [SP:P13485] [LE:2178] [RE:4418] [DI:direct]
>gp:[GI:e1184478:g2636098] [LN:BSUB0019] [AC:Z99122:AL009126]
[PN:CDP-glycerol:polyglycerol phosphate] [GN:tagF] [FN:teichoic acid biosynthesis]
[OR:Bacillus subtilis] [DB:genpept-bct1] [DE:Bacillus subtilis complete genome (section
19 of 21): from 3597091to 3809700.] [NT:alternate gene name: rodC] [SP:P13485]
[LE:78129] [RE:80369] [DI:complement] >gp:[GI:e1184478:g2636098] [LN:BSUB0019]
[AC:Z99122:AL009126] [PN:CDP-glycerol:polyglycerol phosphate] [GN:tagF] [FN:teichoic
acid biosynthesis] [OR:Bacillus subtilis] [DB:genpept] [DE:Bacillus subtilis complete
genome (section 19 of 21): from 3597091to 3809700.] [NT:alternate gene name: rodC]
[SP:P13485] [LE:78129] [RE:80369] [DI:complement]

| ORF_Name | NTID | AAID | NT Length | AA Length | score | probability |
|---|---|---|---|---|---|---|
| AI7503000986_15136562_c2_253 | 1360 | 5132 | 1500 | 499 | 1636 | 3.2e-168 |

Description
gp:[GI:d1039113:g4514332] [LN:AB013369] [AC:AB013369] [OR:Bacillus halodurans]
[SR:Bacillus halodurans (strain:C-125) DNA] [DB:genpept-bct1] [DE:Bacillus halodurans
C-125 yesT and comEC genes, partial andcomplete cds.] [NT:unknown] [LE:4328] [RE:5830]
[DI:direct]

| ORF_Name | NTID | AAID | NT Length | AA Length | score | probability |
|---|---|---|---|---|---|---|
| AI7503000986_15829135_c2_237 | 1361 | 5133 | 204 | 67 | 105 | 1.0e-05 |

Description
pir:[LN:E69764] [AC:E69764 ] [PN:hypothetical protein ycnI] [GN:ycnI ] [OR:Bacillus
subtilis] [DB:pir2] >gp:[GI:e1182361:g2632695] [LN:BSUB0003] [AC:Z99106:AL009126]
[GN:ycnI] [OR:Bacillus subtilis] [FN:unknown] [DB:genpept-bct1] [DE:Bacillus subtilis
complete genome (section 3 of 21): from 402751 to611850.] [LE:43004] [RE:43618]
[DI:complement] >gp:[GI:d1009660:g1805463] [LN:D50453] [AC:D50453] [GN:ycnI]
[OR:Bacillus subtilis] [SR:Bacillus subtilis (strain:168 trpC2) DNA] [DB:genpept-bct1]
[DE:Bacillus subtilis DNA for 25-36 degree region containing theamyE-srfA region,
complete cds.] [LE:125407] [RE:126021] [DI:complement]

| ORF_Name | NTID | AAID | NT Length | AA Length | score | probability |
|---|---|---|---|---|---|---|
| AI7503000986_159377_c3_317 | 1362 | 5134 | 171 | 56 | | |

Description
NO-HIT

| ORF Name | NTID | AAID | NT Length | AA Length | score | probability |
|---|---|---|---|---|---|---|
| AI7503000986_17047575_f3_150 | 1363 | 5135 | 171 | 56 | | |

Description
NO-HIT

| ORF Name | NTID | AAID | NT Length | AA Length | score | probability |
|---|---|---|---|---|---|---|
| AI7503000986_174218_c1_209 | 1364 | 5136 | 1989 | 662 | 1225 | 1.1e-124 |

Description
sp:[LN:YHCA_BACSU] [AC:P54585] [GN:YHCA] [OR:BACILLUS SUBTILIS] [DE:HYPOTHETICAL 58.3 KD PROTEIN IN GLPD-CSPB INTERGENIC REGION] [SP:P54585] [DB:swissprot] >pir:[LN:E69821] [AC:E69821 ] [PN:multidrug resistance protein homolog yhcA] [GN:yhcA ] [CL:lincomycin-resistance protein lmrB] [OR:Bacillus subtilis] [DB:pir2] >gp:[GI:e1182890:g2633224] [LN:BSUB0005] [AC:Z99108:AL009126] [GN:yhcA] [FN:unknown] [OR:Bacillus subtilis] [DB:genpept-bct1] [DE:Bacillus subtilis complete genome (section 5 of 21): from 802821 to1011250.] [NT:similar to multidrug resistance protein] [SP:P54585] [LE:174464] [RE:176062] [DI:direct]

| ORF Name | NTID | AAID | NT Length | AA Length | score | probability |
|---|---|---|---|---|---|---|
| AI7503000986_179653_c3_325 | 1365 | 5137 | 666 | 221 | 100 | 0.015 |

Description
sp:[LN:TCR2_BACSU] [AC:P14512] [GN:TET] [OR:BACILLUS SUBTILIS] [DE:TETRACYCLINE RESISTANCE PROTEIN] [SP:P14512] [DB:swissprot] >pir:[LN:S42238] [AC:S42238 ] [PN:tetracyclin resistance protein] [GN:tet ] [CL:tetracycline resistance protein] [OR:Staphylococcus aureus] [DB:pir2] >gp:[GI:g476735] [LN:PNS1CG] [AC:M16217] [GN:tet] [OR:Plasmid pNS1] [SR:Plasmid pNS1 from Staphylococcus aureus, plasmid pTP5 DNA] [DB:genpept-bct1] [DE:Plasmid pNS1 (from Staphylococcus aureus) encodingtetracycline-resistance (tet), complete genome.] [LE:305] [RE:1684] [DI:direct] >gp:[GI:g456770] [LN:S67449] [AC:S67449] [PN:Tet(K)] [GN:tet(K)] [OR:Staphylococcus aureus] [SR:Staphylococcus aureus pT181] [DB:genpept-bct1] [DE:tet(K)=tetracycline efflux protein [Staphylococcus aureus, pT181,Plasmid, 1380 nt].] [NT:tetracycline efflux protein; This sequence comes] [LE:1] [RE:1380] [DI:direct] >gp:[GI:g1052998] [LN:SAU38428] [AC:U38428] [PN:tetracycline resistance protein] [GN:tet] [OR:Staphylococcus aureus] [SR:Staphylococcus aureus plasmid pKH6] [DB:genpept-bct1] [DE:Staphylococcus aureus tetracycline resistance plasmid pKH6,complete sequence.] [LE:321] [RE:1700] [DI:direct] >gp:[GI:g1053140] [LN:SAU38656] [AC:U38656] [PN:tetracycline resistance protein] [GN:tet] [OR:Staphylococcus aureus] [SR:Staphylococcus aureus plasmid pKH1] [DB:genpept-bct1] [DE:Staphylococcus aureus tetracycline resistance plasmid pKH1, tetgene, complete cds.] [LE:436] [RE:1815] [DI:direct]

| ORF Name | NTID | AAID | NT Length | AA Length | score | probability |
|---|---|---|---|---|---|---|
| AI7503000986_19548755_f3_132 | 1366 | 5138 | 168 | 55 | | |

Description
NO-HIT

| ORF Name | NTID | AAID | NT Length | AA Length | score | probability |
|---|---|---|---|---|---|---|
| AI7503000986_1970178_f3_146 | 1367 | 5139 | 219 | 72 | | |

Description
NO-HIT

| ORF Name | NTID | AAID | NT Length | AA Length | score | probability |
|---|---|---|---|---|---|---|
| AI7503000986_19742962_c1_221 | 1368 | 5140 | 1026 | 341 | 423 | 1.1e-39 |

Description
gp:[GI:e1486019:g4995689] [LN:LLA011653] [AC:AJ011653] [PN:aldose 1-epimerase] [GN:galM] [FN:mutarotase] [OR:Lactococcus lactis] [DB:genpept-bct1] [EC:5.1.3.3] [DE:Lactococcus lactis (strain MG1363) galactose operon (galAMKTEgenes).] [LE:1990] [RE:3009] [DI:direct]

| ORF Name | NTID | AAID | NT Length | AA Length | score | probability |
|---|---|---|---|---|---|---|
| AI7503000986_19960885_c1_228 | 1369 | 5141 | 156 | 51 | | |

Description
NO-HIT

| ORF Name | NTID | AAID | NT Length | AA Length | score | probability |
|---|---|---|---|---|---|---|
| AI7503000986_20579752_c3_319 | 1370 | 5142 | 150 | 49 | | |

Description
NO-HIT

| ORF Name | NTID | AAID | NT Length | AA Length | score | probability |
|---|---|---|---|---|---|---|
| AI7503000986_20580443_c3_310 | 1371 | 5143 | 333 | 110 | 173 | 3.5e-13 |

Description
gp:[GI:g3582220] [LN:AE001272] [AC:AE001272] [PN:conserved hypothetical protein] [GN:ORF00047] [OR:Lactococcus lactis] [DB:genpept-bct2] [DE:Lactococcus lactis DPC3147 plasmid pMRC01, complete plasmidsequence.] [NT:similar to GB:X69895 SP:P39044 PID:40067 percent] [LE:44384] [RE:44728] [DI:direct]

| ORF Name | NTID | AAID | NT Length | AA Length | score | probability |
|---|---|---|---|---|---|---|
| AI7503000986_20718790_f3_138 | 1372 | 5144 | 150 | 49 | | |

Description
NO-HIT

| ORF Name | NTID | AAID | NT Length | AA Length | score | probability |
|---|---|---|---|---|---|---|
| AI7503000986_20789507_c2_280 | 1373 | 5145 | 186 | 61 | | |

Description
NO-HIT

| ORF Name | NTID | AAID | NT Length | AA Length | score | probability |
|---|---|---|---|---|---|---|
| AI7503000986_20897125_c1_212 | 1374 | 5146 | 975 | 324 | 504 | 2.9e-48 |

Description
pir:[LN:H69806] [AC:H69806 ] [PN:divalent cation transport protein homolog yfjQ] [GN:yfjQ ] [CL:magnesium and cobalt transport protein] [OR:Bacillus subtilis] [DB:pir2] >gp:[GI:e1182790:g2633124] [LN:BSUB0005] [AC:Z99108:AL009126] [GN:yfjQ] [FN:unknown] [OR:Bacillus subtilis] [DB:genpept-bct1] [DE:Bacillus subtilis complete genome (section 5 of 21): from 802821 to1011250.] [NT:similar to divalent cation transport protein] [LE:68033] [RE:68992] [DI:complement] >gp:[GI:d1025214:g2780401] [LN:D78509] [AC:D78509] [PN:YfjQ] [OR:Bacillus subtilis] [SR:Bacillus subtilis (strain:AC327) DNA] [DB:genpept-bct1] [DE:Bacillus subtilis YfjG-YfjR genes, complete cds.] [LE:17333] [RE:18292] [DI:direct]

| ORF Name | NTID | AAID | NT Length | AA Length | score | probability |
|---|---|---|---|---|---|---|
| AI7503000986_21676937_c1_190 | 1375 | 5147 | 132 | 43 | | |

Description
NO-HIT

| ORF Name | NTID | AAID | NT Length | AA Length | score | probability |
|---|---|---|---|---|---|---|
| AI7503000986_22074200_f3_184 | 1376 | 5148 | 126 | 42 | | |

Description
NO-HIT

| ORF Name | NTID | AAID | NT Length | AA Length | score | probability |
|---|---|---|---|---|---|---|
| AI7503000986_22277215_f3_142 | 1377 | 5149 | 1164 | 387 | 109 | 1.5e-05 |

Description
pir:[LN:C44863] [AC:C44863 ] [PN:R45 antigen] [OR:Plasmodium falciparum] [DB:pir3]

| ORF Name | NTID | AAID | NT Length | AA Length | score | probability |
|---|---|---|---|---|---|---|
| AI7503000986_22455213_f3_169 | 1378 | 5150 | 687 | 228 | 411 | 2.1e-38 |

Description
gp:[GI:g4982229] [LN:AE001807] [AC:AE001807:AE000512] [PN:response regulator DrrA]
[GN:TM1655] [OR:Thermotoga maritima] [DB:genpept-bct2] [DE:Thermotoga maritima section
119 of 136 of the complete genome.] [NT:similar to PID:1575577 GB:AE000512 percent]
[LE:12477] [RE:13220] [DI:complement]

| ORF Name | NTID | AAID | NT Length | AA Length | score | probability |
|---|---|---|---|---|---|---|
| AI7503000986_22867942_c1_224 | 1379 | 5151 | 711 | 236 | 417 | 4.8e-39 |

Description
gp:[GI:g4262236] [LN:ATAC006200] [AC:AC006200] [PN:putative ribose 5-phosphate
isomerase] [GN:F10A8.17] [OR:Arabidopsis thaliana] [SR:thale cress] [DB:genpept-pln2]
[DE:Arabidopsis thaliana chromosome II BAC F10A8 genomic sequence,complete sequence.]
[LE:58788] [RE:59585] [DI:complement]

| ORF Name | NTID | AAID | NT Length | AA Length | score | probability |
|---|---|---|---|---|---|---|
| AI7503000986_22869687_c1_186 | 1380 | 5152 | 438 | 145 | 143 | 5.2e-10 |

Description
pir:[LN:A64946] [AC:A64946 ] [PN:hypothetical protein b1841] [CL:copper resistance
protein pcoC] [OR:Escherichia coli] [DB:pir2] >gp:[GI:g1788146] [LN:AE000278]
[AC:AE000278:U00096] [PN:orf, hypothetical protein] [GN:b1841] [FN:orf; Unknown]
[OR:Escherichia coli] [DB:genpept-bct2] [DE:Escherichia coli K-12 MG1655 section 168 of
400 of the completegenome.] [NT:f124; This 124 aa ORF is 39 pct identical (6 gaps)]
[LE:4445] [RE:4819] [DI:complement]

| ORF Name | NTID | AAID | NT Length | AA Length | score | probability |
|---|---|---|---|---|---|---|
| AI7503000986_23556552_c2_240 | 1381 | 5153 | 405 | 134 | 123 | 6.9e-08 |

Description
sp:[LN:YCX1_PORPU] [AC:P51192] [OR:PORPHYRA PURPUREA] [DE:HYPOTHETICAL 20.1 KD PROTEIN
IN YCF37-PSAF INTERGENIC REGION (ORF174)] [SP:P51192] [DB:swissprot] >pir:[LN:S73113]
[AC:S73113 ] [PN:hypothetical protein 174] [OR:chloroplast Porphyra purpurea] [DB:pir2]

| ORF Name | NTID | AAID | NT Length | AA Length | score | probability |
|---|---|---|---|---|---|---|
| AI7503000986_23601557_f1_10 | 1382 | 5154 | 201 | 66 | | |

Description
NO-HIT

| ORF Name | NTID | AAID | NT Length | AA Length | score | probability |
|---|---|---|---|---|---|---|
| AI7503000986_23601577_f3_144 | 1383 | 5155 | 186 | 61 | | |

Description
NO-HIT

| ORF Name | NTID | AAID | NT Length | AA Length | score | probability |
|---|---|---|---|---|---|---|
| AI7503000986_23611437_c1_188 | 1384 | 5156 | 135 | 44 | | |

Description
NO-HIT

| ORF Name | NTID | AAID | NT Length | AA Length | score | probability |
|---|---|---|---|---|---|---|
| AI7503000986_23839193_c1_193 | 1385 | 5157 | 1614 | 537 | 1324 | 3.7e-135 |

Description
pir:[LN:F69649] [AC:F69649 ] [PN:L-lactate permease lctP] [GN:lctP ] [CL:L-lactate permease] [OR:Bacillus subtilis] [DB:pir2] >gp:[GI:e1182258:g2632592] [LN:BSUB0002] [AC:Z99105:AL009126] [PN:L-lactate permease] [GN:lctP] [OR:Bacillus subtilis] [DB:genpept-bct1] [DE:Bacillus subtilis complete genome (section 2 of 21): from 194651 to415810.] [NT:alternate gene name: ycgC] [LE:135677] [RE:137302] [DI:direct]

| ORF Name | NTID | AAID | NT Length | AA Length | score | probability |
|---|---|---|---|---|---|---|
| AI7503000986_23876887_f1_60 | 1386 | 5158 | 123 | 40 | | |

Description
NO-HIT

| ORF Name | NTID | AAID | NT Length | AA Length | score | probability |
|---|---|---|---|---|---|---|
| AI7503000986_23923412_f1_31 | 1387 | 5159 | 225 | 74 | | |

Description
NO-HIT

| ORF Name | NTID | AAID | NT Length | AA Length | score | probability |
|---|---|---|---|---|---|---|
| AI7503000986_23929627_f3_160 | 1388 | 5160 | 177 | 58 | 46 | 0.046 |

Description
pir:[LN:I40601] [AC:I40601:S70950 ] [PN:mobilization protein] [GN:mobA ] [OR:Bacteroides vulgatus] [DB:pir2] >gp:[GI:g1079659] [LN:BVU38243] [AC:U38243:M72418] [PN:mobilization protein] [GN:mobA] [FN:conjugal transfer of Tn4555] [OR:Bacteroides vulgatus] [DB:genpept-bct1] [DE:Bacteroides vulgatus beta-lactamase (cfxA) gene, complete cds andmobilization protein (mobA) gene, complete cds.] [LE:1208] [RE:2611] [DI:complement]

| ORF Name | NTID | AAID | NT Length | AA Length | score | probability |
|---|---|---|---|---|---|---|
| AI7503000986_24250317_c1_203 | 1389 | 5161 | 156 | 51 | | |

Description
NO-HIT

| ORF_Name | NTID | AAID | NT Length | AA Length | score | probability |
|---|---|---|---|---|---|---|
| AI7503000986_24267567_f3_163 | 1390 | 5162 | 645 | 214 | 99 | 0.0046 |

Description
pir:[LN:C70649] [AC:C70649 ] [PN:hypothetical protein Rv3058c] [GN:Rv3058c ]
[OR:Mycobacterium tuberculosis] [DB:pir2] >gp:[GI:e290931:g1781155] [LN:MTCY22D7]
[AC:Z83866:AL123456] [PN:hypothetical protein Rv3058c] [GN:Rv3058c] [OR:Mycobacterium
tuberculosis] [DB:genpept-bct1] [DE:Mycobacterium tuberculosis H37Rv complete genome;
segment 133/162.] [NT:Rv3058c, (MTCY22D7.23), len: 216. Function:] [LE:4546] [RE:5196]
[DI:complement]

| ORF_Name | NTID | AAID | NT Length | AA Length | score | probability |
|---|---|---|---|---|---|---|
| AI7503000986_24394175_f3_151 | 1391 | 5163 | 159 | 52 | | |

Description
NO-HIT

| ORF_Name | NTID | AAID | NT Length | AA Length | score | probability |
|---|---|---|---|---|---|---|
| AI7503000986_24407827_c2_266 | 1392 | 5164 | 561 | 186 | | |

Description
NO-HIT

| ORF_Name | NTID | AAID | NT Length | AA Length | score | probability |
|---|---|---|---|---|---|---|
| AI7503000986_24412826_c3_323 | 1393 | 5165 | 963 | 320 | 286 | 3.7e-25 |

Description
sp:[LN:HUTG_KLEAE] [AC:P19452] [GN:HUTG] [OR:KLEBSIELLA AEROGENES] [EC:3.5.3.8]
[DE:(HISTIDINE UTILIZATION PROTEIN G) (FRAGMENT)] [SP:P19452] [DB:swissprot]
>gp:[GI:g149204] [LN:KPNHUTC] [AC:M34604] [OR:Klebsiella aerogenes] [SR:Klebsiella
aerogenes (strain W70) DNA] [DB:genpept-bct1] [DE:K.aerogenes histidine utilization
repressor C (hutC) gene, completecds.] [NT:histidine utilization repressor G] [LE:<1]
[RE:669] [DI:direct]

| ORF_Name | NTID | AAID | NT Length | AA Length | score | probability |
|---|---|---|---|---|---|---|
| AI7503000986_24415925_c1_211 | 1394 | 5166 | 903 | 300 | 282 | 9.7e-25 |

Description
gp:[GI:g1209223] [LN:ACCEST] [AC:L38252] [PN:esterase] [GN:est] [OR:Acinetobacter
lwoffii] [DB:genpept-bct1] [DE:Acinetobacter lwoffii orf1 and esterase (est) genes,
complete cds.] [LE:638] [RE:1549] [DI:direct]

| ORF_Name | NTID | AAID | NT Length | AA Length | score | probability |
|---|---|---|---|---|---|---|
| AI7503000986_24662825_c2_279 | 1395 | 5167 | 618 | 205 | 538 | 7.3e-52 |

Description
pir:[LN:H70068] [AC:H70068 ] [PN:hypothetical protein ywrF] [GN:ywrF] [OR:Bacillus
subtilis] [DB:pir2] >gp:[GI:e1184514:g2636133] [LN:BSUB0019] [AC:Z99122:AL009126]
[GN:ywrF] [FN:unknown] [OR:Bacillus subtilis] [DB:genpept-bct1] [DE:Bacillus subtilis
complete genome (section 19 of 21): from 3597091to 3809700.] [LE:119966] [RE:120583]
[DI:direct] >gp:[GI:e311284:g1929333] [LN:BSZ93767] [AC:Z93767] [GN:ywrF] [OR:Bacillus
subtilis] [DB:genpept-bct1] [DE:B.subtilis DNA; 15.2 kb fragment, from ywqN gene to
ywrO gene.] [LE:4588] [RE:5205] [DI:complement] >gp:[GI:e1184514:g2636133]
[LN:BSUB0019] [AC:Z99122:AL009126] [GN:ywrF] [FN:unknown] [OR:Bacillus subtilis]
[DB:genpept] [DE:Bacillus subtilis complete genome (section 19 of 21): from 3597091to
3809700.] [LE:119966] [RE:120583] [DI:direct]

| ORF Name | NTID | AAID | NT Length | AA Length | score | probability |
|---|---|---|---|---|---|---|
| AI7503000986_2470010_c1_191 | 1396 | 5168 | 723 | 240 | 157 | 1.3e-08 |

Description
gp:[GI:e1407791:g4493935] [LN:PFMAL3P5] [AC:AL034556] [GN:MAL3P5.8] [OR:Plasmodium falciparum] [SR:malaria parasite P. falciparum] [DB:genpept-inv1] [DE:Plasmodium falciparum MAL3P5, complete sequence.] [NT:predicted using hexExon; MAL3P5.8 (PFC0610c),] [LE:29992] [RE:33537] [DI:complement]

| ORF Name | NTID | AAID | NT Length | AA Length | score | probability |
|---|---|---|---|---|---|---|
| AI7503000986_24803386_c1_201 | 1397 | 5169 | 1080 | 359 | 215 | 1.4e-15 |

Description
pir:[LN:G70728] [AC:G70728 ] [PN:hypothetical protein Rv2563] [GN:Rv2563 ] [OR:Mycobacterium tuberculosis] [DB:pir2] >gp:[GI:e1299946:g3261618] [LN:MTCY9C4] [AC:Z77250:AL123456] [PN:hypothetical protein Rv2563] [GN:Rv2563] [OR:Mycobacterium tuberculosis] [DB:genpept-bct1] [DE:Mycobacterium tuberculosis H37Rv complete genome; segment 113/162.] [NT:Rv2563, (MTCY9C4.05c), len: 349. Unknown membrane] [LE:5757] [RE:6806] [DI:direct]

| ORF Name | NTID | AAID | NT Length | AA Length | score | probability |
|---|---|---|---|---|---|---|
| AI7503000986_2540907_c3_304 | 1398 | 5170 | 186 | 61 | | |

Description
NO-HIT

| ORF Name | NTID | AAID | NT Length | AA Length | score | probability |
|---|---|---|---|---|---|---|
| AI7503000986_25527188_c1_225 | 1399 | 5171 | 1137 | 378 | 830 | 8.3e-83 |

Description
pir:[LN:E69640] [AC:E69640 ] [PN:hippurate hydrolase hipO] [GN:hipO ] [CL:hippurate hydrolase] [OR:Bacillus subtilis] [DB:pir2] >gp:[GI:e1184178:g2635394] [LN:BSUB0015] [AC:Z99118:AL009126] [PN:hippurate hydrolase] [GN:hipO] [OR:Bacillus subtilis] [DB:genpept-bct1] [EC:3.5.1.32] [DE:Bacillus subtilis complete genome (section 15 of 21): from 2795131to 3013540.] [LE:203660] [RE:204910] [DI:complement] >gp:[GI:e1185802:g2635413] [LN:BSUB0016] [AC:Z99119:AL009126] [PN:hippurate hydrolase] [GN:hipO] [OR:Bacillus subtilis] [DB:genpept-bct1] [EC:3.5.1.32] [DE:Bacillus subtilis complete genome (section 16 of 21): from 2997771to 3213410.] [LE:1020] [RE:2270] [DI:complement] >gp:[GI:g2293256] [LN:AF008220] [AC:AF008220] [PN:putative hippurate hydrolase] [GN:hipO] [OR:Bacillus subtilis] [DB:genpept-bct2] [DE:Bacillus subtilis rrnB-dnaB genomic region.] [LE:178157] [RE:179407] [DI:direct]

| ORF Name | NTID | AAID | NT Length | AA Length | score | probability |
|---|---|---|---|---|---|---|
| AI7503000986_25551640_c1_214 | 1400 | 5172 | 861 | 286 | 112 | 0.0023 |

Description
gp:[GI:e1331922:g3758855] [LN:PFMAL3P6] [AC:Z98551] [GN:MAL3P6.11] [OR:Plasmodium falciparum] [SR:malaria parasite P. falciparum] [DB:genpept-inv1] [DE:Plasmodium falciparum MAL3P6, complete sequence.] [NT:predicted using hexExon; MAL3P6.11 (PFC0760c),] [LE:53772] [RE:63956] [DI:complement]

| ORF_Name | NTID | AAID | NT Length | AA Length | score | probability |
|---|---|---|---|---|---|---|
| AI7503000986_25579390_f1_50 | 1401 | 5173 | 1194 | 397 | 402 | 8.5e-37 |

Description
gp:[GI:e1294490:g3169038] [LN:SC1C3] [AC:AL023702] [PN:putative transferase] [GN:SC1C3.12] [OR:Streptomyces coelicolor] [DB:genpept-bct1] [DE:Streptomyces coelicolor cosmid 1C3.] [NT:SC1C3.12, possible transferase, len: 697 aa; weakly] [LE:13186] [RE:15279] [DI:direct]

| ORF_Name | NTID | AAID | NT Length | AA Length | score | probability |
|---|---|---|---|---|---|---|
| AI7503000986_25910952_c3_309 | 1402 | 5174 | 141 | 46 | | |

Description
NO-HIT

| ORF_Name | NTID | AAID | NT Length | AA Length | score | probability |
|---|---|---|---|---|---|---|
| AI7503000986_26753588_f1_44 | 1403 | 5175 | 1383 | 460 | 344 | 2.6e-31 |

Description
pir:[LN:H69762] [AC:H69762 ] [PN:two-component sensor histidine kinase homolog yclK] [GN:yclK ] [OR:Bacillus subtilis] [DB:pir2] >gp:[GI:e1182343:g2632677] [LN:BSUB0003] [AC:Z99106:AL009126] [GN:yclK] [FN:unknown] [OR:Bacillus subtilis] [DB:genpept-bct1] [DE:Bacillus subtilis complete genome (section 3 of 21): from 402751 to611850.] [NT:similar to two-component sensor histidine kinase] [LE:24077] [RE:25498] [DI:direct] >gp:[GI:d1009643:g1805446] [LN:D50453] [AC:D50453] [PN:homologue of alkaline phosphatase synthesis] [GN:yclK] [OR:Bacillus subtilis] [SR:Bacillus subtilis (strain:168 trpC2) DNA] [DB:genpept-bct1] [DE:Bacillus subtilis DNA for 25-36 degree region containing theamyE-srfA region, complete cds.] [LE:106480] [RE:107901] [DI:direct]

| ORF_Name | NTID | AAID | NT Length | AA Length | score | probability |
|---|---|---|---|---|---|---|
| AI7503000986_272550_c2_268 | 1404 | 5176 | 123 | 40 | | |

Description
NO-HIT

| ORF_Name | NTID | AAID | NT Length | AA Length | score | probability |
|---|---|---|---|---|---|---|
| AI7503000986_292883_c2_229 | 1405 | 5177 | 126 | 41 | | |

Description
NO-HIT

| ORF_Name | NTID | AAID | NT Length | AA Length | score | probability |
|---|---|---|---|---|---|---|
| AI7503000986_29565627_c3_286 | 1406 | 5178 | 879 | 292 | | |

Description
NO-HIT

| ORF_Name | NTID | AAID | NT Length | AA Length | score | probability |
|---|---|---|---|---|---|---|
| AI7503000986_30476575_c1_216 | 1407 | 5179 | 165 | 54 | | |

Description
NO-HIT

| ORF Name | NTID | AAID | NT Length | AA Length | score | probability |
|---|---|---|---|---|---|---|
| AI7503000986_30703458_c2_230 | 1408 | 5180 | 906 | 301 | 1241 | 2.3e-126 |

Description
sp:[LN:PTSB_STAXY] [AC:P51184] [GN:SCRA] [OR:STAPHYLOCOCCUS XYLOSUS] [EC:2.7.1.69]
[DE:(EC 2.7.1.69) (EII-SCR)] [SP:P51184] [DB:swissprot] >pir:[LN:S39978] [AC:S39978 ]
[PN:scrA protein] [CL:phosphotransferase system sucrose-specific enzyme II, factor II]
[OR:Staphylococcus xylosus] [DB:pir2] >gp:[GI:g407908] [LN:SXSCRA] [AC:X69800]
[PN:EIIscr] [GN:scrA] [OR:Staphylococcus xylosus] [DB:genpept-bct1] [DE:S.xylosus scrA
gene and unidentified open reading frames.] [NT:ORF2] [SP:P51184] [LE:1053] [RE:2495]
[DI:direct]

| ORF Name | NTID | AAID | NT Length | AA Length | score | probability |
|---|---|---|---|---|---|---|
| AI7503000986_34032561_c3_316 | 1409 | 5181 | 123 | 40 | | |

Description
NO-HIT

| ORF Name | NTID | AAID | NT Length | AA Length | score | probability |
|---|---|---|---|---|---|---|
| AI7503000986_34199202_c1_189 | 1410 | 5182 | 540 | 179 | 343 | 3.3e-31 |

Description
gp:[GI:e1184294:g2635712] [LN:BSUB0017] [AC:Z99120:AL009126] [PN:transcriptional
regulator] [GN:paiA] [FN:negative regulation of sporulation, septation] [OR:Bacillus
subtilis] [DB:genpept-bct1] [DE:Bacillus subtilis complete genome (section 17 of 21):
from 3197001to 3414420.] [LE:106800] [RE:107318] [DI:complement]

| ORF Name | NTID | AAID | NT Length | AA Length | score | probability |
|---|---|---|---|---|---|---|
| AI7503000986_34610667_c3_297 | 1411 | 5183 | 690 | 229 | 465 | 3.9e-44 |

Description
pir:[LN:B69377] [AC:B69377 ] [PN:ABC transporter, ATP-binding protein homolog]
[CL:unassigned ATP-binding cassette proteins: ATP-binding cassette homology]
[OR:Archaeoglobus fulgidus] [DB:pir2] >gp:[GI:g2649576] [LN:AE001033]
[AC:AE001033:AE000782] [PN:ABC transporter, ATP-binding protein] [GN:AF1018]
[OR:Archaeoglobus fulgidus] [DB:genpept-bct2] [DE:Archaeoglobus fulgidus section 74 of
172 of the complete genome.] [NT:similar to GB:L77117 SP:Q58206 PID:1591493 percent]
[LE:2126] [RE:2812] [DI:complement]

| ORF Name | NTID | AAID | NT Length | AA Length | score | probability |
|---|---|---|---|---|---|---|
| AI7503000986_35955213_c3_302 | 1412 | 5184 | 165 | 54 | | |

Description
NO-HIT

| ORF Name | NTID | AAID | NT Length | AA Length | score | probability |
|---|---|---|---|---|---|---|
| AI7503000986_36140963_f2_120 | 1413 | 5185 | 1431 | 476 | 226 | 1.9e-15 |

Description
sp:[LN:TAGF_BACSU] [AC:P13485] [GN:TAGF:RODC:TAG3] [OR:BACILLUS SUBTILIS] [DE:TEICHOIC ACID BIOSYNTHESIS PROTEIN F] [SP:P13485] [DB:swissprot] >pir:[LN:S06049] [AC:S06049:G69720 ] [PN:probable CDPglycerol glycerophosphotransferase, :CDP-glycerol:polyglycerol phosphate glycero-phosphotransferase tagF:rodC protein:teichoic-acid synthase] [GN:rodC:tag-3:tagF ] [OR:Bacillus subtilis] [EC:2.7.8.12] [DB:pir2] [MP:310 degrees ] >gp:[GI:g40100] [LN:BSRODC] [AC:X15200] [OR:Bacillus subtilis] [DB:genpept-bct1] [DE:Bacillus subtilis rodC operon.] [NT:rodC (tag3) polypeptide (AA 1-746)] [SP:P13485] [LE:2178] [RE:4418] [DI:direct] >gp:[GI:e1184478:g2636098] [LN:BSUB0019] [AC:Z99122:AL009126] [PN:CDP-glycerol:polyglycerol phosphate] [GN:tagF] [FN:teichoic acid biosynthesis] [OR:Bacillus subtilis] [DB:genpept-bct1] [DE:Bacillus subtilis complete genome (section 19 of 21): from 3597091to 3809700.] [NT:alternate gene name: rodC] [SP:P13485] [LE:78129] [RE:80369] [DI:complement] >gp:[GI:e1184478:g2636098] [LN:BSUB0019] [AC:Z99122:AL009126] [PN:CDP-glycerol:polyglycerol phosphate] [GN:tagF] [FN:teichoic acid biosynthesis] [OR:Bacillus subtilis] [DB:genpept] [DE:Bacillus subtilis complete genome (section 19 of 21): from 3597091to 3809700.] [NT:alternate gene name: rodC] [SP:P13485] [LE:78129] [RE:80369] [DI:complement]

| ORF Name | NTID | AAID | NT Length | AA Length | score | probability |
|---|---|---|---|---|---|---|
| AI7503000986_3906385_f3_183 | 1414 | 5186 | 126 | 41 | | |

Description
NO-HIT

| ORF Name | NTID | AAID | NT Length | AA Length | score | probability |
|---|---|---|---|---|---|---|
| AI7503000986_3957511_c2_248 | 1415 | 5187 | 126 | 41 | | |

Description
NO-HIT

| ORF Name | NTID | AAID | NT Length | AA Length | score | probability |
|---|---|---|---|---|---|---|
| AI7503000986_4062562_c2_269 | 1416 | 5188 | 183 | 60 | | |

Description
NO-HIT

| ORF Name | NTID | AAID | NT Length | AA Length | score | probability |
|---|---|---|---|---|---|---|
| AI7503000986_4178140_c2_270 | 1417 | 5189 | 141 | 46 | | |

Description
NO-HIT

| ORF Name | NTID | AAID | NT Length | AA Length | score | probability |
|---|---|---|---|---|---|---|
| AI7503000986_4297627_f2_119 | 1418 | 5190 | 132 | 43 | | |

Description
NO-HIT

| ORF Name | NTID | AAID | NT Length | AA Length | score | probability |
|---|---|---|---|---|---|---|
| AI7503000986_4382062_f1_19 | 1419 | 5191 | 189 | 62 | | |

Description
NO-HIT

| ORF Name | NTID | AAID | NT Length | AA Length | score | probability |
|---|---|---|---|---|---|---|
| AI7503000986_4496062_c3_287 | 1420 | 5192 | 345 | 114 | 168 | 1.2e-12 |

Description
pir:[LN:E69764] [AC:E69764 ] [PN:hypothetical protein ycnI] [GN:ycnI ] [OR:Bacillus subtilis] [DB:pir2] >gp:[GI:e1182361:g2632695] [LN:BSUB0003] [AC:Z99106:AL009126] [GN:ycnI] [FN:unknown] [OR:Bacillus subtilis] [DB:genpept-bct1] [DE:Bacillus subtilis complete genome (section 3 of 21): from 402751 to611850.] [LE:43004] [RE:43618] [DI:complement] >gp:[GI:d1009660:g1805463] [LN:D50453] [AC:D50453] [GN:ycnI] [OR:Bacillus subtilis] [SR:Bacillus subtilis (strain:168 trpC2) DNA] [DB:genpept-bct1] [DE:Bacillus subtilis DNA for 25-36 degree region containing theamyE-srfA region, complete cds.] [LE:125407] [RE:126021] [DI:complement]

| ORF Name | NTID | AAID | NT Length | AA Length | score | probability |
|---|---|---|---|---|---|---|
| AI7503000986_4687893_c1_213 | 1421 | 5193 | 1059 | 352 | 523 | 2.8e-50 |

Description
gp:[GI:g2822338] [LN:AF016485] [AC:AF016485] [OR:Halobacterium sp. NRC-1] [DB:genpept-bct2] [DE:Halobacterium sp. NRC-1 plasmid pNRC100, complete plasmid sequence.] [NT:ORF H0660; similar to ORF in Sulfolobus] [LE:60258] [RE:61397] [DI:complement] >gp:[GI:g2822427] [LN:AF016485] [AC:AF016485] [OR:Halobacterium sp. NRC-1] [DB:genpept-bct2] [DE:Halobacterium sp. NRC-1 plasmid pNRC100, complete plasmid sequence.] [NT:ORF H1696; similar to Sulolobus solfataricus] [LE:161992] [RE:163131] [DI:direct]

| ORF Name | NTID | AAID | NT Length | AA Length | score | probability |
|---|---|---|---|---|---|---|
| AI7503000986_4689007_f1_49 | 1422 | 5194 | 123 | 40 | | |

Description
NO-HIT

| ORF Name | NTID | AAID | NT Length | AA Length | score | probability |
|---|---|---|---|---|---|---|
| AI7503000986_4727217_f1_25 | 1423 | 5195 | 402 | 133 | | |

Description
NO-HIT

| ORF Name | NTID | AAID | NT Length | AA Length | score | probability |
|---|---|---|---|---|---|---|
| AI7503000986_4797125_f3_148 | 1424 | 5196 | 1647 | 548 | 970 | 1.2e-97 |

Description
sp:[LN:ARAB_BACSU] [AC:P94524] [GN:ARAB] [OR:BACILLUS SUBTILIS] [EC:2.7.1.16] [DE:L-RIBULOKINASE,] [SP:P94524] [DB:swissprot] >pir:[LN:D69587] [AC:D69587 ] [PN:L-ribulokinase araB] [GN:araB ] [OR:Bacillus subtilis] [DB:pir2] >gp:[GI:e1184128:g2635344] [LN:BSUB0015] [AC:Z99118:AL009126] [PN:L-ribulokinase] [GN:araB] [FN:L-arabinose utilization] [OR:Bacillus subtilis] [DB:genpept-bct1] [EC:2.7.1.16] [DE:Bacillus subtilis complete genome (section 15 of 21): from 2795131to 3013540.] [SP:P94524] [LE:149661] [RE:151343] [DI:complement] >gp:[GI:e1165307:g1770015] [LN:BSZ75208] [AC:Z75208] [PN:L-ribulokinase] [GN:araB] [OR:Bacillus subtilis] [DB:genpept-bct1] [DE:B.subtilis genomic sequence 89009bp.] [NT:homology to araB of Escherichia coli;identified on] [SP:P94524] [LE:18564] [RE:20246] [DI:direct]

| ORF Name | NTID | AAID | NT Length | AA Length | score | probability |
|---|---|---|---|---|---|---|
| AI7503000986_4881588_c2_258 | 1425 | 5197 | 465 | 154 | 134 | 4.7e-09 |

Description pir:[LN:A69783] [AC:A69783 ] [PN:transcription regulator MarR family homolog ydgG]
[GN:ydgG ] [OR:Bacillus subtilis] [DB:pir2] >gp:[GI:d1020150:g1881370] [LN:AB001488]
[AC:AB001488] [GN:ydgG] [OR:Bacillus subtilis] [SR:Bacillus subtilis (strain:168) DNA]
[DB:genpept-bct1] [DE:Bacillus subtilis genome sequence, 148 kb sequence of the
regionbetween 35 and 47 degree.] [NT:FUNCTION UNKNOWN.] [LE:142152] [RE:142610]
[DI:direct] >gp:[GI:e1182530:g2632864] [LN:BSUB0003] [AC:Z99106:AL009126] [GN:ydgG]
[FN:unknown] [OR:Bacillus subtilis] [DB:genpept-bct1] [DE:Bacillus subtilis complete
genome (section 3 of 21): from 402751 to611850.] [NT:similar to transcriptional
regulator (MarR family)] [LE:205898] [RE:206356] [DI:direct] >gp:[GI:e1182543:g2632877]
[LN:BSUB0004] [AC:Z99107:AL009126] [GN:ydgG] [FN:unknown] [OR:Bacillus subtilis]
[DB:genpept-bct1] [DE:Bacillus subtilis complete genome (section 4 of 21): from 600701
to813890.] [NT:similar to transcriptional regulator (MarR family)] [LE:7948] [RE:8406]
[DI:direct]

| ORF Name | NTID | AAID | NT Length | AA Length | score | probability |
|---|---|---|---|---|---|---|
| AI7503000986_5111253_f1_6 | 1426 | 5198 | 147 | 48 | | |

Description

NO-HIT

| ORF Name | NTID | AAID | NT Length | AA Length | score | probability |
|---|---|---|---|---|---|---|
| AI7503000986_5128587_f1_12 | 1427 | 5199 | 696 | 231 | 336 | 1.8e-30 |

Description pir:[LN:A69811] [AC:A69811 ] [PN:conserved hypothetical protein yflK] [GN:yflK ]
[CL:hypothetical protein HI0278] [OR:Bacillus subtilis] [DB:pir2]
>gp:[GI:e1182755:g2633089] [LN:BSUB0005] [AC:Z99108:AL009126] [GN:yflK] [FN:unknown]
[OR:Bacillus subtilis] [DB:genpept-bct1] [DE:Bacillus subtilis complete genome (section
5 of 21): from 802821 to1011250.] [NT:similar to hypothetical proteins] [LE:34765]
[RE:35430] [DI:direct] >gp:[GI:d1023167:g2443233] [LN:D86417] [AC:D86417] [PN:YflK]
[OR:Bacillus subtilis] [SR:Bacillus subtilis (strain:AC327) DNA] [DB:genpept-bct1]
[DE:Bacillus subtilis 35.7 kb genomic DNA, 70-73 degree region,complete cds.]
[LE:13092] [RE:13757] [DI:complement]

| ORF Name | NTID | AAID | NT Length | AA Length | score | probability |
|---|---|---|---|---|---|---|
| AI7503000986_5283390_c2_259 | 1428 | 5200 | 1416 | 471 | 465 | 3.9e-44 |

Description gp:[GI:g3676414] [LN:AF051917] [AC:AF051917:L19570] [PN:unknown] [OR:Staphylococcus
aureus] [DB:genpept-bct2] [DE:Staphylococcus aureus plasmid pSK41, complete sequence.]
[NT:Orf423] [LE:755] [RE:2026] [DI:direct]

| ORF Name | NTID | AAID | NT Length | AA Length | score | probability |
|---|---|---|---|---|---|---|
| AI7503000986_6307_f3_182 | 1429 | 5201 | 174 | 57 | | |

Description

NO-HIT

| ORF Name | NTID | AAID | NT Length | AA Length | score | probability |
|---|---|---|---|---|---|---|
| AI7503000986_6930462_c2_260 | 1430 | 5202 | 1227 | 408 | 634 | 4.9e-62 |

Description
pir:[LN:E69783] [AC:E69783 ] [PN:bicyclomycin resistance protein homolog ydgK] [GN:ydgK] [CL:bicyclomycin resistance protein] [OR:Bacillus subtilis] [DB:pir2]
>gp:[GI:d1020154:g1881374] [LN:AB001488] [AC:AB001488] [GN:ydgK] [OR:Bacillus subtilis] [SR:Bacillus subtilis (strain:168) DNA] [DB:genpept-bct1] [DE:Bacillus subtilis genome sequence, 148 kb sequence of the regionbetween 35 and 47 degree.] [NT:SIMILAR TO BICYCLOMYCIN RESISTANCE PROTEIN.] [LE:146860] [RE:148068] [DI:direct]
>gp:[GI:e1182547:g2632881] [LN:BSUB0004] [AC:Z99107:AL009126] [GN:ydgK] [FN:unknown] [OR:Bacillus subtilis] [DB:genpept-bct1] [DE:Bacillus subtilis complete genome (section 4 of 21): from 600701 to813890.] [NT:similar to bicyclomycin resistance protein] [LE:12656] [RE:13864] [DI:direct]

| ORF Name | NTID | AAID | NT Length | AA Length | score | probability |
|---|---|---|---|---|---|---|
| AI7503000986_7242812_f3_152 | 1431 | 5203 | 627 | 208 | 373 | 2.2e-34 |

Description
sp:[LN:3MGH_BACSU] [AC:P94378] [GN:YXLJ] [OR:BACILLUS SUBTILIS] [EC:3.2.2.-] [DE:PUTATIVE 3-METHYLADENINE DNA GLYCOSYLASE,] [SP:P94378] [DB:swissprot]
>pir:[LN:D70082] [AC:D70082 ] [PN:DNA-3-methyladenine glycosidase homolog yxlJ] [GN:yxlJ ] [OR:Bacillus subtilis] [DB:pir2] >gp:[GI:e1186361:g2636397] [LN:BSUB0020] [AC:Z99123:AL009126] [GN:yxlJ] [FN:unknown] [OR:Bacillus subtilis] [DB:genpept-bct1] [DE:Bacillus subtilis complete genome (section 20 of 21): from 3798401to 4010550.] [NT:similar to DNA-3-methyladenine glycosidase] [SP:P94378] [LE:164671] [RE:165261] [DI:complement] >gp:[GI:d1012408:g1783264] [LN:D83026] [AC:D83026:D45911] [GN:yxlJ] [OR:Bacillus subtilis] [SR:Bacillus subtilis (strain:BGSC 1A1) DNA] [DB:genpept-bct1] [DE:Bacillus subtilis genome sequence covering lic-cel region.] [NT:homologous to DNA glycosylases; hypothetical] [LE:59204] [RE:59794] [DI:direct]

| ORF Name | NTID | AAID | NT Length | AA Length | score | probability |
|---|---|---|---|---|---|---|
| AI7503000986_803137_f1_5 | 1432 | 5204 | 165 | 54 | | |

Description
NO-HIT

| ORF Name | NTID | AAID | NT Length | AA Length | score | probability |
|---|---|---|---|---|---|---|
| AI7503000986_804837_f1_59 | 1433 | 5205 | 963 | 320 | 342 | 4.3e-31 |

Description
gp:[GI:e327689:g2407930] [LN:LLPFLDB13] [AC:AJ000326] [GN:orfA] [FN:putative membrane protein] [OR:Lactococcus lactis] [DB:genpept-bct1] [DE:Lactococcus lactis pfl gene (strain DB1341).] [LE:464] [RE:1381] [DI:direct]

| ORF Name | NTID | AAID | NT Length | AA Length | score | probability |
|---|---|---|---|---|---|---|
| AI7503000986_814838_c1_208 | 1434 | 5206 | 660 | 219 | 472 | 7.1e-45 |

Description
pir:[LN:D69821] [AC:D69821 ] [PN:hypothetical protein yhbJ] [GN:yhbJ ] [OR:Bacillus subtilis] [DB:pir2] >gp:[GI:e1182889:g2633223] [LN:BSUB0005] [AC:Z99108:AL009126] [GN:yhbJ] [FN:unknown] [OR:Bacillus subtilis] [DB:genpept-bct1] [DE:Bacillus subtilis complete genome (section 5 of 21): from 802821 to1011250.] [LE:173758] [RE:174423] [DI:direct]

| ORF_Name | NTID | AAID | NT Length | AA Length | score | probability |
|---|---|---|---|---|---|---|
| AI7503000986_837578_c3_326 | 1435 | 5207 | 1233 | 410 | 708 | 7.0e-70 |

Description
pir:[LN:D70179] [AC:D70179 ] [PN:Na+/H+ antiporter (nhaC-1) homolog] [OR:Borrelia burgdorferi] [SR:, Lyme disease spirochete] [DB:pir2] >gp:[GI:g2688567] [LN:AE001165] [AC:AE001165:AE000783] [PN:Na+/H+ antiporter (nhaC-1)] [GN:BB0637] [OR:Borrelia burgdorferi] [SR:Lyme disease spirochete] [DB:genpept-bct2] [DE:Borrelia burgdorferi (section 51 of 70) of the complete genome.] [NT:similar to GB:M73530 SP:P27611 PID:143245] [LE:6377] [RE:7726] [DI:direct]

| ORF_Name | NTID | AAID | NT Length | AA Length | score | probability |
|---|---|---|---|---|---|---|
| AI7503000986_8568_c3_289 | 1436 | 5208 | 429 | 142 | 73 | 0.017 |

Description
gp:[GI:g4151243] [LN:AF063590] [AC:AF063590] [PN:microcin E492 immunity protein] [GN:mceB] [OR:Klebsiella pneumoniae] [DB:genpept-bct2] [DE:Klebsiella pneumoniae microcin E492 precursor (mceA) and microcinE492 immunity protein (mceB) genes, complete cds.] [NT:overlapping with mceA] [LE:541] [RE:828] [DI:complement]

| ORF_Name | NTID | AAID | NT Length | AA Length | score | probability |
|---|---|---|---|---|---|---|
| AI7503000986_901515_c3_318 | 1437 | 5209 | 285 | 94 | 81 | 0.0019 |

Description
gp:[GI:g4731215] [LN:BMMITOCH03] [AC:AF110612] [PN:cytochrome b apoenzyme] [GN:Cytb] [OR:Mitochondrion Boophilus microplus] [SR:southern cattle tick] [DB:genpept-inv2] [DE:Boophilus microplus cytochrome b apoenzyme (Cytb) gene, partialcds; tRNA-Ser, tRNA-Leu, tRNA-Cys, and tRNA-Met genes, completesequence; and NADH dehydrogenase subunit 2 (ND2) gene, partial cds,mitochondrial genes for mitochondrial products.] [LE:<1] [RE:285] [DI:direct] >gp:[GI:g4731215] [LN:BMMITOCH03] [AC:AF110612] [PN:cytochrome b apoenzyme] [GN:Cytb] [OR:Mitochondrion Boophilus microplus] [SR:southern cattle tick] [DB:genpept] [DE:Boophilus microplus cytochrome b apoenzyme (Cytb) gene, partialcds; tRNA-Ser, tRNA-Leu, tRNA-Cys, and tRNA-Met genes, completesequence; and NADH dehydrogenase subunit 2 (ND2) gene, partial cds,mitochondrial genes for mitochondrial products.] [LE:<1] [RE:285] [DI:direct]

| ORF_Name | NTID | AAID | NT Length | AA Length | score | probability |
|---|---|---|---|---|---|---|
| AI7503000986_968751_f2_63 | 1438 | 5210 | 123 | 40 | | |

Description
NO-HIT

| ORF_Name | NTID | AAID | NT Length | AA Length | score | probability |
|---|---|---|---|---|---|---|
| AI7503000986_975261_f3_149 | 1439 | 5211 | 168 | 55 | 60 | 0.022 |

Description
sp:[LN:YC36_GUITH] [AC:O78501] [GN:YCF36] [OR:GUILLARDIA THETA] [SR:,CRYPTOMONAS PHI] [DE:HYPOTHETICAL 18.4 KD PROTEIN YCF36] [SP:O78501] [DB:swissprot] >gp:[GI:g3603031] [LN:AF041468] [AC:AF041468:X14171:X62349:X51511:X14504:X52158:X52912:X56806:M7654 7] [PN:hypothetical chloroplast RF36] [GN:ycf36] [OR:Chloroplast Guillardia theta] [SR:Guillardia theta] [DB:genpept-pln2] [DE:Guillardia theta complete plastid genome.] [LE:88514] [RE:88981] [DI:direct]

| ORF_Name | NTID | AAID | NT Length | AA Length | score | probability |
|---|---|---|---|---|---|---|
| AI7503000986_9797911_f3_139 | 1440 | 5212 | 126 | 41 | | |

Description
NO-HIT

| ORF Name | NTID | AAID | NT Length | AA Length | score | probability |
|---|---|---|---|---|---|---|
| AI7503000986_984628_f2_65 | 1441 | 5213 | 132 | 43 | | |

Description
NO-HIT

| ORF Name | NTID | AAID | NT Length | AA Length | score | probability |
|---|---|---|---|---|---|---|
| AI7503000986_990952_f3_155 | 1442 | 5214 | 1209 | 402 | 744 | 1.1e-73 |

Description
gp:[GI:d1042605:g5103194] [LN:AP000342] [AC:AP000342] [GN:ydhA] [OR:Plasmid R100] [SR:Plasmid R100 (lab_host:Escherichia coli strain K-12) DNA] [DB:genpept] [DE:Plasmid R100 genomic DNA.] [NT:58% identical (1 gap) to 376 residues of 404 aa] [LE:37813] [RE:39018] [DI:complement]

| ORF Name | NTID | AAID | NT Length | AA Length | score | probability |
|---|---|---|---|---|---|---|
| AI7503000986_9944132_f1_20 | 1443 | 5215 | 189 | 62 | | |

Description
NO-HIT

| ORF Name | NTID | AAID | NT Length | AA Length | score | probability |
|---|---|---|---|---|---|---|
| AI7503000987_10188258_f1_158 | 1444 | 5216 | 129 | 42 | | |

Description
NO-HIT

| ORF Name | NTID | AAID | NT Length | AA Length | score | probability |
|---|---|---|---|---|---|---|
| AI7503000987_10547152_f1_153 | 1445 | 5217 | 144 | 47 | | |

Description
NO-HIT

| ORF Name | NTID | AAID | NT Length | AA Length | score | probability |
|---|---|---|---|---|---|---|
| AI7503000987_10662763_c2_764 | 1446 | 5218 | 1089 | 362 | 688 | 9.2e-68 |

Description
sp:[LN:YACL_BACSU] [AC:Q06754] [GN:YACL] [OR:BACILLUS SUBTILIS] [DE:HYPOTHETICAL 40.9 KD PROTEIN IN MECB-GLTX INTERGENIC REGION] [SP:Q06754] [DB:swissprot] >pir:[LN:S66118] [AC:S66118:D69741 ] [PN:conserved hypothetical protein yacL] [GN:yacL ] [CL:conserved hypothetical protein yacL] [OR:Bacillus subtilis] [DB:pir2] >gp:[GI:d1005865:g467477] [LN:BAC180K] [AC:D26185] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:172273] [RE:173373] [DI:direct] >gp:[GI:e1182022:g2632356] [LN:BSUB0001] [AC:Z99104:AL009126] [GN:yacL] [FN:unknown] [OR:Bacillus subtilis] [DB:genpept-bct1] [DE:Bacillus subtilis complete genome (section 1 of 21): from 1 to213080.] [NT:similar to hypothetical proteins] [SP:Q06754] [LE:108671] [RE:109771] [DI:direct]

| ORF Name | NTID | AAID | NT Length | AA Length | score | probability |
|---|---|---|---|---|---|---|
| AI7503000987_10667002_c1_690 | 1447 | 5219 | 207 | 68 | | |

Description
NO-HIT

| ORF Name | NTID | AAID | NT Length | AA Length | score | probability |
|---|---|---|---|---|---|---|
| AI7503000987_10734838_c2_819 | 1448 | 5220 | 996 | 331 | 397 | 6.3e-37 |

Description
sp:[LN:ER19_YEAST] [AC:P32377] [GN:ERG19:MVD1:MPD:YNR043W:N3427] [OR:SACCHAROMYCES CEREVISIAE] [SR:,BAKER'S YEAST] [EC:4.1.1.33] [DE:PYROPHOSPHATE DECARBOXYLASE)] [SP:P32377] [DB:swissprot] >pir:[LN:S63374] [AC:S63374:S20057 ] [PN:diphosphomevalonate decarboxylase,:protein N3427:protein YNR043w] [GN:MVD1:ERG19:MPD ] [OR:Saccharomyces cerevisiae] [EC:4.1.1.33] [DB:pir2] [MP:14R ] >gp:[GI:e238625:g1292890] [LN:SCERG19] [AC:X97557] [PN:diphosphomevalonate decarboxylase] [GN:ERG19] [OR:Saccharomyces cerevisiae] [SR:baker's yeast] [DB:genpept-pln1] [EC:4.1.1.33] [DE:S.cerevisiae ERG19 gene.] [SP:P32377] [LE:544] [RE:1734] [DI:direct] >gp:[GI:e239591:g1302550] [LN:SCYNR043W] [AC:Z71658:Y13139] [GN:MVD1] [OR:Saccharomyces cerevisiae] [SR:baker's yeast] [DB:genpept-pln1] [DE:S.cerevisiae chromosome XIV reading frame ORF YNR043w.] [NT:ORF YNR043w] [SP:P32377] [LE:229] [RE:1419] [DI:direct]

| ORF Name | NTID | AAID | NT Length | AA Length | score | probability |
|---|---|---|---|---|---|---|
| AI7503000987_10735832_c1_722 | 1449 | 5221 | 273 | 90 | 67 | 0.0041 |

Description
pir:[LN:E71854] [AC:E71854 ] [PN:hypothetical protein jhp1053] [GN:jhp1053 ] [OR:Helicobacter pylori] [SR:strain J99, , strain J99] [SR:strain J99, ] [DB:pir2] >gp:[GI:g4155644] [LN:AE001533] [AC:AE001533:AE001439] [PN:putative] [GN:jhp1053] [OR:Helicobacter pylori J99] [DB:genpept-bct2] [DE:Helicobacter pylori, strain J99 section 94 of 132 of the completegenome.] [NT:similar to H. pylori 26695 gene HP1124] [LE:5370] [RE:6365] [DI:complement]

| ORF Name | NTID | AAID | NT Length | AA Length | score | probability |
|---|---|---|---|---|---|---|
| AI7503000987_10928_c2_757 | 1450 | 5222 | 1242 | 413 | 230 | 1.2e-16 |

Description
pir:[LN:T03492] [AC:T03492 ] [PN:hypothetical protein] [OR:Rhodobacter capsulatus] [DB:pir2] [MP:1 ] >gp:[GI:g3128293] [LN:AF010496] [AC:AF010496] [PN:hypothetical protein] [OR:Rhodobacter capsulatus] [DB:genpept-bct2] [DE:Rhodobacter capsulatus strain SB1003, partial genome.] [LE:54291] [RE:55613] [DI:complement]

| ORF Name | NTID | AAID | NT Length | AA Length | score | probability |
|---|---|---|---|---|---|---|
| AI7503000987_110766_f1_13 | 1451 | 5223 | 132 | 43 | | |

Description
NO-HIT

| ORF Name | NTID | AAID | NT Length | AA Length | score | probability |
|---|---|---|---|---|---|---|
| AI7503000987_117893_c3_957 | 1452 | 5224 | 426 | 141 | | |

Description
NO-HIT

| ORF Name | NTID | AAID | NT Length | AA Length | score | probability |
|---|---|---|---|---|---|---|
| AI7503000987_11894032_c3_930 | 1453 | 5225 | 126 | 41 | | |

Description
NO-HIT

| ORF Name | NTID | AAID | NT Length | AA Length | score | probability |
|---|---|---|---|---|---|---|
| AI7503000987_12267167_c2_786 | 1454 | 5226 | 135 | 44 | | |

Description
NO-HIT

| ORF Name | NTID | AAID | NT Length | AA Length | score | probability |
|---|---|---|---|---|---|---|
| AI7503000987_1227250_f3_539 | 1455 | 5227 | 996 | 331 | 562 | 2.1e-54 |

Description
sp:[LN:YXEI_BACSU] [AC:P54948] [GN:YXEI:LP9A] [OR:BACILLUS SUBTILIS] [DE:HYPOTHETICAL 37.2 KD PROTEIN IN IDH-DEOR INTERGENIC REGION] [SP:P54948] [DB:swissprot]
>pir:[LN:C70075] [AC:C70075 ] [PN:penicillin amidase homolog yxeI] [GN:yxeI ] [CL:choloylglycine hydrolase] [OR:Bacillus subtilis] [DB:pir2]
>gp:[GI:e1184679:g2636500] [LN:BSUB0021] [AC:Z99124:AL009126] [GN:yxeI] [FN:unknown] [OR:Bacillus subtilis] [DB:genpept-bct1] [DE:Bacillus subtilis complete genome (section 21 of 21): from 3999281to 4214814.] [NT:similar to penicillin amidase] [SP:P54948] [LE:62053] [RE:63039] [DI:complement] >gp:[GI:d1008921:g1408494] [LN:D45912] [AC:D45912] [GN:yxeI] [OR:Bacillus subtilis] [SR:Bacillus subtilis (strain:BGSC 1A1 (Marburg 168; trpC2)) DNA] [DB:genpept-bct1] [DE:Bacillus subtilis genome sequence between the iol and hut operon,partial and complete cds.] [NT:homologous to penicillin acylase] [LE:8437] [RE:9423] [DI:direct]

| ORF Name | NTID | AAID | NT Length | AA Length | score | probability |
|---|---|---|---|---|---|---|
| AI7503000987_12516511_c2_813 | 1456 | 5228 | 129 | 42 | 164 | 4.7e-12 |

Description
gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF Name | NTID | AAID | NT Length | AA Length | score | probability |
|---|---|---|---|---|---|---|
| AI7503000987_12601637_c3_898 | 1457 | 5229 | 144 | 47 | 76 | 0.0065 |

Description
pir:[LN:B70148] [AC:B70148 ] [PN:ribosomal protein S12] [GN:BB0387:rpsL ] [CL:Escherichia coli ribosomal protein S12] [OR:Borrelia burgdorferi] [SR:, Lyme disease spirochete] [DB:pir2] >gp:[GI:g2688295] [LN:AE001144] [AC:AE001144:AE000783] [PN:ribosomal protein S12 (rpsL)] [GN:BB0387] [OR:Borrelia burgdorferi] [SR:Lyme disease spirochete] [DB:genpept-bct2] [DE:Borrelia burgdorferi (section 30 of 70) of the complete genome.] [NT:similar to SP:P18662 percent identity: 79.03;] [LE:1809] [RE:2183] [DI:complement]

| ORF Name | NTID | AAID | NT Length | AA Length | score | probability |
|---|---|---|---|---|---|---|
| AI7503000987_12714833_c2_863 | 1458 | 5230 | 1218 | 405 | 95 | 0.021 |

Description
pir:[LN:S72278] [AC:S72278:S78483 ] [PN:ATP-dependent Clp proteinase, homolog] [GN:clpC ] [OR:plastid Plasmodium falciparum] [EC:3.4.21.-] [DB:pir2]

| ORF Name | NTID | AAID | NT Length | AA Length | score | probability |
|---|---|---|---|---|---|---|
| AI7503000987_12902217_f2_349 | 1459 | 5231 | 681 | 226 | 292 | 8.5e-26 |

Description
pir:[LN:D69906] [AC:D69906 ] [PN:hypothetical protein yojG] [GN:yojG ] [OR:Bacillus subtilis] [DB:pir2] >gp:[GI:e1185418:g2634339] [LN:BSUB0011] [AC:Z99114:AL009126] [GN:yojG] [FN:unknown] [OR:Bacillus subtilis] [DB:genpept-bct1] [DE:Bacillus subtilis complete genome (section 11 of 21): from 2000171to 2207900.] [LE:120715] [RE:121143] [DI:complement] >gp:[GI:g3169323] [LN:AF026147] [AC:AF026147] [PN:YojG] [GN:yojG] [FN:unknown] [OR:Bacillus subtilis] [DB:genpept-bct2] [DE:Bacillus subtilis YojA (yojA), YojB (yojB), YojC (yojC), YojD(yojD), YojE (yojE), YojF (yojF), YojG (yojG), YojH (yojH), YojI(yojI), YojJ (yojJ), YojK (yojK), YojL (yojL), YojM (yojM), YojN(yojN), and YojO (yojO) genes, complete cds; and OdhA (odhA) gene,partial cds.] [LE:4122] [RE:4550] [DI:direct]

| ORF Name | NTID | AAID | NT Length | AA Length | score | probability |
|---|---|---|---|---|---|---|
| AI7503000987_12932802_f1_115 | 1460 | 5232 | 126 | 41 | | |

Description
NO-HIT

| ORF Name | NTID | AAID | NT Length | AA Length | score | probability |
|---|---|---|---|---|---|---|
| AI7503000987_134702_f1_113 | 1461 | 5233 | 834 | 277 | 673 | 3.6e-66 |

Description
sp:[LN:THID_BACSU] [AC:P39610] [GN:THID:IPA-52R] [OR:BACILLUS SUBTILIS] [EC:2.7.4.7] [DE:(HMP-P KINASE)] [SP:P39610] [DB:swissprot] >pir:[LN:S39707] [AC:S39707:F69722 ] [PN:phosphomethylpyrimidine kinase thiD:protein ipa-52r] [GN:thiD ] [CL:phosphomethylpyrimidine phosphate kinase] [OR:Bacillus subtilis] [DB:pir2] >gp:[GI:g413976] [LN:BSGENR] [AC:X73124] [GN:ipa-52r] [OR:Bacillus subtilis] [DB:genpept-bct1] [DE:B.subtilis genomic region (325 to 333).] [SP:P39610] [LE:55788] [RE:56603] [DI:complement] >gp:[GI:e1186301:g2636337] [LN:BSUB0020] [AC:Z99123:AL009126] [PN:phosphomethylpyrimidine kinase] [GN:thiD] [FN:thiamin biosynthesis] [OR:Bacillus subtilis] [DB:genpept-bct1] [EC:2.7.4.7] [DE:Bacillus subtilis complete genome (section 20 of 21): from 3798401to 4010550.] [NT:alternate gene name: ywdB, ipa-52r] [SP:P39610] [LE:101359] [RE:102174] [DI:direct]

| ORF Name | NTID | AAID | NT Length | AA Length | score | probability |
|---|---|---|---|---|---|---|
| AI7503000987_13695125_c2_771 | 1462 | 5234 | 603 | 200 | 117 | 9.1e-06 |

Description
gp:[GI:g3025463] [LN:CAU58131] [AC:U58131] [PN:SigX] [GN:sigX] [OR:Clostridium acetobutylicum] [DB:genpept-bct2] [DE:Clostridium acetobutylicum pho-sigX gene region, phoP, phoR, sigX,orf36, and orf18 genes, complete cds.] [NT:proposed ECF subfamily RNA polymerase sigmafactor] [LE:3293] [RE:3847] [DI:direct]

| ORF Name | NTID | AAID | NT Length | AA Length | score | probability |
|---|---|---|---|---|---|---|
| AI7503000987_1379061_c3_991 | 1463 | 5235 | 153 | 50 | | |

Description
NO-HIT

| ORF Name | NTID | AAID | NT Length | AA Length | score | probability |
|---|---|---|---|---|---|---|
| AI7503000987_13835930_c3_950 | 1464 | 5236 | 276 | 91 | | |

Description
NO-HIT

| ORF Name | NTID | AAID | NT Length | AA Length | score | probability |
|---|---|---|---|---|---|---|
| AI7503000987_13876005_c1_677 | 1465 | 5237 | 339 | 112 | | |

Description
NO-HIT

| ORF Name | NTID | AAID | NT Length | AA Length | score | probability |
|---|---|---|---|---|---|---|
| AI7503000987_14254437_c3_903 | 1466 | 5238 | 123 | 40 | | |

Description
NO-HIT

| ORF Name | NTID | AAID | NT Length | AA Length | score | probability |
|---|---|---|---|---|---|---|
| AI7503000987_14460882_f1_107 | 1467 | 5239 | 177 | 58 | 236 | 7.3e-20 |

Description
gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF Name | NTID | AAID | NT Length | AA Length | score | probability |
|---|---|---|---|---|---|---|
| AI7503000987_14501556_f2_325 | 1468 | 5240 | 171 | 56 | | |

Description
NO-HIT

| ORF Name | NTID | AAID | NT Length | AA Length | score | probability |
|---|---|---|---|---|---|---|
| AI7503000987_14537578_c2_763 | 1469 | 5241 | 147 | 48 | | |

Description
NO-HIT

| ORF Name | NTID | AAID | NT Length | AA Length | score | probability |
|---|---|---|---|---|---|---|
| AI7503000987_14547143_c3_912 | 1470 | 5242 | 522 | 173 | 501 | 6.0e-48 |

Description
sp:[LN:YAAJ_BACSU] [AC:P21335] [GN:YAAJ] [OR:BACILLUS SUBTILIS] [DE:HYPOTHETICAL 17.8 KD PROTEIN IN SERS-DNAH INTERGENIC REGION] [SP:P21335] [DB:swissprot] >pir:[LN:S11690] [AC:S11690:S66048:B69737 ] [PN:conserved hypothetical protein yaaJ] [GN:yaaJ ] [CL:hypothetical protein YaaJ] [OR:Bacillus subtilis] [DB:pir2]
>gp:[GI:d1005796:g467408] [LN:BAC180K] [AC:D26185] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:89452] [RE:89937] [DI:direct] >gp:[GI:g40011] [LN:BSORF17] [AC:X52144] [OR:Bacillus subtilis] [DB:genpept-bct1] [DE:Bacillus subtilis DNA for ORF17, small cytoplasmic RNA and partialdnaX gene.] [NT:ORF17 (AA 1-161)] [SP:P21335] [LE:129] [RE:614] [DI:direct]
>gp:[GI:e1181951:g2632285] [LN:BSUB0001] [AC:Z99104:AL009126] [GN:yaaJ] [FN:unknown] [OR:Bacillus subtilis] [DB:genpept-bct1] [DE:Bacillus subtilis complete genome (section 1 of 21): from 1 to213080.] [NT:similar to hypothetical proteins] [SP:P21335] [LE:25850] [RE:26335] [DI:direct]

| ORF Name | NTID | AAID | NT Length | AA Length | score | probability |
|---|---|---|---|---|---|---|
| AI7503000987_14587817_f3_520 | 1471 | 5243 | 528 | 175 | | |

Description
NO-HIT

| ORF_Name | NTID | AAID | NT Length | AA Length | score | probability |
|---|---|---|---|---|---|---|
| AI7503000987_14647510_f1_27 | 1472 | 5244 | 255 | 84 | | |

Description
NO-HIT

| ORF_Name | NTID | AAID | NT Length | AA Length | score | probability |
|---|---|---|---|---|---|---|
| AI7503000987_14879688_c1_704 | 1473 | 5245 | 927 | 308 | 234 | 5.1e-26 |

Description
pir:[LN:A71042] [AC:A71042 ] [PN:probable mevalonate kinase] [GN:PH1625 ]
[OR:Pyrococcus horikoshii] [DB:pir2] >gp:[GI:d1031680:g3258054] [LN:AP000006]
[AC:AP000006:AB005215:AB009510:AB009511:AB009512:AB009513:AB009514] [PN:335aa long
hypothetical mevalonate kinase] [GN:PH1625] [OR:Pyrococcus horikoshii] [SR:Pyrococcus
horikoshii (strain:OT3) DNA, clone:Pyrococcus horikoshi] [DB:genpept-bct1]
[DE:Pyrococcus horikoshii OT3 genomic DNA, 1166001-1485000 nt. position(6/7).]
[NT:similar to owl:MTU47134 percent identity: 41.993 in] [LE:275590] [RE:276597]
[DI:complement]

| ORF_Name | NTID | AAID | NT Length | AA Length | score | probability |
|---|---|---|---|---|---|---|
| AI7503000987_14882681_c1_717 | 1474 | 5246 | 210 | 69 | 99 | 2.4e-05 |

Description
gp:[GI:g2897106] [LN:AF020798] [AC:AF020798] [PN:repressor] [OR:Streptococcus
thermophilus bacteriophage TP-J34] [DB:genpept-phg] [DE:Streptococcus thermophilus
bacteriophage lysogeny module, integrasehomolog (int), putative host cell
surface-exposed lipoprotein,putative metallo-proteinase, repressor, Cro-like
regulatoryprotein, and P1-antirepressor homolog genes, complete cds.] [NT:CI-like
regulatory protein; orf121] [LE:4825] [RE:5190] [DI:complement]

| ORF_Name | NTID | AAID | NT Length | AA Length | score | probability |
|---|---|---|---|---|---|---|
| AI7503000987_14885260_c2_839 | 1475 | 5247 | 441 | 146 | 209 | 5.3e-17 |

Description
gp:[GI:g2444132] [LN:U88974] [AC:U88974] [PN:ORF25] [OR:Streptococcus thermophilus
temperate bacteriophage O1205] [DB:genpept-phg] [DE:Streptococcus thermophilus
temperate bacteriophage O1205, completegenome.] [NT:putative small subunit of the
terminase] [LE:13835] [RE:14329] [DI:direct]

| ORF_Name | NTID | AAID | NT Length | AA Length | score | probability |
|---|---|---|---|---|---|---|
| AI7503000987_15735181_f3_451 | 1476 | 5248 | 204 | 67 | | |

Description
NO-HIT

| ORF_Name | NTID | AAID | NT Length | AA Length | score | probability |
|---|---|---|---|---|---|---|
| AI7503000987_15782160_c3_905 | 1477 | 5249 | 747 | 248 | 469 | 1.5e-44 |

Description
gp:[GI:g1458327] [LN:CELF08F3] [AC:U64847] [GN:F08F3.4] [OR:Caenorhabditis elegans]
[SR:Caenorhabditis elegans strain=Bristol N2] [DB:genpept-inv1] [DE:Caenorhabditis
elegans cosmid F08F3.] [LE:1515:1817:2044:2841] [RE:1758:1994:2276:3110]
[DI:directJoin]

| ORF Name | NTID | AAID | NT Length | AA Length | score | probability |
|---|---|---|---|---|---|---|
| AI7503000987_15892932_c3_902 | 1478 | 5250 | 129 | 42 | | |

Description
NO-HIT

| ORF Name | NTID | AAID | NT Length | AA Length | score | probability |
|---|---|---|---|---|---|---|
| AI7503000987_16054827_c3_959 | 1479 | 5251 | 357 | 118 | 184 | 2.4e-14 |

Description
pir:[LN:T00183] [AC:T00183 ] [PN:hypothetical protein 50] [OR:Staphylococcus aureus phage phi PVL] [DB:pir3] >gp:[GI:d1032884:g3341957] [LN:AB009866] [AC:AB009866] [OR:bacteriophage phi PVL] [SR:bacteriophage phi PVL (specific_host:Staphylococcus aureus ATC] [DB:genpept-phg] [DE:Bacteriophage phi PVL proviral DNA, complete sequence.] [NT:orf 50] [LE:36701] [RE:37069] [DI:direct]

| ORF Name | NTID | AAID | NT Length | AA Length | score | probability |
|---|---|---|---|---|---|---|
| AI7503000987_16212803_c2_844 | 1480 | 5252 | 318 | 105 | 124 | 5.4e-08 |

Description
pir:[LN:S58144] [AC:S58144 ] [PN:gene 15 protein] [OR:phage SPP1] [DB:pir2] >gp:[GI:e244843:g2764862] [LN:BSPP1GENM] [AC:X97918] [OR:Bacteriophage SPP1] [DB:genpept-phg] [DE:Bacteriophage SPP1 complete nucleotide sequence.] [NT:gene 15] [LE:9012] [RE:9320] [DI:direct] >gp:[GI:g1052813] [LN:SPP1HEADG] [AC:X89721] [GN:15] [OR:Bacteriophage SPP1] [DB:genpept-phg] [DE:Bacteriophage SPP1 head morphogenesis genes 7 to 15.] [NT:product required for head morphogenesis] [LE:5788] [RE:6096] [DI:direct]

| ORF Name | NTID | AAID | NT Length | AA Length | score | probability |
|---|---|---|---|---|---|---|
| AI7503000987_16413130_f1_128 | 1481 | 5253 | 246 | 81 | 146 | 1.8e-08 |

Description
gp:[GI:g3929312] [LN:AF100426] [AC:AF100426] [PN:fimbriae-associated protein Fap1] [GN:fap1] [OR:Streptococcus parasanguinis] [DB:genpept-bct2] [DE:Streptococcus parasanguis fimbriae-associated protein Fap1 (fap1)gene, complete cds.] [NT:invovled in fimbriae assembly and fimbriae-mediated] [LE:284] [RE:7996] [DI:direct]

| ORF Name | NTID | AAID | NT Length | AA Length | score | probability |
|---|---|---|---|---|---|---|
| AI7503000987_16603427_c2_861 | 1482 | 5254 | 531 | 176 | | |

Description
NO-HIT

| ORF Name | NTID | AAID | NT Length | AA Length | score | probability |
|---|---|---|---|---|---|---|
| AI7503000987_16681687_c1_635 | 1483 | 5255 | 1029 | 342 | 694 | 2.1e-68 |

Description
sp:[LN:YACI_BACSU] [AC:P37570] [GN:YACI] [OR:BACILLUS SUBTILIS] [DE:HYPOTHETICAL 41.1 KD PROTEIN IN LYSS-MECB INTERGENIC REGION (ORFX)] [SP:P37570] [DB:swissprot] >pir:[LN:S66114] [AC:S66114:I40507:B69741 ] [PN:creatine kinase homolog yacI] [GN:yacI ] [OR:Bacillus subtilis] [DB:pir2] >gp:[GI:d1005861:g467473] [LN:BAC180K] [AC:D26185] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:166083] [RE:167174] [DI:direct] >gp:[GI:e1182018:g2632352] [LN:BSUB0001] [AC:Z99104:AL009126] [GN:yacI] [FN:unknown] [OR:Bacillus subtilis] [DB:genpept-bct1] [DE:Bacillus subtilis complete genome (section 1 of 21): from 1 to213080.] [NT:similar to creatine kinase] [SP:P37570] [LE:102481] [RE:103572] [DI:direct]

| ORF Name | NTID | AAID | NT Length | AA Length | score | probability |
|---|---|---|---|---|---|---|
| AI7503000987_16798777_c1_646 | 1484 | 5256 | 3558 | 1185 | 5906 | 0.0 |

Description sp:[LN:RPOB_STAAU] [AC:P47768] [GN:RPOB] [OR:STAPHYLOCOCCUS AUREUS] [EC:2.7.7.6]
[DE:BETA CHAIN) (RNA POLYMERASE BETA SUBUNIT)] [SP:P47768] [DB:swissprot]
>pir:[LN:S59951] [AC:S59951 ] [PN:DNA-directed RNA polymerase, beta chain] [GN:rpoB ]
[CL:DNA-directed RNA polymerase beta chain] [OR:Staphylococcus aureus] [EC:2.7.7.6]
[DB:pir2] >gp:[GI:g677851] [LN:SARPLRPO] [AC:X64172] [PN:DNA-directed RNA polymerase
beta chain] [GN:rpoB] [OR:Staphylococcus aureus] [DB:genpept-bct1] [EC:2.7.7.6]
[DE:S.aureus rplL, orf202, rpoB(rif) and rpoC genes for ribosomalprotein L7/L12,
hypothetical protein ORF202, DNA-directed RNApolymerase beta & beta' chains.]
[SP:P47768] [LE:1222] [RE:4770] [DI:direct]

| ORF Name | NTID | AAID | NT Length | AA Length | score | probability |
|---|---|---|---|---|---|---|
| AI7503000987_16972575_f1_196 | 1485 | 5257 | 186 | 61 | 76 | 0.036 |

Description gp:[GI:g4580755] [LN:AF061085] [AC:AF061085] [PN:P-glycoprotein] [OR:Gossypium
herbaceum] [DB:genpept-pln2] [DE:Gossypium herbaceum P-glycoprotein gene, partial cds.]
[NT:similar to P-glycoprotein in Hordeum vulgare and] [LE:<22] [RE:>894] [DI:direct]

| ORF Name | NTID | AAID | NT Length | AA Length | score | probability |
|---|---|---|---|---|---|---|
| AI7503000987_1702_f2_209 | 1486 | 5258 | 522 | 173 | 88 | 0.0089 |

Description pir:[LN:T00168] [AC:T00168 ] [PN:hypothetical protein 33] [OR:Staphylococcus aureus
phage phi PVL] [DB:pir3] >gp:[GI:d1032869:g3341942] [LN:AB009866] [AC:AB009866]
[OR:bacteriophage phi PVL] [SR:bacteriophage phi PVL (specific_host:Staphylococcus
aureus ATC] [DB:genpept-phg] [DE:Bacteriophage phi PVL proviral DNA, complete
sequence.] [NT:orf 33] [LE:28172] [RE:28582] [DI:complement]

| ORF Name | NTID | AAID | NT Length | AA Length | score | probability |
|---|---|---|---|---|---|---|
| AI7503000987_19690876_c3_935 | 1487 | 5259 | 876 | 291 | 662 | 5.3e-65 |

Description sp:[LN:YWFL_BACSU] [AC:P39648] [GN:YWFL:IPA-90D] [OR:BACILLUS SUBTILIS]
[DE:HYPOTHETICAL 31.4 KD PROTEIN IN PTA 3'REGION] [SP:P39648] [DB:swissprot]
>pir:[LN:S39745] [AC:S39745:D70056 ] [PN:ywfL protein:hypothetical protein ipa-90d]
[GN:ywfL ] [OR:Bacillus subtilis] [DB:pir2] >gp:[GI:g414014] [LN:BSGENR] [AC:X73124]
[GN:ipa-90d] [OR:Bacillus subtilis] [DB:genpept-bct1] [DE:B.subtilis genomic region
(325 to 333).] [SP:P39648] [LE:93300] [RE:94145] [DI:direct] >gp:[GI:e1186264:g2636300]
[LN:BSUB0020] [AC:Z99123:AL009126] [GN:ywfL] [FN:unknown] [OR:Bacillus subtilis]
[DB:genpept-bct1] [DE:Bacillus subtilis complete genome (section 20 of 21): from
3798401to 4010550.] [NT:alternate gene name: ipa-90d] [SP:P39648] [LE:63814] [RE:64659]
[DI:complement]

| ORF Name | NTID | AAID | NT Length | AA Length | score | probability |
|---|---|---|---|---|---|---|
| AI7503000987_19695386_c3_953 | 1488 | 5260 | 771 | 256 | 111 | 0.00059 |

Description pir:[LN:T00180] [AC:T00180 ] [PN:hypothetical protein 46] [OR:Staphylococcus aureus
phage phi PVL] [DB:pir3] >gp:[GI:d1032881:g3341954] [LN:AB009866] [AC:AB009866]
[OR:bacteriophage phi PVL] [SR:bacteriophage phi PVL (specific_host:Staphylococcus
aureus ATC] [DB:genpept-phg] [DE:Bacteriophage phi PVL proviral DNA, complete
sequence.] [NT:orf 46] [LE:35157] [RE:36050] [DI:direct]

| ORF Name | NTID | AAID | NT Length | AA Length | score | probability |
|---|---|---|---|---|---|---|
| AI7503000987_20078287_f3_533 | 1489 | 5261 | 825 | 274 | 145 | 2.5e-07 |

Description
pir:[LN:B70798] [AC:B70798 ] [PN:probable membrane protein] [GN:Rv3737 ]
[OR:Mycobacterium tuberculosis] [DB:pir2] >gp:[GI:e1264597:g2960161] [LN:MTV025]
[AC:AL022121:AL123456] [PN:hypothetical protein Rv3737] [GN:Rv3737] [OR:Mycobacterium
tuberculosis] [DB:genpept-bct1] [DE:Mycobacterium tuberculosis H37Rv complete genome;
segment 155/162.] [NT:Rv3737, (MTV025.085), len: 529. Probable membrane] [LE:94796]
[RE:96385] [DI:direct] >gp:[GI:e1264597:g2960161] [LN:MTV025] [AC:AL022121:AL123456]
[PN:hypothetical protein Rv3737] [GN:Rv3737] [OR:Mycobacterium tuberculosis]
[DB:genpept] [DE:Mycobacterium tuberculosis H37Rv complete genome; segment 155/162.]
[NT:Rv3737, (MTV025.085), len: 529. Probable membrane] [LE:94796] [RE:96385]
[DI:direct]

| ORF Name | NTID | AAID | NT Length | AA Length | score | probability |
|---|---|---|---|---|---|---|
| AI7503000987_20087752_f2_352 | 1490 | 5262 | 1506 | 501 | 397 | 2.5e-36 |

Description
sp:[LN:TAGE_BACSU] [AC:P13484] [GN:TAGE:RODD:GTAA] [OR:BACILLUS SUBTILIS] [EC:2.4.1.52]
[DE:(EC 2.4.1.52) (TEICHOIC ACID BIOSYNTHESIS PROTEIN E)] [SP:P13484] [DB:swissprot]
>pir:[LN:S06048] [AC:S06048:F69720 ] [PN:poly(glycerol-phosphate)
alpha-glucosyltransferase, tagE:probable rodD protein:UDP-glucose--polyglycerol
phosphate glucosyltransferase tagE] [GN:tagE:rodD ] [OR:Bacillus subtilis] [EC:
2.4.1.52] [DB:pir2] [MP:310 degrees ] >gp:[GI:g580920] [LN:BSRODC] [AC:X15200]
[OR:Bacillus subtilis] [DB:genpept-bct1] [DE:Bacillus subtilis rodC operon.] [NT:rodD
(gtaA) polypeptide (AA 1-673)] [SP:P13484] [LE:157] [RE:2178] [DI:direct]
>gp:[GI:e1184479:g2636099] [LN:BSUB0019] [AC:Z99122:AL009126]
[PN:UDP-glucose:polyglycerol phosphate] [GN:tagE] [FN:teichoic acid biosynthesis]
[OR:Bacillus subtilis] [DB:genpept-bct1] [EC:2.4.1.52] [DE:Bacillus subtilis complete
genome (section 19 of 21): from 3597091to 3809700.] [NT:alternate gene name: rodD,
gtaA, gtaD] [SP:P13484] [LE:80369] [RE:82390] [DI:complement]
>gp:[GI:e1184479:g2636099] [LN:BSUB0019] [AC:Z99122:AL009126]
[PN:UDP-glucose:polyglycerol phosphate] [GN:tagE] [FN:teichoic acid biosynthesis]
[OR:Bacillus subtilis] [DB:genpept] [EC:2.4.1.52] [DE:Bacillus subtilis complete genome
(section 19 of 21): from 3597091to 3809700.] [NT:alternate gene name: rodD, gtaA, gtaD]
[SP:P13484] [LE:80369] [RE:82390] [DI:complement]

| ORF Name | NTID | AAID | NT Length | AA Length | score | probability |
|---|---|---|---|---|---|---|
| AI7503000987_20322153_c2_818 | 1491 | 5263 | 219 | 72 | | |

Description
NO-HIT

| ORF Name | NTID | AAID | NT Length | AA Length | score | probability |
|---|---|---|---|---|---|---|
| AI7503000987_20331552_c1_659 | 1492 | 5264 | 996 | 331 | 447 | 3.2e-42 |

Description
pir:[LN:C69066] [AC:C69066 ] [PN:ornithine cyclodeaminase] [GN:MTH1495 ]
[OR:Methanobacterium thermoautotrophicum] [DB:pir2] >gp:[GI:g2622612] [LN:AE000910]
[AC:AE000910:AE000666] [PN:ornithine cyclodeaminase] [GN:MTH1495] [OR:Methanobacterium
thermoautotrophicum] [DB:genpept-bct2] [DE:Methanobacterium thermoautotrophicum from
bases 1349621 to 1362200(section 116 of 148) of the complete genome.] [NT:Function
Code:5.09 - L-Amino Acid Metabolism,] [LE:963] [RE:1982] [DI:complement]

| ORF Name | NTID | AAID | NT Length | AA Length | score | probability |
|---|---|---|---|---|---|---|
| AI7503000987_20511590_c3_893 | 1493 | 5265 | 384 | 127 | 414 | 1.0e-38 |

Description
sp:[LN:RL7_MICLU] [AC:P02395] [GN:RPLL] [OR:MICROCOCCUS LUTEUS] [SR:,MICROCOCCUS LYSODEIKTICUS] [DE:50S RIBOSOMAL PROTEIN L7/L12 (MA1/MA2)] [SP:P02395] [DB:swissprot] >pir:[LN:R7MCML] [AC:A02771 ] [PN:ribosomal protein L7/L12:ribosomal protein MA] [CL:Escherichia coli ribosomal protein L12] [OR:Micrococcus luteus:Micrococcus lysodeikticus] [DB:pir1]

| ORF Name | NTID | AAID | NT Length | AA Length | score | probability |
|---|---|---|---|---|---|---|
| AI7503000987_20756260_c1_729 | 1494 | 5266 | 408 | 135 | 184 | 2.4e-14 |

Description
pir:[LN:T00194] [AC:T00194 ] [PN:hypothetical protein 61] [OR:Staphylococcus aureus phage phi PVL] [DB:pir3] >gp:[GI:d1032895:g3341968] [LN:AB009866] [AC:AB009866] [OR:bacteriophage phi PVL] [SR:bacteriophage phi PVL (specific_host:Staphylococcus aureus ATC] [DB:genpept-phg] [DE:Bacteriophage phi PVL proviral DNA, complete sequence.] [NT:orf 61] [LE:39932] [RE:40402] [DI:direct]

| ORF Name | NTID | AAID | NT Length | AA Length | score | probability |
|---|---|---|---|---|---|---|
| AI7503000987_20980262_c2_762 | 1495 | 5267 | 2472 | 823 | 2959 | 0.0 |

Description
sp:[LN:MECB_BACSU] [AC:P37571] [GN:MECB:CLPC] [OR:BACILLUS SUBTILIS] [DE:NEGATIVE REGULATOR OF GENETIC COMPETENCE MECB] [SP:P37571] [DB:swissprot] >pir:[LN:I40508] [AC:I40508:S66115:I40385:H69600 ] [PN:class III stress response-related ATPase clpC:adenosine triphosphatase clpC:clpA/clpB protein homolog] [GN:clpC:mecB ] [CL:ATP-dependent Clp proteinase chain A] [OR:Bacillus subtilis] [DB:pir2] >gp:[GI:d1005862:g467474] [LN:BAC180K] [AC:D26185] [PN:clpA/clpB family] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:167171] [RE:169603] [DI:direct] >gp:[GI:g442360] [LN:BSU02604] [AC:U02604] [PN:ClpC adenosine triphosphatase] [GN:mecB] [FN:competence gene repressor; required for cell] [OR:Bacillus subtilis] [DB:genpept-bct1] [DE:Bacillus subtilis Marburg 168 ClpC adenosine triphosphatase (mecB)gene, complete cds, orfX and orfY, partial cds.] [LE:335] [RE:2767] [DI:direct] >gp:[GI:e1182019:g2632353] [LN:BSUB0001] [AC:Z99104:AL009126] [PN:class III stress response-related ATPase] [GN:clpC] [FN:negative regulator of late competence genes;] [OR:Bacillus subtilis] [DB:genpept-bct1] [DE:Bacillus subtilis complete genome (section 1 of 21): from 1 to213080.] [NT:alternate gene name: mecB] [SP:P37571] [LE:103569] [RE:106001] [DI:direct]

| ORF Name | NTID | AAID | NT Length | AA Length | score | probability |
|---|---|---|---|---|---|---|
| AI7503000987_2117202_c2_831 | 1496 | 5268 | 177 | 58 | | |

Description
NO-HIT

| ORF Name | NTID | AAID | NT Length | AA Length | score | probability |
|---|---|---|---|---|---|---|
| AI7503000987_21484465_c2_848 | 1497 | 5269 | 516 | 171 | 98 | 0.019 |

Description
gp:[GI:g3702331] [LN:ATAC005397] [AC:AC005397] [GN:T3F17.17] [OR:Arabidopsis thaliana] [SR:thale cress] [DB:genpept-pln2] [DE:Arabidopsis thaliana chromosome II BAC T3F17 genomic sequence,complete sequence.] [NT:hypothetical protein] [LE:52308:52593:52780:53023] [RE:52505:52691:52902:53157] [DI:directJoin]

| ORF Name | NTID | AAID | NT Length | AA Length | score | probability |
|---|---|---|---|---|---|---|
| AI7503000987_21598838_f3_534 | 1498 | 5270 | 465 | 154 | 155 | 7.2e-11 |

Description sp:[LN:YJJP_HAEIN] [AC:P44520] [GN:HI0108] [OR:HAEMOPHILUS INFLUENZAE] [DE:HYPOTHETICAL PROTEIN HI0108] [SP:P44520] [DB:swissprot] >pir:[LN:I64142] [AC:I64142 ] [PN:hypothetical protein HI0108] [OR:Haemophilus influenzae] [DB:pir2] >gp:[GI:g1573061] [LN:U32696] [AC:U32696:L42023] [PN:conserved hypothetical protein] [GN:HI0108] [OR:Haemophilus influenzae Rd] [DB:genpept-bct2] [DE:Haemophilus influenzae Rd section 11 of 163 of the complete genome.] [NT:similar to GB:U14003 SP:P39402 PID:537207 GB:U00096] [LE:4095] [RE:4988] [DI:direct]

| ORF Name | NTID | AAID | NT Length | AA Length | score | probability |
|---|---|---|---|---|---|---|
| AI7503000987_21603777_f1_144 | 1499 | 5271 | 126 | 41 | | |

Description

NO-HIT

| ORF Name | NTID | AAID | NT Length | AA Length | score | probability |
|---|---|---|---|---|---|---|
| AI7503000987_21758468_c3_992 | 1500 | 5272 | 489 | 162 | 123 | 6.9e-08 |

Description pir:[LN:B70351] [AC:B70351 ] [PN:ribosomal-protein-alanine acetyltransferase] [GN:rimI ] [CL:Escherichia coli peptide N-acetyltransferase rimI] [OR:Aquifex aeolicus] [DB:pir2] >gp:[GI:g2983204] [LN:AE000696] [AC:AE000696:AE000657] [PN:ribosomal-protein-alanine acetyltransferase] [GN:rimI] [OR:Aquifex aeolicus] [DB:genpept-bct2] [DE:Aquifex aeolicus section 28 of 109 of the complete genome.] [LE:3558] [RE:4022] [DI:complement]

| ORF Name | NTID | AAID | NT Length | AA Length | score | probability |
|---|---|---|---|---|---|---|
| AI7503000987_22042128_f3_519 | 1501 | 5273 | 150 | 49 | | |

Description

NO-HIT

| ORF Name | NTID | AAID | NT Length | AA Length | score | probability |
|---|---|---|---|---|---|---|
| AI7503000987_22069160_c1_652 | 1502 | 5274 | 393 | 130 | 623 | 7.1e-61 |

Description sp:[LN:RS12_STAAU] [AC:P48942] [GN:RPSL] [OR:STAPHYLOCOCCUS AUREUS] [DE:30S RIBOSOMAL PROTEIN S12] [SP:P48942] [DB:swissprot] >gp:[GI:g706921] [LN:SAU20869] [AC:U20869] [PN:ribosomal protein S12] [GN:rpsL] [OR:Staphylococcus aureus] [DB:genpept-bct2] [DE:Staphylococcus aureus ribosomal protein S12 (rpsL) gene, completecds, ribosomal protein S7 (rpsG) and ORF 1 genes, partial cds.] [LE:418] [RE:831] [DI:direct]

| ORF Name | NTID | AAID | NT Length | AA Length | score | probability |
|---|---|---|---|---|---|---|
| AI7503000987_2211036_f2_414 | 1503 | 5275 | 174 | 57 | | |

Description

NO-HIT

| ORF Name | NTID | AAID | NT Length | AA Length | score | probability |
|---|---|---|---|---|---|---|
| AI7503000987_22272200_c1_735 | 1504 | 5276 | 939 | 312 | | |

Description

NO-HIT

| ORF_Name | NTID | AAID | NT Length | AA Length | score | probability |
|---|---|---|---|---|---|---|
| AI7503000987_22400261_c2_843 | 1505 | 5277 | 834 | 277 | 634 | 4.9e-62 |

Description
gp:[GI:e139438:g1369939] [LN:BTP9011] [AC:X84706] [PN:major head protein] [GN:mhp]
[OR:Bacteriophage B1] [DB:genpept-phg] [DE:Bacteriophage TP901-1 genomic region.]
[LE:360] [RE:1181] [DI:direct]

| ORF_Name | NTID | AAID | NT Length | AA Length | score | probability |
|---|---|---|---|---|---|---|
| AI7503000987_22539010_f3_603 | 1506 | 5278 | 129 | 42 | | |

Description
NO-HIT

| ORF_Name | NTID | AAID | NT Length | AA Length | score | probability |
|---|---|---|---|---|---|---|
| AI7503000987_22539186_f1_67 | 1507 | 5279 | 138 | 45 | | |

Description
NO-HIT

| ORF_Name | NTID | AAID | NT Length | AA Length | score | probability |
|---|---|---|---|---|---|---|
| AI7503000987_22689067_f1_205 | 1508 | 5280 | 1221 | 406 | 1218 | 6.3e-124 |

Description
sp:[LN:NUPC_BACSU] [AC:P39141] [GN:NUPC] [OR:BACILLUS SUBTILIS] [DE:PYRIMIDINE
NUCLEOSIDE TRANSPORT PROTEIN] [SP:P39141] [DB:swissprot] >gp:[GI:d1008934:g1408507]
[LN:D45912] [AC:D45912] [PN:pyrimidine nucleoside transport protein] [GN:nupC]
[OR:Bacillus subtilis] [SR:Bacillus subtilis (strain:BGSC 1A1 (Marburg 168; trpC2))
DNA] [DB:genpept-bct1] [DE:Bacillus subtilis genome sequence between the iol and hut
operon,partial and complete cds.] [LE:20443] [RE:21624] [DI:direct]

| ORF_Name | NTID | AAID | NT Length | AA Length | score | probability |
|---|---|---|---|---|---|---|
| AI7503000987_22694377_c2_776 | 1509 | 5281 | 741 | 246 | 762 | 1.3e-75 |

Description
pir:[LN:S59955] [AC:S59955 ] [PN:hypothetical protein 202] [CL:hypothetical protein
MJ0882] [OR:Staphylococcus aureus] [DB:pir2] >gp:[GI:g677850] [LN:SARPLRPO] [AC:X64172]
[PN:hypothetical protein] [GN:ORF202] [OR:Staphylococcus aureus] [DB:genpept-bct1]
[DE:S.aureus rplL, orf202, rpoB(rif) and rpoC genes for ribosomalprotein L7/L12,
hypothetical protein ORF202, DNA-directed RNApolymerase beta & beta' chains.] [LE:399]
[RE:1007] [DI:direct]

| ORF_Name | NTID | AAID | NT Length | AA Length | score | probability |
|---|---|---|---|---|---|---|
| AI7503000987_22773302_c1_741 | 1510 | 5282 | 1803 | 600 | 1371 | 3.9e-140 |

Description
gp:[GI:e286568:g2764983] [LN:BP187PLYH] [AC:Y07740] [PN:cell wall hydrolase Ply187]
[GN:ply187] [OR:Staphylococcus phage 187] [DB:genpept-phg] [DE:Staphylococcus phage 187
ply187 and hol187 genes.] [LE:222] [RE:2108] [DI:direct]

| ORF_Name | NTID | AAID | NT Length | AA Length | score | probability |
|---|---|---|---|---|---|---|
| AI7503000987_22790941_c2_847 | 1511 | 5283 | 543 | 180 | 143 | 5.2e-10 |

Description
gp:[GI:e244714:g2764866] [LN:BSPP1GENM] [AC:X97918] [OR:Bacteriophage SPP1]
[DB:genpept-phg] [DE:Bacteriophage SPP1 complete nucleotide sequence.] [NT:gene 17.1]
[LE:10481] [RE:11014] [DI:direct]

| ORF Name | NTID | AAID | NT Length | AA Length | score | probability |
|---|---|---|---|---|---|---|
| AI7503000987_23442135_c1_685 | 1512 | 5284 | 675 | 224 | 156 | 7.9e-11 |

Description
pir:[LN:F71309] [AC:F71309 ] [PN:probable phosphoglycolate phosphatase (gph-2)]
[GN:TP0554 ] [OR:Treponema pallidum subsp. pallidum] [SR:, syphilis spirochete]
[DB:pir2] >gp:[GI:g3322848] [LN:AE001231] [AC:AE001231:AE000520] [PN:phosphoglycolate
phosphatase (gph-2)] [GN:TP0554] [OR:Treponema pallidum] [DB:genpept-bct2]
[DE:Treponema pallidum section 47 of 87 of the complete genome.] [NT:similar to
GB:L42023 SP:P44755 PID:1004013] [LE:1483] [RE:2151] [DI:direct]

| ORF Name | NTID | AAID | NT Length | AA Length | score | probability |
|---|---|---|---|---|---|---|
| AI7503000987_23469213_c2_838 | 1513 | 5285 | 411 | 136 | | |

Description
NO-HIT

| ORF Name | NTID | AAID | NT Length | AA Length | score | probability |
|---|---|---|---|---|---|---|
| AI7503000987_23477213_c1_701 | 1514 | 5286 | 1011 | 336 | 1085 | 7.9e-110 |

Description
pir:[LN:S39743] [AC:S39743:D69683 ] [PN:phosphotransacetylase pta] [GN:pta ]
[CL:phosphate acetyltransferase] [OR:Bacillus subtilis] [DB:pir2] >gp:[GI:g580883]
[LN:BSGENR] [AC:X73124] [GN:ipa-88d] [OR:Bacillus subtilis] [DB:genpept-bct1]
[DE:B.subtilis genomic region (325 to 333).] [SP:P39646] [LE:91234] [RE:92205]
[DI:direct] >gp:[GI:e1186266:g2636302] [LN:BSUB0020] [AC:Z99123:AL009126]
[PN:phosphotransacetylase] [GN:pta] [OR:Bacillus subtilis] [DB:genpept-bct1]
[EC:2.3.1.8] [DE:Bacillus subtilis complete genome (section 20 of 21): from 3798401to
4010550.] [NT:alternate gene name: ipa-88d, ywfJ] [SP:P39646] [LE:65754] [RE:66725]
[DI:complement]

| ORF Name | NTID | AAID | NT Length | AA Length | score | probability |
|---|---|---|---|---|---|---|
| AI7503000987_23554700_c3_1002 | 1515 | 5287 | 162 | 53 | | |

Description
NO-HIT

| ORF Name | NTID | AAID | NT Length | AA Length | score | probability |
|---|---|---|---|---|---|---|
| AI7503000987_23572178_c3_958 | 1516 | 5288 | 195 | 64 | | |

Description
NO-HIT

| ORF Name | NTID | AAID | NT Length | AA Length | score | probability |
|---|---|---|---|---|---|---|
| AI7503000987_23601637_c2_794 | 1517 | 5289 | 816 | 271 | 374 | 1.7e-34 |

Description
pir:[LN:S60902] [AC:S60902:S49238:S44071 ] [PN:CDP-ribitol pyrophosphorylase]
[OR:Haemophilus influenzae] [DB:pir2] >gp:[GI:g471234] [LN:HISBCAL] [AC:X78559]
[OR:Haemophilus influenzae] [DB:genpept-bct1] [DE:H.influenzae DNA for serotype b
capsulation locus.] [NT:orf1] [LE:434] [RE:1858] [DI:direct]

| ORF Name | NTID | AAID | NT Length | AA Length | score | probability |
|---|---|---|---|---|---|---|
| AI7503000987_23603391_c3_969 | 1518 | 5290 | 294 | 97 | 94 | 0.00030 |

Description
gp:[GI:e1389970:g4539393] [LN:ATF28A21] [AC:AL035526] [PN:hypothetical protein]
[GN:F28A21.150] [OR:Arabidopsis thaliana] [SR:thale cress] [DB:genpept-pln1]
[DE:Arabidopsis thaliana DNA chromosome 4, BAC clone F28A21 (ESSAproject).]
[LE:62401:62755:63247] [RE:62693:63126:63337] [DI:complementJoin]

| ORF Name | NTID | AAID | NT Length | AA Length | score | probability |
|---|---|---|---|---|---|---|
| AI7503000987_23617140_c1_686 | 1519 | 5291 | 1404 | 467 | 441 | 6.0e-44 |

Description
pir:[LN:A69832] [AC:A69832 ] [PN:long-chain fatty-acid-CoA ligase homolog yhfT]
[GN:yhfT ] [CL:acetate--CoA ligase homology] [OR:Bacillus subtilis] [DB:pir2]
>gp:[GI:e1183038:g2633372] [LN:BSUB0006] [AC:Z99109:AL009126] [GN:yhfT] [FN:unknown]
[OR:Bacillus subtilis] [DB:genpept-bct1] [DE:Bacillus subtilis complete genome (section
6 of 21): from 999501 to1209940.] [NT:similar to long-chain fatty-acid-CoA ligase]
[LE:110451] [RE:111890] [DI:complement] >gp:[GI:e324999:g2226256] [LN:BSY14084]
[AC:Y14084] [PN:hypothetical protein] [GN:yhfT] [OR:Bacillus subtilis]
[DB:genpept-bct1] [DE:B.subtilis chromosomal DNA, region 78-80 degrees: aprE to comK.]
[NT:similarity to long-chain-acyl-CoA synthetase from] [LE:4879] [RE:6318]
[DI:complement]

| ORF Name | NTID | AAID | NT Length | AA Length | score | probability |
|---|---|---|---|---|---|---|
| AI7503000987_23673313_f2_408 | 1520 | 5292 | 198 | 65 | 64 | 0.0061 |

Description
gp:[GI:g3329651] [LN:CELT17A3] [AC:AF078787] [GN:T17A3.9] [OR:Caenorhabditis elegans]
[DB:genpept-inv2] [DE:Caenorhabditis elegans cosmid T17A3.] [LE:15875:16120:16852]
[RE:16060:16380:17211] [DI:complementJoin]

| ORF Name | NTID | AAID | NT Length | AA Length | score | probability |
|---|---|---|---|---|---|---|
| AI7503000987_23709631_c1_676 | 1521 | 5293 | 123 | 40 | | |

Description
NO-HIT

| ORF Name | NTID | AAID | NT Length | AA Length | score | probability |
|---|---|---|---|---|---|---|
| AI7503000987_23712830_c1_713 | 1522 | 5294 | 489 | 162 | 227 | 6.6e-19 |

Description
gp:[GI:g4049992] [LN:AF077306] [AC:AF077306] [PN:gp157] [OR:Streptococcus thermophilus
bacteriophage Sfi19] [DB:genpept-phg] [DE:Streptococcus thermophilus bacteriophage
Sfi19 gp157, gp233,putative helicase , gp151, gp271, putative primase, and gp143genes,
complete cds.] [NT:orf157] [LE:1] [RE:474] [DI:direct]

| ORF Name | NTID | AAID | NT Length | AA Length | score | probability |
|---|---|---|---|---|---|---|
| AI7503000987_23867125_f2_333 | 1523 | 5295 | 204 | 67 | 57 | 0.018 |

Description
pir:[LN:S21443] [AC:S21443 ] [PN:hypothetical protein] [OR:Dictyostelium discoideum]
[DB:pir2]

| ORF Name | NTID | AAID | NT Length | AA Length | score | probability |
|---|---|---|---|---|---|---|
| AI7503000987_23910052_f3_585 | 1524 | 5296 | 147 | 48 | | |

Description
NO-HIT

| ORF Name | NTID | AAID | NT Length | AA Length | score | probability |
|---|---|---|---|---|---|---|
| AI7503000987_2392837_c1_732 | 1525 | 5297 | 426 | 141 | 226 | 8.4e-19 |

Description
gp:[GI:e244844:g2764864] [LN:BSPP1GENM] [AC:X97918] [OR:Bacteriophage SPP1]
[DB:genpept-phg] [DE:Bacteriophage SPP1 complete nucleotide sequence.] [NT:gene 16.1]
[LE:9632] [RE:10066] [DI:direct]

| ORF Name | NTID | AAID | NT Length | AA Length | score | probability |
|---|---|---|---|---|---|---|
| AI7503000987_24026077_c3_966 | 1526 | 5298 | 954 | 317 | 560 | 3.4e-54 |

Description
pir:[LN:S58137] [AC:S58137:S24456 ] [PN:gene 7 protein] [OR:phage SPP1] [DB:pir2]
>gp:[GI:e244838:g2764848] [LN:BSPP1GENM] [AC:X97918] [OR:Bacteriophage SPP1]
[DB:genpept-phg] [DE:Bacteriophage SPP1 complete nucleotide sequence.] [NT:gene 7]
[LE:3802] [RE:4728] [DI:direct] >gp:[GI:g1052806] [LN:SPP1HEADG] [AC:X89721] [GN:7]
[OR:Bacteriophage SPP1] [DB:genpept-phg] [DE:Bacteriophage SPP1 head morphogenesis
genes 7 to 15.] [NT:product required for head morphogenesis] [LE:578] [RE:1504]
[DI:direct]

| ORF Name | NTID | AAID | NT Length | AA Length | score | probability |
|---|---|---|---|---|---|---|
| AI7503000987_24026576_c2_854 | 1527 | 5299 | 180 | 59 | | |

Description
NO-HIT

| ORF Name | NTID | AAID | NT Length | AA Length | score | probability |
|---|---|---|---|---|---|---|
| AI7503000987_24229837_c1_716 | 1528 | 5300 | 243 | 80 | 97 | 3.9e-05 |

Description
pir:[LN:A56273] [AC:A56273 ] [PN:hypothetical protein (bacteriocin saiA 3'-region)]
[OR:Lactobacillus sake] [DB:pir2] >gp:[GI:g599850] [LN:LSSAKACLU] [AC:Z46867] [GN:orf1]
[OR:Lactobacillus sakei] [DB:genpept-bct1] [DE:L.sake sakacin A gene cluster.] [LE:5]
[RE:268] [DI:complement]

| ORF Name | NTID | AAID | NT Length | AA Length | score | probability |
|---|---|---|---|---|---|---|
| AI7503000987_24258462_c3_982 | 1529 | 5301 | 336 | 111 | 200 | 4.8e-16 |

Description
gp:[GI:g928831] [LN:BK5TATTP] [AC:L44593] [FN:unidentified] [OR:Lactococcus lactis
phage BK5-T] [SR:Bacteriophage BK5-T DNA] [DB:genpept-phg] [DE:Bacteriophage BK5-T
ORF'410, 3' end pf cds, 20 ORFs, repressorprotein, and Cro repressor protein genes,
complete cds, ORF70'gene, 5' end of cds.] [NT:ORF95; putative] [LE:7452] [RE:7739]
[DI:direct]

| ORF Name | NTID | AAID | NT Length | AA Length | score | probability |
|---|---|---|---|---|---|---|
| AI7503000987_24275342_c1_718 | 1530 | 5302 | 378 | 125 | | |

Description
NO-HIT

| ORF Name | NTID | AAID | NT Length | AA Length | score | probability |
|---|---|---|---|---|---|---|
| AI7503000987_24320256_f1_134 | 1531 | 5303 | 165 | 54 | | |

Description
NO-HIT

| ORF Name | NTID | AAID | NT Length | AA Length | score | probability |
|---|---|---|---|---|---|---|
| AI7503000987_24328127_f3_452 | 1532 | 5304 | 204 | 67 | 154 | 2.6e-10 |

Description
sp:[LN:YKGC_ECOLI] [AC:P77212] [GN:YKGC] [OR:ESCHERICHIA COLI] [DE:INTERGENIC REGION] [SP:P77212] [DB:swissprot] >pir:[LN:H64756] [AC:H64756 ] [PN:probable mercury(II) reductase,:ykgC protein] [GN:ykgC ] [OR:Escherichia coli] [EC:1.16.1.1] [DB:pir2] >gp:[GI:g1657503] [LN:ECU73857] [AC:U73857] [OR:Escherichia coli] [DB:genpept-bct1] [DE:Escherichia coli chromosome minutes 6-8.] [NT:similar to S. aureus mercury(II) reductase] [LE:26473] [RE:27825] [DI:complement] >gp:[GI:g1786495] [LN:AE000137] [AC:AE000137:U00096] [PN:putative oxidoreductase] [GN:ykgC] [FN:putative enzyme; Not classified] [OR:Escherichia coli] [DB:genpept-bct2] [DE:Escherichia coli K-12 MG1655 section 27 of 400 of the completegenome.] [NT:f450; 35 pct identical (29 gaps) to 430 residues of] [LE:6292] [RE:7644] [DI:complement]

| ORF Name | NTID | AAID | NT Length | AA Length | score | probability |
|---|---|---|---|---|---|---|
| AI7503000987_24337800_c2_862 | 1533 | 5305 | 1386 | 461 | 945 | 5.4e-95 |

Description
pir:[LN:T00158] [AC:T00158 ] [PN:amidase,] [OR:Staphylococcus aureus phage phi PVL] [EC:3.5.-.-] [DB:pir3] >gp:[GI:d1032859:g3341932] [LN:AB009866] [AC:AB009866] [PN:amidase (peptidoglycan hydrolase)] [OR:bacteriophage phi PVL] [SR:bacteriophage phi PVL (specific_host:Staphylococcus aureus ATC] [DB:genpept-phg] [DE:Bacteriophage phi PVL proviral DNA, complete sequence.] [NT:orf 25] [LE:20199] [RE:21653] [DI:direct]

| ORF Name | NTID | AAID | NT Length | AA Length | score | probability |
|---|---|---|---|---|---|---|
| AI7503000987_2438878_f1_126 | 1534 | 5306 | 213 | 70 | 288 | 2.3e-25 |

Description
sp:[LN:ARSC_STAAU] [AC:P30330] [GN:ARSC] [OR:STAPHYLOCOCCUS AUREUS] [DE:ARSENATE REDUCTASE (ARSENICAL PUMP MODIFIER)] [SP:P30330] [DB:swissprot] >pir:[LN:D41903] [AC:D41903 ] [PN:arsenate reductase,] [GN:arsC ] [CL:protein-tyrosine-phosphatase, low molecular weight] [OR:Staphylococcus aureus] [EC:1.-.-.-] [DB:pir1] >gp:[GI:g150729] [LN:PI2ARSRBC] [AC:M86824] [PN:arsenate reductase] [GN:arsC] [FN:Reduction of arsenate to arsenite] [OR:Plasmid pI258] [SR:Plasmid pI258 DNA] [DB:genpept-bct1] [DE:Plasmid pI258 arsenic resistance operon (arsRBC) genes, completecds.] [LE:1894] [RE:2289] [DI:direct]

| ORF Name | NTID | AAID | NT Length | AA Length | score | probability |
|---|---|---|---|---|---|---|
| AI7503000987_24401462_c3_921 | 1535 | 5307 | 591 | 196 | 367 | 9.6e-34 |

Description
sp:[LN:YCKF_BACSU] [AC:P42404] [GN:YCKF] [OR:BACILLUS SUBTILIS] [DE:HYPOTHETICAL 20.0 KD PROTEIN IN TLPC-SRFAA INTERGENIC REGION (ORF9)] [SP:P42404] [DB:swissprot] >pir:[LN:H69760] [AC:H69760 ] [PN:conserved hypothetical protein yckF [GN:yckF ] [CL:conserved hypothetical protein MJ1247] [OR:Bacillus subtilis] [DB:pir2] >gp:[GI:d1007003:g1438846] [LN:BACYCK] [AC:D30762] [PN:unknown] [GN:yckF] [OR:Bacillus subtilis] [SR:Bacillus subtilis (strain:168trpC2) DNA, clone_lib:lambda DASHI] [DB:genpept-bct1] [DE:Bacillus subtilis DNA around 28 degrees region of chromosomecontaining yckA-H genes.] [LE:7448] [RE:8005] [DI:complement] >gp:[GI:e1182297:g2632631] [LN:BSUB0002] [AC:Z99105:AL009126] [GN:yckF] [FN:unknown] [OR:Bacillus subtilis] [DB:genpept-bct1] [DE:Bacillus subtilis complete genome (section 2 of 21): from 194651 to415810.] [NT:similar to hypothetical proteins] [LE:179524] [RE:180081] [DI:complement] >gp:[GI:d1009614:g1805417] [LN:D50453] [AC:D50453] [GN:yckF] [OR:Bacillus subtilis] [SR:Bacillus subtilis (strain:168 trpC2) DNA] [DB:genpept-bct1] [DE:Bacillus subtilis DNA for 25-36 degree region containing theamyE-srfA region, complete cds.] [LE:53828] [RE:54385] [DI:complement]

| ORF Name | NTID | AAID | NT Length | AA Length | score | probability |
|---|---|---|---|---|---|---|
| AI7503000987_24407327_c1_643 | 1536 | 5308 | 696 | 231 | 892 | 2.2e-89 |

Description
pir:[LN:E69694] [AC:E69694:S39861:S40073 ] [PN:ribosomal protein L1] [GN:rplA ] [CL:Escherichia coli ribosomal protein L1] [OR:Bacillus subtilis] [DB:pir2] >gp:[GI:e1182036:g2632370] [LN:BSUB0001] [AC:Z99104:AL009126] [PN:ribosomal protein L1 (BL1)] [GN:rplA] [OR:Bacillus subtilis] [DB:genpept-bct1] [DE:Bacillus subtilis complete genome (section 1 of 21): from 1 to213080.] [SP:Q06797] [LE:119107] [RE:119805] [DI:direct]

| ORF Name | NTID | AAID | NT Length | AA Length | score | probability |
|---|---|---|---|---|---|---|
| AI7503000987_24414050_c2_806 | 1537 | 5309 | 2793 | 930 | 4374 | 0.0 |

Description
gp:[GI:e1296735:g3201550] [LN:SEY17116] [AC:Y17116] [PN:fibrinogen-binding protein] [OR:Staphylococcus epidermidis] [DB:genpept-bct1] [DE:Staphylococcus epidermidis gene encoding fibrinogen-bindingprotein, complete CDS.] [LE:38] [RE:3316] [DI:direct]

| ORF Name | NTID | AAID | NT Length | AA Length | score | probability |
|---|---|---|---|---|---|---|
| AI7503000987_24415875_c1_660 | 1538 | 5310 | 300 | 99 | 129 | 1.7e-07 |

Description
gp:[GI:g1458327] [LN:CELF08F3] [AC:U64847] [GN:F08F3.4] [OR:Caenorhabditis elegans] [SR:Caenorhabditis elegans strain=Bristol N2] [DB:genpept-inv1] [DE:Caenorhabditis elegans cosmid F08F3.] [LE:1515:1817:2044:2841] [RE:1758:1994:2276:3110] [DI:directJoin]

| ORF Name | NTID | AAID | NT Length | AA Length | score | probability |
|---|---|---|---|---|---|---|
| AI7503000987_24422175_f2_402 | 1539 | 5311 | 132 | 43 | | |

Description
NO-HIT

| ORF Name | NTID | AAID | NT Length | AA Length | score | probability |
|---|---|---|---|---|---|---|
| AI7503000987_24429643_c2_793 | 1540 | 5312 | 222 | 73 | 58 | 0.011 |

Description
sp:[LN:YA28_PYRHO] [AC:O58584] [GN:PHAL028] [OR:PYROCOCCUS HORIKOSHII] [DE:HYPOTHETICAL PROTEIN PHAL028] [SP:O58584] [DB:swissprot] >pir:[LN:B71136] [AC:B71136 ] [PN:hypothetical protein PH0854] [GN:PH0854 ] [CL:hypothetical protein HI0719] [OR:Pyrococcus horikoshii] [DB:pir2] >gp:[GI:d1030891:g3257265] [LN:AP000003] [AC:AP000003:AB009484:AB009485:AB009486:AB009487:AB009488:AB009489] [PN:137aa long hypothetical protein] [GN:PH0854] [OR:Pyrococcus horikoshii] [SR:Pyrococcus horikoshii (strain:OT3) DNA] [DB:genpept-bct1] [DE:Pyrococcus horikoshii OT3 genomic DNA, 544001-777000 nt. position(3/7).] [NT:similar to Swiss_Prot:P37552 percent identity:] [LE:218223] [RE:218636] [DI:complement]

| ORF Name | NTID | AAID | NT Length | AA Length | score | probability |
|---|---|---|---|---|---|---|
| AI7503000987_24491037_c1_719 | 1541 | 5313 | 495 | 164 | | |

Description
NO-HIT

| ORF Name | NTID | AAID | NT Length | AA Length | score | probability |
|---|---|---|---|---|---|---|
| AI7503000987_24500387_c3_961 | 1542 | 5314 | 564 | 187 | 85 | 0.0016 |

Description
sp:[LN:Y53_BPT3] [AC:P20327] [GN:5.3] [OR:BACTERIOPHAGE T3] [DE:HYPOTHETICAL GENE 5.3 PROTEIN] [SP:P20327] [DB:swissprot] >pir:[LN:S07514] [AC:S07514 ] [PN:gene 5.3 protein] [GN:5.3 ] [CL:phage T7 gene 2.8 protein] [OR:phage T3] [DB:pir2] >gp:[GI:g15705] [LN:POT3111G] [AC:X17255] [GN:5.3] [OR:Bacteriophage T3] [DB:genpept-phg] [DE:Bacteriophage T3 gene 1 to gene 11.] [SP:P20327] [LE:12333] [RE:12638] [DI:direct]

| ORF Name | NTID | AAID | NT Length | AA Length | score | probability |
|---|---|---|---|---|---|---|
| AI7503000987_245953_c3_881 | 1543 | 5315 | 579 | 192 | 231 | 2.5e-19 |

Description
gp:[GI:g1314295] [LN:LMU40604] [AC:U40604] [FN:unknown] [OR:Listeria monocytogenes] [DB:genpept-bct2] [DE:Listeria monocytogenes ClpC ATPase (mec) gene, complete cds.] [NT:ORF2; putative 19 kDa protein] [LE:672] [RE:1196] [DI:direct]

| ORF Name | NTID | AAID | NT Length | AA Length | score | probability |
|---|---|---|---|---|---|---|
| AI7503000987_24617130_c3_896 | 1544 | 5316 | 3648 | 1215 | 5258 | 0.0 |

Description
gp:[GI:e187583:g1495791] [LN:SARPOCGEN] [AC:X89233] [PN:DNA-directed RNA polymerase] [GN:rpoC] [OR:Staphylococcus aureus] [DB:genpept-bct1] [EC:2.7.7.6] [DE:S.aureus DNA for rpoC gene.] [NT:B' subunit] [SP:P47770] [LE:<1] [RE:>3171] [DI:direct]

| ORF Name | NTID | AAID | NT Length | AA Length | score | probability |
|---|---|---|---|---|---|---|
| AI7503000987_24648937_c3_924 | 1545 | 5317 | 657 | 218 | 626 | 3.4e-61 |

Description
sp:[LN:UNG_BACSU] [AC:P39615] [GN:UNG:IPA-57D] [OR:BACILLUS SUBTILIS] [EC:3.2.2.-]
[DE:URACIL-DNA GLYCOSYLASE, (UDG)] [SP:P39615] [DB:swissprot] >pir:[LN:S39712]
[AC:S39712:H69728 ] [PN:uracil-DNA glycosylase, ung] [GN:ung ] [CL:uracil-DNA
glycosylase] [OR:Bacillus subtilis] [EC:3.2.2.-] [DB:pir2] >gp:[GI:g580875] [LN:BSGENR]
[AC:X73124] [GN:ipa-57d] [OR:Bacillus subtilis] [DB:genpept-bct1] [DE:B.subtilis
genomic region (325 to 333).] [SP:P39615] [LE:59206] [RE:59883] [DI:direct]
>gp:[GI:e1186296:g2636332] [LN:BSUB0020] [AC:Z99123:AL009126] [PN:uracil-DNA
glycosylase] [GN:ung] [OR:Bacillus subtilis] [DB:genpept-bct1] [EC:3.2.2.-]
[DE:Bacillus subtilis complete genome (section 20 of 21): from 3798401to 4010550.]
[NT:alternate gene name: ipa-57d, ywdG] [SP:P39615] [LE:98079] [RE:98756]
[DI:complement]

| ORF Name | NTID | AAID | NT Length | AA Length | score | probability |
|---|---|---|---|---|---|---|
| AI7503000987_24650332_c3_962 | 1546 | 5318 | 228 | 75 | | |

Description
NO-HIT

| ORF Name | NTID | AAID | NT Length | AA Length | score | probability |
|---|---|---|---|---|---|---|
| AI7503000987_24650468_f3_522 | 1547 | 5319 | 1383 | 460 | 711 | 3.4e-70 |

Description
gp:[GI:d1037645:g4126638] [LN:AB016282] [AC:AB016282] [PN:site-specific recombinase for
integration and] [OR:bacteriophage phi-105] [SR:bacteriophage phi-105 DNA]
[DB:genpept-phg] [DE:Bacteriophage phi-105 DNA, complete sequence.] [NT:ORF3]
[LE:25528] [RE:26952] [DI:complement]

| ORF Name | NTID | AAID | NT Length | AA Length | score | probability |
|---|---|---|---|---|---|---|
| AI7503000987_24656552_c2_772 | 1548 | 5320 | 150 | 49 | 149 | 1.2e-10 |

Description
sp:[LN:RL33_THEMA] [AC:P35873] [GN:RPMG] [OR:THERMOTOGA MARITIMA] [DE:50S RIBOSOMAL
PROTEIN L33] [SP:P35873] [DB:swissprot] >gp:[GI:g407022] [LN:TMNUSGGE] [AC:Z11839]
[PN:RIBOSOMAL PROTEIN L33] [OR:Thermotoga maritima] [DB:genpept-bct1] [DE:T.maritima
nusG gene and genes for ribosomal proteins.] [SP:P35873] [LE:579] [RE:728] [DI:direct]
>gp:[GI:g4980957] [LN:AE001723] [AC:AE001723:AE000512] [PN:ribosomal protein L33]
[GN:TM0451] [OR:Thermotoga maritima] [DB:genpept-bct2] [DE:Thermotoga maritima section
35 of 136 of the complete genome.] [NT:similar to SP:P35873 GB:Z11839 PID:407022]
[LE:5319] [RE:5468] [DI:direct]

| ORF Name | NTID | AAID | NT Length | AA Length | score | probability |
|---|---|---|---|---|---|---|
| AI7503000987_24667192_f2_350 | 1549 | 5321 | 183 | 60 | 201 | 1.7e-15 |

Description
sp:[LN:ARSB_STAAU] [AC:P30329] [GN:ARSB] [OR:STAPHYLOCOCCUS AUREUS] [DE:ARSENICAL PUMP
MEMBRANE PROTEIN] [SP:P30329] [DB:swissprot] >pir:[LN:C41903] [AC:C41903 ]
[PN:arsenical pump membrane protein] [GN:arsB ] [CL:arsenical pump membrane protein]
[OR:Staphylococcus aureus] [DB:pir1] >gp:[GI:g150728] [LN:PI2ARSRBC] [AC:M86824]
[PN:arsenic efflux pump protein] [GN:arsB] [FN:arsenic efflux pump component (membrane]
[OR:Plasmid pI258] [SR:Plasmid pI258 DNA] [DB:genpept-bct1] [DE:Plasmid pI258 arsenic
resistance operon (arsRBC) genes, completecds.] [LE:587] [RE:1876] [DI:direct]

| ORF Name | NTID | AAID | NT Length | AA Length | score | probability |
|---|---|---|---|---|---|---|
| AI7503000987_24803462_f1_9 | 1550 | 5322 | 861 | 286 | 463 | 6.4e-44 |

Description
sp:[LN:YH17_SYNY3] [AC:P73846] [GN:SLR1717] [OR:SYNECHOCYSTIS SP] [SR:PCC 6803,] [DE:HYPOTHETICAL 30.2 KD PROTEIN SLR1717] [SP:P73846] [DB:swissprot] >pir:[LN:S75043] [AC:S75043 ] [PN:hypothetical protein slr1717] [OR:Synechocystis sp.] [SR:PCC 6803, , PCC 6803] [SR:PCC 6803, ] [DB:pir2] >gp:[GI:d1018638:g1652988] [LN:D90910] [AC:D90910:AB001339] [PN:hypothetical protein] [OR:Synechocystis sp.] [SR:Synechocystis sp. (strain:PCC6803) DNA] [DB:genpept-bct1] [DE:Synechocystis sp. PCC6803 complete genome, 12/27, 1430419-1576592.] [NT:ORF_ID:slr1717] [LE:37735] [RE:38541] [DI:direct]

| ORF Name | NTID | AAID | NT Length | AA Length | score | probability |
|---|---|---|---|---|---|---|
| AI7503000987_24823437_f3_521 | 1551 | 5323 | 495 | 164 | 71 | 0.044 |

Description
gp:[GI:g46550] [LN:SACP221] [AC:X02166] [OR:Staphylococcus aureus] [DB:genpept-bct1] [DE:Staphylococcus plasmid pC221.] [NT:pot. reading-frame C (aa 1-90) (4555 is 2nd base in] [SP:P03866] [LE:4287] [RE:>4555] [DI:direct] >gp:[GI:e190060:g1333818] [LN:SAPC221] [AC:X02529] [OR:Staphylococcus aureus] [DB:genpept-bct1] [DE:Staphylococcus aureus plasmid pC221 complete DNA sequence.] [NT:pot. orfB (aa 1-92) (4557 is 2nd base in codon)] [SP:P03866] [LE:4289] [RE:>4557] [DI:direct]

| ORF Name | NTID | AAID | NT Length | AA Length | score | probability |
|---|---|---|---|---|---|---|
| AI7503000987_24854637_c2_804 | 1552 | 5324 | 903 | 300 | 404 | 1.1e-37 |

Description
pir:[LN:C70070] [AC:C70070 ] [PN:conserved hypothetical protein ywtE] [GN:ywtE ] [CL:hypothetical protein ywpJ] [OR:Bacillus subtilis] [DB:pir2]
>gp:[GI:e1184491:g2636110] [LN:BSUB0019] [AC:Z99122:AL009126] [GN:ywtE] [FN:unknown] [OR:Bacillus subtilis] [DB:genpept-bct1] [DE:Bacillus subtilis complete genome (section 19 of 21): from 3597091to 3809700.] [NT:similar to hypothetical proteins] [LE:97330] [RE:98190] [DI:direct] >gp:[GI:e308093:g1894770] [LN:BSZ92954] [AC:Z92954] [GN:ywtE] [OR:Bacillus subtilis] [DB:genpept-bct1] [DE:B.subtilis yws[A,B,C,D,E,F,G] and gerBC genes.] [NT:product similar to Bacillus subtilis YxeH and YcsE] [LE:4292] [RE:5152] [DI:complement] >gp:[GI:e1184491:g2636110] [LN:BSUB0019] [AC:Z99122:AL009126] [GN:ywtE] [FN:unknown] [OR:Bacillus subtilis] [DB:genpept] [DE:Bacillus subtilis complete genome (section 19 of 21): from 3597091to 3809700.] [NT:similar to hypothetical proteins] [LE:97330] [RE:98190] [DI:direct]

| ORF Name | NTID | AAID | NT Length | AA Length | score | probability |
|---|---|---|---|---|---|---|
| AI7503000987_24855325_c3_936 | 1553 | 5325 | 129 | 42 | | |

Description
NO-HIT

| ORF Name | NTID | AAID | NT Length | AA Length | score | probability |
|---|---|---|---|---|---|---|
| AI7503000987_25398262_f3_622 | 1554 | 5326 | 132 | 43 | | |

Description
NO-HIT

| ORF Name | NTID | AAID | NT Length | AA Length | score | probability |
|---|---|---|---|---|---|---|
| AI7503000987_25478801_f3_446 | 1555 | 5327 | 147 | 48 | | |

Description
NO-HIT

| ORF Name | NTID | AAID | NT Length | AA Length | score | probability |
|---|---|---|---|---|---|---|
| AI7503000987_25509692_c3_972 | 1556 | 5328 | 498 | 165 | 151 | 7.4e-11 |

Description
gp:[GI:e244846:g2764870] [LN:BSPP1GENM] [AC:X97918] [OR:Bacteriophage SPP1] [DB:genpept-phg] [DE:Bacteriophage SPP1 complete nucleotide sequence.] [NT:gene 17.5] [LE:11342] [RE:11881] [DI:direct]

| ORF Name | NTID | AAID | NT Length | AA Length | score | probability |
|---|---|---|---|---|---|---|
| AI7503000987_25578827_c3_897 | 1557 | 5329 | 261 | 86 | 334 | 3.0e-30 |

Description
sp:[LN:YBXF_STAAU] [AC:Q53602] [OR:STAPHYLOCOCCUS AUREUS] [DE:PROBABLE RIBOSOMAL PROTEIN IN RPSL 5'REGION (FRAGMENT)] [SP:Q53602] [DB:swissprot] >gp:[GI:g706920] [LN:SAU20869] [AC:U20869] [PN:unknown] [FN:unknown] [OR:Staphylococcus aureus] [DB:genpept-bct2] [DE:Staphylococcus aureus ribosomal protein S12 (rpsL) gene, completecds, ribosomal protein S7 (rpsG) and ORF 1 genes, partial cds.] [NT:ORF 1] [LE:<1] [RE:320] [DI:direct]

| ORF Name | NTID | AAID | NT Length | AA Length | score | probability |
|---|---|---|---|---|---|---|
| AI7503000987_25579662_f3_575 | 1558 | 5330 | 1221 | 406 | 849 | 8.0e-85 |

Description
pir:[LN:H69817] [AC:H69817 ] [PN:aminoacylase homolog yhaA] [GN:yhaA ] [CL:hippurate hydrolase] [OR:Bacillus subtilis] [DB:pir2] >gp:[GI:e1183009:g2633343] [LN:BSUB0006] [AC:Z99109:AL009126] [GN:yhaA] [FN:unknown] [OR:Bacillus subtilis] [DB:genpept-bct1] [DE:Bacillus subtilis complete genome (section 6 of 21): from 999501 to1209940.] [NT:similar to aminoacylase] [LE:80123] [RE:81313] [DI:complement]

| ORF Name | NTID | AAID | NT Length | AA Length | score | probability |
|---|---|---|---|---|---|---|
| AI7503000987_25660937_c3_990 | 1559 | 5331 | 498 | 165 | 175 | 3.5e-13 |

Description
sp:[LN:OPUC_BACSU] [AC:P46922] [GN:OPUAC] [OR:BACILLUS SUBTILIS] [DE:GLYCINE BETAINE-BINDING PROTEIN PRECURSOR] [SP:P46922] [DB:swissprot] >pir:[LN:I40537] [AC:I40537:F69669 ] [PN:glycine betaine ABC transporter (glycine betaine-binding protein) opuAC precursor] [GN:opuAC ] [OR:Bacillus subtilis] [DB:pir2] >gp:[GI:e1182252:g2632586] [LN:BSUB0002] [AC:Z99105:AL009126] [PN:glycine betaine ABC transporter (glycine] [GN:opuAC] [FN:glycine betaine transport (osmoprotection)] [OR:Bacillus subtilis] [DB:genpept-bct1] [DE:Bacillus subtilis complete genome (section 2 of 21): from 194651 to415810.] [SP:P46922] [LE:128023] [RE:128904] [DI:direct] >gp:[GI:d1009569:g1805372] [LN:D50453] [AC:D50453] [PN:glycine betain-binding protein precursor] [GN:opuAC] [OR:Bacillus subtilis] [SR:Bacillus subtilis (strain:168 trpC2) DNA] [DB:genpept-bct1] [DE:Bacillus subtilis DNA for 25-36 degree region containing theamyE-srfA region, complete cds.] [LE:2326] [RE:3207] [DI:direct] >gp:[GI:g984805] [LN:BSU17292] [AC:U17292] [PN:glycine betaine-binding protein precursor] [GN:opuAC] [OR:Bacillus subtilis] [DB:genpept-bct2] [DE:Bacillus subtilis ATPase (opuAA), transmembrane protein (opuAB) andglycine betaine-binding protein precursor (opuAC) genes, completecds.] [LE:2332] [RE:3213] [DI:direct]

| ORF Name | NTID | AAID | NT Length | AA Length | score | probability |
|---|---|---|---|---|---|---|
| AI7503000987_25667753_c2_773 | 1560 | 5332 | 564 | 187 | 906 | 7.3e-91 |

Description sp:[LN:NUSG_STACA] [AC:P36264] [GN:NUSG] [OR:STAPHYLOCOCCUS CARNOSUS] [DE:TRANSCRIPTION ANTITERMINATION PROTEIN NUSG] [SP:P36264] [DB:swissprot] >pir:[LN:S38870] [AC:S38870 ] [PN:transcription antitermination factor nusG] [GN:nusG ] [CL:transcription antitermination factor nusG] [OR:Staphylococcus carnosus] [DB:pir2] >gp:[GI:g426473] [LN:SCSECE] [AC:X76134] [GN:nusG] [OR:Staphylococcus carnosus] [DB:genpept-bct1] [DE:S.carnosus secE, nusG and rplK genes.] [SP:P36264] [LE:331] [RE:879] [DI:direct]

| ORF Name | NTID | AAID | NT Length | AA Length | score | probability |
|---|---|---|---|---|---|---|
| AI7503000987_25972086_f1_108 | 1561 | 5333 | 135 | 44 | | |

Description

NO-HIT

| ORF Name | NTID | AAID | NT Length | AA Length | score | probability |
|---|---|---|---|---|---|---|
| AI7503000987_26173287_c3_970 | 1562 | 5334 | 363 | 120 | 103 | 9.0e-06 |

Description gp:[GI:e244712:g2764863] [LN:BSPP1GENM] [AC:X97918] [OR:Bacteriophage SPP1] [DB:genpept-phg] [DE:Bacteriophage SPP1 complete nucleotide sequence.] [NT:gene 16] [LE:9322] [RE:9651] [DI:direct]

| ORF Name | NTID | AAID | NT Length | AA Length | score | probability |
|---|---|---|---|---|---|---|
| AI7503000987_26206687_c1_642 | 1563 | 5335 | 210 | 69 | 278 | 2.6e-24 |

Description sp:[LN:SECE_STAAU] [AC:O06442] [GN:SECE] [OR:STAPHYLOCOCCUS AUREUS] [DE:PREPROTEIN TRANSLOCASE SECE SUBUNIT] [SP:O06442] [DB:swissprot] >gp:[GI:g2078376] [LN:SAU96619] [AC:U96619] [PN:SecE] [GN:secE] [OR:Staphylococcus aureus] [DB:genpept-bct1] [DE:Staphylococcus aureus NCTC 8325 SecE (secE), NusG (nusG) and RplK(rplK) genes, complete cds.] [LE:31] [RE:213] [DI:direct]

| ORF Name | NTID | AAID | NT Length | AA Length | score | probability |
|---|---|---|---|---|---|---|
| AI7503000987_26290912_f3_547 | 1564 | 5336 | 882 | 293 | 665 | 2.5e-65 |

Description pir:[LN:H69759] [AC:H69759 ] [PN:conserved hypothetical protein yciA] [GN:yciA ] [OR:Bacillus subtilis] [DB:pir2] >gp:[GI:e1182286:g2632620] [LN:BSUB0002] [AC:Z99105:AL009126] [GN:yciA] [FN:unknown] [OR:Bacillus subtilis] [DB:genpept-bct1] [DE:Bacillus subtilis complete genome (section 2 of 21): from 194651 to415810.] [NT:similar to hypothetical proteins] [LE:169177] [RE:170094] [DI:direct] >gp:[GI:d1009603:g1805406] [LN:D50453] [AC:D50453] [GN:yciA] [OR:Bacillus subtilis] [SR:Bacillus subtilis (strain:168 trpC2) DNA] [DB:genpept-bct1] [DE:Bacillus subtilis DNA for 25-36 degree region containing theamyE-srfA region, complete cds.] [LE:43480] [RE:44397] [DI:direct]

| ORF Name | NTID | AAID | NT Length | AA Length | score | probability |
|---|---|---|---|---|---|---|
| AI7503000987_26306568_c1_724 | 1565 | 5337 | 330 | 109 | 83 | 0.019 |

Description gp:[GI:g4894306] [LN:AF065404] [AC:AF065404] [PN:pXO1-90] [OR:Bacillus anthracis] [DB:genpept-bct2] [DE:Bacillus anthracis virulence plasmid PX01, complete sequence.] [LE:106772] [RE:108730] [DI:direct]

| ORF Name | NTID | AAID | NT Length | AA Length | score | probability |
|---|---|---|---|---|---|---|
| AI7503000987_26350125_c2_834 | 1566 | 5338 | 252 | 83 | 79 | 0.041 |

Description pir:[LN:C69161] [AC:C69161 ] [PN:sensory transduction histidine kinase] [GN:MTH468 ]
[OR:Methanobacterium thermoautotrophicum] [DB:pir2] >gp:[GI:g2621537] [LN:AE000831]
[AC:AE000831:AE000666] [PN:sensory transduction histidine kinase] [GN:MTH468]
[OR:Methanobacterium thermoautotrophicum] [DB:genpept-bct1] [DE:Methanobacterium
thermoautotrophicum from bases 404817 to 415582(section 37 of 148) of the complete
genome.] [NT:Function Code:12.12 - Cell Processes, Broad] [LE:3329] [RE:4993]
[DI:complement]

| ORF Name | NTID | AAID | NT Length | AA Length | score | probability |
|---|---|---|---|---|---|---|
| AI7503000987_26360327_c1_725 | 1567 | 5339 | 552 | 183 | 515 | 2.0e-49 |

Description pir:[LN:T00186] [AC:T00186 ] [PN:dUTP pyrophosphatase,] [OR:Staphylococcus aureus phage
phi PVL] [EC:3.6.1.23] [DB:pir3] >gp:[GI:d1032887:g3341960] [LN:AB009866] [AC:AB009866]
[PN:dUTPase] [OR:bacteriophage phi PVL] [SR:bacteriophage phi PVL
(specific_host:Staphylococcus aureus ATC] [DB:genpept-phg] [DE:Bacteriophage phi PVL
proviral DNA, complete sequence.] [NT:orf 53] [LE:37579] [RE:38106] [DI:direct]

| ORF Name | NTID | AAID | NT Length | AA Length | score | probability |
|---|---|---|---|---|---|---|
| AI7503000987_26369082_c2_837 | 1568 | 5340 | 252 | 83 | | |

Description
NO-HIT

| ORF Name | NTID | AAID | NT Length | AA Length | score | probability |
|---|---|---|---|---|---|---|
| AI7503000987_26375952_c1_714 | 1569 | 5341 | 627 | 208 | 223 | 1.7e-18 |

Description gp:[GI:e1254413:g2924242] [LN:BTP901456] [AC:Y14232] [PN:hypothetical protein]
[OR:Bacteriophage TP901-1] [DB:genpept-phg] [DE:Bacteriophage TP901-1 ORFs 1-12.]
[NT:ORF11] [LE:5545] [RE:6168] [DI:direct]

| ORF Name | NTID | AAID | NT Length | AA Length | score | probability |
|---|---|---|---|---|---|---|
| AI7503000987_26569377_c2_810 | 1570 | 5342 | 639 | 212 | 625 | 4.4e-61 |

Description sp:[LN:HUMS_BACSU] [AC:P42405:O31477] [GN:YCKG] [OR:BACILLUS SUBTILIS] [EC:4.1.2.-]
[DE:3-HEXULOSE 6-PHOSPHATE FORMALDEHYDE LYASE)] [SP:P42405:O31477] [DB:swissprot]
>pir:[LN:A69761] [AC:A69761 ] [PN:D-arabino 3-hexulose 6-phosphate formaldeh homolog
yckG] [GN:yckG ] [OR:Bacillus subtilis] [DB:pir2] >gp:[GI:e1182298:g2632632]
[LN:BSUB0002] [AC:Z99105:AL009126] [GN:yckG] [FN:unknown] [OR:Bacillus subtilis]
[DB:genpept-bct1] [DE:Bacillus subtilis complete genome (section 2 of 21): from 194651
to415810.] [NT:similar to D-arabino 3-hexulose 6-phosphate] [SP:P42405] [LE:180087]
[RE:180719] [DI:complement]

| ORF Name | NTID | AAID | NT Length | AA Length | score | probability |
|---|---|---|---|---|---|---|
| AI7503000987_26734625_f1_89 | 1571 | 5343 | 351 | 116 | 210 | 4.1e-17 |

Description gp:[GI:e308969:g2292761] [LN:BSFI21LYS] [AC:X95646] [PN:cI-like repressor] [GN:orf127]
[OR:Streptococcus thermophilus bacteriophage Sfi21] [DB:genpept-phg] [DE:Streptococcus
thermophilus bacteriophage Sfi21 DNA; lysogenymodule, 8141 bp.] [NT:putative] [LE:5693]
[RE:6076] [DI:complement]

| ORF Name | NTID | AAID | NT Length | AA Length | score | probability |
|---|---|---|---|---|---|---|
| AI7503000987_26772801_f1_91 | 1572 | 5344 | 504 | 167 | 168 | 6.1e-12 |

Description
pir:[LN:A71608] [AC:A71608 ] [PN:probable integral membrane protein PFB0710c]
[GN:PFB0710c ] [OR:Plasmodium falciparum] [DB:pir2] >gp:[GI:g3845257] [LN:AE001413]
[AC:AE001413:AE001362] [PN:predicted integral membrane protein] [GN:PFB0710c]
[OR:Plasmodium falciparum] [SR:malaria parasite P. falciparum] [DB:genpept-inv2]
[DE:Plasmodium falciparum chromosome 2, section 50 of 73 of thecomplete sequence.]
[NT:predicted by GlimmerM] [LE:4351] [RE:5562] [DI:complement]

| ORF Name | NTID | AAID | NT Length | AA Length | score | probability |
|---|---|---|---|---|---|---|
| AI7503000987_26839638_c1_750 | 1573 | 5345 | 1314 | 437 | 1429 | 2.8e-146 |

Description
sp:[LN:YWFO_BACSU] [AC:P39651] [GN:YWFO:IPA-93D] [OR:BACILLUS SUBTILIS]
[DE:HYPOTHETICAL 51.0 KD PROTEIN IN PTA 3'REGION] [SP:P39651] [DB:swissprot]
>pir:[LN:G70056] [AC:G70056:S39748 ] [PN:ywfO protein:hypothetical protein ipa-93d]
[GN:ywfO ] [OR:Bacillus subtilis] [DB:pir2] >gp:[GI:e1186260:g2636296] [LN:BSUB0020]
[AC:Z99123:AL009126] [GN:ywfO] [FN:unknown] [OR:Bacillus subtilis] [DB:genpept-bct1]
[DE:Bacillus subtilis complete genome (section 20 of 21): from 3798401to 4010550.]
[NT:alternate gene name: ipa-93d; similar to] [SP:P39651] [LE:59934] [RE:61235]
[DI:complement] >gp:[GI:e267329:g1561567] [LN:BSUWFO] [AC:Z80355] [PN:Unknown]
[GN:ywfO] [OR:Bacillus subtilis] [DB:genpept-bct1] [DE:B.subtilis ywfO, ywgA and ywgB
genes.] [SP:P39651] [LE:267] [RE:1568] [DI:direct]

| ORF Name | NTID | AAID | NT Length | AA Length | score | probability |
|---|---|---|---|---|---|---|
| AI7503000987_26854757_c3_886 | 1574 | 5346 | 660 | 219 | 975 | 3.6e-98 |

Description
sp:[LN:CYSE_STAXY] [AC:P77985] [GN:CYSE] [OR:STAPHYLOCOCCUS XYLOSUS] [EC:2.3.1.30]
[DE:SERINE ACETYLTRANSFERASE, (SAT)] [SP:P77985] [DB:swissprot]
>gp:[GI:e261410:g1514656] [LN:SXCYSEREG] [AC:Y07614] [PN:serine O-acetyltransferase]
[GN:cysE] [OR:Staphylococcus xylosus] [DB:genpept-bct1] [EC:2.3.1.30] [DE:S.xylosus
cysE gene, genomic region.] [SP:P77985] [LE:707] [RE:1357] [DI:direct]

| ORF Name | NTID | AAID | NT Length | AA Length | score | probability |
|---|---|---|---|---|---|---|
| AI7503000987_27318_c2_877 | 1575 | 5347 | 1035 | 344 | 1198 | 8.3e-122 |

Description
sp:[LN:ADH1_ZYMMO] [AC:P20368] [GN:ADHA] [OR:ZYMOMONAS MOBILIS] [EC:1.1.1.1]
[DE:ALCOHOL DEHYDROGENASE I, (ADH I)] [SP:P20368] [DB:swissprot] >pir:[LN:A35260]
[AC:A35260:E40649:A24801 ] [PN:alcohol dehydrogenase, 1] [GN:adhA ] [CL:alcohol
dehydrogenase:long-chain alcohol dehydrogenase homology] [OR:Zymomonas mobilis]
[EC:1.1.1.1] [DB:pir1] >gp:[GI:g155571] [LN:ZMOADHA] [AC:M32100] [OR:Zymomonas mobilis]
[SR:Z.mobilis (strain CP4) DNA] [DB:genpept-bct1] [DE:Z.mobilis alcohol dehydrogenase I
(adhA) gene, complete cds.] [NT:alcohol dehydrogenase I (adhA) (EC 1.1.1.1)] [LE:218]
[RE:1231] [DI:direct]

| ORF Name | NTID | AAID | NT Length | AA Length | score | probability |
|---|---|---|---|---|---|---|
| AI7503000987_276590_c2_821 | 1576 | 5348 | 375 | 124 | 279 | 2.0e-24 |

Description
pir:[LN:H70070] [AC:H70070 ] [PN:hypothetical protein ywzC] [GN:ywzC ] [OR:Bacillus
subtilis] [DB:pir2] >gp:[GI:e1186261:g2636297] [LN:BSUB0020] [AC:Z99123:AL009126]
[GN:ywzC] [FN:unknown] [OR:Bacillus subtilis] [DB:genpept-bct1] [DE:Bacillus subtilis
complete genome (section 20 of 21): from 3798401to 4010550.] [LE:61397] [RE:61621]
[DI:complement]

| ORF Name | NTID | AAID | NT Length | AA Length | score | probability |
|---|---|---|---|---|---|---|
| AI7503000987_2847887_f2_351 | 1577 | 5349 | 576 | 191 | 797 | 2.6e-79 |

Description
sp:[LN:ARSB_STAAU] [AC:P30329] [GN:ARSB] [OR:STAPHYLOCOCCUS AUREUS] [DE:ARSENICAL PUMP MEMBRANE PROTEIN] [SP:P30329] [DB:swissprot] >pir:[LN:C41903] [AC:C41903 ] [PN:arsenical pump membrane protein] [GN:arsB ] [CL:arsenical pump membrane protein] [OR:Staphylococcus aureus] [DB:pir1] >gp:[GI:g150728] [LN:PI2ARSRBC] [AC:M86824] [PN:arsenic efflux pump protein] [GN:arsB] [FN:arsenic efflux pump component (membrane] [OR:Plasmid pI258] [SR:Plasmid pI258 DNA] [DB:genpept-bct1] [DE:Plasmid pI258 arsenic resistance operon (arsRBC) genes, completecds.] [LE:587] [RE:1876] [DI:direct]

| ORF Name | NTID | AAID | NT Length | AA Length | score | probability |
|---|---|---|---|---|---|---|
| AI7503000987_29320127_f3_442 | 1578 | 5350 | 135 | 44 | | |

Description
NO-HIT

| ORF Name | NTID | AAID | NT Length | AA Length | score | probability |
|---|---|---|---|---|---|---|
| AI7503000987_29694425_f1_142 | 1579 | 5351 | 852 | 283 | 418 | 3.8e-39 |

Description
gp:[GI:g1502421] [LN:BSU59433] [AC:U59433] [PN:3-ketoacyl-acyl carrier protein reductase] [GN:fabG] [OR:Bacillus subtilis] [DB:genpept-bct2] [DE:Bacillus subtilis PlsX (plsX), malonyl-CoA:Acyl carrier proteintransacylase (fabD) and 3-ketoacyl-acyl carrier protein reductase(fabG) genes, complete cds, and acyl carrier protein (acpP) gene,partial cds.] [NT:also called 3-oxoacyl-acyl carrier protein] [LE:1813] [RE:2553] [DI:direct]

| ORF Name | NTID | AAID | NT Length | AA Length | score | probability |
|---|---|---|---|---|---|---|
| AI7503000987_30178137_c1_706 | 1580 | 5352 | 132 | 43 | | |

Description
NO-HIT

| ORF Name | NTID | AAID | NT Length | AA Length | score | probability |
|---|---|---|---|---|---|---|
| AI7503000987_30267937_f3_532 | 1581 | 5353 | 123 | 40 | | |

Description
NO-HIT

| ORF Name | NTID | AAID | NT Length | AA Length | score | probability |
|---|---|---|---|---|---|---|
| AI7503000987_30742332_c2_841 | 1582 | 5354 | 228 | 75 | 76 | 0.012 |

Description
pir:[LN:D71169] [AC:D71169 ] [PN:hypothetical protein PH0552] [GN:PH0552 ] [OR:Pyrococcus horikoshii] [DB:pir2] >gp:[GI:d1030584:g3256958] [LN:AP000002] [AC:AP000002:AB009475:AB009476:AB009477:AB009478:AB009479:AB009480] [PN:163aa long hypothetical protein] [GN:PH0552] [OR:Pyrococcus horikoshii] [SR:Pyrococcus horikoshii (strain:OT3) DNA] [DB:genpept-bct1] [DE:Pyrococcus horikoshii OT3 genomic DNA, 287001-544000 nt. position(2/7).] [NT:similar to PIR:F64411 percent identity:33.898 in] [LE:205880] [RE:206371] [DI:direct]

| ORF Name | NTID | AAID | NT Length | AA Length | score | probability |
|---|---|---|---|---|---|---|
| AI7503000987_31256916_c2_774 | 1583 | 5355 | 507 | 168 | 681 | 5.1e-67 |

Description
pir:[LN:S38871] [AC:S38871 ] [PN:ribosomal protein L11] [GN:rplK ] [CL:Escherichia coli ribosomal protein L11] [OR:Staphylococcus carnosus] [DB:pir2] >gp:[GI:g581638] [LN:SCSECE] [AC:X76134] [PN:L11 protein] [GN:rplK] [OR:Staphylococcus carnosus] [DB:genpept-bct1] [DE:S.carnosus secE, nusG and rplK genes.] [SP:P36254] [LE:1061] [RE:1483] [DI:direct]

| ORF Name | NTID | AAID | NT Length | AA Length | score | probability |
|---|---|---|---|---|---|---|
| AI7503000987_31334838_c3_993 | 1584 | 5356 | 519 | 172 | 544 | 1.7e-52 |

Description
pir:[LN:E70057] [AC:E70057 ] [PN:hypothetical protein ywhD] [GN:ywhD ] [OR:Bacillus subtilis] [DB:pir2] >gp:[GI:e267625:g1565239] [LN:BSTHRZ] [AC:Z80360] [PN:Unknown] [GN:ywhD] [OR:Bacillus subtilis] [DB:genpept-bct1] [DE:B.subtilis thrZ downstream chromosomal region.] [LE:3358] [RE:3876] [DI:direct] >gp:[GI:e1186252:g2636288] [LN:BSUB0020] [AC:Z99123:AL009126] [GN:ywhD] [FN:unknown] [OR:Bacillus subtilis] [DB:genpept-bct1] [DE:Bacillus subtilis complete genome (section 20 of 21): from 3798401to 4010550.] [LE:52838] [RE:53356] [DI:complement]

| ORF Name | NTID | AAID | NT Length | AA Length | score | probability |
|---|---|---|---|---|---|---|
| AI7503000987_3134386_f3_616 | 1585 | 5357 | 228 | 75 | | |

Description
NO-HIT

| ORF Name | NTID | AAID | NT Length | AA Length | score | probability |
|---|---|---|---|---|---|---|
| AI7503000987_31353377_c2_785 | 1586 | 5358 | 474 | 157 | 703 | 2.4e-69 |

Description
gp:[GI:d1039003:g4512400] [LN:AB017508] [AC:AB017508] [GN:rpsG] [OR:Bacillus halodurans] [SR:Bacillus halodurans (strain:C-125) DNA] [DB:genpept-bct1] [DE:Bacillus halodurans C-125 genomic DNA, 32 kb fragment, completecds.] [NT:rpsG homologue (identity of 84% to B. subtilis )] [LE:8367] [RE:8837] [DI:direct]

| ORF Name | NTID | AAID | NT Length | AA Length | score | probability |
|---|---|---|---|---|---|---|
| AI7503000987_31562_f2_326 | 1587 | 5359 | 123 | 40 | | |

Description
NO-HIT

| ORF Name | NTID | AAID | NT Length | AA Length | score | probability |
|---|---|---|---|---|---|---|
| AI7503000987_32031437_c1_736 | 1588 | 5360 | 2706 | 901 | 1163 | 4.3e-118 |

Description
sp:[LN:VG12_BPPZA] [AC:P07537] [GN:12] [OR:BACTERIOPHAGE PZA] [DE:PRE-NECK APPENDAGE PROTEIN (LATE PROTEIN GP12)] [SP:P07537] [DB:swissprot] >pir:[LN:WMBP12] [AC:G24831 ] [PN:gene 12 protein] [GN:12 ] [CL:phage PZA gene 12 protein] [OR:phage PZA] [DB:pir1] >gp:[GI:g216061] [LN:PZACG] [AC:M11813:M13904:M13905] [PN:pre-neck appendage protein] [OR:Bacteriophage PZA] [SR:Bacteriophage PZA DNA] [DB:genpept-phg] [DE:Bacteriophage PZA (from B.subtilis), complete genome.] [LE:11428] [RE:13992] [DI:direct]

| ORF Name | NTID | AAID | NT Length | AA Length | score | probability |
|---|---|---|---|---|---|---|
| AI7503000987_32251_f1_98 | 1589 | 5361 | 129 | 42 | | |

Description
NO-HIT

| ORF Name | NTID | AAID | NT Length | AA Length | score | probability |
|---|---|---|---|---|---|---|
| AI7503000987_32315907_f3_595 | 1590 | 5362 | 126 | 41 | | |

Description
NO-HIT

| ORF Name | NTID | AAID | NT Length | AA Length | score | probability |
|---|---|---|---|---|---|---|
| AI7503000987_32595152_c1_739 | 1591 | 5363 | 402 | 133 | | |

Description
NO-HIT

| ORF Name | NTID | AAID | NT Length | AA Length | score | probability |
|---|---|---|---|---|---|---|
| AI7503000987_3306563_c1_688 | 1592 | 5364 | 366 | 121 | | |

Description
NO-HIT

| ORF Name | NTID | AAID | NT Length | AA Length | score | probability |
|---|---|---|---|---|---|---|
| AI7503000987_33235050_f2_235 | 1593 | 5365 | 507 | 168 | 92 | 0.0014 |

Description
pir:[LN:D70063] [AC:D70063 ] [PN:hypothetical protein ywnA] [GN:ywnA ] [OR:Bacillus subtilis] [DB:pir2] >gp:[GI:e1184569:g2636188] [LN:BSUB0019] [AC:Z99122:AL009126] [GN:ywnA] [FN:unknown] [OR:Bacillus subtilis] [DB:genpept-bct1] [DE:Bacillus subtilis complete genome (section 19 of 21): from 3597091to 3809700.] [LE:168142] [RE:168543] [DI:complement] >gp:[GI:e269486:g1592697] [LN:BSUEROP] [AC:Y08559] [PN:Unknown] [GN:ywnA] [OR:Bacillus subtilis] [DB:genpept-bct1] [DE:B.subtilis urease operon and downstream DNA.] [LE:2688] [RE:3089] [DI:direct] >gp:[GI:e1184569:g2636188] [LN:BSUB0019] [AC:Z99122:AL009126] [GN:ywnA] [FN:unknown] [OR:Bacillus subtilis] [DB:genpept] [DE:Bacillus subtilis complete genome (section 19 of 21): from 3597091to 3809700.] [LE:168142] [RE:168543] [DI:complement]

| ORF Name | NTID | AAID | NT Length | AA Length | score | probability |
|---|---|---|---|---|---|---|
| AI7503000987_33394062_f1_179 | 1594 | 5366 | 129 | 42 | | |

Description
NO-HIT

| ORF Name | NTID | AAID | NT Length | AA Length | score | probability |
|---|---|---|---|---|---|---|
| AI7503000987_33414693_c2_820 | 1595 | 5367 | 1089 | 362 | 150 | 6.9e-16 |

Description
sp:[LN:KIME_METJA] [AC:Q58487] [GN:MJ1087] [OR:METHANOCOCCUS JANNASCHII] [EC:2.7.1.36] [DE:MEVALONATE KINASE, (MK)] [SP:Q58487] [DB:swissprot] >pir:[LN:F64435] [AC:F64435 ] [PN:mevalonate kinase,] [OR:Methanococcus jannaschii] [EC:2.7.1.36] [DB:pir2] [MP:FOR1026197-1027135 ] >gp:[GI:g1591731] [LN:U67551] [AC:U67551:L77117] [PN:mevalonate kinase] [GN:MJ1087] [OR:Methanococcus jannaschii] [DB:genpept-bct2] [DE:Methanococcus jannaschii section 93 of 150 of the complete genome.] [NT:similar to PID:1184118 SP:Q50559 GB:AE000666] [LE:5625] [RE:6563] [DI:direct]

| ORF Name | NTID | AAID | NT Length | AA Length | score | probability |
|---|---|---|---|---|---|---|
| AI7503000987_33600035_c1_653 | 1596 | 5368 | 2118 | 705 | 3427 | 0.0 |

Description
gp:[GI:e1422302:g4582216] [LN:SAU237696] [AC:AJ237696] [PN:elongation factor G (EF-G)] [GN:fus] [FN:translation elongation factor] [OR:Staphylococcus aureus] [DB:genpept-bct1] [DE:Staphylococcus aureus fus gene.] [LE:83] [RE:2164] [DI:direct]

| ORF Name | NTID | AAID | NT Length | AA Length | score | probability |
|---|---|---|---|---|---|---|
| AI7503000987_33756503_c2_830 | 1597 | 5369 | 273 | 90 | 265 | 6.2e-23 |

Description
gp:[GI:e1285113:g3005826] [LN:BPA2INT] [AC:Y12813] [PN:hypothetical protein] [GN:orfB] [OR:Lactobacillus casei bacteriophage A2] [DB:genpept-phg] [DE:Bacteriophage A2 rep, xis and int genes.] [LE:852] [RE:1097] [DI:complement]

| ORF Name | NTID | AAID | NT Length | AA Length | score | probability |
|---|---|---|---|---|---|---|
| AI7503000987_33786251_c2_865 | 1598 | 5370 | 246 | 81 | | |

Description
NO-HIT

| ORF Name | NTID | AAID | NT Length | AA Length | score | probability |
|---|---|---|---|---|---|---|
| AI7503000987_33869193_c1_726 | 1599 | 5371 | 183 | 60 | 130 | 1.2e-08 |

Description
sp:[LN:RINB_BPPHA] [AC:Q03183] [GN:RINB] [OR:BACTERIOPHAGE PHI-11] [DE:TRANSCRIPTIONAL ACTIVATOR RINB] [SP:Q03183] [DB:swissprot] >pir:[LN:A49703] [AC:A49703 ] [PN:int gene activator RinB] [OR:phage phi-11] [DB:pir2] >gp:[GI:g166161] [LN:BPHRINAB] [AC:L07580] [PN:Bacteriophage phi-11 int gene activator] [GN:rinB] [FN:Activate bacteriophage phi-11 int gene] [OR:Staphylococcus bacteriophage phi 11] [SR:Bacteriophage phi-11 DNA] [DB:genpept-phg] [DE:Bacteriophage phi-11 rinA and rin B genes, required for theactivation of Staphylococcal phage phi-11 int expression.] [LE:60] [RE:248] [DI:direct]

| ORF Name | NTID | AAID | NT Length | AA Length | score | probability |
|---|---|---|---|---|---|---|
| AI7503000987_34025066_c2_856 | 1600 | 5372 | 642 | 213 | 89 | 8.2e-07 |

Description
gp:[GI:e247172:g1926370] [LN:LBPHIG1E] [AC:X98106] [GN:Rorf232] [OR:Bacteriophage phig1e] [DB:genpept-phg] [DE:Lactobacillus bacteriophage phig1e complete genomic DNA.] [LE:4579] [RE:5277] [DI:complement]

| ORF_Name | NTID | AAID | NT Length | AA Length | score | probability |
|---|---|---|---|---|---|---|
| AI7503000987_34242202_c3_956 | 1601 | 5373 | 270 | 89 | 78 | 0.017 |

Description
sp:[LN:VP8_VARV] [AC:P33039] [GN:L4R:M4R] [OR:VARIOLA VIRUS] [DE:STRUCTURAL PROTEIN VP8 PRECURSOR (25 KD MAJOR CORE PROTEIN) (P25K)] [SP:P33039] [DB:swissprot] >pir:[LN:A36845] [AC:A36845:S33090 ] [PN:M4R protein:structural protein VP8] [CL:vaccinia virus 28K protein] [OR:variola virus] [DB:pir2] >gp:[GI:g262435] [LN:S55844] [AC:S55844] [PN:glycoprotein VP8] [GN:L4R] [OR:Variola major virus] [SR:Variola major virus India-1967] [DB:genpept-vrl] [DE:G9R...H7R [variola major virus, India-1967, Genomic, 19 genes,18029 nt].] [NT:This sequence comes from Fig. 2.] [LE:3187] [RE:3942] [DI:direct] >gp:[GI:g438994] [LN:VARCG] [AC:L22579] [OR:Variola major virus] [SR:Variola major virus (strain Bangladesh-1975) DNA] [DB:genpept-vrl] [DE:Variola major virus (strain Bangladesh-1975) complete genome.] [NT:homolog of vaccinia virus CDS L4R (structural] [LE:70583] [RE:71338] [DI:direct] >gp:[GI:g297256] [LN:VVCGAA] [AC:X69198] [GN:M4R] [OR:Variola virus] [DB:genpept-vrl] [DE:Variola virus DNA complete genome.] [SP:P33039] [LE:69950] [RE:70705] [DI:direct] >gp:[GI:g62352] [LN:VVHINDQKH] [AC:X67119] [PN:structural protein VP8] [GN:L4R COP] [OR:Variola virus] [DB:genpept-vrl] [DE:Variola virus (HindIII-Q,K,H,M,L,I,F genome fragment) genes.] [SP:P33039] [LE:19835] [RE:20590] [DI:direct]

| ORF_Name | NTID | AAID | NT Length | AA Length | score | probability |
|---|---|---|---|---|---|---|
| AI7503000987_34242202_f1_156 | 1602 | 5374 | 210 | 69 | 69 | 0.047 |

Description
sp:[LN:Y076_MYCPN] [AC:P75555] [OR:MYCOPLASMA PNEUMONIAE] [DE:HYPOTHETICAL PROTEIN MG076 HOMOLOG] [SP:P75555] [DB:swissprot] >pir:[LN:S73943] [AC:S73943 ] [PN:MG076 homolog G07_orf138] [OR:Mycoplasma pneumoniae] [SR:ATCC 29342, , ATCC 29342] [SR:ATCC 29342, ] [DB:pir2] >gp:[GI:g1674320] [LN:MPAE000059] [AC:AE000059:U00089] [GN:G07_orf138] [OR:Mycoplasma pneumoniae] [DB:genpept-bct2] [DE:Mycoplasma pneumoniae section 59 of 63 of the complete genome.] [NT:MG076 homolog, from M. genitalium] [LE:168] [RE:584] [DI:direct]

| ORF_Name | NTID | AAID | NT Length | AA Length | score | probability |
|---|---|---|---|---|---|---|
| AI7503000987_34407053_f3_433 | 1603 | 5375 | 783 | 260 | 564 | 1.3e-54 |

Description
pir:[LN:S76797] [AC:S76797 ] [PN:hypothetical protein] [CL:conserved hypothetical protein MJ0165: phosphoribosylaminoimidazole carboxylase catalytic chain homology] [OR:Synechocystis sp.] [SR:PCC 6803, , PCC 6803] [SR:PCC 6803, ] [DB:pir2] >gp:[GI:d1019442:g1653798] [LN:D90916] [AC:D90916:AB001339] [PN:hypothetical protein] [OR:Synechocystis sp.] [SR:Synechocystis sp. (strain:PCC6803) DNA] [DB:genpept-bct1] [DE:Synechocystis sp. PCC6803 complete genome, 26/27, 3270710-3418851.] [NT:ORF_ID:sll1489] [LE:107538] [RE:108377] [DI:complement]

| ORF_Name | NTID | AAID | NT Length | AA Length | score | probability |
|---|---|---|---|---|---|---|
| AI7503000987_34609703_c3_963 | 1604 | 5376 | 198 | 65 | 110 | 1.6e-06 |

Description
pir:[LN:T00185] [AC:T00185 ] [PN:hypothetical protein 52] [OR:Staphylococcus aureus phage phi PVL] [DB:pir3] >gp:[GI:d1032886:g3341959] [LN:AB009866] [AC:AB009866] [OR:bacteriophage phi PVL] [SR:bacteriophage phi PVL (specific_host:Staphylococcus aureus ATC] [DB:genpept-phg] [DE:Bacteriophage phi PVL proviral DNA, complete sequence.] [NT:orf 52] [LE:37356] [RE:37604] [DI:direct]

| ORF Name | NTID | AAID | NT Length | AA Length | score | probability |
|---|---|---|---|---|---|---|
| AI7503000987_34651555_c1_734 | 1605 | 5377 | 3123 | 1040 | 267 | 2.8e-24 |

Description gp:[GI:e244718:g2764872] [LN:BSPP1GENM] [AC:X97918] [OR:Bacteriophage SPP1] [DB:genpept-phg] [DE:Bacteriophage SPP1 complete nucleotide sequence.] [NT:gene 18] [LE:12264] [RE:13373] [DI:direct]

| ORF Name | NTID | AAID | NT Length | AA Length | score | probability |
|---|---|---|---|---|---|---|
| AI7503000987_35162800_c3_885 | 1606 | 5378 | 1506 | 501 | 1701 | 4.2e-175 |

Description sp:[LN:SYE_BACSU] [AC:P22250] [GN:GLTX] [OR:BACILLUS SUBTILIS] [EC:6.1.1.17] [DE:(GLURS)] [SP:P22250] [DB:swissprot] >pir:[LN:SYBSET] [AC:A36090:S66121:E69635 ] [PN:glutamate--tRNA ligase, gltX:glutamyl-tRNA synthetase gltX] [GN:gltX ] [CL:glutamate--tRNA ligase:glutamine--tRNA ligase homology] [OR:Bacillus subtilis] [EC:6.1.1.17] [DB:pir1] >gp:[GI:d1005868:g467480] [LN:BAC180K] [AC:D26185] [PN:glutamyl-tRNA synthetase] [GN:gltX] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:174646] [RE:176097] [DI:direct] >gp:[GI:g143006] [LN:BACGLTXA] [AC:M55073:J05647] [PN:transfer RNA-Gln synthetase] [GN:gltX] [OR:Bacillus subtilis] [SR:Bacillus subtilis 168T DNA] [DB:genpept-bct1] [EC:6.1.1.17] [DE:Bacillus subtilis glutamyl-tRNA synthetase gene, complete cds.] [LE:1] [RE:1452] [DI:direct] >gp:[GI:g289282] [LN:BACGLUSYN] [AC:L14580] [PN:glutamyl-tRNA synthetase] [GN:gltX] [OR:Bacillus subtilis] [SR:Bacillus subtilis (strain 168T) DNA] [DB:genpept-bct1] [DE:Bacillus subtilis glutamyl-tRNA transferase (gltX), serineacetyltransferase (cysE), and cysteinyl-tRNA synthetase (cysS)genes, complete cds's.] [LE:1706] [RE:3157] [DI:direct] >gp:[GI:e1182025:g2632359] [LN:BSUB0001] [AC:Z99104:AL009126] [PN:glutamyl-tRNA synthetase] [GN:gltX] [OR:Bacillus subtilis] [DB:genpept-bct1] [EC:6.1.1.17] [DE:Bacillus subtilis complete genome (section 1 of 21): from 1 to213080.] [SP:P22250] [LE:111044] [RE:112495] [DI:direct] >gp:[GI:g2653659] [LN:U49789] [AC:U49789] [PN:glutamyl-tRNA synthetase] [OR:Bacillus subtilis] [DB:genpept-bct2] [DE:Bacillus subtilis glutamyl-tRNA synthetase gene, complete cds.] [LE:1] [RE:1452] [DI:direct]

| ORF Name | NTID | AAID | NT Length | AA Length | score | probability |
|---|---|---|---|---|---|---|
| AI7503000987_35350062_f2_317 | 1607 | 5379 | 141 | 46 | | |

Description
NO-HIT

| ORF Name | NTID | AAID | NT Length | AA Length | score | probability |
|---|---|---|---|---|---|---|
| AI7503000987_35445875_c1_728 | 1608 | 5380 | 159 | 52 | 53 | 0.016 |

Description pir:[LN:C70306] [AC:C70306 ] [PN:conserved hypothetical protein aq_064c] [GN:aq_064c ] [CL:conserved hypothetical secreted protein HP0320] [OR:Aquifex aeolicus] [DB:pir2] >gp:[GI:g2982828] [LN:AE000672] [AC:AE000672:AE000657] [PN:hypothetical protein] [GN:aq_064c] [OR:Aquifex aeolicus] [DB:genpept-bct2] [DE:Aquifex aeolicus section 4 of 109 of the complete genome.] [LE:2190] [RE:2423] [DI:direct]

| ORF_Name | NTID | AAID | NT Length | AA Length | score | probability |
|---|---|---|---|---|---|---|
| AI7503000987_36054813_c2_833 | 1609 | 5381 | 387 | 128 | 79 | 0.034 |

Description
pir:[LN:S41186] [AC:S43812:S41186 ] [PN:gene 39 protein] [OR:phage SPP1] [DB:pir2] >gp:[GI:e244746:g2764918] [LN:BSPP1GENM] [AC:X97918] [OR:Bacteriophage SPP1] [DB:genpept-phg] [DE:Bacteriophage SPP1 complete nucleotide sequence.] [NT:gene 39] [LE:36342] [RE:36722] [DI:direct] >gp:[GI:g439643] [LN:BSSPP1] [AC:X67865] [GN:39] [OR:Bacteriophage SPP1] [DB:genpept-phg] [DE:B.subtilis phage SPP1 DNA sequence coding for products required forreplication initiation.] [LE:6073] [RE:6453] [DI:direct]

| ORF_Name | NTID | AAID | NT Length | AA Length | score | probability |
|---|---|---|---|---|---|---|
| AI7503000987_36134715_c3_887 | 1610 | 5382 | 771 | 256 | 666 | 2.0e-65 |

Description
sp:[LN:YACO_BACSU] [AC:Q06753] [GN:YACO] [OR:BACILLUS SUBTILIS] [EC:2.1.1.-] [DE:HYPOTHETICAL TRNA/RRNA METHYLTRANSFERASE YACO,] [SP:Q06753] [DB:swissprot] >pir:[LN:S66124] [AC:S66124:G69741:I40000 ] [PN:conserved hypothetical protein yacO] [GN:yacO ] [CL:conserved hypothetical protein HI0860] [OR:Bacillus subtilis] [DB:pir2] >gp:[GI:d1005871:g467483] [LN:BAC180K] [AC:D26185] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:178868] [RE:179617] [DI:direct] >gp:[GI:e1182029:g2632363] [LN:BSUB0001] [AC:Z99104:AL009126] [GN:yacO] [FN:unknown] [OR:Bacillus subtilis] [DB:genpept-bct1] [DE:Bacillus subtilis complete genome (section 1 of 21): from 1 to213080.] [NT:similar to hypothetical proteins] [SP:Q06753] [LE:115266] [RE:116015] [DI:direct]

| ORF_Name | NTID | AAID | NT Length | AA Length | score | probability |
|---|---|---|---|---|---|---|
| AI7503000987_36228563_c3_960 | 1611 | 5383 | 699 | 232 | 110 | 0.00063 |

Description
gp:[GI:g2865254] [LN:AF008237] [AC:AF008237:L28928:L28929:L28930:L28931] [PN:unknown] [OR:Mitochondrion Chlamydomonas eugametos] [SR:Chlamydomonas eugametos] [DB:genpept-pln2] [DE:Chlamydomonas eugametos mitochondrion, complete genome.] [NT:orf306; intronic ORF; formerly i3; in frame with] [LE:<8260] [RE:9180] [DI:direct]

| ORF_Name | NTID | AAID | NT Length | AA Length | score | probability |
|---|---|---|---|---|---|---|
| AI7503000987_36521067_f3_540 | 1612 | 5384 | 204 | 67 | | |

Description
NO-HIT

| ORF_Name | NTID | AAID | NT Length | AA Length | score | probability |
|---|---|---|---|---|---|---|
| AI7503000987_3908462_c1_703 | 1613 | 5385 | 144 | 47 | | |

Description
NO-HIT

| ORF_Name | NTID | AAID | NT Length | AA Length | score | probability |
|---|---|---|---|---|---|---|
| AI7503000987_3909643_f2_217 | 1614 | 5386 | 1197 | 398 | 719 | 4.8e-71 |

Description
gp:[GI:g4981502] [LN:AE001759] [AC:AE001759:AE000512] [PN:conserved hypothetical protein] [GN:TM0964] [OR:Thermotoga maritima] [DB:genpept-bct2] [DE:Thermotoga maritima section 71 of 136 of the complete genome.] [NT:similar to GP:2622211 percent identity: 60.38;] [LE:5733] [RE:6941] [DI:direct]

| ORF_Name | NTID | AAID | NT Length | AA Length | score | probability |
|---|---|---|---|---|---|---|
| AI7503000987_3912503_c1_698 | 1615 | 5387 | 1500 | 499 | 331 | 1.5e-28 |

Description
pir:[LN:E69825] [AC:E69825 ] [PN:amino acid transporter homolog yhdG] [GN:yhdG ] [CL:arginine permease] [OR:Bacillus subtilis] [DB:pir2] >gp:[GI:e1182947:g2633281] [LN:BSUB0006] [AC:Z99109:AL009126] [GN:yhdG] [FN:unknown] [OR:Bacillus subtilis] [DB:genpept-bct1] [DE:Bacillus subtilis complete genome (section 6 of 21): from 999501 to1209940.] [NT:similar to amino acid transporter] [LE:23330] [RE:24727] [DI:direct] >gp:[GI:e325026:g2226202] [LN:BSY14082] [AC:Y14082] [PN:hypothetical protein] [GN:yhdG] [OR:Bacillus subtilis] [DB:genpept-bct1] [DE:Bacillus subtilis chromosomal DNA, region 72 to 75 degrees: spoVRto sspB.] [NT:Similarity to human retroviral receptor (PIR] [LE:9978] [RE:11375] [DI:direct]

| ORF_Name | NTID | AAID | NT Length | AA Length | score | probability |
|---|---|---|---|---|---|---|
| AI7503000987_3945333_c2_782 | 1616 | 5388 | 168 | 55 | | |

Description
NO-HIT

| ORF_Name | NTID | AAID | NT Length | AA Length | score | probability |
|---|---|---|---|---|---|---|
| AI7503000987_3961590_c3_922 | 1617 | 5389 | 1164 | 387 | 669 | 9.5e-66 |

Description
pir:[LN:H69831] [AC:H69831 ] [PN:acetyl-CoA C-acetyltransferase homolog yhfS] [GN:yhfS ] [OR:Bacillus subtilis] [DB:pir2] >gp:[GI:e1183037:g2633371] [LN:BSUB0006] [AC:Z99109:AL009126] [GN:yhfS] [FN:unknown] [OR:Bacillus subtilis] [DB:genpept-bct1] [DE:Bacillus subtilis complete genome (section 6 of 21): from 999501 to1209940.] [NT:similar to acetyl-CoA C-acetyltransferase] [LE:109360] [RE:110454] [DI:complement] >gp:[GI:e324998:g2226255] [LN:BSY14084] [AC:Y14084] [PN:hypothetical protein] [GN:yhfS] [OR:Bacillus subtilis] [DB:genpept-bct1] [DE:B.subtilis chromosomal DNA, region 78-80 degrees: aprE to comK.] [NT:similarity to acetyl-CoAuacetyltransferases (ThiL,] [LE:3788] [RE:4882] [DI:complement]

| ORF_Name | NTID | AAID | NT Length | AA Length | score | probability |
|---|---|---|---|---|---|---|
| AI7503000987_39635_f2_316 | 1618 | 5390 | 1245 | 414 | 972 | 7.4e-98 |

Description
sp:[LN:YKGC_ECOLI] [AC:P77212] [GN:YKGC] [OR:ESCHERICHIA COLI] [DE:INTERGENIC REGION] [SP:P77212] [DB:swissprot] >pir:[LN:H64756] [AC:H64756 ] [PN:probable mercury(II) reductase,:ykgC protein] [GN:ykgC ] [OR:Escherichia coli] [EC:1.16.1.1] [DB:pir2] >gp:[GI:g1657503] [LN:ECU73857] [AC:U73857] [OR:Escherichia coli] [DB:genpept-bct1] [DE:Escherichia coli chromosome minutes 6-8.] [NT:similar to S. aureus mercury(II) reductase] [LE:26473] [RE:27825] [DI:complement] >gp:[GI:g1786495] [LN:AE000137] [AC:AE000137:U00096] [PN:putative oxidoreductase] [GN:ykgC] [FN:putative enzyme; Not classified] [OR:Escherichia coli] [DB:genpept-bct2] [DE:Escherichia coli K-12 MG1655 section 27 of 400 of the completegenome.] [NT:f450; 35 pct identical (29 gaps) to 430 residues of] [LE:6292] [RE:7644] [DI:complement]

| ORF_Name | NTID | AAID | NT Length | AA Length | score | probability |
|---|---|---|---|---|---|---|
| AI7503000987_4031952_c2_775 | 1619 | 5391 | 501 | 166 | 545 | 1.3e-52 |

Description
pir:[LN:D69695] [AC:D69695 ] [PN:ribosomal protein L10 (BL5) rplJ] [GN:rplJ ]
[CL:Escherichia coli ribosomal protein L10] [OR:Bacillus subtilis] [DB:pir2]
>gp:[GI:d1009473:g786163] [LN:BACRPL2] [AC:D50303] [PN:Ribosomal Protein L10] [GN:rplJ]
[OR:Bacillus subtilis] [SR:Bacillus subtilis (strain:168) DNA] [DB:genpept-bct1]
[DE:Bacillus subtilis genes for ribosomal proteins L1, L10 and L12,partial and complete
cds.] [LE:347] [RE:847] [DI:direct] >gp:[GI:e1182037:g2632371] [LN:BSUB0001]
[AC:Z99104:AL009126] [PN:ribosomal protein L10 (BL5)] [GN:rplJ] [OR:Bacillus subtilis]
[DB:genpept-bct1] [DE:Bacillus subtilis complete genome (section 1 of 21): from 1
to213080.] [SP:P42923] [LE:120057] [RE:120557] [DI:direct]

| ORF_Name | NTID | AAID | NT Length | AA Length | score | probability |
|---|---|---|---|---|---|---|
| AI7503000987_40676_c1_644 | 1620 | 5392 | 183 | 60 | | |

Description
NO-HIT

| ORF_Name | NTID | AAID | NT Length | AA Length | score | probability |
|---|---|---|---|---|---|---|
| AI7503000987_4078305_c3_927 | 1621 | 5393 | 126 | 41 | | |

Description
NO-HIT

| ORF_Name | NTID | AAID | NT Length | AA Length | score | probability |
|---|---|---|---|---|---|---|
| AI7503000987_4078375_f1_6 | 1622 | 5394 | 129 | 42 | | |

Description
NO-HIT

| ORF_Name | NTID | AAID | NT Length | AA Length | score | probability |
|---|---|---|---|---|---|---|
| AI7503000987_4078518_f1_143 | 1623 | 5395 | 843 | 280 | 521 | 4.6e-50 |

Description
sp:[LN:YXEK_BACSU] [AC:P54950] [GN:YXEK:LP9C] [OR:BACILLUS SUBTILIS] [DE:HYPOTHETICAL
49.3 KD PROTEIN IN IDH-DEOR INTERGENIC REGION] [SP:P54950] [DB:swissprot]
>pir:[LN:E70075] [AC:E70075 ] [PN:monooxygenase homolog yxeK] [GN:yxeK ]
[CL:nitrilotriacetate monooxygenase] [OR:Bacillus subtilis] [DB:pir2]
>gp:[GI:e1184677:g2636498] [LN:BSUB0021] [AC:Z99124:AL009126] [GN:yxeK] [FN:unknown]
[OR:Bacillus subtilis] [DB:genpept-bct1] [DE:Bacillus subtilis complete genome (section
21 of 21): from 3999281to 4214814.] [NT:similar to monooxygenase] [SP:P54950]
[LE:60328] [RE:61653] [DI:complement] >gp:[GI:d1008923:g1408496] [LN:D45912]
[AC:D45912] [GN:yxeK] [OR:Bacillus subtilis] [SR:Bacillus subtilis (strain:BGSC 1A1
(Marburg 168; trpC2)) DNA] [DB:genpept-bct1] [DE:Bacillus subtilis genome sequence
between the iol and hut operon,partial and complete cds.] [NT:homologous to dszA gene
product of Rhodococcus sp.] [LE:9823] [RE:11148] [DI:direct]

| ORF_Name | NTID | AAID | NT Length | AA Length | score | probability |
|---|---|---|---|---|---|---|
| AI7503000987_4181527_c1_720 | 1624 | 5396 | 447 | 148 | 93 | 0.0045 |

Description
sp:[LN:V17_BPT7] [AC:P03781] [GN:1.7] [OR:BACTERIOPHAGE T7] [DE:GENE 1.7 PROTEIN]
[SP:P03781] [DB:swissprot] >pir:[LN:W1BP77] [AC:G43002:G43004:S42296:A04406 ] [PN:gene
1.7 protein] [GN:1.7 ] [CL:phage T7 gene 1.7 protein] [OR:phage T7] [DB:pir1]
[MP:20.42-21.89 ] >gp:[GI:g15512] [LN:PET7XX] [AC:V01127] [OR:Bacteriophage T7]
[DB:genpept-phg] [DE:Left end of bacteriophage T7 genome. Includes the reading frames
ofthe genes 0.3, 0.4, 0.5, 0.6, 0.65, 0.7, 1, 1.1, 1.2, 1.3 (earlyproteins) and 1.4,
1.5, 1.6, 1.7, 2, 2.5, 2.8, 3, 3.5, 4A and 4B(late proteins). Gene 1 is the T7 RNA
polymerase.] [NT:1.7 protein] [SP:P03781] [LE:8166] [RE:8756] [DI:direct]
>gp:[GI:g15576] [LN:T7CG] [AC:V01146:J02518:X00411] [OR:Bacteriophage T7]
[DB:genpept-phg] [DE:Genome of bacteriophage T7.] [NT:gene 1.7] [SP:P03781] [LE:8166]
[RE:8756] [DI:direct]

| ORF_Name | NTID | AAID | NT Length | AA Length | score | probability |
|---|---|---|---|---|---|---|
| AI7503000987_4181577_c3_955 | 1625 | 5397 | 1251 | 416 | 465 | 3.9e-44 |

Description
pir:[LN:H70427] [AC:H70427 ] [PN:replicative DNA helicase] [GN:dnaB ] [CL:phage P22
gene 12 protein] [OR:Aquifex aeolicus] [DB:pir2] >gp:[GI:g2983861] [LN:AE000742]
[AC:AE000742:AE000657] [PN:replicative DNA helicase] [GN:dnaB] [OR:Aquifex aeolicus]
[DB:genpept-bct2] [DE:Aquifex aeolicus section 74 of 109 of the complete genome.]
[LE:2249] [RE:3655] [DI:direct]

| ORF_Name | NTID | AAID | NT Length | AA Length | score | probability |
|---|---|---|---|---|---|---|
| AI7503000987_4329063_c3_900 | 1626 | 5398 | 1245 | 414 | 1786 | 4.1e-184 |

Description
gp:[GI:d1039005:g4512402] [LN:AB017508] [AC:AB017508] [GN:tufA] [OR:Bacillus
halodurans] [SR:Bacillus halodurans (strain:C-125) DNA] [DB:genpept-bct1] [DE:Bacillus
halodurans C-125 genomic DNA, 32 kb fragment, completecds.] [NT:tufA homologue
(identity of 91% to B. subtilis )] [LE:11150] [RE:12340] [DI:direct]

| ORF_Name | NTID | AAID | NT Length | AA Length | score | probability |
|---|---|---|---|---|---|---|
| AI7503000987_4334510_c2_822 | 1627 | 5399 | 135 | 44 | | |

Description
NO-HIT

| ORF_Name | NTID | AAID | NT Length | AA Length | score | probability |
|---|---|---|---|---|---|---|
| AI7503000987_4398453_f3_561 | 1628 | 5400 | 477 | 158 | 279 | 4.5e-24 |

Description
sp:[LN:NTAA_CHEHE] [AC:P54989] [GN:NTAA:NMOA] [OR:CHELATOBACTER HEINTZII]
[EC:1.14.13.-] [DE:MONOOXYGENASE COMPONENT A) (NTA-MO)] [SP:P54989] [DB:swissprot]
>gp:[GI:g1119211] [LN:CBYNMOB] [AC:L49438] [GN:nmoA] [FN:component A of NTA
monooxygenase] [OR:Chelatobacter heintzii] [DB:genpept-bct1] [DE:Chelatobacter heintzii
NTA monooxygenase component B (nmoB), NTAmonooxygenase component A (nmoA), regulatory
protein (nmoR) andtransposase (nmoT) genes, complete cds.] [LE:1323] [RE:2684]
[DI:direct] >gp:[GI:g1480205] [LN:CHU39411] [AC:U39411] [PN:NTA monooxygenase component
A] [GN:ntaA] [OR:Chelatobacter heintzii] [SR:Chelatobacter heintzii strain=ATCC 29600]
[DB:genpept-bct1] [DE:Chelatobacter heintzii nitrilotriacetate monooxygenase
genes,putative regulatory protein (ntaR), NTA monooxygenase component A(ntaA) and
component B (ntaB) genes, complete cds.] [LE:1123] [RE:2484] [DI:complement]

| ORF Name | NTID | AAID | NT Length | AA Length | score | probability |
|---|---|---|---|---|---|---|
| AI7503000987_446062_c1_748 | 1629 | 5401 | 690 | 229 | 1165 | 2.6e-118 |

Description sp:[LN:TRA2_STAAU] [AC:P19380] [OR:STAPHYLOCOCCUS AUREUS] [DE:TRANSPOSASE FOR INSERTION SEQUENCE-LIKE ELEMENT IS431MEC] [SP:P19380] [DB:swissprot] >pir:[LN:S12093] [AC:S12093:JU0116 ] [PN:probable transposase] [OR:Staphylococcus aureus] [DB:pir2] >gp:[GI:g46602] [LN:SAIS431M] [AC:X53818:M18438] [OR:Staphylococcus aureus] [DB:genpept-bct1] [DE:S. aureus IS431mec gene associated with methicillin resistance.] [NT:putative transposase (AA 1 - 224)] [SP:P19380] [LE:272] [RE:946] [DI:direct] >gp:[GI:e1237900:g2791991] [LN:SAMECAR1I] [AC:Y14051] [PN:putative transposase] [OR:Staphylococcus aureus] [DB:genpept-bct1] [DE:Staphylococcus aureus mecA, mecR1, mecI genes and ORF168, ORF142,ORF44, ORF145 and ORF224.] [NT:ORF224] [LE:8096] [RE:8770] [DI:direct] >gp:[GI:d1046034:g5360858] [LN:D86934] [AC:D86934] [PN:transposase for insertion sequence-like element] [OR:Staphylococcus aureus] [SR:Staphylococcus aureus (strain:N315) DNA, clone_lib:library of N31] [DB:genpept] [DE:Staphylococcus aureus genes, mec region, partial and complete cds.] [NT:ORF N062] [LE:48054] [RE:48728] [DI:direct] >gp:[GI:d1046044:g5360868] [LN:D86934] [AC:D86934] [PN:transposase for insertion sequence-like element] [OR:Staphylococcus aureus] [SR:Staphylococcus aureus (strain:N315) DNA, clone_lib:library of N31] [DB:genpept] [DE:Staphylococcus aureus genes, mec region, partial and complete cds.] [NT:ORF N070] [LE:53400] [RE:54074] [DI:direct]

| ORF Name | NTID | AAID | NT Length | AA Length | score | probability |
|---|---|---|---|---|---|---|
| AI7503000987_4725006_c3_981 | 1630 | 5402 | 537 | 178 | | |

Description
NO-HIT

| ORF Name | NTID | AAID | NT Length | AA Length | score | probability |
|---|---|---|---|---|---|---|
| AI7503000987_4727203_c3_925 | 1631 | 5403 | 369 | 122 | 86 | 0.032 |

Description gp:[GI:d1004088:g505029] [LN:MUSMNS1] [AC:D14849] [PN:meiosis-specific nuclear structural protein 1] [OR:Mus musculus] [SR:Mus mucsulus (strain ddY) testis pachytene spermatocyte cDNA t] [DB:genpept-rod] [DE:Mouse mRNA for meiosis-specific nuclear structural protein 1(MNS1), complete cds.] [LE:180] [RE:1655] [DI:direct]

| ORF Name | NTID | AAID | NT Length | AA Length | score | probability |
|---|---|---|---|---|---|---|
| AI7503000987_4735833_f2_359 | 1632 | 5404 | 711 | 236 | 464 | 5.0e-44 |

Description sp:[LN:YAAG_BACSU] [AC:P37530] [GN:YAAG] [OR:BACILLUS SUBTILIS] [DE:HYPOTHETICAL 24.1 KD PROTEIN IN SERS-DNAZ INTERGENIC REGION] [SP:P37530] [DB:swissprot] >pir:[LN:S66045] [AC:S66045:G69736 ] [PN:deoxypurine kinase subunit homolog yaaG] [GN:yaaG ] [CL:Lactobacillus acidophilus deoxyadenosine kinase] [OR:Bacillus subtilis] [DB:pir2] >gp:[GI:d1005793:g467405] [LN:BAC180K] [AC:D26185] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:86746] [RE:87369] [DI:complement] >gp:[GI:e1181948:g2632282] [LN:BSUB0001] [AC:Z99104:AL009126] [GN:yaaG] [FN:unknown] [OR:Bacillus subtilis] [DB:genpept-bct1] [DE:Bacillus subtilis complete genome (section 1 of 21): from 1 to213080.] [NT:similar to deoxypurine kinase subunit] [SP:P37530] [LE:23144] [RE:23767] [DI:complement]

| ORF Name | NTID | AAID | NT Length | AA Length | score | probability |
|---|---|---|---|---|---|---|
| AI7503000987_4741068_c3_967 | 1633 | 5405 | 609 | 202 | 210 | 4.1e-17 |

Description
gp:[GI:e247154:g1926352] [LN:LBPHIG1E] [AC:X98106] [PN:minor capsid protein]
[GN:Rorf204] [OR:Bacteriophage phig1e] [DB:genpept-phg] [DE:Lactobacillus bacteriophage phig1e complete genomic DNA.] [LE:24554] [RE:25168] [DI:complement]

| ORF Name | NTID | AAID | NT Length | AA Length | score | probability |
|---|---|---|---|---|---|---|
| AI7503000987_4741077_c3_952 | 1634 | 5406 | 687 | 228 | 238 | 4.5e-20 |

Description
gp:[GI:e247139:g1926334] [LN:LBPHIG1E] [AC:X98106] [GN:Rorf242] [OR:Bacteriophage phig1e] [DB:genpept-phg] [DE:Lactobacillus bacteriophage phig1e complete genomic DNA.]
[LE:37600] [RE:38328] [DI:complement]

| ORF Name | NTID | AAID | NT Length | AA Length | score | probability |
|---|---|---|---|---|---|---|
| AI7503000987_4876967_c3_913 | 1635 | 5407 | 579 | 192 | 168 | 1.2e-12 |

Description
pir:[LN:G69824] [AC:G69824 ] [PN:conserved hypothetical protein yhdA] [GN:yhdA ]
[OR:Bacillus subtilis] [DB:pir2] >gp:[GI:e1182923:g2633257] [LN:BSUB0005]
[AC:Z99108:AL009126] [GN:yhdA] [FN:unknown] [OR:Bacillus subtilis] [DB:genpept-bct1]
[DE:Bacillus subtilis complete genome (section 5 of 21): from 802821 to1011250.]
[NT:similar to hypothetical proteins] [LE:207082] [RE:207606] [DI:direct]
>gp:[GI:e1182935:g2633269] [LN:BSUB0006] [AC:Z99109:AL009126] [GN:yhdA] [FN:unknown]
[OR:Bacillus subtilis] [DB:genpept-bct1] [DE:Bacillus subtilis complete genome (section 6 of 21): from 999501 to1209940.] [NT:similar to hypothetical proteins] [LE:10402]
[RE:10926] [DI:direct] >gp:[GI:e324946:g2226142] [LN:BSY14079] [AC:Y14079]
[PN:hypothetical protein] [GN:yhdA] [OR:Bacillus subtilis] [DB:genpept-bct1]
[DE:Bacillus subtilis chromosomal DNA, region 75 degrees: glpPFKDoperon and downstream.] [NT:similarity to the hypothetical protein YIEF from] [LE:10050]
[RE:10574] [DI:direct]

| ORF Name | NTID | AAID | NT Length | AA Length | score | probability |
|---|---|---|---|---|---|---|
| AI7503000987_4882760_c3_1001 | 1636 | 5408 | 183 | 60 | | |

Description
NO-HIT

| ORF Name | NTID | AAID | NT Length | AA Length | score | probability |
|---|---|---|---|---|---|---|
| AI7503000987_4886075_f3_559 | 1637 | 5409 | 678 | 225 | 794 | 5.4e-79 |

Description
sp:[LN:YAAF_BACSU] [AC:P37529] [GN:YAAF] [OR:BACILLUS SUBTILIS] [DE:HYPOTHETICAL 25.4
KD PROTEIN IN SERS-DNAZ INTERGENIC REGION] [SP:P37529] [DB:swissprot] >pir:[LN:S66044]
[AC:S66044:F69736 ] [PN:deoxypurine kinase subunit homolog yaaF] [GN:yaaF ]
[CL:Lactobacillus acidophilus deoxyadenosine kinase] [OR:Bacillus subtilis] [DB:pir2]
>gp:[GI:d1005792:g467404] [LN:BAC180K] [AC:D26185] [PN:unknown] [OR:Bacillus subtilis]
[SR:Bacillus subtilis (sub_species:Marburg, strain:168) DNA] [DB:genpept-bct1] [DE:B.
subtilis DNA, 180 kilobase region of replication origin.] [LE:86096] [RE:86749]
[DI:complement] >gp:[GI:e1181947:g2632281] [LN:BSUB0001] [AC:Z99104:AL009126] [GN:yaaF]
[FN:unknown] [OR:Bacillus subtilis] [DB:genpept-bct1] [DE:Bacillus subtilis complete genome (section 1 of 21): from 1 to213080.] [NT:similar to deoxypurine kinase subunit]
[SP:P37529] [LE:22494] [RE:23147] [DI:complement]

| ORF Name | NTID | AAID | NT Length | AA Length | score | probability |
|---|---|---|---|---|---|---|
| AI7503000987_4892127_c1_746 | 1638 | 5410 | 2706 | 901 | 1557 | 7.6e-160 |

Description
pir:[LN:H69780] [AC:H69780 ] [PN:antibiotic transport-associated protein homolog ydfJ] [GN:ydfJ ] [OR:Bacillus subtilis] [DB:pir2] >gp:[GI:d1020130:g1881350] [LN:AB001488] [AC:AB001488] [GN:ydfJ] [OR:Bacillus subtilis] [SR:Bacillus subtilis (strain:168) DNA] [DB:genpept-bct1] [DE:Bacillus subtilis genome sequence, 148 kb sequence of the regionbetween 35 and 47 degree.] [NT:PROBABLE TRANSPORT PROTEIN, SIMILAR TO ANTIBIOTIC] [LE:122935] [RE:125109] [DI:direct] >gp:[GI:e1182509:g2632843] [LN:BSUB0003] [AC:Z99106:AL009126] [GN:ydfJ] [FN:unknown] [OR:Bacillus subtilis] [DB:genpept-bct1] [DE:Bacillus subtilis complete genome (section 3 of 21): from 402751 to611850.] [NT:similar to antibiotic transport-associated protein] [LE:186681] [RE:188855] [DI:direct]

| ORF Name | NTID | AAID | NT Length | AA Length | score | probability |
|---|---|---|---|---|---|---|
| AI7503000987_4901703_c2_792 | 1639 | 5411 | 510 | 169 | 95 | 0.0031 |

Description
pir:[LN:D69887] [AC:D69887 ] [PN:conserved hypothetical protein ynaD] [GN:ynaD ] [OR:Bacillus subtilis] [DB:pir2] >gp:[GI:g1750115] [LN:BSU66480] [AC:U66480] [PN:YnaD] [GN:ynaD] [OR:Bacillus subtilis] [DB:genpept-bct1] [DE:Bacillus subtilis SpoVK (spoVK), YnbA (ynbA), YnbB (ynbB), GlnR(glnR), glutamine synthetase (glnA), YnaA (ynaA), YnaB (ynaB), YnaC(ynaC), YnaD (ynaD), YnaE (ynaE), YnaF (ynaF), YnaG (ynaG), YnaH(ynaH), YnaI (ynaI), YnaJ (ynaJ), xylan beta-1,4-xylosidase (xynB),xylose repressor (xylR), xylose isomerase (xylA), xylulose kinase(xylB), YncB (yncB), YncC (yncC), YncD (yncD) and YncE (yncE)genes, complete cds.] [LE:9169] [RE:9681] [DI:direct] >gp:[GI:e1183411:g2634136] [LN:BSUB0010] [AC:Z99113:AL009126] [GN:ynaD] [FN:unknown] [OR:Bacillus subtilis] [DB:genpept-bct1] [DE:Bacillus subtilis complete genome (section 10 of 21): from 1781201to 2014980.] [NT:similar to hypothetical proteins] [LE:101220] [RE:101732] [DI:direct]

| ORF Name | NTID | AAID | NT Length | AA Length | score | probability |
|---|---|---|---|---|---|---|
| AI7503000987_4946962_c3_907 | 1640 | 5412 | 1068 | 355 | 183 | 1.0e-11 |

Description
gp:[GI:g3264834] [LN:AF072541] [AC:AF072541] [PN:xylitol dehydrogenase] [GN:xdh] [FN:xylose utilisation] [OR:Galactocandida mastotermitis] [DB:genpept-pln2] [EC:1.1.1.9] [DE:Galactocandida mastotermitis xylitol dehydrogenase (xdh) gene,complete cds.] [NT:a member of the medium chain dehydrogenase] [LE:301:373] [RE:312:1422] [DI:directJoin]

| ORF Name | NTID | AAID | NT Length | AA Length | score | probability |
|---|---|---|---|---|---|---|
| AI7503000987_4964677_c2_832 | 1641 | 5413 | 444 | 147 | 257 | 4.3e-22 |

Description
pir:[LN:T00179] [AC:T00179 ] [PN:ssDNA-binding protein] [OR:Staphylococcus aureus phage phi PVL] [DB:pir3] >gp:[GI:d1032880:g3341953] [LN:AB009866] [AC:AB009866] [PN:ssDNA binding protein] [OR:bacteriophage phi PVL] [SR:bacteriophage phi PVL (specific_host:Staphylococcus aureus ATC] [DB:genpept-phg] [DE:Bacteriophage phi PVL proviral DNA, complete sequence.] [NT:orf 45] [LE:34657] [RE:35127] [DI:direct]

| ORF Name | NTID | AAID | NT Length | AA Length | score | probability |
|---|---|---|---|---|---|---|
| AI7503000987_5080092_c2_809 | 1642 | 5414 | 744 | 247 | 529 | 6.5e-51 |

Description sp:[LN:YBFT_BACSU] [AC:O31458] [GN:YBFT] [OR:BACILLUS SUBTILIS] [DE:HYPOTHETICAL 27.3 KD PROTEIN IN GLTP-CWLJ INTERGENIC REGION] [SP:O31458] [DB:swissprot] >pir:[LN:E69750] [AC:E69750 ] [PN:glucosamine-6-phosphate isomerase homolog ybfT] [GN:ybfT ] [CL:glucosamine-6-phosphate isomerase] [OR:Bacillus subtilis] [DB:pir2] >gp:[GI:d1034099:g3599658] [LN:AB006424] [AC:AB006424] [GN:ybfT] [OR:Bacillus subtilis] [SR:Bacillus subtilis (strain:168) DNA] [DB:genpept-bct1] [DE:Bacillus subtilis genomic DNA, 70 kb region between 17 and 23degree.] [LE:59813] [RE:60562] [DI:complement] >gp:[GI:e1182188:g2632522] [LN:BSUB0002] [AC:Z99105:AL009126] [GN:ybfT] [FN:unknown] [OR:Bacillus subtilis] [DB:genpept-bct1] [DE:Bacillus subtilis complete genome (section 2 of 21): from 194651 to415810.] [NT:similar to glucosamine-6-phosphate isomerase] [SP:O31458] [LE:62162] [RE:62911] [DI:complement]

| ORF Name | NTID | AAID | NT Length | AA Length | score | probability |
|---|---|---|---|---|---|---|
| AI7503000987_5125076_f3_531 | 1643 | 5415 | 810 | 269 | 873 | 2.3e-87 |

Description sp:[LN:YWFI_BACSU] [AC:P39645] [GN:YWFI:IPA-87R] [OR:BACILLUS SUBTILIS] [DE:HYPOTHETICAL 29.5 KD PROTEIN IN ROCC-PTA INTERGENIC REGION] [SP:P39645] [DB:swissprot] >pir:[LN:S39742] [AC:S39742:B70056 ] [PN:ywfI protein:hypothetical protein ipa-87r] [GN:ywfI ] [OR:Bacillus subtilis] [DB:pir2] >gp:[GI:g414011] [LN:BSGENR] [AC:X73124] [GN:ipa-87r] [OR:Bacillus subtilis] [DB:genpept-bct1] [DE:B.subtilis genomic region (325 to 333).] [SP:P39645] [LE:90200] [RE:90964] [DI:complement] >gp:[GI:e1186267:g2636303] [LN:BSUB0020] [AC:Z99123:AL009126] [GN:ywfI] [FN:unknown] [OR:Bacillus subtilis] [DB:genpept-bct1] [DE:Bacillus subtilis complete genome (section 20 of 21): from 3798401to 4010550.] [NT:alternate gene name: ipa-87r; similar to] [SP:P39645] [LE:66995] [RE:67759] [DI:direct]

| ORF Name | NTID | AAID | NT Length | AA Length | score | probability |
|---|---|---|---|---|---|---|
| AI7503000987_5251588_c1_747 | 1644 | 5416 | 582 | 193 | 87 | 0.0010 |

Description gp:[GI:g1079814] [LN:S79230] [AC:S79230] [PN:BM1P1] [GN:CYP106] [OR:Bacillus megaterium] [DB:genpept-bct2] [DE:CYP106=BM1P2 orf...CYP106=P450BM-1 orf {regulatory regions}[Bacillus megaterium, mRNA Partial, 3 genes, 1400 nt].] [NT:positive transcription factor involved in] [LE:763] [RE:1059] [DI:complement]

| ORF Name | NTID | AAID | NT Length | AA Length | score | probability |
|---|---|---|---|---|---|---|
| AI7503000987_5258515_c3_965 | 1645 | 5417 | 1314 | 437 | 1298 | 2.1e-132 |

Description sp:[LN:TERL_BPSPP] [AC:P54308] [GN:2] [OR:BACTERIOPHAGE SPP1] [DE:TERMINASE LARGE SUBUNIT (G2P)] [SP:P54308] [DB:swissprot] >pir:[LN:S24451] [AC:S24451 ] [PN:terminase] [OR:phage SPP1] [DB:pir2] >gp:[GI:e244468:g2764840] [LN:BSPP1GENM] [AC:X97918] [OR:Bacteriophage SPP1] [DB:genpept-phg] [DE:Bacteriophage SPP1 complete nucleotide sequence.] [NT:gene 2] [SP:P54308] [LE:307] [RE:1575] [DI:direct] >gp:[GI:g15466] [LN:NCSPP116] [AC:X56064:S35313] [PN:terminase] [GN:SPP1 gene 2] [OR:Bacteriophage SPP1] [DB:genpept-phg] [DE:B. subtilis bacteriophage SPP1 genes for terminase and portalprotein.] [SP:P54308] [LE:633] [RE:1901] [DI:direct]

| ORF Name | NTID | AAID | NT Length | AA Length | score | probability |
|---|---|---|---|---|---|---|
| AI7503000987_5370450_f3_432 | 1646 | 5418 | 1284 | 427 | 305 | 3.6e-27 |

Description
pir:[LN:A69256] [AC:A69256 ] [PN:hypothetical protein AF0049] [OR:Archaeoglobus fulgidus] [DB:pir2] >gp:[GI:g2650605] [LN:AE001103] [AC:AE001103:AE000782] [PN:A. fulgidus predicted coding region AF0049] [GN:AF0049] [OR:Archaeoglobus fulgidus] [DB:genpept-bct2] [DE:Archaeoglobus fulgidus section 4 of 172 of the complete genome.] [NT:hypothetical protein; identified by GeneMark;] [LE:7830] [RE:9068] [DI:complement]

| ORF Name | NTID | AAID | NT Length | AA Length | score | probability |
|---|---|---|---|---|---|---|
| AI7503000987_56626_c2_855 | 1647 | 5419 | 336 | 111 | 84 | 0.0020 |

Description
gp:[GI:g1209829] [LN:BBU45421] [AC:U45421] [GN:REP+] [OR:Borrelia burgdorferi] [SR:Lyme disease spirochete strain=297] [DB:genpept-bct1] [DE:Borrelia burgdorferi 2.9-1 locus, ORF 5-8, ORF-A-D, REP+, REP-, andlipoprotein (LP) genes, complete cds.] [NT:repeat motif-containing gene] [LE:4602] [RE:5156] [DI:direct]

| ORF Name | NTID | AAID | NT Length | AA Length | score | probability |
|---|---|---|---|---|---|---|
| AI7503000987_587811_f1_125 | 1648 | 5420 | 345 | 114 | | |

Description
NO-HIT

| ORF Name | NTID | AAID | NT Length | AA Length | score | probability |
|---|---|---|---|---|---|---|
| AI7503000987_6056625_c1_755 | 1649 | 5421 | 258 | 85 | | |

Description
NO-HIT

| ORF Name | NTID | AAID | NT Length | AA Length | score | probability |
|---|---|---|---|---|---|---|
| AI7503000987_6149152_c3_884 | 1650 | 5422 | 1389 | 462 | 1543 | 2.3e-158 |

Description
sp:[LN:RADA_BACSU] [AC:P37572] [GN:RADA:SMS] [OR:BACILLUS SUBTILIS] [DE:DNA REPAIR PROTEIN RADA HOMOLOG (DNA REPAIR PROTEIN SMS HOMOLOG)] [SP:P37572] [DB:swissprot] >pir:[LN:S66116] [AC:S66116:I40509:A69709 ] [PN:DNA repair protein homolog sms] [GN:sms ] [CL:DNA repair protein sms] [OR:Bacillus subtilis] [DB:pir2]
>gp:[GI:d1005863:g467475] [LN:BAC180K] [AC:D26185] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:169695] [RE:171071] [DI:direct] >gp:[GI:e1182020:g2632354] [LN:BSUB0001] [AC:Z99104:AL009126] [PN:DNA repair protein homolog] [GN:sms] [OR:Bacillus subtilis] [DB:genpept-bct1] [DE:Bacillus subtilis complete genome (section 1 of 21): from 1 to213080.] [NT:alternate gene name: yacJ] [SP:P37572] [LE:106093] [RE:107469] [DI:direct]

| ORF Name | NTID | AAID | NT Length | AA Length | score | probability |
|---|---|---|---|---|---|---|
| AI7503000987_6250050_f2_233 | 1651 | 5423 | 147 | 48 | | |

Description
NO-HIT

| ORF Name | NTID | AAID | NT Length | AA Length | score | probability |
|---|---|---|---|---|---|---|
| AI7503000987_6406337_f3_448 | 1652 | 5424 | 210 | 69 | | |

Description
NO-HIT

| ORF Name | NTID | AAID | NT Length | AA Length | score | probability |
|---|---|---|---|---|---|---|
| AI7503000987_6407136_c2_840 | 1653 | 5425 | 1455 | 484 | 667 | 1.6e-65 |

Description
sp:[LN:SIZ_BPSPP] [AC:P54309] [GN:6:SIZ] [OR:BACTERIOPHAGE SPP1] [DE:PORTAL PROTEIN
(PORTAL VERTEX PROTEIN) (GP6)] [SP:P54309] [DB:swissprot] >pir:[LN:S21805]
[AC:S21805:S24455:S36725 ] [PN:portal protein:gene 6 protein] [GN:6 ] [OR:phage SPP1]
[DB:pir2] >gp:[GI:e244702:g2764847] [LN:BSPP1GENM] [AC:X97918] [OR:Bacteriophage SPP1]
[DB:genpept-phg] [DE:Bacteriophage SPP1 complete nucleotide sequence.] [NT:gene 6]
[SP:P54309] [LE:2334] [RE:3845] [DI:direct] >gp:[GI:g15470] [LN:NCSPP116]
[AC:X56064:S35313] [PN:portal protein] [GN:SPP1 gene 6] [OR:Bacteriophage SPP1]
[DB:genpept-phg] [DE:B. subtilis bacteriophage SPP1 genes for terminase and
portalprotein.] [SP:P54309] [LE:2660] [RE:4171] [DI:direct]

| ORF Name | NTID | AAID | NT Length | AA Length | score | probability |
|---|---|---|---|---|---|---|
| AI7503000987_6443763_c2_769 | 1654 | 5426 | 408 | 135 | 298 | 2.0e-26 |

Description
pir:[LN:C69742] [AC:C69742 ] [PN:conserved hypothetical protein yazC] [GN:yazC ]
[OR:Bacillus subtilis] [DB:pir2] >gp:[GI:e1182028:g2632362] [LN:BSUB0001]
[AC:Z99104:AL009126] [GN:yazC] [FN:unknown] [OR:Bacillus subtilis] [DB:genpept-bct1]
[DE:Bacillus subtilis complete genome (section 1 of 21): from 1 to213080.] [NT:similar
to hypothetical proteins] [LE:114851] [RE:115282] [DI:direct]

| ORF Name | NTID | AAID | NT Length | AA Length | score | probability |
|---|---|---|---|---|---|---|
| AI7503000987_661062_c1_641 | 1655 | 5427 | 1440 | 479 | 1568 | 5.2e-161 |

Description
sp:[LN:SYC_BACSU] [AC:Q06752] [GN:CYSS:SPNA] [OR:BACILLUS SUBTILIS] [EC:6.1.1.16]
[DE:(CYSRS)] [SP:Q06752] [DB:swissprot] >pir:[LN:C53402]
[AC:C53402:S44447:S66123:B69612 ] [PN:cysteine--tRNA ligase, cysS:cysteinyl-tRNA
synthetase cysS] [GN:cysS ] [CL:cysteine--tRNA ligase] [OR:Bacillus subtilis]
[EC:6.1.1.16] [DB:pir1] >gp:[GI:d1005870:g467482] [LN:BAC180K] [AC:D26185]
[PN:cysteinyl-tRNA synthetase] [GN:cysS] [OR:Bacillus subtilis] [SR:Bacillus subtilis
(sub_species:Marburg, strain:168) DNA] [DB:genpept-bct1] [DE:B. subtilis DNA, 180
kilobase region of replication origin.] [LE:177049] [RE:178449] [DI:direct]
>gp:[GI:g289284] [LN:BACGLUSYN] [AC:L14580] [PN:cysteinyl-tRNA synthetase] [OR:Bacillus
subtilis] [SR:Bacillus subtilis (strain 168T) DNA] [DB:genpept-bct1] [DE:Bacillus
subtilis glutamyl-tRNA transferase (gltX), serineacetyltransferase (cysE), and
cysteinyl-tRNA synthetase (cysS)genes, complete cds's.] [LE:4109] [RE:5509] [DI:direct]
>gp:[GI:g499303] [LN:BSCTS] [AC:X73989] [PN:cysteine--tRNA ligase] [GN:SPNA/CYSS]
[OR:Bacillus subtilis] [DB:genpept-bct1] [EC:6.1.1.16] [DE:B.subtilis gene for
cysteinyl-tRNA synthetase.] [SP:Q06752] [LE:321] [RE:1721] [DI:direct]
>gp:[GI:e1182027:g2632361] [LN:BSUB0001] [AC:Z99104:AL009126] [PN:cysteinyl-tRNA
synthetase] [GN:cysS] [OR:Bacillus subtilis] [DB:genpept-bct1] [EC:6.1.1.16]
[DE:Bacillus subtilis complete genome (section 1 of 21): from 1 to213080.]
[NT:alternate gene name: snpA] [SP:Q06752] [LE:113447] [RE:114847] [DI:direct]

| ORF Name | NTID | AAID | NT Length | AA Length | score | probability |
|---|---|---|---|---|---|---|
| AI7503000987_6725707_c2_770 | 1656 | 5428 | 552 | 183 | 327 | 1.7e-29 |

Description
sp:[LN:YACP_BACSU] [AC:P37574] [GN:YACP] [OR:BACILLUS SUBTILIS] [DE:HYPOTHETICAL 19.7 KD PROTEIN IN CYSS 3'REGION] [SP:P37574] [DB:swissprot] >pir:[LN:S66125] [AC:S66125:H69741 ] [PN:conserved hypothetical protein yacP] [GN:yacP ] [OR:Bacillus subtilis] [DB:pir2] >gp:[GI:d1005872:g467484] [LN:BAC180K] [AC:D26185] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:179624] [RE:180136] [DI:direct] >gp:[GI:e1182030:g2632364] [LN:BSUB0001] [AC:Z99104:AL009126] [GN:yacP] [FN:unknown] [OR:Bacillus subtilis] [DB:genpept-bct1] [DE:Bacillus subtilis complete genome (section 1 of 21): from 1 to213080.] [NT:similar to hypothetical proteins] [SP:P37574] [LE:116022] [RE:116534] [DI:direct]

| ORF Name | NTID | AAID | NT Length | AA Length | score | probability |
|---|---|---|---|---|---|---|
| AI7503000987_6757338_c3_906 | 1657 | 5429 | 1089 | 362 | 1129 | 1.7e-114 |

Description
pir:[LN:H69750] [AC:H69750 ] [PN:branched-chain amino acid aminotransferase homolog ybgE] [GN:ybgE ] [CL:branched-chain-amino-acid transaminase BAT1] [OR:Bacillus subtilis] [DB:pir2] >gp:[GI:d1034103:g3599662] [LN:AB006424] [AC:AB006424] [GN:ybgE] [OR:Bacillus subtilis] [SR:Bacillus subtilis (strain:168) DNA] [DB:genpept-bct1] [DE:Bacillus subtilis genomic DNA, 70 kb region between 17 and 23degree.] [LE:62005] [RE:63075] [DI:direct] >gp:[GI:e1182191:g2632525] [LN:BSUB0002] [AC:Z99105:AL009126] [GN:ybgE] [FN:unknown] [OR:Bacillus subtilis] [DB:genpept-bct1] [DE:Bacillus subtilis complete genome (section 2 of 21): from 194651 to415810.] [NT:similar to branched-chain amino acid] [LE:64355] [RE:65425] [DI:direct]

| ORF Name | NTID | AAID | NT Length | AA Length | score | probability |
|---|---|---|---|---|---|---|
| AI7503000987_6932750_f2_348 | 1658 | 5430 | 378 | 125 | 266 | 4.8e-23 |

Description
pir:[LN:C69906] [AC:C69906 ] [PN:hypothetical protein yojF] [GN:yojF ] [OR:Bacillus subtilis] [DB:pir2] >gp:[GI:e1185419:g2634340] [LN:BSUB0011] [AC:Z99114:AL009126] [GN:yojF] [FN:unknown] [OR:Bacillus subtilis] [DB:genpept-bct1] [DE:Bacillus subtilis complete genome (section 11 of 21): from 2000171to 2207900.] [LE:121397] [RE:121747] [DI:complement] >gp:[GI:g3169322] [LN:AF026147] [AC:AF026147] [PN:YojF] [GN:yojF] [FN:unknown] [OR:Bacillus subtilis] [DB:genpept-bct2] [DE:Bacillus subtilis YojA (yojA), YojB (yojB), YojC (yojC), YojD(yojD), YojE (yojE), YojF (yojF), YojG (yojG), YojH (yojH), YojI(yojI), YojJ (yojJ), YojK (yojK), YojL (yojL), YojM (yojM), YojN(yojN), and YojO (yojO) genes, complete cds; and OdhA (odhA) gene,partial cds.] [LE:3518] [RE:3868] [DI:direct]

| ORF Name | NTID | AAID | NT Length | AA Length | score | probability |
|---|---|---|---|---|---|---|
| AI7503000987_7032188_f2_246 | 1659 | 5431 | 126 | 41 | | |

Description
NO-HIT

| ORF Name | NTID | AAID | NT Length | AA Length | score | probability |
|---|---|---|---|---|---|---|
| AI7503000987_7068751_c3_984 | 1660 | 5432 | 945 | 314 | 974 | 4.6e-98 |

Description
sp:[LN:IOLS_BACSU] [AC:P46336] [GN:IOLS:SS92ER] [OR:BACILLUS SUBTILIS] [DE:IOLS PROTEIN (VEGETATIVE PROTEIN 147) (VEG147)] [SP:P46336] [DB:swissprot] >pir:[LN:D69646] [AC:D69646 ] [PN:myo-inositol catabolism iolS] [GN:iolS ] [CL:conserved hypothetical protein YPL088w] [OR:Bacillus subtilis] [DB:pir2] >gp:[GI:d1022457:g904205] [LN:AB005554] [AC:AB005554:D45242:D31629] [GN:iolS] [OR:Bacillus subtilis] [SR:Bacillus subtilis (strain:BGSC 1A1) DNA] [DB:genpept-bct1] [DE:Bacillus subtilis genomic DNA, 36 kb region between gnt and ioloperons.] [NT:plausibly involved in inositol catabolism] [LE:32539] [RE:33471] [DI:complement] >gp:[GI:e1184703:g2636524] [LN:BSUB0021] [AC:Z99124:AL009126] [GN:iolS] [OR:Bacillus subtilis] [DB:genpept-bct1] [DE:Bacillus subtilis complete genome (section 21 of 21): from 3999281to 4214814.] [NT:alternate gene name: yxbF; myo-inositol catabolism] [SP:P46336] [LE:85121] [RE:86053] [DI:direct]

| ORF Name | NTID | AAID | NT Length | AA Length | score | probability |
|---|---|---|---|---|---|---|
| AI7503000987_7160287_c2_805 | 1661 | 5433 | 126 | 41 | | |

Description
NO-HIT

| ORF Name | NTID | AAID | NT Length | AA Length | score | probability |
|---|---|---|---|---|---|---|
| AI7503000987_7164191_c2_798 | 1662 | 5434 | 150 | 49 | | |

Description
NO-HIT

| ORF Name | NTID | AAID | NT Length | AA Length | score | probability |
|---|---|---|---|---|---|---|
| AI7503000987_7229680_c1_634 | 1663 | 5435 | 492 | 163 | 377 | 8.3e-35 |

Description
sp:[LN:CTSR_BACSU] [AC:P37568] [GN:CTSR] [OR:BACILLUS SUBTILIS] [DE:TRANSCRIPTIONAL REGULATOR CTSR] [SP:P37568] [DB:swissprot] >pir:[LN:S66112] [AC:S66112:D69610 ] [PN:transcription repressor of class III stress genes ctsR] [GN:ctsR ] [OR:Bacillus subtilis] [DB:pir2] >gp:[GI:d1005859:g467471] [LN:BAC180K] [AC:D26185] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:165048] [RE:165512] [DI:direct] >gp:[GI:e1182016:g2632350] [LN:BSUB0001] [AC:Z99104:AL009126] [PN:transcriptional regulator] [GN:ctsR] [FN:negative regulation of class III stress genes] [OR:Bacillus subtilis] [DB:genpept-bct1] [DE:Bacillus subtilis complete genome (section 1 of 21): from 1 to213080.] [NT:alternate gene name: yacG] [SP:P37568] [LE:101446] [RE:101910] [DI:direct]

| ORF Name | NTID | AAID | NT Length | AA Length | score | probability |
|---|---|---|---|---|---|---|
| AI7503000987_7275263_c1_733 | 1664 | 5436 | 441 | 146 | 158 | 1.3e-11 |

Description
gp:[GI:e244713:g2764865] [LN:BSPP1GENM] [AC:X97918] [OR:Bacteriophage SPP1] [DB:genpept-phg] [DE:Bacteriophage SPP1 complete nucleotide sequence.] [NT:gene 17] [LE:10063] [RE:10467] [DI:direct]

| ORF Name | NTID | AAID | NT Length | AA Length | score | probability |
|---|---|---|---|---|---|---|
| AI7503000987_782590_f1_114 | 1665 | 5437 | 171 | 56 | 56 | 0.044 |

Description
gp:[GI:e289995:g1764015] [LN:CICOS41] [AC:Z83760] [PN:COS41.5] [OR:Ciona intestinalis] [DB:genpept-invl] [DE:Ciona intestinalis DNA sequence from cosmid COS41.] [NT:weak similarity to membrane transport proteins] [LE:11497:13519:14634] [RE:13190:13703:14681] [DI:complementJoin]

| ORF Name | NTID | AAID | NT Length | AA Length | score | probability |
|---|---|---|---|---|---|---|
| AI7503000987_783425_c1_675 | 1666 | 5438 | 165 | 54 | | |

Description
NO-HIT

| ORF Name | NTID | AAID | NT Length | AA Length | score | probability |
|---|---|---|---|---|---|---|
| AI7503000987_818942_c3_989 | 1667 | 5439 | 477 | 158 | 173 | 3.4e-17 |

Description
sp:[LN:OPUC_BACSU] [AC:P46922] [GN:OPUAC] [OR:BACILLUS SUBTILIS] [DE:GLYCINE BETAINE-BINDING PROTEIN PRECURSOR] [SP:P46922] [DB:swissprot] >pir:[LN:I40537] [AC:I40537:F69669 ] [PN:glycine betaine ABC transporter (glycine betaine-binding protein) opuAC precursor] [GN:opuAC ] [OR:Bacillus subtilis] [DB:pir2] >gp:[GI:e1182252:g2632586] [LN:BSUB0002] [AC:Z99105:AL009126] [PN:glycine betaine ABC transporter (glycine)] [GN:opuAC] [FN:glycine betaine transport (osmoprotection)] [OR:Bacillus subtilis] [DB:genpept-bct1] [DE:Bacillus subtilis complete genome (section 2 of 21): from 194651 to415810.] [SP:P46922] [LE:128023] [RE:128904] [DI:direct] >gp:[GI:d1009569:g1805372] [LN:D50453] [AC:D50453] [PN:glycine betain-binding protein precursor] [GN:opuAC] [OR:Bacillus subtilis] [SR:Bacillus subtilis (strain:168 trpC2) DNA] [DB:genpept-bct1] [DE:Bacillus subtilis DNA for 25-36 degree region containing theamyE-srfA region, complete cds.] [LE:2326] [RE:3207] [DI:direct] >gp:[GI:g984805] [LN:BSU17292] [AC:U17292] [PN:glycine betaine-binding protein precursor] [GN:opuAC] [OR:Bacillus subtilis] [DB:genpept-bct2] [DE:Bacillus subtilis ATPase (opuAA), transmembrane protein (opuAB) andglycine betaine-binding protein precursor (opuAC) genes, completecds.] [LE:2332] [RE:3213] [DI:direct]

| ORF Name | NTID | AAID | NT Length | AA Length | score | probability |
|---|---|---|---|---|---|---|
| AI7503000987_819575_c2_850 | 1668 | 5440 | 1857 | 618 | 158 | 1.4e-08 |

Description
gp:[GI:e247163:g1926361] [LN:LBPHIG1E] [AC:X98106] [GN:Rorf372] [OR:Bacteriophage phig1e] [DB:genpept-phg] [DE:Lactobacillus bacteriophage phig1e complete genomic DNA.] [LE:13476] [RE:14594] [DI:complement]

| ORF Name | NTID | AAID | NT Length | AA Length | score | probability |
|---|---|---|---|---|---|---|
| AI7503000987_821012_c1_664 | 1669 | 5441 | 1725 | 574 | 469 | 6.8e-44 |

Description
pir:[LN:S49240] [AC:S49240 ] [PN:hypothetical protein 3 (capsulation locus)] [OR:Haemophilus influenzae] [DB:pir2] >gp:[GI:g547513] [LN:HIACAPIID] [AC:Z37516] [OR:Haemophilus influenzae] [DB:genpept-bct1] [DE:Haemophilus influenzae serotype a capsulation locus region II DNA.] [NT:orf3] [LE:2838] [RE:5207] [DI:direct]

| ORF Name | NTID | AAID | NT Length | AA Length | score | probability |
|---|---|---|---|---|---|---|
| AI7503000987_833125_f3_493 | 1670 | 5442 | 285 | 94 | | |

Description
NO-HIT

| ORF Name | NTID | AAID | NT Length | AA Length | score | probability |
|---|---|---|---|---|---|---|
| AI7503000987_892842_c3_926 | 1671 | 5443 | 387 | 128 | 337 | 1.4e-30 |

Description
sp:[LN:YWDK_BACSU] [AC:P39619] [GN:YWDK:IPA-61D] [OR:BACILLUS SUBTILIS]
[DE:HYPOTHETICAL 12.0 KD PROTEIN IN UNG-ROCA INTERGENIC REGION] [SP:P39619]
[DB:swissprot] >pir:[LN:S39716] [AC:S39716:F70054 ] [PN:ywdK protein:hypothetical
protein ipa-61d] [GN:ywdK ] [OR:Bacillus subtilis] [DB:pir2] >gp:[GI:g413985]
[LN:BSGENR] [AC:X73124] [GN:ipa-61d] [OR:Bacillus subtilis] [DB:genpept-bct1]
[DE:B.subtilis genomic region (325 to 333).] [SP:P39619] [LE:63169] [RE:63510]
[DI:direct] >gp:[GI:e1186292:g2636328] [LN:BSUB0020] [AC:Z99123:AL009126] [GN:ywdK]
[FN:unknown] [OR:Bacillus subtilis] [DB:genpept-bct1] [DE:Bacillus subtilis complete
genome (section 20 of 21): from 3798401to 4010550.] [NT:alternate gene name: ipa-61d;
similar to] [SP:P39619] [LE:94452] [RE:94793] [DI:complement]

| ORF Name | NTID | AAID | NT Length | AA Length | score | probability |
|---|---|---|---|---|---|---|
| AI7503000987_972187_f2_208 | 1672 | 5444 | 924 | 307 | 834 | 3.1e-83 |

Description
gp:[GI:g2689564] [LN:U93688] [AC:U93688] [PN:integrase] [GN:int] [OR:Staphylococcus
aureus] [DB:genpept-bct2] [DE:Staphylococcus aureus toxic shock syndrome toxin-1
(tst),enterotoxin (ent), and integrase (int) genes, complete cds.] [NT:similar to
staphylococcal phage integrase] [LE:13871] [RE:15091] [DI:direct]

| ORF Name | NTID | AAID | NT Length | AA Length | score | probability |
|---|---|---|---|---|---|---|
| AI7503000987_9765677_c3_949 | 1673 | 5445 | 804 | 267 | 226 | 8.4e-19 |

Description
gp:[GI:g928839] [LN:BK5TATTP] [AC:L44593] [FN:unidentified] [OR:Lactococcus lactis
phage BK5-T] [SR:Bacteriophage BK5-T DNA] [DB:genpept-phg] [DE:Bacteriophage BK5-T
ORF'410, 3' end pf cds, 20 ORFs, repressorprotein, and Cro repressor protein genes,
complete cds, ORF70'gene, 5' end of cds.] [NT:ORF266; putative] [LE:14882] [RE:15682]
[DI:direct]

| ORF Name | NTID | AAID | NT Length | AA Length | score | probability |
|---|---|---|---|---|---|---|
| AI7503000987_977181_c1_702 | 1674 | 5446 | 180 | 59 | | |

Description
NO-HIT

| ORF Name | NTID | AAID | NT Length | AA Length | score | probability |
|---|---|---|---|---|---|---|
| AI7503000987_978377_c1_689 | 1675 | 5447 | 264 | 87 | 75 | 0.0037 |

Description
sp:[LN:VG05_VACCC] [AC:P21026] [GN:G5R] [OR:VACCINIA VIRUS] [SR:COPENHAGEN,]
[DE:PROTEIN G5] [SP:P21026] [DB:swissprot] >pir:[LN:A42512] [AC:A42512 ] [PN:G5R
protein] [OR:vaccinia virus] [DB:pir2] >gp:[GI:g335417] [LN:VACCG] [AC:M35027]
[OR:Vaccinia virus] [SR:Vaccinia virus (strain Copenhagen) DNA, clone VC-2]
[DB:genpept-vrl] [DE:Vaccinia virus, complete genome.] [NT:G5R; putative] [LE:75218]
[RE:76522] [DI:direct]

| ORF Name | NTID | AAID | NT Length | AA Length | score | probability |
|---|---|---|---|---|---|---|
| AI7503000987_9819392_c3_908 | 1676 | 5448 | 789 | 262 | 179 | 6.4e-13 |

Description
gp:[GI:g1463023] [LN:CELF45E1] [AC:U28732] [GN:F45E1.3] [OR:Caenorhabditis elegans] [SR:Caenorhabditis elegans strain=Bristol N2] [DB:genpept-invl] [DE:Caenorhabditis elegans cosmid F45E1.] [LE:13873:15298:15662:15851] [RE:14009:15615:15806:16024] [DI:directJoin]

| ORF Name | NTID | AAID | NT Length | AA Length | score | probability |
|---|---|---|---|---|---|---|
| AI7503000987_9924055_c2_765 | 1677 | 5449 | 216 | 71 | | |

Description
NO-HIT

| ORF Name | NTID | AAID | NT Length | AA Length | score | probability |
|---|---|---|---|---|---|---|
| AI7503000987_9926903_c2_835 | 1678 | 5450 | 309 | 102 | 79 | 0.0032 |

Description
pir:[LN:F45681] [AC:F45681 ] [PN:orf 61.2] [OR:phage T2] [DB:pir2] >gp:[GI:g298525] [LN:S57515] [AC:S57515] [GN:orf 61.2] [OR:coliphage T2] [DB:genpept-phg] [DE:orf 61.2 {intergenic region between 41 and 61} [bacteriophage T2,Genomic, 323 nt].] [NT:This sequence comes from Fig. A3.] [LE:12] [RE:323] [DI:direct]

| ORF Name | NTID | AAID | NT Length | AA Length | score | probability |
|---|---|---|---|---|---|---|
| AI7503000987_994052_c3_979 | 1679 | 5451 | 1536 | 511 | 130 | 0.00012 |

Description
gp:[GI:g4049717] [LN:AF063866] [AC:AF063866] [PN:ORF MSV156 hypothetical protein] [GN:MSV156] [OR:Melanoplus sanguinipes entomopoxvirus] [DB:genpept-vrl] [DE:Melanoplus sanguinipes entomopoxvirus, complete genome.] [LE:140126] [RE:143509] [DI:direct]

| ORF Name | NTID | AAID | NT Length | AA Length | score | probability |
|---|---|---|---|---|---|---|
| AI7503000988_22939705_c3_35 | 1680 | 5452 | 402 | 133 | 99 | 0.00020 |

Description
gp:[GI:g2689564] [LN:U93688] [AC:U93688] [PN:integrase] [GN:int] [OR:Staphylococcus aureus] [DB:genpept-bct2] [DE:Staphylococcus aureus toxic shock syndrome toxin-1 (tst),enterotoxin (ent), and integrase (int) genes, complete cds.] [NT:similar to staphylococcal phage integrase] [LE:13871] [RE:15091] [DI:direct]

| ORF Name | NTID | AAID | NT Length | AA Length | score | probability |
|---|---|---|---|---|---|---|
| AI7503000988_235762_f2_11 | 1681 | 5453 | 159 | 52 | | |

Description
NO-HIT

| ORF Name | NTID | AAID | NT Length | AA Length | score | probability |
|---|---|---|---|---|---|---|
| AI7503000988_23626577_c2_32 | 1682 | 5454 | 210 | 69 | 56 | 0.0035 |

Description
gp:[GI:d1009788:g829068] [LN:SHFORF] [AC:D50601] [PN:ORF10] [OR:Shigella sonnei] [SR:Shigella sonnei (individual_isolate HW383) DNA, clone pJK1142] [DB:genpept-bct1] [DE:Shigella sonnei DNA for 26 ORFs, complete cds.] [LE:5933] [RE:6628] [DI:direct]

| ORF Name | NTID | AAID | NT Length | AA Length | score | probability |
|---|---|---|---|---|---|---|
| AI7503000988_24297062_f1_1 | 1683 | 5455 | 183 | 60 | | |

Description
NO-HIT

| ORF Name | NTID | AAID | NT Length | AA Length | score | probability |
|---|---|---|---|---|---|---|
| AI7503000988_24642202_c1_30 | 1684 | 5456 | 648 | 215 | 822 | 5.8e-82 |

Description
gp:[GI:g2689554] [LN:U93688] [AC:U93688] [OR:Staphylococcus aureus] [DB:genpept-bct2] [DE:Staphylococcus aureus toxic shock syndrome toxin-1 (tst),enterotoxin (ent), and integrase (int) genes, complete cds.] [NT:orf7] [LE:6109] [RE:6708] [DI:complement]

| ORF Name | NTID | AAID | NT Length | AA Length | score | probability |
|---|---|---|---|---|---|---|
| AI7503000988_25665687_c2_33 | 1685 | 5457 | 876 | 291 | 322 | 5.6e-29 |

Description
gp:[GI:g2689560] [LN:U93688] [AC:U93688] [OR:Staphylococcus aureus] [DB:genpept-bct2] [DE:Staphylococcus aureus toxic shock syndrome toxin-1 (tst),enterotoxin (ent), and integrase (int) genes, complete cds.] [NT:orf13] [LE:9717] [RE:10004] [DI:complement]

| ORF Name | NTID | AAID | NT Length | AA Length | score | probability |
|---|---|---|---|---|---|---|
| AI7503000988_34428905_f1_3 | 1686 | 5458 | 165 | 54 | | |

Description
NO-HIT

| ORF Name | NTID | AAID | NT Length | AA Length | score | probability |
|---|---|---|---|---|---|---|
| AI7503000988_35428187_c3_37 | 1687 | 5459 | 438 | 145 | | |

Description
NO-HIT

| ORF Name | NTID | AAID | NT Length | AA Length | score | probability |
|---|---|---|---|---|---|---|
| AI7503000988_36601678_c1_29 | 1688 | 5460 | 1728 | 575 | 102 | 0.010 |

Description
gp:[GI:g1004289] [LN:PPRNAE14B] [AC:Z50050] [PN:Xylanase B] [OR:Penicillium purporogenum] [DB:genpept-pln1] [EC:3.2.1.8] [DE:P.purpurogenum mRNA for endo-1,4-beta-xylanase.] [LE:11] [RE:637] [DI:direct]

| ORF Name | NTID | AAID | NT Length | AA Length | score | probability |
|---|---|---|---|---|---|---|
| AI7503000988_4303175_f1_10 | 1689 | 5461 | 180 | 59 | | |

Description
NO-HIT

| ORF_Name | NTID | AAID | NT Length | AA Length | score | probability |
|---|---|---|---|---|---|---|
| AI7503000988_9923176_f3_20 | 1690 | 5462 | 162 | 53 | 56 | 0.013 |

Description
sp:[LN:NU5M_CAEEL] [AC:P24896] [GN:ND5] [OR:CAENORHABDITIS ELEGANS] [EC:1.6.5.3]
[DE:NADH-UBIQUINONE OXIDOREDUCTASE CHAIN 5,] [SP:P24896] [DB:swissprot]
>pir:[LN:S26037] [AC:S26037:S25810 ] [PN:NADH dehydrogenase (ubiquinone), chain 5]
[GN:ND5 ] [CL:NADH dehydrogenase (ubiquinone) chain 5] [OR:mitochondrion Caenorhabditis
elegans] [EC:1.6.5.3] [DB:pir2] >gp:[GI:g515886] [LN:MTCE] [AC:X54252:S93745]
[OR:Mitochondrion Caenorhabditis elegans] [SR:Caenorhabditis elegans] [DB:genpept-invl]
[DE:C. elegans complete mitochondrial genome.] [NT:ND5 protein (AA 1 - 527)]
[SP:P24896] [LE:11691] [RE:13274] [DI:direct]

| ORF_Name | NTID | AAID | NT Length | AA Length | score | probability |
|---|---|---|---|---|---|---|
| AI7503000990_10003756_f3_471 | 1691 | 5463 | 138 | 45 | | |

Description
NO-HIT

| ORF_Name | NTID | AAID | NT Length | AA Length | score | probability |
|---|---|---|---|---|---|---|
| AI7503000990_10193763_c2_864 | 1692 | 5464 | 186 | 61 | | |

Description
NO-HIT

| ORF_Name | NTID | AAID | NT Length | AA Length | score | probability |
|---|---|---|---|---|---|---|
| AI7503000990_10194713_f1_31 | 1693 | 5465 | 147 | 48 | | |

Description
NO-HIT

| ORF_Name | NTID | AAID | NT Length | AA Length | score | probability |
|---|---|---|---|---|---|---|
| AI7503000990_10241287_c2_822 | 1694 | 5466 | 663 | 220 | 74 | 0.037 |

Description
gp:[GI:g924349] [LN:HIV1U13473] [AC:U13473] [PN:envelope glycoprotein V1V2 region]
[GN:env] [OR:Human immunodeficiency virus type 1] [DB:genpept-vrl] [DE:Human
immunodeficiency virus type 1 isolate 037 clone 03 fromUganda, envelope glycoprotein
(env) gene, V1V2 region, partial cds.] [LE:<1] [RE:>285] [DI:direct]

| ORF_Name | NTID | AAID | NT Length | AA Length | score | probability |
|---|---|---|---|---|---|---|
| AI7503000990_10268812_c2_820 | 1695 | 5467 | 144 | 47 | | |

Description
NO-HIT

| ORF_Name | NTID | AAID | NT Length | AA Length | score | probability |
|---|---|---|---|---|---|---|
| AI7503000990_10360902_f3_536 | 1696 | 5468 | 183 | 60 | | |

Description
NO-HIT

| ORF Name | NTID | AAID | NT Length | AA Length | score | probability |
|---|---|---|---|---|---|---|
| AI7503000990_1042202_c3_948 | 1697 | 5469 | 1074 | 357 | 625 | 4.4e-61 |

Description
sp:[LN:POTD_ECOLI] [AC:P23861] [GN:POTD] [OR:ESCHERICHIA COLI]
[DE:SPERMIDINE/PUTRESCINE-BINDING PERIPLASMIC PROTEIN PRECURSOR (SPBP)] [SP:P23861]
[DB:swissprot] >pir:[LN:D40840] [AC:D40840:H64856 ] [PN:spermidine/putrescine-binding
protein precursor:spermidine/putrescine transport protein D] [GN:potD ] [OR:Escherichia
coli] [DB:pir2] >gp:[GI:d1036929:g1651550] [LN:D90747] [AC:D90747:AB001340]
[PN:Spermidine/putrescine transport protein D] [GN:potD] [OR:Escherichia coli]
[SR:Escherichia coli(strain:K12) DNA, clone:Kohara clone #238] [DB:genpept-bct1]
[DE:Escherichia coli genomic DNA. (25.2 - 25.6 min).] [NT:ORF_ID:o238#12; similar to
PIR Accession Number] [LE:13470] [RE:14516] [DI:complement] >gp:[GI:g1787367]
[LN:AE000212] [AC:AE000212:U00096] [PN:spermidine/putrescine periplasmic transport]
[GN:potD] [FN:transport; Transport of small molecules: Amino] [OR:Escherichia coli]
[DB:genpept-bct2] [DE:Escherichia coli K-12 MG1655 section 102 of 400 of the
completegenome.] [NT:f348; 100 pct identical to POTD_ECOLI SW: P23861] [LE:7785]
[RE:8831] [DI:complement] >gp:[GI:g147329] [LN:ECOPOTABCD] [AC:M64519] [PN:transport
protein] [GN:potD] [OR:Escherichia coli] [SR:E.coli (strain DR112) DNA, clone pPT104]
[DB:genpept-bct2] [DE:E.coli transport protein (potA, potB, potC and potD)
genes,complete cds.] [LE:3144] [RE:4190] [DI:direct]

| ORF Name | NTID | AAID | NT Length | AA Length | score | probability |
|---|---|---|---|---|---|---|
| AI7503000990_10579000_c1_734 | 1698 | 5470 | 957 | 318 | 728 | 5.3e-72 |

Description
sp:[LN:COXX_BACSU] [AC:P24009] [GN:CTAB] [OR:BACILLUS SUBTILIS] [DE:PROBABLE CYTOCHROME
C OXIDASE ASSEMBLY FACTOR] [SP:P24009] [DB:swissprot] >pir:[LN:C69609]
[AC:C69609:S14395 ] [PN:cytochrome caa3 oxidase (assembly factor) ctaB] [GN:ctaB ]
[CL:heme O synthase] [OR:Bacillus subtilis] [DB:pir2] >gp:[GI:e334763:g2339991]
[LN:BS16823KB] [AC:Z98682] [PN:CtaB protein] [GN:ctaB] [OR:Bacillus subtilis]
[DB:genpept-bct1] [DE:Bacillus subtilis genomic DNA 23.9kB fragment.] [SP:P24009]
[LE:4441] [RE:5358] [DI:direct] >gp:[GI:g994794] [LN:BSCTABF] [AC:X54140]
[PN:cytochrome a assembly facto] [GN:ctaB] [OR:Bacillus subtilis] [DB:genpept-bct1]
[EC:1.9.3.1] [DE:B. subtilis ctaB-F genes for cytochrome a assembly factor
andcytochrome-c oxidase (EC 1.9.3.1) subunits II, I, II, and IVB.] [NT:putative]
[SP:P24009] [LE:408] [RE:1325] [DI:direct] >gp:[GI:e1185078:g2633859] [LN:BSUB0008]
[AC:Z99111:AL009126] [PN:cytochrome caa3 oxydase assembly factor] [GN:ctaB]
[OR:Bacillus subtilis] [DB:genpept-bct1] [DE:Bacillus subtilis complete genome (section
8 of 21): from 1394791to 1603020.] [SP:P24009] [LE:163924] [RE:164841] [DI:direct]

| ORF Name | NTID | AAID | NT Length | AA Length | score | probability |
|---|---|---|---|---|---|---|
| AI7503000990_1063753_c2_874 | 1699 | 5471 | 1374 | 457 | 2070 | 3.3e-214 |

Description
sp:[LN:MURD_STAAU] [AC:O33595:O07323] [GN:MURD] [OR:STAPHYLOCOCCUS AUREUS] [EC:6.3.2.9]
[DE:ADDING ENZYME)] [SP:O33595:O07323] [DB:swissprot] >pir:[LN:JC6560] [AC:JC6560 ]
[PN:UDP-N-acetylmuramoylalanine--D-glutamate ligase,
:UDP-N-acetylmuramoyl-L-alanyl-D-glutamate synthetase] [GN:murD ] [OR:Staphylococcus
aureus] [EC:6.3.2.9] [DB:pir2] >gp:[GI:g2271510] [LN:AF009671] [AC:AF009671]
[PN:UDP-N-acetylmuramoyl-L-alanine : D-glutamate] [GN:murD] [FN:catalyzes ATP-dependent
D-glutamate addition] [OR:Staphylococcus aureus] [DB:genpept-bct2] [DE:Staphylococcus
aureus UDP-N-acetylmuramoyl-L-alanine : D-glutamateligase (murD) gene, complete cds.]
[NT:MurD] [LE:1] [RE:1350] [DI:direct]

| ORF Name | NTID | AAID | NT Length | AA Length | score | probability |
|---|---|---|---|---|---|---|
| AI7503000990_10740628_f3_637 | 1700 | 5472 | 183 | 60 | | |

Description
NO-HIT

| ORF Name | NTID | AAID | NT Length | AA Length | score | probability |
|---|---|---|---|---|---|---|
| AI7503000990_10928_c3_958 | 1701 | 5473 | 1242 | 413 | 239 | 1.1e-17 |

Description
pir:[LN:T03492] [AC:T03492 ] [PN:hypothetical protein] [OR:Rhodobacter capsulatus] [DB:pir2] [MP:1 ] >gp:[GI:g3128293] [LN:AF010496] [AC:AF010496] [PN:hypothetical protein] [OR:Rhodobacter capsulatus] [DB:genpept-bct2] [DE:Rhodobacter capsulatus strain SB1003, partial genome.] [LE:54291] [RE:55613] [DI:complement]

| ORF Name | NTID | AAID | NT Length | AA Length | score | probability |
|---|---|---|---|---|---|---|
| AI7503000990_10969052_c3_935 | 1702 | 5474 | 1725 | 574 | 2602 | 1.4e-270 |

Description
sp:[LN:PT1_STAAU] [AC:P51183] [GN:PTSI] [OR:STAPHYLOCOCCUS AUREUS] [EC:2.7.3.9] [DE:(PHOSPHOTRANSFERASE SYSTEM, ENZYME I)] [SP:P51183] [DB:swissprot] >gp:[GI:g1070386] [LN:SAPTSHI] [AC:X93205] [PN:phosphoenolpyruvate-protein phosphatase] [GN:ptsI] [OR:Staphylococcus aureus] [DB:genpept-bct1] [EC:2.7.3.9] [DE:S.aureus ptsH and ptsI genes.] [SP:P51183] [LE:462] [RE:2180] [DI:direct]

| ORF Name | NTID | AAID | NT Length | AA Length | score | probability |
|---|---|---|---|---|---|---|
| AI7503000990_10972150_c3_1037 | 1703 | 5475 | 2055 | 684 | 3024 | 0.0 |

Description
sp:[LN:RECG_STAAU] [AC:O50581] [GN:RECG] [OR:STAPHYLOCOCCUS AUREUS] [EC:3.6.1.-] [DE:ATP-DEPENDENT DNA HELICASE RECG,] [SP:O50581] [DB:swissprot] >gp:[GI:d1025491:g2826896] [LN:AB000439] [AC:AB000439] [PN:RecG] [GN:recG] [OR:Staphylococcus aureus] [SR:Staphylococcus aureus (strain:RN4220) DNA] [DB:genpept-bct1] [DE:Staphylococcus aureus recG gene, complete cds.] [LE:319] [RE:2379] [DI:direct]

| ORF Name | NTID | AAID | NT Length | AA Length | score | probability |
|---|---|---|---|---|---|---|
| AI7503000990_1173177_f3_667 | 1704 | 5476 | 1053 | 350 | 691 | 4.4e-68 |

Description
sp:[LN:YAAF_ECOLI] [AC:P22564] [GN:YAAF] [OR:ESCHERICHIA COLI] [DE:HYPOTHETICAL 32.6 KD PROTEIN IN LYTB-DAPB INTERGENIC REGION] [SP:P22564] [DB:swissprot] >pir:[LN:JE0404] [AC:JE0404:S40553:F64723:S22291 ] [PN:probable glycosidase, yaaF] [GN:yaaF ] [CL:yaaF protein] [OR:Escherichia coli] [EC:3.2.-.-] [DB:pir2] >gp:[GI:g41934] [LN:ECLSPDAP] [AC:X54945] [GN:ORF 3] [OR:Escherichia coli] [DB:genpept-bct1] [DE:E. coli lsp-dapB interval.] [NT:product appears to be membrane bound] [SP:P22564] [LE:1613] [RE:2527] [DI:direct] >gp:[GI:d1001780:g216457] [LN:ECO110K] [AC:D10483:J01597:J01683:J01706:K01298:K01990:M10420:M10611:M12544] [OR:Escherichia coli] [SR:Escherichia coli (strain:K-12) DNA] [DB:genpept-bct1] [DE:E.coli K12 genome, 0-2.4min. region.] [NT:hypothetical 32.6K protein(PIR:JE0404)] [LE:26947] [RE:27861] [DI:direct] >gp:[GI:g1786213] [LN:AE000113] [AC:AE000113:U00096] [PN:orf, hypothetical protein] [GN:yaaF] [FN:orf; Unknown] [OR:Escherichia coli] [DB:genpept-bct2] [DE:Escherichia coli K-12 MG1655 section 3 of 400 of the completegenome.] [NT:o304; 100 pct identical to YAAF_ECOLI SW: P22564] [LE:6634] [RE:7548] [DI:direct]

| ORF Name | NTID | AAID | NT Length | AA Length | score | probability |
|---|---|---|---|---|---|---|
| AI7503000990_1178828_c2_810 | 1705 | 5477 | 705 | 234 | 649 | 1.3e-63 |

Description
gp:[GI:g4097530] [LN:LLU64311] [AC:U64311]
[PN:phosphoribosylaminoimidazolesuccinocarboxamide] [GN:purC] [OR:Lactococcus lactis]
[DB:genpept-bct2] [EC:6.3.2.6] [DE:Lactococcus lactis
phosphoribosylaminoimidazolesuccinocarboxamidesynthetase (purC),
phosphoribosylformylglycinamidine synthetase I(purQ), phosphoribosylformylglycinamidine
synthetase II (purL), andphosphoribosylpyrophosphate amidotransferase (purF) genes,
completecds; and unknown gene.] [NT:SAICAR synthetase] [LE:792] [RE:1502] [DI:direct]

| ORF Name | NTID | AAID | NT Length | AA Length | score | probability |
|---|---|---|---|---|---|---|
| AI7503000990_1179542_c2_839 | 1706 | 5478 | 222 | 73 | | |

Description
NO-HIT

| ORF Name | NTID | AAID | NT Length | AA Length | score | probability |
|---|---|---|---|---|---|---|
| AI7503000990_11806512_f3_562 | 1707 | 5479 | 207 | 68 | 86 | 0.0050 |

Description
gp:[GI:e1344613:g3874900] [LN:CEC41G6] [AC:Z81047] [GN:C41G6.8] [OR:Caenorhabditis
elegans] [DB:genpept-invl] [DE:Caenorhabditis elegans cosmid C41G6, complete sequence.]
[LE:18951:19702:20184] [RE:19549:20043:20463] [DI:directJoin]

| ORF Name | NTID | AAID | NT Length | AA Length | score | probability |
|---|---|---|---|---|---|---|
| AI7503000990_1204567_c2_897 | 1708 | 5480 | 750 | 249 | 481 | 8.0e-46 |

Description
pir:[LN:G69878] [AC:G69878 ] [PN:conserved hypothetical protein yloO] [GN:yloO ]
[CL:conserved hypothetical protein yloO:conserved hypothetical protein yloO homology]
[OR:Bacillus subtilis] [DB:pir2] >gp:[GI:e1185167:g2633948] [LN:BSUB0009]
[AC:Z99112:AL009126] [GN:yloO] [FN:unknown] [OR:Bacillus subtilis] [DB:genpept-bct1]
[DE:Bacillus subtilis complete genome (section 9 of 21): from 1598421to 1807200.]
[NT:similar to hypothetical proteins] [LE:51363] [RE:52127] [DI:direct]
>gp:[GI:e323505:g2337805] [LN:BSY13937] [AC:Y13937] [PN:putative Ptcl protein]
[GN:yloO] [FN:unknown] [OR:Bacillus subtilis] [DB:genpept-bct1] [DE:Bacillus subtilis
genomic DNA from the spoVM region.] [LE:13135] [RE:13899] [DI:direct]

| ORF Name | NTID | AAID | NT Length | AA Length | score | probability |
|---|---|---|---|---|---|---|
| AI7503000990_1209638_c1_775 | 1709 | 5481 | 540 | 179 | 642 | 6.9e-63 |

Description
sp:[LN:LSPA_STAAU] [AC:P31024] [GN:LSPA:LSP] [OR:STAPHYLOCOCCUS AUREUS] [EC:3.4.23.36]
[DE:PEPTIDASE) (SIGNAL PEPTIDASE II) (SPASE II)] [SP:P31024] [DB:swissprot]
>pir:[LN:S20433] [AC:S20433 ] [PN:lipoprotein signal peptidase,] [CL:lipoprotein signal
peptidase] [OR:Staphylococcus aureus] [EC:3.4.23.36] [DB:pir2] >gp:[GI:g153045]
[LN:STALSP] [AC:M83994:M84707] [PN:prolipoprotein signal peptidase] [GN:lsp]
[OR:Staphylococcus aureus] [SR:Staphylococcus aureus DNA] [DB:genpept-bct1]
[DE:Staphylococcus aureus prolipoprotein signal peptidase (lsp) gene,complete cds.]
[LE:1213] [RE:1704] [DI:direct]

| ORF Name | NTID | AAID | NT Length | AA Length | score | probability |
|---|---|---|---|---|---|---|
| AI7503000990_1209682_c2_856 | 1710 | 5482 | 2409 | 802 | 1984 | 4.3e-205 |

Description sp:[LN:SYFB_BACSU] [AC:P17922:P94540] [GN:PHET] [OR:BACILLUS SUBTILIS] [EC:6.1.1.20]
[DE:TRNA LIGASE BETA CHAIN) (PHERS)] [SP:P17922:P94540] [DB:swissprot] >pir:[LN:YFBSB]
[AC:A69676:I40460:S11731 ] [PN:phenylalanine--tRNA ligase, beta chain:phenylalanyl-tRNA
synthetase beta chain] [GN:pheT ] [CL:phenylalanine--tRNA ligase beta chain]
[OR:Bacillus subtilis] [EC:6.1.1.20] [DB:pir1] >gp:[GI:e1184112:g2635328] [LN:BSUB0015]
[AC:Z99118:AL009126] [PN:phenylalanyl-tRNA synthetase (beta subunit)] [GN:pheT]
[OR:Bacillus subtilis] [DB:genpept-bct1] [EC:6.1.1.20] [DE:Bacillus subtilis complete
genome (section 15 of 21): from 2795131to 3013540.] [SP:P17922] [LE:130980] [RE:133394]
[DI:complement] >gp:[GI:e1165325:g1770031] [LN:BSZ75208] [AC:Z75208]
[PN:phenylalanyl-tRNA synthetase beta subunit] [GN:pheT] [OR:Bacillus subtilis]
[DB:genpept-bct1] [EC:6.1.1.20] [DE:B.subtilis genomic sequence 89009bp.]
[NT:phenylalanyl-tRNA synthetase beta subunit] [SP:P17922] [LE:36513] [RE:38927]
[DI:direct]

| ORF Name | NTID | AAID | NT Length | AA Length | score | probability |
|---|---|---|---|---|---|---|
| AI7503000990_13720312_c3_1024 | 1711 | 5483 | 240 | 79 | 117 | 3.0e-07 |

Description pir:[LN:C69878] [AC:C69878 ] [PN:hypothetical protein yloH] [GN:yloH ] [OR:Bacillus
subtilis] [DB:pir2] >gp:[GI:e1185160:g2633941] [LN:BSUB0009] [AC:Z99112:AL009126]
[GN:yloH] [FN:unknown] [OR:Bacillus subtilis] [DB:genpept-bct1] [DE:Bacillus subtilis
complete genome (section 9 of 21): from 1598421to 1807200.] [LE:43546] [RE:43749]
[DI:direct] >gp:[GI:e323522:g2337798] [LN:BSY13937] [AC:Y13937] [PN:putative rpoZ
protein] [GN:yloH] [FN:unknown] [OR:Bacillus subtilis] [DB:genpept-bct1] [DE:Bacillus
subtilis genomic DNA from the spoVM region.] [LE:5318] [RE:5521] [DI:direct]

| ORF Name | NTID | AAID | NT Length | AA Length | score | probability |
|---|---|---|---|---|---|---|
| AI7503000990_13757785_f3_639 | 1712 | 5484 | 135 | 44 | | |

Description
NO-HIT

| ORF Name | NTID | AAID | NT Length | AA Length | score | probability |
|---|---|---|---|---|---|---|
| AI7503000990_1376317_c2_881 | 1713 | 5485 | 564 | 187 | 481 | 8.0e-46 |

Description gp:[GI:e199384:g1514599] [LN:LPPYRBSOP] [AC:Z54240] [GN:pyrR] [FN:regulatory protein]
[OR:Lactobacillus plantarum] [DB:genpept-bct1] [DE:L.plantarum pyrimidine biosynthetic
operon (pyrR, pyrB, pyrC,pyrAA, pyrAB, pyrD, pyrF, and pyrE) genes.] [LE:781] [RE:1323]
[DI:direct]

| ORF Name | NTID | AAID | NT Length | AA Length | score | probability |
|---|---|---|---|---|---|---|
| AI7503000990_13797076_c3_915 | 1714 | 5486 | 135 | 44 | | |

Description
NO-HIT

| ORF Name | NTID | AAID | NT Length | AA Length | score | probability |
|---|---|---|---|---|---|---|
| AI7503000990_13864213_f3_624 | 1715 | 5487 | 234 | 77 | 186 | 1.4e-14 |

Description
pir:[LN:D69871] [AC:D69871 ] [PN:hypothetical protein ykzG] [GN:ykzG] [OR:Bacillus subtilis] [DB:pir2] >gp:[GI:e1185044:g2633825] [LN:BSUB0008] [AC:Z99111:AL009126] [GN:ykzG] [FN:unknown] [OR:Bacillus subtilis] [DB:genpept-bct1] [DE:Bacillus subtilis complete genome (section 8 of 21): from 1394791to 1603020.] [LE:129406] [RE:129615] [DI:complement]

| ORF Name | NTID | AAID | NT Length | AA Length | score | probability |
|---|---|---|---|---|---|---|
| AI7503000990_13869091_f2_433 | 1716 | 5488 | 294 | 97 | 246 | 6.4e-21 |

Description
sp:[LN:QOX4_BACSU] [AC:P34959] [GN:QOXD:IPA-40D] [OR:BACILLUS SUBTILIS] [EC:1.9.3.-] [DE:SUBUNIT QOXD)] [SP:P34959] [DB:swissprot] >pir:[LN:D38129] [AC:D38129:S39695:H69687 ] [PN:quinol oxidase aa3-600 chain IV qoxD:cytochrome aa3 quinol oxidase (subunit IV) qoxD] [GN:qoxD ] [OR:Bacillus subtilis] [DB:pir2] >gp:[GI:g143399] [LN:BACQOXA] [AC:M86548] [PN:quinol oxidase] [GN:QOXD] [OR:Bacillus subtilis] [SR:Bacillus subtilis DNA] [DB:genpept-bct1] [DE:Bacillus subtilis AA3-600 quinol oxidase (QOXA, QOXB, QOXC, QOXD)genes, complete cds.] [LE:4425] [RE:4799] [DI:direct] >gp:[GI:g413964] [LN:BSGENR] [AC:X73124] [GN:ipa-40d qoxD] [OR:Bacillus subtilis] [DB:genpept-bct1] [DE:B.subtilis genomic region (325 to 333).] [SP:P34959] [LE:42877] [RE:43251] [DI:direct] >gp:[GI:e1186313:g2636349] [LN:BSUB0020] [AC:Z99123:AL009126] [PN:cytochrome aa3 quinol oxidase (subunit IV)] [GN:qoxD] [OR:Bacillus subtilis] [DB:genpept-bct1] [DE:Bacillus subtilis complete genome (section 20 of 21): from 3798401to 4010550.] [NT:alternate gene name: ipa-40d] [SP:P34959] [LE:114711] [RE:115085] [DI:complement]

| ORF Name | NTID | AAID | NT Length | AA Length | score | probability |
|---|---|---|---|---|---|---|
| AI7503000990_13916017_c1_738 | 1717 | 5489 | 123 | 40 | | |

Description
NO-HIT

| ORF Name | NTID | AAID | NT Length | AA Length | score | probability |
|---|---|---|---|---|---|---|
| AI7503000990_14460882_c2_840 | 1718 | 5490 | 240 | 79 | 321 | 7.2e-29 |

Description
gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF Name | NTID | AAID | NT Length | AA Length | score | probability |
|---|---|---|---|---|---|---|
| AI7503000990_14557882_f3_532 | 1719 | 5491 | 126 | 41 | | |

Description
NO-HIT

| ORF Name | NTID | AAID | NT Length | AA Length | score | probability |
|---|---|---|---|---|---|---|
| AI7503000990_14642135_c3_957 | 1720 | 5492 | 1905 | 634 | 2456 | 4.1e-255 |

Description
sp:[LN:TYPA_BACSU] [AC:O07631] [GN:TYPA] [OR:BACILLUS SUBTILIS] [DE:GTP-BINDING PROTEIN TYPA/BIPA HOMOLOG] [SP:O07631] [DB:swissprot] >pir:[LN:E69872] [AC:E69872 ] [PN:GTP-binding elongation factor homolog ylaG] [GN:ylaG ] [CL:translation elongation factor Tu homology] [OR:Bacillus subtilis] [DB:pir2] >gp:[GI:e1185067:g2633848] [LN:BSUB0008] [AC:Z99111:AL009126] [GN:ylaG] [FN:unknown] [OR:Bacillus subtilis] [DB:genpept-bct1] [DE:Bacillus subtilis complete genome (section 8 of 21): from 1394791to 1603020.] [NT:similar to GTP-binding elongation factor] [SP:O07631] [LE:150736] [RE:152574] [DI:direct] >gp:[GI:e1191893:g2224766] [LN:BSZ97025] [AC:Z97025] [GN:ylaG] [OR:Bacillus subtilis] [DB:genpept-bct1] [DE:Bacillus subtilis nprE, yla[A,B,C,D,E,F,G,H,I,J,K,L,M,N,O] and pycAgenes.] [NT:product highly similar to elongation factor EF-G] [SP:O07631] [LE:4995] [RE:6833] [DI:direct]

| ORF Name | NTID | AAID | NT Length | AA Length | score | probability |
|---|---|---|---|---|---|---|
| AI7503000990_14644066_c2_865 | 1721 | 5493 | 189 | 62 | 79 | 0.0032 |

Description
gp:[GI:g3212079] [LN:AF068633] [AC:AF068633] [PN:phenol soluble modulin beta 1] [FN:inflammatory protein] [OR:Staphylococcus epidermidis] [DB:genpept-bct2] [DE:Staphylococcus epidermidis phenol soluble modulin beta 1 and phenolsoluble modulin beta 2 genes, complete cds.] [NT:PSM beta 1] [LE:669] [RE:803] [DI:direct] >gp:[GI:g3212080] [LN:AF068633] [AC:AF068633] [PN:phenol soluble modulin beta 2] [FN:inflammatory protein] [OR:Staphylococcus epidermidis] [DB:genpept-bct2] [DE:Staphylococcus epidermidis phenol soluble modulin beta 1 and phenolsoluble modulin beta 2 genes, complete cds.] [NT:PSM beta 2] [LE:859] [RE:993] [DI:direct]

| ORF Name | NTID | AAID | NT Length | AA Length | score | probability |
|---|---|---|---|---|---|---|
| AI7503000990_14650302_c1_688 | 1722 | 5494 | 264 | 87 | 179 | 8.0e-14 |

Description
sp:[LN:YEXA_BACSU] [AC:P12049] [GN:YEXA] [OR:BACILLUS SUBTILIS] [DE:HYPOTHETICAL 9.7 KD PROTEIN IN PURC-PURL INTERGENIC REGION] [SP:P12049] [DB:swissprot] >pir:[LN:E29326] [AC:E29326:E69799 ] [PN:conserved hypothetical protein yexA:hypothetical protein (pur operon)] [GN:yexA ] [CL:conserved hypothetical protein MJ1593] [OR:Bacillus subtilis] [DB:pir2] >gp:[GI:e1182626:g2632960] [LN:BSUB0004] [AC:Z99107:AL009126] [GN:yexA] [FN:unknown] [OR:Bacillus subtilis] [DB:genpept-bct1] [DE:Bacillus subtilis complete genome (section 4 of 21): from 600701 to813890.] [NT:similar to hypothetical proteins] [LE:101124] [RE:101378] [DI:direct]

| ORF Name | NTID | AAID | NT Length | AA Length | score | probability |
|---|---|---|---|---|---|---|
| AI7503000990_14664012_f2_323 | 1723 | 5495 | 468 | 155 | 341 | 5.4e-31 |

Description
pir:[LN:E69875] [AC:E69875 ] [PN:hypothetical protein ylbP] [GN:ylbP ] [OR:Bacillus subtilis] [DB:pir2] >gp:[GI:e334785:g2340013] [LN:BS16823KB] [AC:Z98682] [PN:YlbP protein] [GN:ylbP] [OR:Bacillus subtilis] [DB:genpept-bct1] [DE:Bacillus subtilis genomic DNA 23.9kB fragment.] [LE:21896] [RE:22378] [DI:complement] >gp:[GI:e1185100:g2633881] [LN:BSUB0008] [AC:Z99111:AL009126] [GN:ylbP] [FN:unknown] [OR:Bacillus subtilis] [DB:genpept-bct1] [DE:Bacillus subtilis complete genome (section 8 of 21): from 1394791to 1603020.] [LE:181379] [RE:181861] [DI:complement]

| ORF Name | NTID | AAID | NT Length | AA Length | score | probability |
|---|---|---|---|---|---|---|
| AI7503000990_14851587_c3_1010 | 1724 | 5496 | 126 | 41 | | |

Description
NO-HIT

| ORF Name | NTID | AAID | NT Length | AA Length | score | probability |
|---|---|---|---|---|---|---|
| AI7503000990_14875002_f2_408 | 1725 | 5497 | 141 | 46 | 85 | 0.0044 |

Description
gp:[GI:g488889] [LN:A12521] [AC:A12521] [PN:Acidic Basic Repeat Antigen Rhoptry (ABRA)] [OR:Plasmodium falciparum] [SR:malaria parasite P. falciparum] [DB:genpept-pat] [DE:Ag189 clone.] [LE:1:61] [RE:45:963] [DI:directJoin]

| ORF Name | NTID | AAID | NT Length | AA Length | score | probability |
|---|---|---|---|---|---|---|
| AI7503000990_156502_f1_179 | 1726 | 5498 | 243 | 80 | | |

Description
NO-HIT

| ORF Name | NTID | AAID | NT Length | AA Length | score | probability |
|---|---|---|---|---|---|---|
| AI7503000990_16593800_f2_359 | 1727 | 5499 | 144 | 47 | | |

Description
NO-HIT

| ORF Name | NTID | AAID | NT Length | AA Length | score | probability |
|---|---|---|---|---|---|---|
| AI7503000990_19537562_f2_429 | 1728 | 5500 | 198 | 65 | | |

Description
NO-HIT

| ORF Name | NTID | AAID | NT Length | AA Length | score | probability |
|---|---|---|---|---|---|---|
| AI7503000990_19537878_f1_177 | 1729 | 5501 | 159 | 52 | | |

Description
NO-HIT

| ORF Name | NTID | AAID | NT Length | AA Length | score | probability |
|---|---|---|---|---|---|---|
| AI7503000990_19556326_f1_94 | 1730 | 5502 | 141 | 46 | | |

Description
NO-HIT

| ORF Name | NTID | AAID | NT Length | AA Length | score | probability |
|---|---|---|---|---|---|---|
| AI7503000990_19557752_c1_777 | 1731 | 5503 | 912 | 303 | 844 | 2.7e-84 |

Description sp:[LN:PYRB_BACSU] [AC:P05654] [GN:PYRB] [OR:BACILLUS SUBTILIS] [EC:2.1.3.2]
[DE:TRANSCARBAMYLASE) (ATCASE)] [SP:P05654] [DB:swissprot] >pir:[LN:OWBSAC]
[AC:A25015:C39845:B69686 ] [PN:aspartate carbamoyltransferase, catalytic
chain:aspartate transcarbamoylase] [GN:pyrB ] [CL:ornithine carbamoyltransferase:
aspartate/ornithine carbamoyltransferase homology] [OR:Bacillus subtilis] [EC:2.1.3.2]
[DB:pir1] [MP:37 min ] >gp:[GI:g143384] [LN:BACPYRB] [AC:M13128] [OR:Bacillus subtilis]
[SR:B.subtilis (strain JH861), clone pLS201] [DB:genpept-bct1] [DE:B.subtilis pyrB
gene encoding aspartate transcarbamoylase, completecds.] [NT:aspartate
transcarbamoylase (EC 2.1.3.2)] [LE:96] [RE:1010] [DI:direct]
>gp:[GI:e1185141:g2633922] [LN:BSUB0009] [AC:Z99112:AL009126] [PN:aspartate
carbamoyltransferase] [GN:pyrB] [FN:pyrimidine biosynthesis] [OR:Bacillus subtilis]
[DB:genpept-bct1] [EC:2.1.3.2] [DE:Bacillus subtilis complete genome (section 9 of 21):
from 1598421to 1807200.] [SP:P05654] [LE:21455] [RE:22369] [DI:direct] >gp:[GI:g143387]
[LN:BACPYROP] [AC:M59757] [PN:aspartate transcarbamylase] [GN:pyrB] [OR:Bacillus
subtilis] [DB:genpept-bct2] [DE:Bacillus subtilis ORF1A (pyrR), putative membrane-bound
uracilpermease (pyrP), aspartate transcarbamylase (pyrB), dihydroorotase(pyrC),
glutaminase of carbamyl phosphate synthetase (pyrAA),carbamyl phosphate synthetase
(pyrAB), dihydroorotase dehydrogenase(pyrD), OMP decarboxylase (pyrF), and OMP-PRPP
transferase (pyrE)genes, complete cds; and unknown gene.] [LE:2859] [RE:3773]
[DI:direct]

| ORF Name | NTID | AAID | NT Length | AA Length | score | probability |
|---|---|---|---|---|---|---|
| AI7503000990_19565627_c2_879 | 1732 | 5504 | 132 | 43 | | |

Description
NO-HIT

| ORF Name | NTID | AAID | NT Length | AA Length | score | probability |
|---|---|---|---|---|---|---|
| AI7503000990_19609530_f1_155 | 1733 | 5505 | 147 | 48 | | |

Description
NO-HIT

| ORF Name | NTID | AAID | NT Length | AA Length | score | probability |
|---|---|---|---|---|---|---|
| AI7503000990_19804703_c2_811 | 1734 | 5506 | 747 | 248 | 696 | 1.3e-68 |

Description sp:[LN:PURQ_BACSU] [AC:P12041] [GN:PURQ] [OR:BACILLUS SUBTILIS] [EC:6.3.5.3]
[DE:SYNTHASE I)] [SP:P12041] [DB:swissprot] >pir:[LN:SYBS1G] [AC:F29326:H69684 ]
[PN:phosphoribosylformylglycinamidine synthase, component I] [GN:purQ ]
[CL:phosphoribosylformylglycinamidine synthase component I] [OR:Bacillus subtilis]
[EC:6.3.5.3] [DB:pir1] [MP:18 min ] >gp:[GI:g143368] [LN:BACPURF] [AC:J02732:K00047]
[OR:Bacillus subtilis] [SR:B.subtilis (strain DE1 (prototroph DER. or W168)) DNA, clone
pPZ] [DB:genpept-bct1] [DE:B.subtilis pur operon encoding purine biosynthesis enzymes,
12genes.] [NT:phosphoribosylformyl glycinamidine synthetase I] [LE:4393] [RE:5076]
[DI:direct] >gp:[GI:e1182627:g2632961] [LN:BSUB0004] [AC:Z99107:AL009126]
[PN:phosphoribosylformylglycinamidine synthetase II] [GN:purL] [FN:purine biosynthesis]
[OR:Bacillus subtilis] [DB:genpept-bct1] [EC:6.3.5.3] [DE:Bacillus subtilis complete
genome (section 4 of 21): from 600701 to813890.] [SP:P12041] [LE:101375] [RE:102058]
[DI:direct]

| ORF Name | NTID | AAID | NT Length | AA Length | score | probability |
|---|---|---|---|---|---|---|
| AI7503000990_19957802_c1_752 | 1735 | 5507 | 1896 | 631 | 2764 | 9.5e-288 |

Description gp:[GI:e1333202:g3776112] [LN:SATRXA] [AC:AJ223480] [PN:excinuclease ABC, subunit C] [GN:uvrC] [FN:excision of ultraviolet light-induced] [OR:Staphylococcus aureus] [DB:genpept-bct1] [DE:Staphylococcus aureus trxA and uvrC genes and partial mutS and dhsCgenes.] [NT:alternative gene name: uvrB] [LE:2972] [RE:4753] [DI:direct]

| ORF Name | NTID | AAID | NT Length | AA Length | score | probability |
|---|---|---|---|---|---|---|
| AI7503000990_20312515_f2_242 | 1736 | 5508 | 141 | 46 | | |

Description

NO-HIT

| ORF Name | NTID | AAID | NT Length | AA Length | score | probability |
|---|---|---|---|---|---|---|
| AI7503000990_20500055_f1_218 | 1737 | 5509 | 132 | 43 | | |

Description

NO-HIT

| ORF Name | NTID | AAID | NT Length | AA Length | score | probability |
|---|---|---|---|---|---|---|
| AI7503000990_20502217_c3_990 | 1738 | 5510 | 1626 | 541 | 718 | 6.1e-71 |

Description pir:[LN:G69875] [AC:G69875 ] [PN:hypothetical protein yllA] [GN:yllA] [OR:Bacillus subtilis] [DB:pir2] >gp:[GI:e1185102:g2633883] [LN:BSUB0008] [AC:Z99111:AL009126] [GN:yllA] [FN:unknown] [OR:Bacillus subtilis] [DB:genpept-bct1] [DE:Bacillus subtilis complete genome (section 8 of 21): from 1394791to 1603020.] [LE:182988] [RE:184607] [DI:direct]

| ORF Name | NTID | AAID | NT Length | AA Length | score | probability |
|---|---|---|---|---|---|---|
| AI7503000990_2067627_c2_849 | 1739 | 5511 | 129 | 42 | | |

Description

NO-HIT

| ORF Name | NTID | AAID | NT Length | AA Length | score | probability |
|---|---|---|---|---|---|---|
| AI7503000990_20890875_c2_801 | 1740 | 5512 | 147 | 48 | | |

Description

NO-HIT

| ORF Name | NTID | AAID | NT Length | AA Length | score | probability |
|---|---|---|---|---|---|---|
| AI7503000990_209840_f1_44 | 1741 | 5513 | 195 | 64 | | |

Description

NO-HIT

| ORF Name | NTID | AAID | NT Length | AA Length | score | probability |
|---|---|---|---|---|---|---|
| AI7503000990_20994212_f1_151 | 1742 | 5514 | 207 | 68 | 71 | 0.022 |

Description
pir:[LN:D69872] [AC:D69872 ] [PN:hypothetical protein ylaF] [GN:ylaF ] [OR:Bacillus subtilis] [DB:pir2] >gp:[GI:e1185066:g2633847] [LN:BSUB0008] [AC:Z99111:AL009126] [GN:ylaF] [FN:unknown] [OR:Bacillus subtilis] [DB:genpept-bct1] [DE:Bacillus subtilis complete genome (section 8 of 21): from 1394791to 1603020.] [LE:150435] [RE:150623] [DI:complement] >gp:[GI:e324391:g2224765] [LN:BSZ97025] [AC:Z97025] [GN:ylaF] [OR:Bacillus subtilis] [DB:genpept-bct1] [DE:Bacillus subtilis nprE, yla[A,B,C,D,E,F,G,H,I,J,K,L,M,N,O] and pycAgenes.] [LE:4694] [RE:4882] [DI:complement]

| ORF Name | NTID | AAID | NT Length | AA Length | score | probability |
|---|---|---|---|---|---|---|
| AI7503000990_211677_c3_989 | 1743 | 5515 | 702 | 233 | 436 | 4.7e-41 |

Description
pir:[LN:E69814] [AC:E69814 ] [PN:conserved hypothetical protein yfnB] [GN:yfnB ] [OR:Bacillus subtilis] [DB:pir2] >gp:[GI:e1182712:g2633046] [LN:BSUB0004] [AC:Z99107:AL009126] [GN:yfnB] [FN:unknown] [OR:Bacillus subtilis] [DB:genpept-bct1] [DE:Bacillus subtilis complete genome (section 4 of 21): from 600701 to813890.] [NT:similar to hypothetical proteins] [LE:203465] [RE:204172] [DI:complement] >gp:[GI:e1182723:g2633057] [LN:BSUB0005] [AC:Z99108:AL009126] [GN:yfnB] [FN:unknown] [OR:Bacillus subtilis] [DB:genpept-bct1] [DE:Bacillus subtilis complete genome (section 5 of 21): from 802821 to1011250.] [NT:similar to hypothetical proteins] [LE:1345] [RE:2052] [DI:complement] >gp:[GI:d1020926:g2116760] [LN:D86418] [AC:D86418] [PN:YfnB] [OR:Bacillus subtilis] [SR:Bacillus subtilis (strain:AC327) DNA] [DB:genpept-bct1] [DE:Bacillus subtilis genomic DNA 69-70 degree region, partialsequence.] [LE:9019] [RE:9726] [DI:direct]

| ORF Name | NTID | AAID | NT Length | AA Length | score | probability |
|---|---|---|---|---|---|---|
| AI7503000990_21648962_c3_930 | 1744 | 5516 | 1827 | 608 | 1793 | 7.4e-185 |

Description
gp:[GI:g517205] [LN:SPU09352] [AC:U09352] [PN:67 kDa Myosin-crossreactive streptococcal] [OR:Streptococcus pyogenes] [DB:genpept-bct1] [DE:Streptococcus pyogenes 42 KD protein (ORF1) gene and 67 KDMyosin-crossreactive streptococcal antigen gene, complete cds.] [NT:ORF2] [LE:1734] [RE:3506] [DI:direct]

| ORF Name | NTID | AAID | NT Length | AA Length | score | probability |
|---|---|---|---|---|---|---|
| AI7503000990_21656327_c1_761 | 1745 | 5517 | 936 | 311 | 1464 | 5.4e-150 |

Description
gp:[GI:g2149891] [LN:SAU94706] [AC:U94706] [PN:unknown] [GN:yllC] [OR:Staphylococcus aureus] [DB:genpept-bct2] [DE:Staphylococcus aureus strain ATCC 8325-4 cell wall/cell divisiongene cluster, yllB, yllC, yllD, pbpA, mraY, murD, divIB, ftsA andftsZ genes, complete cds.] [LE:987] [RE:1922] [DI:direct]

| ORF Name | NTID | AAID | NT Length | AA Length | score | probability |
|---|---|---|---|---|---|---|
| AI7503000990_21759653_f3_666 | 1746 | 5518 | 609 | 202 | 552 | 2.4e-53 |

Description
sp:[LN:QOX3_BACSU] [AC:P34958] [GN:QOXC:IPA-39D] [OR:BACILLUS SUBTILIS] [EC:1.9.3.-]
[DE:SUBUNIT QOXC)] [SP:P34958] [DB:swissprot] >pir:[LN:C38129] [AC:C38129:S39694:G69687
] [PN:bo-type ubiquinol oxidase, chain III qoxC:cytochrome aa3 quinol oxidase (subunit
III) qoxC] [GN:qoxC ] [CL:cytochrome-c oxidase chain III] [OR:Bacillus subtilis]
[EC:1.10.3.-] [DB:pir2] >gp:[GI:g143398] [LN:BACQOXA] [AC:M86548] [PN:quinol oxidase]
[GN:QOXC] [OR:Bacillus subtilis] [SR:Bacillus subtilis DNA] [DB:genpept-bct1]
[DE:Bacillus subtilis AA3-600 quinol oxidase (QOXA, QOXB, QOXC, QOXD)genes, complete
cds.] [LE:3809] [RE:4423] [DI:direct] >gp:[GI:g413963] [LN:BSGENR] [AC:X73124]
[GN:ipa-39d qoxC] [OR:Bacillus subtilis] [DB:genpept-bct1] [DE:B.subtilis genomic
region (325 to 333).] [SP:P34958] [LE:42261] [RE:42875] [DI:direct]
>gp:[GI:e1186314:g2636350] [LN:BSUB0020] [AC:Z99123:AL009126] [PN:cytochrome aa3 quinol
oxidase (subunit III)] [GN:qoxC] [OR:Bacillus subtilis] [DB:genpept-bct1] [DE:Bacillus
subtilis complete genome (section 20 of 21): from 3798401to 4010550.] [NT:alternate
gene name: ipa-39d] [SP:P34958] [LE:115087] [RE:115701] [DI:complement]

| ORF Name | NTID | AAID | NT Length | AA Length | score | probability |
|---|---|---|---|---|---|---|
| AI7503000990_21915911_f1_197 | 1747 | 5519 | 894 | 297 | 229 | 4.0e-19 |

Description
pir:[LN:G69858] [AC:G69858 ] [PN:hypothetical protein ykoC] [GN:ykoC ] [OR:Bacillus
subtilis] [DB:pir2] >gp:[GI:e1181521:g2632041] [LN:BSAJ2571] [AC:AJ002571] [PN:YkoC]
[GN:ykoC] [FN:unknown] [OR:Bacillus subtilis] [DB:genpept-bct1] [DE:Bacillus subtilis
168 56 kb DNA fragment between xlyA and ykoR.] [LE:40195] [RE:40959] [DI:complement]
>gp:[GI:e1183341:g2633675] [LN:BSUB0007] [AC:Z99110:AL009126] [GN:ykoC] [FN:unknown]
[OR:Bacillus subtilis] [DB:genpept-bct1] [DE:Bacillus subtilis complete genome (section
7 of 21): from 1194391to 1411140.] [LE:193144] [RE:193908] [DI:complement]

| ORF Name | NTID | AAID | NT Length | AA Length | score | probability |
|---|---|---|---|---|---|---|
| AI7503000990_22000943_f1_216 | 1748 | 5520 | 222 | 73 | | |

Description
NO-HIT

| ORF Name | NTID | AAID | NT Length | AA Length | score | probability |
|---|---|---|---|---|---|---|
| AI7503000990_22400283_C2_830 | 1749 | 5521 | 981 | 326 | 1329 | 1.1e-135 |

Description
pir:[LN:C36718] [AC:C36718:A69674 ] [PN:pyruvate dehydrogenase (lipoamide), E1 beta
chain precursor pdhB] [GN:pdhB ] [CL:pyruvate dehydrogenase (lipoamide) beta chain]
[OR:Bacillus subtilis] [EC:1.2.4.1] [DB:pir2] >gp:[GI:g143378] [LN:BACPYDHY]
[AC:M57435:M31542] [PN:pyruvate decarboxylase (E-1) beta subunit] [GN:pdhB]
[OR:Bacillus subtilis] [SR:B.subtilis (strain 168) BRB1 (sacA321 metB5) cell line DNA,
clone] [DB:genpept-bct1] [EC:1.2.4.1] [DE:B.subtilis pyruvate dehydrogenase complex
genes, complete cds;PAL-related lipoprotein (slp) gene, complete cds,
lysinedecarboxylase (cad) gene, partial cds.] [LE:2796] [RE:3773] [DI:direct]
>gp:[GI:e1185049:g2633830] [LN:BSUB0008] [AC:Z99111:AL009126] [PN:pyruvate
dehydrogenase (E1 beta subunit)] [GN:pdhB] [OR:Bacillus subtilis] [DB:genpept-bct1]
[EC:1.2.4.1] [DE:Bacillus subtilis complete genome (section 8 of 21): from 1394791to
1603020.] [SP:P21882] [LE:134060] [RE:135037] [DI:direct] >gp:[GI:g3282143]
[LN:AF012285] [AC:AF012285:AF012284:U51911] [PN:pyruvate decarboxylase E-1 beta
subunit] [GN:pdhB] [OR:Bacillus subtilis] [DB:genpept-bct2] [EC:1.2.4.1] [DE:Bacillus
subtilis mobA-nprE gene region.] [NT:similar to pyruvate decarboxylase (E-1) beta]
[LE:34548] [RE:35525] [DI:direct]

| ORF Name | NTID | AAID | NT Length | AA Length | score | probability |
|---|---|---|---|---|---|---|
| AI7503000990_2242938_c3_1009 | 1750 | 5522 | 933 | 310 | 1055 | 1.2e-106 |

Description
sp:[LN:YLYB_BACSU] [AC:Q45480:O31732] [GN:YLYB] [OR:BACILLUS SUBTILIS] [DE:HYPOTHETICAL 33.7 KD PROTEIN IN LSP-PYRR INTERGENIC REGION (ORF-X)] [SP:Q45480:O31732] [DB:swissprot] >gp:[GI:g1373157] [LN:BSU48870] [AC:U48870] [OR:Bacillus subtilis] [DB:genpept-bct1] [DE:Bacillus subtilis signal peptidase II (lsp) gene, complete cds,isoleucyl-tRNA synthetase (ileS) and pyrR genes, partial cds.] [NT:orf-X; hypothetical protein; Method: conceptual] [LE:1658] [RE:2569] [DI:direct]

| ORF Name | NTID | AAID | NT Length | AA Length | score | probability |
|---|---|---|---|---|---|---|
| AI7503000990_22461078_c1_769 | 1751 | 5523 | 735 | 244 | 814 | 4.1e-81 |

Description
gp:[GI:g1314301] [LN:SAU41072] [AC:U41072] [PN:unknown] [GN:ORF] [OR:Staphylococcus aureus] [DB:genpept-bct2] [DE:Staphylococcus aureus isoleucyl-tRNA synthetase (ileS) gene,partial cds.] [LE:106] [RE:723] [DI:direct]

| ORF Name | NTID | AAID | NT Length | AA Length | score | probability |
|---|---|---|---|---|---|---|
| AI7503000990_22462802_c3_1026 | 1752 | 5524 | 1203 | 400 | 1070 | 3.1e-108 |

Description
pir:[LN:D69878] [AC:D69878 ] [PN:pantothenate metabolism flavoprotein homolog yloI] [GN:yloI ] [CL:pantothenate metabolism flavoprotein dfp] [OR:Bacillus subtilis] [DB:pir2] >gp:[GI:e1185161:g2633942] [LN:BSUB0009] [AC:Z99112:AL009126] [GN:yloI] [FN:unknown] [OR:Bacillus subtilis] [DB:genpept-bct1] [DE:Bacillus subtilis complete genome (section 9 of 21): from 1598421to 1807200.] [NT:similar to pantothenate metabolism flavoprotein] [LE:43830] [RE:45050] [DI:direct] >gp:[GI:e323501:g2337799] [LN:BSY13937] [AC:Y13937] [PN:putative Dfp protein] [GN:yloI] [FN:unknown] [OR:Bacillus subtilis] [DB:genpept-bct1] [DE:Bacillus subtilis genomic DNA from the spoVM region.] [LE:5602] [RE:6822] [DI:direct]

| ORF Name | NTID | AAID | NT Length | AA Length | score | probability |
|---|---|---|---|---|---|---|
| AI7503000990_22478427_c3_987 | 1753 | 5525 | 138 | 45 | 115 | 4.8e-07 |

Description
sp:[LN:GGI2_STAHA] [AC:P11698] [OR:STAPHYLOCOCCUS HAEMOLYTICUS] [DE:ANTIBACTERIAL PROTEIN 2 (GONOCOCCAL GROWTH INHIBITOR 2)] [SP:P11698] [DB:swissprot] >pir:[LN:BXSA2] [AC:S00600 ] [PN:antibacterial protein 2:gonococcal growth inhibitor 2] [CL:Staphylococcus haemolyticus antibacterial protein] [OR:Staphylococcus haemolyticus] [DB:pir1]

| ORF Name | NTID | AAID | NT Length | AA Length | score | probability |
|---|---|---|---|---|---|---|
| AI7503000990_22542567_c2_855 | 1754 | 5526 | 759 | 252 | 562 | 2.1e-54 |

Description
pir:[LN:G69984] [AC:G69984 ] [PN:rRNA methylase homolog ysgA] [GN:ysgA ] [OR:Bacillus subtilis] [DB:pir2] >gp:[GI:e1184114:g2635330] [LN:BSUB0015] [AC:Z99118:AL009126] [GN:ysgA] [FN:unknown] [OR:Bacillus subtilis] [DB:genpept-bct1] [DE:Bacillus subtilis complete genome (section 15 of 21): from 2795131to 3013540.] [NT:similar to rRNA methylase] [LE:134799] [RE:135545] [DI:complement] >gp:[GI:e1165323:g1770029] [LN:BSZ75208] [AC:Z75208] [PN:hypothetical protein] [GN:ysgA] [OR:Bacillus subtilis] [DB:genpept-bct1] [DE:B.subtilis genomic sequence 89009bp.] [NT:Homology to SpoU-type rRNA methyltransferases;] [LE:34362] [RE:35108] [DI:direct]

| ORF Name | NTID | AAID | NT Length | AA Length | score | probability |
|---|---|---|---|---|---|---|
| AI7503000990_22775126_f2_411 | 1755 | 5527 | 633 | 210 | 263 | 1.0e-22 |

Description
pir:[LN:A69859] [AC:A69859 ] [PN:hypothetical protein ykoE] [GN:ykoE ] [OR:Bacillus subtilis] [DB:pir2] >gp:[GI:e1181523:g2632043] [LN:BSAJ2571] [AC:AJ002571] [PN:YkoE] [GN:ykoE] [FN:unknown] [OR:Bacillus subtilis] [DB:genpept-bct1] [DE:Bacillus subtilis 168 56 kb DNA fragment between xlyA and ykoR.] [LE:42565] [RE:43164] [DI:complement] >gp:[GI:e1183343:g2633677] [LN:BSUB0007] [AC:Z99110:AL009126] [GN:ykoE] [FN:unknown] [OR:Bacillus subtilis] [DB:genpept-bct1] [DE:Bacillus subtilis complete genome (section 7 of 21): from 1194391to 1411140.] [LE:195514] [RE:196113] [DI:complement]

| ORF Name | NTID | AAID | NT Length | AA Length | score | probability |
|---|---|---|---|---|---|---|
| AI7503000990_22931642_c2_802 | 1756 | 5528 | 1224 | 407 | 1250 | 2.6e-127 |

Description
gp:[GI:d1024918:g2696796] [LN:AB009635] [AC:AB009635] [PN:Fmt] [GN:fmt] [OR:Staphylococcus aureus] [SR:Staphylococcus aureus (strain:KSA8) DNA] [DB:genpept-bct1] [DE:Staphylococcus aureus DNA for Fmt, complete cds.] [LE:1234] [RE:2427] [DI:direct]

| ORF Name | NTID | AAID | NT Length | AA Length | score | probability |
|---|---|---|---|---|---|---|
| AI7503000990_23438887_c1_748 | 1757 | 5529 | 300 | 99 | 196 | 1.3e-15 |

Description
pir:[LN:A69985] [AC:A69985 ] [PN:hypothetical protein yshA] [GN:yshA ] [OR:Bacillus subtilis] [DB:pir2] >gp:[GI:e1184110:g2635326] [LN:BSUB0015] [AC:Z99118:AL009126] [GN:yshA] [FN:unknown] [OR:Bacillus subtilis] [DB:genpept-bct1] [DE:Bacillus subtilis complete genome (section 15 of 21): from 2795131to 3013540.] [LE:129612] [RE:129869] [DI:complement] >gp:[GI:e1165327:g1770033] [LN:BSZ75208] [AC:Z75208] [PN:hypothetical protein] [GN:yshA] [OR:Bacillus subtilis] [DB:genpept-bct1] [DE:B.subtilis genomic sequence 89009bp.] [NT:unknown function; putative] [LE:40038] [RE:40295] [DI:direct]

| ORF Name | NTID | AAID | NT Length | AA Length | score | probability |
|---|---|---|---|---|---|---|
| AI7503000990_23442177_f3_600 | 1758 | 5530 | 669 | 222 | 429 | 2.6e-40 |

Description
pir:[LN:D69864] [AC:D69864 ] [PN:hypothetical protein yktB] [GN:yktB ] [OR:Bacillus subtilis] [DB:pir2] >gp:[GI:e1185055:g2633836] [LN:BSUB0008] [AC:Z99111:AL009126] [GN:yktB] [FN:unknown] [OR:Bacillus subtilis] [DB:genpept-bct1] [DE:Bacillus subtilis complete genome (section 8 of 21): from 1394791to 1603020.] [LE:140850] [RE:141488] [DI:complement] >gp:[GI:g3282149] [LN:AF012285] [AC:AF012285:AF012284:U51911] [PN:unknown] [GN:yktB] [FN:unknown] [OR:Bacillus subtilis] [DB:genpept-bct2] [DE:Bacillus subtilis mobA-nprE gene region.] [LE:41338] [RE:41976] [DI:complement]

| ORF_Name | NTID | AAID | NT Length | AA Length | score | probability |
|---|---|---|---|---|---|---|
| AI7503000990_23448838_f1_217 | 1759 | 5531 | 873 | 290 | 786 | 3.8e-78 |

Description sp:[LN:FOLD_BACSU] [AC:P54382] [GN:FOLD] [OR:BACILLUS SUBTILIS] [EC:1.5.1.5:3.5.4.9]
[DE:METHENYLTETRAHYDROFOLATE CYCLOHYDROLASE,] [SP:P54382] [DB:swissprot]
>pir:[LN:E69626] [AC:E69626 ] [PN:methylenetetrahydrofolate dehydrogenase (NADP+), /
methenyltetrahydrofolate cyclohydrolase,] [GN:folD ] [CL:methylenetetrahydrofolate
dehydrogenase (NAD+): methylenetetrahydrofolate dehydrogenase (NAD+) homology]
[OR:Bacillus subtilis] [EC:1.5.1.5:3.5.4.9] [DB:pir2] >gp:[GI:d1013251:g1303916]
[LN:BACJH642] [AC:D84432:D82370] [PN:YqiA] [OR:Bacillus subtilis] [SR:Bacillus subtilis
(strain:JH642(trpC2 PheA1)) DNA] [DB:genpept-bct1] [DE:Bacillus subtilis DNA, 283 Kb
region containing skin element.] [LE:190351] [RE:191202] [DI:direct]
>gp:[GI:e1185699:g2634865] [LN:BSUB0013] [AC:Z99116:AL009126]
[PN:methenyltetrahydrofolate cyclohydrolase] [GN:folD] [FN:purines and amino acids
biosynthesis] [OR:Bacillus subtilis] [DB:genpept-bct1] [EC:1.5.1.5:3.5.4.9]
[DE:Bacillus subtilis complete genome (section 13 of 21): from 2395261to 2613730.]
[NT:alternate gene name: yqiA;] [SP:P54382] [LE:132419] [RE:133270] [DI:complement]

| ORF_Name | NTID | AAID | NT Length | AA Length | score | probability |
|---|---|---|---|---|---|---|
| AI7503000990_23453767_f1_62 | 1760 | 5532 | 138 | 45 | | |

Description
NO-HIT

| ORF_Name | NTID | AAID | NT Length | AA Length | score | probability |
|---|---|---|---|---|---|---|
| AI7503000990_23492327_f1_37 | 1761 | 5533 | 204 | 67 | 126 | 3.3e-08 |

Description pir:[LN:S75993] [AC:S75993 ] [PN:hypothetical protein] [OR:Synechocystis sp.] [SR:PCC
6803, , PCC 6803] [SR:PCC 6803, ] [DB:pir2] >gp:[GI:d1011491:g1001353] [LN:SYCSLLLH]
[AC:D64006:AB001339] [PN:hypothetical protein] [GN:clpP] [OR:Synechocystis sp.]
[SR:Synechocystis sp. (strain:PCC6803) DNA] [DB:genpept-bct1] [DE:Synechocystis sp.
PCC6803 complete genome, 25/27, 3138604-3270709.] [NT:ORF_ID:sll0498] [LE:80076]
[RE:80528] [DI:complement]

| ORF_Name | NTID | AAID | NT Length | AA Length | score | probability |
|---|---|---|---|---|---|---|
| AI7503000990_23532327_c2_829 | 1762 | 5534 | 1113 | 370 | 1432 | 1.3e-146 |

Description sp:[LN:ODPA_BACST] [AC:P21873] [GN:PDHA] [OR:BACILLUS STEAROTHERMOPHILUS] [EC:1.2.4.1]
[DE:PYRUVATE DEHYDROGENASE E1 COMPONENT, ALPHA SUBUNIT,] [SP:P21873] [DB:swissprot]

| ORF_Name | NTID | AAID | NT Length | AA Length | score | probability |
|---|---|---|---|---|---|---|
| AI7503000990_23550313_f2_329 | 1763 | 5535 | 141 | 46 | | |

Description
NO-HIT

| ORF_Name | NTID | AAID | NT Length | AA Length | score | probability |
|---|---|---|---|---|---|---|
| AI7503000990_23572178_c2_861 | 1764 | 5536 | 846 | 281 | 1070 | 3.1e-108 |

Description sp:[LN:DHSB_BACSU] [AC:P08066] [GN:SDHB] [OR:BACILLUS SUBTILIS] [EC:1.3.99.1]
[DE:SUCCINATE DEHYDROGENASE IRON-SULFUR PROTEIN,] [SP:P08066] [DB:swissprot]

| ORF_Name | NTID | AAID | NT Length | AA Length | score | probability |
|---|---|---|---|---|---|---|
| AI7503000990_23572253_c1_796 | 1765 | 5537 | 741 | 246 | 623 | 7.1e-61 |

Description
pir:[LN:B69693] [AC:B69693:JC4821 ] [PN:ribonuclease III,:RNase D:RNase O] [GN:rncS:srb ] [CL:ribonuclease III:double-stranded RNA-binding repeat homology] [OR:Bacillus subtilis] [EC:3.1.26.3] [DB:pir2] >gp:[GI:e1185184:g2633965] [LN:BSUB0009] [AC:Z99112:AL009126] [PN:ribonuclease III] [GN:rncS] [OR:Bacillus subtilis] [DB:genpept-bct1] [EC:3.1.26.3] [DE:Bacillus subtilis complete genome (section 9 of 21): from 1598421to 1807200.] [NT:alternate gene name: rnc] [LE:66689] [RE:67438] [DI:direct]

| ORF_Name | NTID | AAID | NT Length | AA Length | score | probability |
|---|---|---|---|---|---|---|
| AI7503000990_23632962_c2_880 | 1766 | 5538 | 810 | 269 | 270 | 1.8e-23 |

Description
sp:[LN:YFIE_BACSU] [AC:P54721] [GN:YFIE] [OR:BACILLUS SUBTILIS] [DE:HYPOTHETICAL 31.5 KD PROTEIN IN GLVBC 3'REGION] [SP:P54721] [DB:swissprot] >pir:[LN:H69802] [AC:H69802 ] [PN:conserved hypothetical protein yfiE] [GN:yfiE ] [OR:Bacillus subtilis] [DB:pir2] >gp:[GI:e1182814:g2633148] [LN:BSUB0005] [AC:Z99108:AL009126] [GN:yfiE] [FN:unknown] [OR:Bacillus subtilis] [DB:genpept-bct1] [DE:Bacillus subtilis complete genome (section 5 of 21): from 802821 to1011250.] [NT:similar to hypothetical proteins from B. subtilis] [SP:P54721] [LE:94696] [RE:95553] [DI:direct] >gp:[GI:d1009744:g1486247] [LN:D50543] [AC:D50543] [PN:unknown] [GN:yfiE] [FN:unknown] [OR:Bacillus subtilis] [SR:Bacillus subtilis (strain:168, haplotype:haploid) DNA] [DB:genpept-bct1] [DE:Bacillus subtilis DNA for 76-degree region, complete cds.] [LE:8372] [RE:9229] [DI:direct]

| ORF_Name | NTID | AAID | NT Length | AA Length | score | probability |
|---|---|---|---|---|---|---|
| AI7503000990_23642217_c1_790 | 1767 | 5539 | 648 | 215 | 396 | 8.1e-37 |

Description
pir:[LN:C69879] [AC:C69879 ] [PN:hypothetical protein yloS] [GN:yloS ] [OR:Bacillus subtilis] [DB:pir2] >gp:[GI:e1185171:g2633952] [LN:BSUB0009] [AC:Z99112:AL009126] [GN:yloS] [FN:unknown] [OR:Bacillus subtilis] [DB:genpept-bct1] [DE:Bacillus subtilis complete genome (section 9 of 21): from 1598421to 1807200.] [LE:55709] [RE:56353] [DI:direct] >gp:[GI:e323508:g2337809] [LN:BSY13937] [AC:Y13937] [PN:YloS protein] [GN:yloS] [FN:unknown] [OR:Bacillus subtilis] [DB:genpept-bct1] [DE:Bacillus subtilis genomic DNA from the spoVM region.] [LE:17481] [RE:18125] [DI:direct]

| ORF_Name | NTID | AAID | NT Length | AA Length | score | probability |
|---|---|---|---|---|---|---|
| AI7503000990_23647178_c2_903 | 1768 | 5540 | 633 | 210 | 398 | 5.0e-37 |

Description
pir:[LN:A69880] [AC:A69880 ] [PN:hypothetical protein ylpC] [GN:ylpC ] [OR:Bacillus subtilis] [DB:pir2] >gp:[GI:e1185179:g2633960] [LN:BSUB0009] [AC:Z99112:AL009126] [GN:ylpC] [FN:unknown] [OR:Bacillus subtilis] [DB:genpept-bct1] [DE:Bacillus subtilis complete genome (section 9 of 21): from 1598421to 1807200.] [LE:62946] [RE:63512] [DI:direct] >gp:[GI:e323513:g2337817] [LN:BSY13937] [AC:Y13937] [PN:YlpC protein] [GN:ylpC] [FN:unknown] [OR:Bacillus subtilis] [DB:genpept-bct1] [DE:Bacillus subtilis genomic DNA from the spoVM region.] [LE:24718] [RE:25284] [DI:direct]

| ORF Name | NTID | AAID | NT Length | AA Length | score | probability |
|---|---|---|---|---|---|---|
| AI7503000990_23650293_c1_785 | 1769 | 5541 | 627 | 208 | 693 | 2.7e-68 |

Description pir:[LN:B69878] [AC:B69878 ] [PN:guanylate kinase homolog yloD] [GN:yloD ]
[CL:guanylate kinase:guanylate kinase homology] [OR:Bacillus subtilis] [DB:pir2]
>gp:[GI:e1185159:g2633940] [LN:BSUB0009] [AC:Z99112:AL009126] [GN:yloD] [FN:unknown]
[OR:Bacillus subtilis] [DB:genpept-bct1] [DE:Bacillus subtilis complete genome (section
9 of 21); from 1598421to 1807200.] [NT:similar to guanylate kinase] [LE:42808]
[RE:43542] [DI:direct] >gp:[GI:e323500:g2337797] [LN:BSY13937] [AC:Y13937] [PN:putative
Gmk protein] [GN:yloD] [FN:unknown] [OR:Bacillus subtilis] [DB:genpept-bct1]
[DE:Bacillus subtilis genomic DNA from the spoVM region.] [LE:4580] [RE:5314]
[DI:direct]

| ORF Name | NTID | AAID | NT Length | AA Length | score | probability |
|---|---|---|---|---|---|---|
| AI7503000990_23695900_c2_812 | 1770 | 5542 | 1551 | 516 | 1490 | 9.5e-153 |

Description gp:[GI:g4097534] [LN:LLU64311] [AC:U64311] [PN:phosphoribosylpyrophosphate
amidotransferase] [GN:purF] [OR:Lactococcus lactis] [DB:genpept-bct2] [EC:2.4.2.14]
[DE:Lactococcus lactis phosphoribosylaminoimidazolesuccinocarboxamidesynthetase (purC),
phosphoribosylformylglycinamidine synthetase I(purQ), phosphoribosylformylglycinamidine
synthetase II (purL), andphosphoribosylpyrophosphate amidotransferase (purF) genes,
completecds; and unknown gene.] [NT:PRPP ATase] [LE:4921] [RE:6441] [DI:direct]

| ORF Name | NTID | AAID | NT Length | AA Length | score | probability |
|---|---|---|---|---|---|---|
| AI7503000990_23730340_c1_716 | 1771 | 5543 | 1422 | 473 | 2270 | 2.1e-235 |

Description pir:[LN:S19723] [AC:S19723 ] [PN:dihydrolipoamide dehydrogenase, :pyruvate dehydrogenase
complex chain E3] [GN:pdhD ] [CL:dihydrolipoamide dehydrogenase:dihydrolipoamide
dehydrogenase homology] [OR:Staphylococcus aureus] [EC:1.8.1.4] [DB:pir1]
>gp:[GI:g48874] [LN:SAPDHDNA] [AC:X58434:S73625] [PN:dihydrolipoamide dehydrogenase:
subunit E3] [GN:pdhD] [OR:Staphylococcus aureus] [DB:genpept-bct1] [EC:1.8.1.4]
[DE:S.aureus pdhB, pdhC and pdhD genes for pyruvate decarboxylase,dihydrolipoamide
acetyltransferase and dihydrolipoamidedehydrogenase.] [LE:1853] [RE:3259] [DI:direct]

| ORF Name | NTID | AAID | NT Length | AA Length | score | probability |
|---|---|---|---|---|---|---|
| AI7503000990_23836036_c2_887 | 1772 | 5544 | 192 | 63 | 153 | 1.2e-09 |

Description sp:[LN:CARB_BACCL] [AC:P46537] [GN:PYRAB] [OR:BACILLUS CALDOLYTICUS] [EC:6.3.5.5]
[DE:(EC 6.3.5.5) (CARBAMOYL-PHOSPHATE SYNTHETASE AMMONIA CHAIN)] [SP:P46537]
[DB:swissprot] >pir:[LN:I40169] [AC:I40169:S34321 ] [PN:carbamoyl-phosphate synthase
(glutamine-hydrolyzing),] [GN:pyrAb ] [CL:carbamoyl-phosphate synthase
(glutamine-hydrolyzing) large chain:biotin carboxylase homology:carbamoyl-phosphate
synthase (glutamine-hydrolyzing) large chain homology] [OR:Bacillus caldolyticus] [EC:
6.3.5.5] [DB:pir2] >gp:[GI:g312443] [LN:BCPYR] [AC:X73308] [PN:carbamoyl-phosphate
synthase] [GN:PyrAb] [OR:Bacillus caldolyticus] [DB:genpept-bct1] [EC:6.3.5.5]
[DE:B.caldolyticus pyrimidine biosynthesis genes.] [SP:P46537] [LE:3658] [RE:6855]
[DI:direct]

| ORF Name | NTID | AAID | NT Length | AA Length | score | probability |
|---|---|---|---|---|---|---|
| AI7503000990_23928937_c3_953 | 1773 | 5545 | 141 | 46 | | |

Description

NO-HIT

| ORF Name | NTID | AAID | NT Length | AA Length | score | probability |
|---|---|---|---|---|---|---|
| AI7503000990_24025253_f1_219 | 1774 | 5546 | 321 | 106 | 198 | 1.3e-14 |

Description
pir:[LN:T00323] [AC:T00323 ] [PN:chitinase, B] [OR:Clostridium paraputrificum]
[EC:3.2.1.14] [DB:pir3] >gp:[GI:d1024701:g2696017] [LN:AB001874] [AC:AB001874]
[PN:chitinase B] [GN:chiB] [OR:Clostridium paraputrificum] [SR:Clostridium
paraputrificum (strain:M21) DNA] [DB:genpept-bct1] [EC:3.2.1.14] [DE:Clostridium
paraputrificum gene for chitinase B, complete cds.] [LE:1] [RE:2496] [DI:direct]

| ORF Name | NTID | AAID | NT Length | AA Length | score | probability |
|---|---|---|---|---|---|---|
| AI7503000990_24025467_c2_863 | 1775 | 5547 | 522 | 173 | 238 | 4.5e-20 |

Description
sp:[LN:YSNB_BACSU] [AC:P94559] [GN:YSNB] [OR:BACILLUS SUBTILIS] [DE:HYPOTHETICAL 19.2
KD PROTEIN IN RPH-ILVB INTERGENIC REGION] [SP:P94559] [DB:swissprot] >pir:[LN:D69986]
[AC:D69986 ] [PN:conserved hypothetical protein ysnB] [GN:ysnB ] [CL:conserved
hypothetical protein MG207: phosphoesterase core homology] [OR:Bacillus subtilis]
[DB:pir2] >gp:[GI:e1184084:g2635300] [LN:BSUB0015] [AC:Z99118:AL009126] [GN:ysnB]
[FN:unknown] [OR:Bacillus subtilis] [DB:genpept-bct1] [DE:Bacillus subtilis complete
genome (section 15 of 21): from 2795131to 3013540.] [NT:similar to hypothetical
proteins] [SP:P94559] [LE:103990] [RE:104505] [DI:complement]
>gp:[GI:e1165358:g1770061] [LN:BSZ75208] [AC:Z75208] [PN:hypothetical protein]
[GN:ysnB] [OR:Bacillus subtilis] [DB:genpept-bct1] [DE:B.subtilis genomic sequence
89009bp.] [NT:homology to HI0260 of Haemophilus influenzae;] [SP:P94559] [LE:65402]
[RE:65917] [DI:direct]

| ORF Name | NTID | AAID | NT Length | AA Length | score | probability |
|---|---|---|---|---|---|---|
| AI7503000990_24220002_f1_67 | 1776 | 5548 | 129 | 42 | | |

Description
NO-HIT

| ORF Name | NTID | AAID | NT Length | AA Length | score | probability |
|---|---|---|---|---|---|---|
| AI7503000990_24240676_f3_477 | 1777 | 5549 | 246 | 81 | | |

Description
NO-HIT

| ORF Name | NTID | AAID | NT Length | AA Length | score | probability |
|---|---|---|---|---|---|---|
| AI7503000990_24245437_c1_763 | 1778 | 5550 | 1005 | 334 | 1471 | 9.8e-151 |

Description
gp:[GI:d1023423:g2463562] [LN:AB007500] [AC:AB007500:D28879] [PN:MRAY] [GN:mraY]
[OR:Staphylococcus aureus] [SR:Staphylococcus aureus (strain:NCTC8325) DNA]
[DB:genpept-bct1] [DE:Staphylococcus aureus genes for penicillin-binding protein 1,
MraY,MurD, partial and complete cds.] [LE:3120] [RE:4085] [DI:direct] >gp:[GI:g4104230]
[LN:AF034153] [AC:AF034153] [PN:phospho-N-acetylmuramoyl-pentapeptide] [GN:mraY]
[OR:Staphylococcus aureus] [DB:genpept-bct2] [DE:Staphylococcus aureus
phospho-N-acetylmuramoyl-pentapeptidetranslocase (mraY) gene, complete cds.] [LE:28]
[RE:993] [DI:direct]

| ORF Name | NTID | AAID | NT Length | AA Length | score | probability |
|---|---|---|---|---|---|---|
| AI7503000990_24256250_f3_467 | 1779 | 5551 | 126 | 41 | | |

Description
NO-HIT

| ORF_Name | NTID | AAID | NT Length | AA Length | score | probability |
|---|---|---|---|---|---|---|
| AI7503000990_24256551_c3_923 | 1780 | 5552 | 1071 | 356 | 938 | 3.0e-94 |

Description
sp:[LN:PUR5_BACSU] [AC:P12043] [GN:PURM:ATH] [OR:BACILLUS SUBTILIS] [EC:6.3.3.1]
[DE:(PHOSPHORIBOSYL-AMINOIMIDAZOLE SYNTHETASE) (AIR SYNTHASE)] [SP:P12043]
[DB:swissprot] >pir:[LN:AJBSCL] [AC:H29326:A69685 ]
[PN:phosphoribosylformylglycinamidine cyclo-ligase,:phosphoribosylaminoimidazole
synthetase] [GN:purM ] [CL:phosphoribosylformylglycinamidine cyclo-ligase:
phosphoribosylformylglycinamidine cyclo-ligase homology] [OR:Bacillus subtilis]
[EC:6.3.3.1] [DB:pir1] [MP:18 min ] >gp:[GI:g143371] [LN:BACPURF] [AC:J02732:K00047]
[OR:Bacillus subtilis] [SR:B.subtilis (strain DE1 (prototroph DER. or W168)) DNA, clone
pPZ] [DB:genpept-bct1] [DE:B.subtilis pur operon encoding purine biosynthesis enzymes,
12genes.] [NT:phosphoribosyl aminoimidazole synthetase (PUR-M)] [LE:8796] [RE:9836]
[DI:direct] >gp:[GI:e1182630:g2632964] [LN:BSUB0004] [AC:Z99107:AL009126]
[PN:phosphoribosylaminoimidazole synthetase] [GN:purM] [FN:purine biosynthesis]
[OR:Bacillus subtilis] [DB:genpept-bct1] [EC:6.3.3.1] [DE:Bacillus subtilis complete
genome (section 4 of 21): from 600701 to813890.] [SP:P12043] [LE:105778] [RE:106818]
[DI:direct]

| ORF_Name | NTID | AAID | NT Length | AA Length | score | probability |
|---|---|---|---|---|---|---|
| AI7503000990_24257877_c2_854 | 1781 | 5553 | 129 | 42 | | |

Description
NO-HIT

| ORF_Name | NTID | AAID | NT Length | AA Length | score | probability |
|---|---|---|---|---|---|---|
| AI7503000990_24261068_c1_758 | 1782 | 5554 | 147 | 48 | 215 | 1.2e-17 |

Description
gp:[GI:g3212079] [LN:AF068633] [AC:AF068633] [PN:phenol soluble modulin beta 1]
[FN:inflammatory protein] [OR:Staphylococcus epidermidis] [DB:genpept-bct2]
[DE:Staphylococcus epidermidis phenol soluble modulin beta 1 and phenolsoluble modulin
beta 2 genes, complete cds.] [NT:PSM beta 1] [LE:669] [RE:803] [DI:direct]
>gp:[GI:g3212080] [LN:AF068633] [AC:AF068633] [PN:phenol soluble modulin beta 2]
[FN:inflammatory protein] [OR:Staphylococcus epidermidis] [DB:genpept-bct2]
[DE:Staphylococcus epidermidis phenol soluble modulin beta 1 and phenolsoluble modulin
beta 2 genes, complete cds.] [NT:PSM beta 2] [LE:859] [RE:993] [DI:direct]

| ORF_Name | NTID | AAID | NT Length | AA Length | score | probability |
|---|---|---|---|---|---|---|
| AI7503000990_24261068_c3_988 | 1783 | 5555 | 147 | 48 | 215 | 1.2e-17 |

Description
gp:[GI:g3212079] [LN:AF068633] [AC:AF068633] [PN:phenol soluble modulin beta 1]
[FN:inflammatory protein] [OR:Staphylococcus epidermidis] [DB:genpept-bct2]
[DE:Staphylococcus epidermidis phenol soluble modulin beta 1 and phenolsoluble modulin
beta 2 genes, complete cds.] [NT:PSM beta 1] [LE:669] [RE:803] [DI:direct]
>gp:[GI:g3212080] [LN:AF068633] [AC:AF068633] [PN:phenol soluble modulin beta 2]
[FN:inflammatory protein] [OR:Staphylococcus epidermidis] [DB:genpept-bct2]
[DE:Staphylococcus epidermidis phenol soluble modulin beta 1 and phenolsoluble modulin
beta 2 genes, complete cds.] [NT:PSM beta 2] [LE:859] [RE:993] [DI:direct]

| ORF_Name | NTID | AAID | NT Length | AA Length | score | probability |
|---|---|---|---|---|---|---|
| AI7503000990_24275137_f1_21 | 1784 | 5556 | 132 | 43 | | |

Description
NO-HIT

| ORF Name | NTID | AAID | NT Length | AA Length | score | probability |
|---|---|---|---|---|---|---|
| AI7503000990_24297217_c1_780 | 1785 | 5557 | 3114 | 1037 | 3756 | 0.0 |

Description
sp:[LN:CARB_BACCL] [AC:P46537] [GN:PYRAB] [OR:BACILLUS CALDOLYTICUS] [EC:6.3.5.5]
[DE:(EC 6.3.5.5) (CARBAMOYL-PHOSPHATE SYNTHETASE AMMONIA CHAIN)] [SP:P46537]
[DB:swissprot] >pir:[LN:I40169] [AC:I40169:S34321 ] [PN:carbamoyl-phosphate synthase
(glutamine-hydrolyzing),] [GN:pyrAb ] [CL:carbamoyl-phosphate synthase
(glutamine-hydrolyzing) large chain:biotin carboxylase homology:carbamoyl-phosphate
synthase (glutamine-hydrolyzing) large chain homology] [OR:Bacillus caldolyticus] [EC:
6.3.5.5] [DB:pir2] >gp:[GI:g312443] [LN:BCPYR] [AC:X73308] [PN:carbamoyl-phosphate
synthase] [GN:PyrAb] [OR:Bacillus caldolyticus] [DB:genpept-bct1] [EC:6.3.5.5]
[DE:B.caldolyticus pyrimidine biosynthesis genes.] [SP:P46537] [LE:3658] [RE:6855]
[DI:direct]

| ORF Name | NTID | AAID | NT Length | AA Length | score | probability |
|---|---|---|---|---|---|---|
| AI7503000990_24330337_f3_557 | 1786 | 5558 | 957 | 318 | 555 | 1.1e-53 |

Description
pir:[LN:H69984] [AC:H69984 ] [PN:conserved hypothetical protein ysgB] [GN:ysgB ]
[OR:Bacillus subtilis] [DB:pir2] >gp:[GI:e1184111:g2635327] [LN:BSUB0015]
[AC:Z99118:AL009126] [GN:ysgB] [FN:unknown] [OR:Bacillus subtilis] [DB:genpept-bct1]
[DE:Bacillus subtilis complete genome (section 15 of 21): from 2795131to 3013540.]
[NT:similar to hypothetical proteins] [LE:130003] [RE:130944] [DI:direct]
>gp:[GI:e1165326:g1770032] [LN:BSZ75208] [AC:Z75208] [PN:hypothetical protein]
[GN:ysgB] [OR:Bacillus subtilis] [DB:genpept-bct1] [DE:B.subtilis genomic sequence
89009bp.] [NT:unknown function; putative] [LE:38963] [RE:39904] [DI:complement]

| ORF Name | NTID | AAID | NT Length | AA Length | score | probability |
|---|---|---|---|---|---|---|
| AI7503000990_24351577_c1_677 | 1787 | 5559 | 171 | 56 | | |

Description
NO-HIT

| ORF Name | NTID | AAID | NT Length | AA Length | score | probability |
|---|---|---|---|---|---|---|
| AI7503000990_24355342_c1_799 | 1788 | 5560 | 1014 | 338 | 1265 | 6.6e-129 |

Description
sp:[LN:SR54_BACSU] [AC:P37105] [GN:FFH] [OR:BACILLUS SUBTILIS] [DE:SIGNAL RECOGNITION
PARTICLE PROTEIN (FIFTY-FOUR HOMOLOG)] [SP:P37105] [DB:swissprot] >pir:[LN:B47154]
[AC:B47154:H69621 ] [PN:signal recognition particle chain ffh] [GN:ffh ] [CL:signal
recognition particle 54K protein] [OR:Bacillus subtilis] [DB:pir2]
>gp:[GI:e1185189:g2633970] [LN:BSUB0009] [AC:Z99112:AL009126] [PN:signal recognition
particle] [GN:ffh] [OR:Bacillus subtilis] [DB:genpept-bct1] [DE:Bacillus subtilis
complete genome (section 9 of 21): from 1598421to 1807200.] [LE:73153] [RE:74493]
[DI:direct] >gp:[GI:d1022545:g2309080] [LN:D14356] [AC:D14356] [PN:Ffh] [GN:ffh]
[OR:Bacillus subtilis] [SR:Bacillus subtilis (strain:168) DNA] [DB:genpept-bct1]
[DE:Bacillus subtilis orf1, ffh, rpsP genes for ORF1, Ffh and 30Sribosomal protein S16,
complete cds.] [LE:711] [RE:2051] [DI:direct]

| ORF Name | NTID | AAID | NT Length | AA Length | score | probability |
|---|---|---|---|---|---|---|
| AI7503000990_24406291_c2_902 | 1789 | 5561 | 417 | 138 | 369 | 5.9e-34 |

Description
pir:[LN:D69879] [AC:D69879 ] [PN:alkaline-shock protein homolog yloU] [GN:yloU ]
[OR:Bacillus subtilis] [DB:pir2] >gp:[GI:e1185174:g2633955] [LN:BSUB0009]
[AC:Z99112:AL009126] [GN:yloU] [FN:unknown] [OR:Bacillus subtilis] [DB:genpept-bct1]
[DE:Bacillus subtilis complete genome (section 9 of 21): from 1598421to 1807200.]
[NT:similar to alkaline-shock protein] [LE:57043] [RE:57405] [DI:direct]
>gp:[GI:e323527:g2337812] [LN:BSY13937] [AC:Y13937] [PN:putative Asp23 protein]
[GN:yloU] [FN:unknown] [OR:Bacillus subtilis] [DB:genpept-bct1] [DE:Bacillus subtilis
genomic DNA from the spoVM region.] [LE:18815] [RE:19177] [DI:direct]

| ORF Name | NTID | AAID | NT Length | AA Length | score | probability |
|---|---|---|---|---|---|---|
| AI7503000990_24406563_c1_742 | 1790 | 5562 | 141 | 46 | | |

Description
NO-HIT

| ORF Name | NTID | AAID | NT Length | AA Length | score | probability |
|---|---|---|---|---|---|---|
| AI7503000990_24407313_f3_590 | 1791 | 5563 | 126 | 41 | | |

Description
NO-HIT

| ORF Name | NTID | AAID | NT Length | AA Length | score | probability |
|---|---|---|---|---|---|---|
| AI7503000990_24407327_c3_1017 | 1792 | 5564 | 612 | 203 | 621 | 1.2e-60 |

Description
sp:[LN:PYRE_BACSU] [AC:P25972] [GN:PYRE:PYRX] [OR:BACILLUS SUBTILIS] [EC:2.4.2.10]
[DE:OROTATE PHOSPHORIBOSYLTRANSFERASE, (OPRT) (OPRTASE)] [SP:P25972] [DB:swissprot]
>pir:[LN:F69686] [AC:F69686:A30492 ] [PN:orotate phosphoribosyltransferase,] [GN:pyrE ]
[CL:orotate phosphoribosyltransferase:orotate phosphoribosyltransferase homology]
[OR:Bacillus subtilis] [EC:2.4.2.10] [DB:pir1] >gp:[GI:e1185148:g2633929] [LN:BSUB0009]
[AC:Z99112:AL009126] [PN:orotate phosphoribosyltransferase] [GN:pyrE] [FN:pyrimidine
biosynthesis] [OR:Bacillus subtilis] [DB:genpept-bct1] [EC:2.4.2.10] [DE:Bacillus
subtilis complete genome (section 9 of 21): from 1598421to 1807200.] [NT:alternate gene
name: pyrX] [SP:P25972] [LE:30299] [RE:30949] [DI:direct] >gp:[GI:g143394]
[LN:BACPYROP] [AC:M59757] [PN:OMP-PRPP transferase] [GN:pyrE] [OR:Bacillus subtilis]
[DB:genpept-bct2] [DE:Bacillus subtilis ORF1A (pyrR), putative membrane-bound
uracilpermease (pyrP), aspartate transcarbamylase (pyrB), dihydroorotase(pyrC),
glutaminase of carbamyl phosphate synthetase (pyrAA),carbamyl phosphate synthetase
(pyrAB), dihydroorotase dehydrogenase(pyrD), OMP decarboxylase (pyrF), and OMP-PRPP
transferase (pyrE)genes, complete cds; and unknown gene.] [LE:11703] [RE:12353]
[DI:direct]

| ORF Name | NTID | AAID | NT Length | AA Length | score | probability |
|---|---|---|---|---|---|---|
| AI7503000990_24407760_c1_773 | 1793 | 5565 | 123 | 40 | | |

Description
NO-HIT

| ORF Name | NTID | AAID | NT Length | AA Length | score | probability |
|---|---|---|---|---|---|---|
| AI7503000990_24407936_c2_896 | 1794 | 5566 | 1122 | 373 | 1380 | 4.3e-141 |

Description
sp:[LN:YLON_BACSU] [AC:O34617] [GN:YLON] [OR:BACILLUS SUBTILIS] [DE:HYPOTHETICAL 41.6 KD PROTEIN IN FMT-SPOVM INTERGENIC REGION] [SP:O34617] [DB:swissprot] >pir:[LN:F69878] [AC:F69878 ] [PN:conserved hypothetical protein yloN] [GN:yloN ] [CL:conserved hypothetical protein HI0365] [OR:Bacillus subtilis] [DB:pir2] >gp:[GI:e1185166:g2633947] [LN:BSUB0009] [AC:Z99112:AL009126] [GN:yloN] [FN:unknown] [OR:Bacillus subtilis] [DB:genpept-bct1] [DE:Bacillus subtilis complete genome (section 9 of 21): from 1598421to 1807200.] [NT:similar to hypothetical proteins] [SP:O34617] [LE:50265] [RE:51356] [DI:direct] >gp:[GI:e323524:g2337804] [LN:BSY13937] [AC:Y13937] [PN:YloN protein] [GN:yloN] [FN:unknown] [OR:Bacillus subtilis] [DB:genpept-bct1] [DE:Bacillus subtilis genomic DNA from the spoVM region.] [SP:O34617] [LE:12037] [RE:13128] [DI:direct]

| ORF Name | NTID | AAID | NT Length | AA Length | score | probability |
|---|---|---|---|---|---|---|
| AI7503000990_24412812_c3_986 | 1795 | 5567 | 225 | 74 | | |

Description
NO-HIT

| ORF Name | NTID | AAID | NT Length | AA Length | score | probability |
|---|---|---|---|---|---|---|
| AI7503000990_24415885_c3_960 | 1796 | 5568 | 1227 | 408 | 869 | 6.1e-87 |

Description
gp:[GI:g4096797] [LN:SCU40157] [AC:U40157] [OR:Staphylococcus carnosus] [DB:genpept-bct2] [DE:Staphylococcus carnosus condensing-enzyme-like protein (orf1) andSpoVE-like protein (orf2) genes, complete cds.] [NT:orf2; unknown function; similar to SpoVE, RodA,] [LE:1676] [RE:2779] [DI:direct]

| ORF Name | NTID | AAID | NT Length | AA Length | score | probability |
|---|---|---|---|---|---|---|
| AI7503000990_24422077_c3_1013 | 1797 | 5569 | 1101 | 366 | 1196 | 1.4e-121 |

Description
sp:[LN:CARA_BACCL] [AC:P52557] [GN:PYRAA] [OR:BACILLUS CALDOLYTICUS] [EC:6.3.5.5] [DE:(EC 6.3.5.5) (CARBAMOYL-PHOSPHATE SYNTHETASE GLUTAMINE CHAIN)] [SP:P52557] [DB:swissprot] >pir:[LN:I40168] [AC:I40168:S34320 ] [PN:carbamoyl-phosphate synthase (glutamine-hydrolyzing),] [GN:pyrAa ] [CL:carbamoyl-phosphate synthase (glutamine-hydrolyzing) small chain:carbamoyl-phosphate synthase (glutamine-hydrolyzing) small chain homology:trpG homology] [OR:Bacillus caldolyticus] [EC: 6.3.5.5] [DB:pir2] >gp:[GI:g312442] [LN:BCPYR] [AC:X73308] [PN:carbamoyl-phosphate synthase] [GN:PyrAa] [OR:Bacillus caldolyticus] [DB:genpept-bct1] [EC:6.3.5.5] [DE:B.caldolyticus pyrimidine biosynthesis genes.] [SP:P52557] [LE:2571] [RE:3665] [DI:direct]

| ORF Name | NTID | AAID | NT Length | AA Length | score | probability |
|---|---|---|---|---|---|---|
| AI7503000990_24424038_c1_791 | 1798 | 5570 | 1692 | 563 | 1538 | 7.8e-158 |

Description
pir:[LN:E69879] [AC:E69879 ] [PN:conserved hypothetical protein yloV] [GN:yloV ] [CL:Mycoplasma genitalium hypothetical protein MG369] [OR:Bacillus subtilis] [DB:pir2] >gp:[GI:e1185175:g2633956] [LN:BSUB0009] [AC:Z99112:AL009126] [GN:yloV] [FN:unknown] [OR:Bacillus subtilis] [DB:genpept-bct1] [DE:Bacillus subtilis complete genome (section 9 of 21): from 1598421to 1807200.] [NT:similar to hypothetical proteins] [LE:57421] [RE:59082] [DI:direct] >gp:[GI:e323510:g2337813] [LN:BSY13937] [AC:Y13937] [PN:YloV protein] [GN:yloV] [FN:unknown] [OR:Bacillus subtilis] [DB:genpept-bct1] [DE:Bacillus subtilis genomic DNA from the spoVM region.] [LE:19193] [RE:20854] [DI:direct]

| ORF Name | NTID | AAID | NT Length | AA Length | score | probability |
|---|---|---|---|---|---|---|
| AI7503000990_24475252_f2_371 | 1799 | 5571 | 159 | 52 | | |

Description
NO-HIT

| ORF Name | NTID | AAID | NT Length | AA Length | score | probability |
|---|---|---|---|---|---|---|
| AI7503000990_24484828_c2_832 | 1800 | 5572 | 552 | 183 | 311 | 8.2e-28 |

Description
gp:[GI:g4981179] [LN:AE001739] [AC:AE001739:AE000512] [PN:conserved hypothetical protein] [GN:TM0656] [OR:Thermotoga maritima] [DB:genpept-bct2] [DE:Thermotoga maritima section 51 of 136 of the complete genome.] [NT:similar to SP:P38522 GB:U00096 PID:1742120] [LE:1379] [RE:1909] [DI:complement]

| ORF Name | NTID | AAID | NT Length | AA Length | score | probability |
|---|---|---|---|---|---|---|
| AI7503000990_24485950_c3_951 | 1801 | 5573 | 537 | 178 | 91 | 0.015 |

Description
gp:[GI:g5306139] [LN:AF160864] [AC:AF160864] [PN:NADH dehydrogenase subunit 2] [GN:nad2] [OR:Mitochondrion Tetrahymena pyriformis] [SR:Tetrahymena pyriformis] [DB:genpept] [EC:1.6.5.3] [DE:Tetrahymena pyriformis mitochondrial DNA, complete genome.] [LE:10108] [RE:10644] [DI:complement]

| ORF Name | NTID | AAID | NT Length | AA Length | score | probability |
|---|---|---|---|---|---|---|
| AI7503000990_24609637_c3_1001 | 1802 | 5574 | 798 | 265 | 916 | 6.4e-92 |

Description
gp:[GI:g4009492] [LN:AF068904] [AC:AF068904] [PN:YlmD] [GN:ylmD] [OR:Staphylococcus aureus] [DB:genpept-bct2] [DE:Staphylococcus aureus cell division protein FtsZ (ftsZ) gene,partial cds; YlmD (ylmD), YlmE (ylmE), YlmF (ylmF), YlmG (ylmG),and YlmH (ylmH) genes, complete cds; and cell division proteinDivIVA (divIVA) gene, partial cds.] [NT:similar to Bacillus subtilis YlmD] [LE:437] [RE:1228] [DI:direct]

| ORF Name | NTID | AAID | NT Length | AA Length | score | probability |
|---|---|---|---|---|---|---|
| AI7503000990_24610885_f2_352 | 1803 | 5575 | 423 | 140 | | |

Description
NO-HIT

| ORF Name | NTID | AAID | NT Length | AA Length | score | probability |
|---|---|---|---|---|---|---|
| AI7503000990_24632827_c1_786 | 1804 | 5576 | 963 | 320 | 917 | 5.0e-92 |

Description
pir:[LN:A69626] [AC:A69626 ] [PN:methionyl-tRNA formyltransferase, fmt] [GN:fmt ] [CL:methionyl-tRNA formyltransferase: phosphoribosylglycinamide formyltransferase homology] [OR:Bacillus subtilis] [EC:2.1.2.9] [DB:pir2] >gp:[GI:e1185164:g2633945] [LN:BSUB0009] [AC:Z99112:AL009126] [PN:methionyl-tRNA formyltransferase] [GN:fmt] [OR:Bacillus subtilis] [DB:genpept-bct1] [EC:2.1.2.9] [DE:Bacillus subtilis complete genome (section 9 of 21): from 1598421to 1807200.] [NT:alternate gene name: yloL] [LE:47978] [RE:48931] [DI:direct] >gp:[GI:e323503:g2337802] [LN:BSY13937] [AC:Y13937] [PN:putative Fmt protein] [GN:yloL] [FN:unknown] [OR:Bacillus subtilis] [DB:genpept-bct1] [DE:Bacillus subtilis genomic DNA from the spoVM region.] [LE:9750] [RE:10703] [DI:direct]

| ORF Name | NTID | AAID | NT Length | AA Length | score | probability |
|---|---|---|---|---|---|---|
| AI7503000990_24642042_c2_853 | 1805 | 5577 | 561 | 186 | 255 | 7.1e-22 |

Description
pir:[LN:C69875] [AC:C69875 ] [PN:hypothetical protein ylbN] [GN:ylbN ] [OR:Bacillus subtilis] [DB:pir2] >gp:[GI:e334782:g2340010] [LN:BS16823KB] [AC:Z98682] [PN:YlbN protein] [GN:ylbN] [OR:Bacillus subtilis] [DB:genpept-bct1] [DE:Bacillus subtilis genomic DNA 23.9kB fragment.] [LE:20393] [RE:20911] [DI:direct]
>gp:[GI:e1185097:g2633878] [LN:BSUB0008] [AC:Z99111:AL009126] [GN:ylbN] [FN:unknown] [OR:Bacillus subtilis] [DB:genpept-bct1] [DE:Bacillus subtilis complete genome (section 8 of 21): from 1394791to 1603020.] [LE:179876] [RE:180394] [DI:direct]

| ORF Name | NTID | AAID | NT Length | AA Length | score | probability |
|---|---|---|---|---|---|---|
| AI7503000990_24642817_c2_862 | 1806 | 5578 | 810 | 269 | 1197 | 1.1e-121 |

Description
sp:[LN:MURI_STAHA] [AC:P52974] [GN:DGA] [OR:STAPHYLOCOCCUS HAEMOLYTICUS] [EC:5.1.1.3] [DE:GLUTAMATE RACEMASE,] [SP:P52974] [DB:swissprot] >gp:[GI:g520574] [LN:SHU12405] [AC:U12405] [PN:glutamate racemase] [GN:dga] [OR:Staphylococcus haemolyticus] [DB:genpept-bct1] [DE:Staphylococcus haemolyticus Y176 glutamate racemase (dga) gene,complete cds.] [LE:263] [RE:1063] [DI:direct]

| ORF Name | NTID | AAID | NT Length | AA Length | score | probability |
|---|---|---|---|---|---|---|
| AI7503000990_24643836_c3_943 | 1807 | 5579 | 633 | 210 | 227 | 6.6e-19 |

Description
pir:[LN:D69870] [AC:D69870:A36718 ] [PN:conserved hypothetical protein ykyA:hypothetical protein (aceA 5' region)] [GN:ykyA ] [OR:Bacillus subtilis] [DB:pir2] >gp:[GI:e1185047:g2633828] [LN:BSUB0008] [AC:Z99111:AL009126] [GN:ykyA] [FN:unknown] [OR:Bacillus subtilis] [DB:genpept-bct1] [DE:Bacillus subtilis complete genome (section 8 of 21): from 1394791to 1603020.] [NT:alternate gene name: ykrC; similar to hypothetical] [LE:131900] [RE:132517] [DI:direct] >gp:[GI:g3282141] [LN:AF012285] [AC:AF012285:AF012284:U51911] [PN:unknown] [GN:ykrC] [FN:unknown] [OR:Bacillus subtilis] [DB:genpept-bct2] [DE:Bacillus subtilis mobA-nprE gene region.] [NT:similar to Orf5 encoded by GenBank Accession] [LE:32388] [RE:33005] [DI:direct]

| ORF Name | NTID | AAID | NT Length | AA Length | score | probability |
|---|---|---|---|---|---|---|
| AI7503000990_24645025_c3_1012 | 1808 | 5580 | 1284 | 427 | 1287 | 3.1e-131 |

Description
sp:[LN:PYRC_BACCL] [AC:P46538] [GN:PYRC] [OR:BACILLUS CALDOLYTICUS] [EC:3.5.2.3] [DE:DIHYDROOROTASE, (DHOASE)] [SP:P46538] [DB:swissprot] >pir:[LN:I40167] [AC:I40167:S34319 ] [PN:dihydroorotase,] [GN:pyrC ] [CL:Bacillus dihydroorotase:Bacillus dihydroorotase homology] [OR:Bacillus caldolyticus] [EC:3.5.2.3] [DB:pir2] >gp:[GI:g312441] [LN:BCPYR] [AC:X73308] [PN:dihydroorotase] [GN:PyrC] [OR:Bacillus caldolyticus] [DB:genpept-bct1] [EC:3.5.2.3] [DE:B.caldolyticus pyrimidine biosynthesis genes.] [SP:P46538] [LE:1285] [RE:2568] [DI:direct]

| ORF Name | NTID | AAID | NT Length | AA Length | score | probability |
|---|---|---|---|---|---|---|
| AI7503000990_24648412_c1_798 | 1809 | 5581 | 402 | 133 | 302 | 7.4e-27 |

Description sp:[LN:YLXM_BACSU] [AC:P37104] [GN:YLXM] [OR:BACILLUS SUBTILIS] [DE:HYPOTHETICAL 13.2 KD PROTEIN IN FFH 5'REGION] [SP:P37104] [DB:swissprot] >pir:[LN:A47154] [AC:A47154:A69882 ] [PN:conserved hypothetical protein ylxM] [GN:ylxM ] [OR:Bacillus subtilis] [DB:pir2] >gp:[GI:e1185188:g2633969] [LN:BSUB0009] [AC:Z99112:AL009126] [GN:ylxM] [FN:unknown] [OR:Bacillus subtilis] [DB:genpept-bct1] [DE:Bacillus subtilis complete genome (section 9 of 21): from 1598421to 1807200.] [NT:similar to hypothetical proteins] [LE:72807] [RE:73139] [DI:direct] >gp:[GI:d1023083:g2424968] [LN:D14356] [AC:D14356] [PN:ORF1] [GN:orf1] [OR:Bacillus subtilis] [SR:Bacillus subtilis (strain:168) DNA] [DB:genpept-bct1] [DE:Bacillus subtilis orf1, ffh, rpsP genes for ORF1, Ffh and 30Sribosomal protein S16, complete cds.] [LE:365] [RE:697] [DI:direct]

| ORF Name | NTID | AAID | NT Length | AA Length | score | probability |
|---|---|---|---|---|---|---|
| AI7503000990_24652178_c2_847 | 1810 | 5582 | 477 | 158 | 174 | 2.7e-13 |

Description pir:[LN:F69930] [AC:F69930 ] [PN:conserved hypothetical protein yozB] [GN:yozB ] [OR:Bacillus subtilis] [DB:pir2] >gp:[GI:e1185386:g2634307] [LN:BSUB0011] [AC:Z99114:AL009126] [GN:yozB] [FN:unknown] [OR:Bacillus subtilis] [DB:genpept-bct1] [DE:Bacillus subtilis complete genome (section 11 of 21): from 2000171to 2207900.] [NT:similar to hypothetical proteins] [LE:85155] [RE:85691] [DI:complement]

| ORF Name | NTID | AAID | NT Length | AA Length | score | probability |
|---|---|---|---|---|---|---|
| AI7503000990_24730340_c3_937 | 1811 | 5583 | 672 | 223 | 731 | 2.6e-72 |

Description sp:[LN:YKQB_BACSU] [AC:P39760] [GN:YKQB] [OR:BACILLUS SUBTILIS] [DE:HYPOTHETICAL 24.3 KD PROTEIN IN KINC-ADEC INTERGENIC REGION (ORF4)] [SP:P39760] [DB:swissprot] >pir:[LN:A69862] [AC:A69862:PC6016 ] [PN:conserved hypothetical protein ykqB] [GN:ykqB ] [CL:conserved hypothetical protein MG323] [OR:Bacillus subtilis] [DB:pir2] >gp:[GI:d1007628:g520844] [LN:BACAMOKOOO] [AC:D37799] [PN:orf4] [OR:Bacillus subtilis] [SR:Bacillus subtilis (sub_species:Marburg, strain:168] [DB:genpept-bct1] [DE:Bacillus subtilis genes for ampS, mreBH, orf1, kinC, orf3, orf4 andorf5.] [LE:5175] [RE:5840] [DI:direct] >gp:[GI:e1185041:g2633822] [LN:BSUB0008] [AC:Z99111:AL009126] [GN:ykqB] [FN:unknown] [OR:Bacillus subtilis] [DB:genpept-bct1] [DE:Bacillus subtilis complete genome (section 8 of 21): from 1394791to 1603020.] [NT:alternate gene name: ylxV, yzaC; similar to] [SP:P39760] [LE:125146] [RE:125811] [DI:direct] >gp:[GI:g3282136] [LN:AF012285] [AC:AF012285:AF012284:U51911] [PN:unknown] [GN:ykqA] [FN:unknown] [OR:Bacillus subtilis] [DB:genpept-bct2] [DE:Bacillus subtilis mobA-nprE gene region.] [NT:similar to product of orf4 encoded by GenBank] [LE:25634] [RE:26299] [DI:direct]

| ORF Name | NTID | AAID | NT Length | AA Length | score | probability |
|---|---|---|---|---|---|---|
| AI7503000990_24801713_c3_946 | 1812 | 5584 | 1314 | 437 | 1906 | 7.9e-197 |

Description sp:[LN:ODP2_STAAU] [AC:Q59821] [GN:PDHC] [OR:STAPHYLOCOCCUS AUREUS] [EC:2.3.1.12] [DE:COMPLEX, (E2)] [SP:Q59821] [DB:swissprot] >pir:[LN:S19722] [AC:S19722 ] [PN:dihydrolipoamide S-acetyltransferase, chain E2] [CL:dihydrolipoamide acetyltransferase: lipoyl/biotin-binding homology] [OR:Staphylococcus aureus] [EC:2.3.1.12] [DB:pir2] >gp:[GI:g581570] [LN:SAPDHDNA] [AC:X58434:S73625] [PN:dihydrolipoamide acetyltransferase: subunit E2] [GN:pdhC] [OR:Staphylococcus aureus] [DB:genpept-bct1] [EC:2.3.1.12] [DE:S.aureus pdhB, pdhC and pdhD genes for pyruvate decarboxylase,dihydrolipoamide acetyltransferase and dihydrolipoamidedehydrogenase.] [SP:Q59821] [LE:557] [RE:1849] [DI:direct]

| ORF_Name | NTID | AAID | NT Length | AA Length | score | probability |
|---|---|---|---|---|---|---|
| AI7503000990_24806587_c2_848 | 1813 | 5585 | 1056 | 351 | 399 | 3.9e-37 |

Description
pir:[LN:H69873] [AC:H69873 ] [PN:conserved hypothetical protein ylbC] [GN:ylbC ] [OR:Bacillus subtilis] [DB:pir2] >gp:[GI:e334771:g2339999] [LN:BS16823KB] [AC:Z98682] [PN:YlbC protein] [GN:ylbC] [OR:Bacillus subtilis] [DB:genpept-bct1] [DE:Bacillus subtilis genomic DNA 23.9kB fragment.] [LE:11510] [RE:12550] [DI:direct] >gp:[GI:e1185086:g2633867] [LN:BSUB0008] [AC:Z99111:AL009126] [GN:ylbC] [FN:unknown] [OR:Bacillus subtilis] [DB:genpept-bct1] [DE:Bacillus subtilis complete genome (section 8 of 21): from 1394791to 1603020.] [NT:similar to hypothetical proteins from B. subtilis] [LE:170993] [RE:172033] [DI:direct]

| ORF_Name | NTID | AAID | NT Length | AA Length | score | probability |
|---|---|---|---|---|---|---|
| AI7503000990_24851577_c3_971 | 1814 | 5586 | 564 | 187 | 405 | 9.0e-38 |

Description
pir:[LN:E69874] [AC:E69874 ] [PN:conserved hypothetical protein ylbH] [GN:ylbH ] [OR:Bacillus subtilis] [DB:pir2] >gp:[GI:e334776:g2340004] [LN:BS16823KB] [AC:Z98682] [PN:YlbH protein] [GN:ylbH] [OR:Bacillus subtilis] [DB:genpept-bct1] [DE:Bacillus subtilis genomic DNA 23.9kB fragment.] [LE:14650] [RE:15144] [DI:direct] >gp:[GI:e1185091:g2633872] [LN:BSUB0008] [AC:Z99111:AL009126] [GN:ylbH] [FN:unknown] [OR:Bacillus subtilis] [DB:genpept-bct1] [DE:Bacillus subtilis complete genome (section 8 of 21): from 1394791to 1603020.] [NT:similar to hypothetical proteins] [LE:174133] [RE:174627] [DI:direct]

| ORF_Name | NTID | AAID | NT Length | AA Length | score | probability |
|---|---|---|---|---|---|---|
| AI7503000990_25425202_c1_749 | 1815 | 5587 | 522 | 173 | 196 | 1.3e-15 |

Description
pir:[LN:B69985] [AC:B69985 ] [PN:hypothetical protein yshB] [GN:yshB ] [OR:Bacillus subtilis] [DB:pir2] >gp:[GI:e1184109:g2635325] [LN:BSUB0015] [AC:Z99118:AL009126] [GN:yshB] [FN:unknown] [OR:Bacillus subtilis] [DB:genpept-bct1] [DE:Bacillus subtilis complete genome (section 15 of 21): from 2795131to 3013540.] [LE:129072] [RE:129605] [DI:complement] >gp:[GI:e1165328:g1770034] [LN:BSZ75208] [AC:Z75208] [PN:hypothetical protein] [GN:yshB] [OR:Bacillus subtilis] [DB:genpept-bct1] [DE:B.subtilis genomic sequence 89009bp.] [NT:unknown function; putative] [LE:40302] [RE:40835] [DI:direct]

| ORF_Name | NTID | AAID | NT Length | AA Length | score | probability |
|---|---|---|---|---|---|---|
| AI7503000990_25475250_c3_985 | 1816 | 5588 | 1827 | 608 | 2503 | 4.3e-260 |

Description
pir:[LN:A27763] [AC:A27763:C69704 ] [PN:succinate dehydrogenase, flavoprotein:fumarate reductase:fumaric hydrogenase:succinic dehydrogenase] [GN:sdhA:sdhB ] [CL:fumarate reductase flavoprotein:3-oxosteroid 1-dehydrogenase homology:fumarate reductase flavoprotein homology] [OR:Bacillus subtilis] [EC:1.3.99.1] [DB:pir2]

| ORF_Name | NTID | AAID | NT Length | AA Length | score | probability |
|---|---|---|---|---|---|---|
| AI7503000990_25509640_f1_185 | 1817 | 5589 | 240 | 79 | 75 | 0.0084 |

Description
sp:[LN:YRUB_CLOPA] [AC:P23171] [OR:CLOSTRIDIUM PASTEURIANUM] [DE:(ORF B)] [SP:P23171] [DB:swissprot] >pir:[LN:S29118] [AC:S29118 ] [PN:hypothetical protein 2] [OR:Clostridium pasteurianum] [DB:pir2] >gp:[GI:g144907] [LN:CLORUB] [AC:M60116] [OR:Clostridium pasteurianum] [SR:C.pasteurianum (strain ATCC 6013) DNA] [DB:genpept-bct1] [DE:C.pasteurianum open reading frame A, B, C, and rubredoxin gene,complete cds.] [NT:open reading frame B] [LE:1126] [RE:1353] [DI:direct]

| ORF_Name | NTID | AAID | NT Length | AA Length | score | probability |
|---|---|---|---|---|---|---|
| AI7503000990_25604677_c1_736 | 1818 | 5590 | 450 | 149 | 322 | 5.6e-29 |

Description
pir:[LN:C69874] [AC:C69874 ] [PN:conserved hypothetical protein ylbF] [GN:ylbF ]
[OR:Bacillus subtilis] [DB:pir2] >gp:[GI:e334774:g2340002] [LN:BS16823KB] [AC:Z98682]
[PN:YlbF protein] [GN:ylbF] [OR:Bacillus subtilis] [DB:genpept-bct1] [DE:Bacillus
subtilis genomic DNA 23.9kB fragment.] [LE:13551] [RE:14000] [DI:direct]
>gp:[GI:e1185089:g2633870] [LN:BSUB0008] [AC:Z99111:AL009126] [GN:ylbF] [FN:unknown]
[OR:Bacillus subtilis] [DB:genpept-bct1] [DE:Bacillus subtilis complete genome (section
8 of 21): from 1394791to 1603020.] [NT:similar to hypothetical proteins] [LE:173034]
[RE:173483] [DI:direct]

| ORF_Name | NTID | AAID | NT Length | AA Length | score | probability |
|---|---|---|---|---|---|---|
| AI7503000990_25635962_c3_1008 | 1819 | 5591 | 486 | 161 | 274 | 6.9e-24 |

Description
gp:[GI:e244971:g1340128] [LN:SA1234] [AC:X97985] [OR:Staphylococcus aureus]
[DB:genpept-bct1] [DE:S.aureus orfs 1,2,3 & 4.] [NT:ORF1] [LE:537] [RE:1304]
[DI:direct]

| ORF_Name | NTID | AAID | NT Length | AA Length | score | probability |
|---|---|---|---|---|---|---|
| AI7503000990_25816552_c3_1004 | 1820 | 5592 | 777 | 258 | 984 | 4.0e-99 |

Description
gp:[GI:g4009496] [LN:AF068904] [AC:AF068904] [PN:YlmH] [GN:ylmH] [OR:Staphylococcus
aureus] [DB:genpept-bct2] [DE:Staphylococcus aureus cell division protein FtsZ (ftsZ)
gene,partial cds; YlmD (ylmD), YlmE (ylmE), YlmF (ylmF), YlmG (ylmG),and YlmH (ylmH)
genes, complete cds; and cell division proteinDivIVA (divIVA) gene, partial cds.]
[NT:similar to Bacillus subtilis YlmH] [LE:2865] [RE:3671] [DI:direct]

| ORF_Name | NTID | AAID | NT Length | AA Length | score | probability |
|---|---|---|---|---|---|---|
| AI7503000990_25818811_c2_841 | 1821 | 5593 | 153 | 50 | 162 | 5.1e-12 |

Description
gp:[GI:g1022725] [LN:SHU35635] [AC:U35635] [PN:unknown] [OR:Staphylococcus
haemolyticus] [SR:Staphylococcus haemolyticus strain=Y176] [DB:genpept-bct1]
[DE:Staphylococcus haemolyticus IS1272 ORF1 and ORF2 genes, completecds.] [NT:ORF2]
[LE:394] [RE:1083] [DI:complement] >gp:[GI:g295162] [LN:STAMECRA] [AC:L14017]
[OR:Staphylococcus aureus] [SR:Staphylococcus aureus (strain COL) DNA]
[DB:genpept-bct1] [DE:Staphylococcus aureus methicillin-resistance protein (mecR)
geneand unknown ORF, complete cds.] [NT:unknown ORF1; putative] [LE:1492] [RE:2181]
[DI:complement]

| ORF_Name | NTID | AAID | NT Length | AA Length | score | probability |
|---|---|---|---|---|---|---|
| AI7503000990_25939030_f2_399 | 1822 | 5594 | 183 | 60 | | |

Description
NO-HIT

| ORF_Name | NTID | AAID | NT Length | AA Length | score | probability |
|---|---|---|---|---|---|---|
| AI7503000990_25972207_f1_6 | 1823 | 5595 | 126 | 41 | | |

Description
NO-HIT

| ORF Name | NTID | AAID | NT Length | AA Length | score | probability |
|---|---|---|---|---|---|---|
| AI7503000990_25976401_f3_533 | 1824 | 5596 | 150 | 49 | | |

Description
NO-HIT

| ORF Name | NTID | AAID | NT Length | AA Length | score | probability |
|---|---|---|---|---|---|---|
| AI7503000990_26354550_c1_740 | 1825 | 5597 | 192 | 63 | | |

Description
NO-HIT

| ORF Name | NTID | AAID | NT Length | AA Length | score | probability |
|---|---|---|---|---|---|---|
| AI7503000990_26423305_c1_767 | 1826 | 5598 | 336 | 111 | 386 | 9.3e-36 |

Description
gp:[GI:g4009495] [LN:AF068904] [AC:AF068904] [PN:YlmG] [GN:ylmG] [OR:Staphylococcus aureus] [DB:genpept-bct2] [DE:Staphylococcus aureus cell division protein FtsZ (ftsZ) gene,partial cds; YlmD (ylmD), YlmE (ylmE), YlmF (ylmF), YlmG (ylmG),and YlmH (ylmH) genes, complete cds; and cell division proteinDivIVA (divIVA) gene, partial cds.] [NT:similar to Bacillus subtilis YlmG] [LE:2492] [RE:2782] [DI:direct]

| ORF Name | NTID | AAID | NT Length | AA Length | score | probability |
|---|---|---|---|---|---|---|
| AI7503000990_26597077_c2_875 | 1827 | 5599 | 1398 | 465 | 1113 | 8.5e-113 |

Description
gp:[GI:g2149896] [LN:SAU94706] [AC:U94706] [PN:cell division protein] [GN:divIB] [OR:Staphylococcus aureus] [DB:genpept-bct2] [DE:Staphylococcus aureus strain ATCC 8325-4 cell wall/cell divisiongene cluster, yllB, yllC, yllD, pbpA, mraY, murD, divIB, ftsA andftsZ genes, complete cds.] [LE:7179] [RE:8498] [DI:direct]

| ORF Name | NTID | AAID | NT Length | AA Length | score | probability |
|---|---|---|---|---|---|---|
| AI7503000990_26598402_c3_1011 | 1828 | 5600 | 1314 | 437 | 1251 | 2.0e-127 |

Description
sp:[LN:PYRP_BACCL] [AC:P41006] [GN:PYRP] [OR:BACILLUS CALDOLYTICUS] [DE:URACIL PERMEASE (URACIL TRANSPORTER)] [SP:P41006] [DB:swissprot] >pir:[LN:S38893] [AC:S38893 ] [PN:uracil transport protein:uracil permease] [CL:uracil transport protein uraA] [OR:Bacillus caldolyticus] [DB:pir2] >gp:[GI:g431231] [LN:BCPYRQP] [AC:X76083] [PN:uracil permease] [GN:pyrP] [OR:Bacillus caldolyticus] [DB:genpept-bct1] [DE:B.caldolyticus (DSM405) pyrR, pyrP and pyrB (partial) genes.] [SP:P41006] [LE:1490] [RE:2788] [DI:direct]

| ORF Name | NTID | AAID | NT Length | AA Length | score | probability |
|---|---|---|---|---|---|---|
| AI7503000990_26614167_c1_795 | 1829 | 5601 | 240 | 79 | 238 | 4.5e-20 |

Description
sp:[LN:ACP_BACSU] [AC:P80643:P51832] [GN:ACPA:ACPP] [OR:BACILLUS SUBTILIS] [DE:ACYL CARRIER PROTEIN (ACP)] [SP:P80643:P51832] [DB:swissprot] >pir:[LN:JC4822] [AC:JC4822:A69582 ] [PN:acyl carrier protein:8.5K protein] [GN:acpA:srb ] [CL:acyl carrier protein:acyl carrier protein homology] [OR:Bacillus subtilis] [DB:pir2] >gp:[GI:e1185183:g2633964] [LN:BSUB0009] [AC:Z99112:AL009126] [PN:acyl carrier protein] [GN:acpA] [FN:fatty acid biosynthesis] [OR:Bacillus subtilis] [DB:genpept-bct1] [DE:Bacillus subtilis complete genome (section 9 of 21): from 1598421to 1807200.] [NT:alternate gene name: acpP] [SP:P80643] [LE:66316] [RE:66549] [DI:direct] >gp:[GI:d1011632:g1237013] [LN:D64116] [AC:D64116] [PN:ORF2] [GN:orf2] [OR:Bacillus subtilis] [SR:Bacillus subtilis DNA] [DB:genpept-bct1] [DE:Bacillus subtilis genes for ORF1, ORF2, ORF3, ORF4 and Srb, partialand complete cds.] [LE:140] [RE:373] [DI:direct]

| ORF_Name | NTID | AAID | NT Length | AA Length | score | probability |
|---|---|---|---|---|---|---|
| AI7503000990_26828187_f1_147 | 1830 | 5602 | 504 | 167 | 187 | 1.1e-14 |

Description
pir:[LN:B69873] [AC:B69873 ] [PN:hypothetical protein ylaL] [GN:ylaL ] [OR:Bacillus subtilis] [DB:pir2] >gp:[GI:e1185072:g2633853] [LN:BSUB0008] [AC:Z99111:AL009126] [GN:ylaL] [FN:unknown] [OR:Bacillus subtilis] [DB:genpept-bct1] [DE:Bacillus subtilis complete genome (section 8 of 21): from 1394791to 1603020.] [LE:155412] [RE:155897] [DI:complement] >gp:[GI:e324323:g2224771] [LN:BSZ97025] [AC:Z97025] [GN:ylaL] [OR:Bacillus subtilis] [DB:genpept-bct1] [DE:Bacillus subtilis nprE, yla[A,B,C,D,E,F,G,H,I,J,K,L,M,N,O] and pycAgenes.] [LE:9671] [RE:10156] [DI:complement]

| ORF_Name | NTID | AAID | NT Length | AA Length | score | probability |
|---|---|---|---|---|---|---|
| AI7503000990_2751260_f3_673 | 1831 | 5603 | 153 | 50 | | |

Description
NO-HIT

| ORF_Name | NTID | AAID | NT Length | AA Length | score | probability |
|---|---|---|---|---|---|---|
| AI7503000990_2766500_c3_938 | 1832 | 5604 | 153 | 50 | 113 | 2.8e-06 |

Description
gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF_Name | NTID | AAID | NT Length | AA Length | score | probability |
|---|---|---|---|---|---|---|
| AI7503000990_2789801_f2_436 | 1833 | 5605 | 366 | 121 | 163 | 1.2e-11 |

Description
pir:[LN:D70070] [AC:D70070 ] [PN:transcription regulator homolog ywtF] [GN:ywtF ] [CL:Bacillus subtilis probable transcription regulator yvhJ] [OR:Bacillus subtilis] [DB:pir2]

| ORF_Name | NTID | AAID | NT Length | AA Length | score | probability |
|---|---|---|---|---|---|---|
| AI7503000990_2835285_f3_466 | 1834 | 5606 | 147 | 48 | | |

Description
NO-HIT

| ORF_Name | NTID | AAID | NT Length | AA Length | score | probability |
|---|---|---|---|---|---|---|
| AI7503000990_29319086_c1_739 | 1835 | 5607 | 519 | 172 | 467 | 2.4e-44 |

Description
pir:[LN:F69874] [AC:F69874 ] [PN:lipopolysaccharide core biosynthesis homolog ylbI] [GN:ylbI ] [CL:lipopolysaccharide core biosynthesis protein kdtB] [OR:Bacillus subtilis] [DB:pir2] >gp:[GI:e334777:g2340005] [LN:BS16823KB] [AC:Z98682] [PN:YlbI protein] [GN:ylbI] [OR:Bacillus subtilis] [DB:genpept-bct1] [DE:Bacillus subtilis genomic DNA 23.9kB fragment.] [LE:15208] [RE:15693] [DI:direct]
>gp:[GI:e1185092:g2633873] [LN:BSUB0008] [AC:Z99111:AL009126] [GN:ylbI] [FN:unknown] [OR:Bacillus subtilis] [DB:genpept-bct1] [DE:Bacillus subtilis complete genome (section 8 of 21): from 1394791to 1603020.] [NT:similar to lipopolysaccharide core biosynthesis] [LE:174691] [RE:175176] [DI:direct]

| ORF Name | NTID | AAID | NT Length | AA Length | score | probability |
|---|---|---|---|---|---|---|
| AI7503000990_29320217_f2_271 | 1836 | 5608 | 207 | 68 | | |

Description
NO-HIT

| ORF Name | NTID | AAID | NT Length | AA Length | score | probability |
|---|---|---|---|---|---|---|
| AI7503000990_29384818_c2_845 | 1837 | 5609 | 3465 | 1154 | 3900 | 0.0 |

Description
pir:[LN:F69685] [AC:F69685 ] [PN:pyruvate carboxylase pycA] [GN:pycA ] [CL:pyruvate carboxylase:biotin carboxylase homology:lipoyl/biotin-binding homology] [OR:Bacillus subtilis] [DB:pir2] >gp:[GI:e1185076:g2633857] [LN:BSUB0008] [AC:Z99111:AL009126] [PN:pyruvate carboxylase] [GN:pycA] [OR:Bacillus subtilis] [DB:genpept-bct1] [EC:6.4.1.1] [DE:Bacillus subtilis complete genome (section 8 of 21): from 1394791to 1603020.] [NT:alternate gene name: ylaP] [LE:158800] [RE:162246] [DI:direct]

| ORF Name | NTID | AAID | NT Length | AA Length | score | probability |
|---|---|---|---|---|---|---|
| AI7503000990_29410908_c2_867 | 1838 | 5610 | 129 | 42 | | |

Description
NO-HIT

| ORF Name | NTID | AAID | NT Length | AA Length | score | probability |
|---|---|---|---|---|---|---|
| AI7503000990_29488551_f2_398 | 1839 | 5611 | 234 | 77 | 59 | 0.020 |

Description
gp:[GI:g453389] [LN:BCU05814] [AC:U05814] [PN:cytochrome C oxidase subunit III] [GN:COIII] [FN:electron transport] [OR:Kinetoplast Blastocrithidia culicis] [SR:Blastocrithidia culicis] [DB:genpept-inv1] [DE:Blastocrithidia culicis ATCC30268 kinetoplast NADH dehydrogenasesubunit 7 (ND7) gene, partial cds, and cytochrome C oxidase subunitIII (COIII) gene, complete cds.] [LE:223] [RE:1089] [DI:direct]

| ORF Name | NTID | AAID | NT Length | AA Length | score | probability |
|---|---|---|---|---|---|---|
| AI7503000990_30656300_c3_1030 | 1840 | 5612 | 1353 | 450 | 912 | 1.7e-91 |

Description
sp:[LN:SUN_BACSU] [AC:P94464] [GN:SUN:FMU] [OR:BACILLUS SUBTILIS] [DE:SUN PROTEIN] [SP:P94464] [DB:swissprot] >pir:[LN:E69878] [AC:E69878 ] [PN:RNA-binding Sun protein homolog yloM] [GN:yloM ] [CL:hypothetical protein HI0624] [OR:Bacillus subtilis] [DB:pir2] >gp:[GI:e1185165:g2633946] [LN:BSUB0009] [AC:Z99112:AL009126] [GN:yloM] [FN:unknown] [OR:Bacillus subtilis] [DB:genpept-bct1] [DE:Bacillus subtilis complete genome (section 9 of 21): from 1598421to 1807200.] [NT:alternate gene name: sun; similar to RNA-binding] [SP:P94464] [LE:48918] [RE:50261] [DI:direct]
>gp:[GI:e323504:g2337803] [LN:BSY13937] [AC:Y13937] [PN:putative Fmu protein] [GN:yloM] [FN:unknown] [OR:Bacillus subtilis] [DB:genpept-bct1] [DE:Bacillus subtilis genomic DNA from the spoVM region.] [SP:P94464] [LE:10690] [RE:12033] [DI:direct]

| ORF Name | NTID | AAID | NT Length | AA Length | score | probability |
|---|---|---|---|---|---|---|
| AI7503000990_30663955_c2_809 | 1841 | 5613 | 1152 | 383 | 767 | 3.9e-76 |

Description
sp:[LN:PURK_BACSU] [AC:P12045] [GN:PURK] [OR:BACILLUS SUBTILIS] [EC:4.1.1.21] [DE:(AIR CARBOXYLASE) (AIRC)] [SP:P12045] [DB:swissprot] >pir:[LN:DCBSPK] [AC:B29326:G69684 ] [PN:phosphoribosylaminoimidazole carboxylase, carbon dioxide-fixation chain:phosphoribosylaminoimidazole carboxylase chain II] [GN:purK ] [CL:phosphoribosylaminoimidazole carboxylase carbon dioxide-fixation chain:phosphoribosylaminoimidazole carboxylase carbon dioxide-fixation chain homology] [OR:Bacillus subtilis] [EC:4.1.1.21] [DB:pir1] [MP:18 min ] >gp:[GI:g143365] [LN:BACPURF] [AC:J02732:K00047] [OR:Bacillus subtilis] [SR:B.subtilis (strain DE1 (prototroph DER. or W168)) DNA, clone pPZ] [DB:genpept-bct1] [DE:B.subtilis pur operon encoding purine biosynthesis enzymes, 12genes.] [NT:phosphoribosyl aminoimidazole carboxylase II] [LE:920] [RE:2059] [DI:direct] >gp:[GI:e1182623:g2632957] [LN:BSUB0004] [AC:Z99107:AL009126] [PN:phosphoribosylaminoimidazole carboxylase II] [GN:purK] [FN:purine biosynthesis] [OR:Bacillus subtilis] [DB:genpept-bct1] [EC:4.1.1.21] [DE:Bacillus subtilis complete genome (section 4 of 21): from 600701 to813890.] [SP:P12045] [LE:97902] [RE:99041] [DI:direct]

| ORF Name | NTID | AAID | NT Length | AA Length | score | probability |
|---|---|---|---|---|---|---|
| AI7503000990_30745680_f2_431 | 1842 | 5614 | 2007 | 668 | 2279 | 2.3e-236 |

Description
sp:[LN:QOX1_BACSU] [AC:P34956] [GN:QOXB:IPA-38D] [OR:BACILLUS SUBTILIS] [EC:1.9.3.-] [DE:SUBUNIT QOXB) (OXIDASE AA(3) SUBUNIT 1)] [SP:P34956] [DB:swissprot] >pir:[LN:B38129] [AC:B38129:S39693:F69687 ] [PN:bo-type ubiquinol oxidase, chain I:cytochrome aa3 quinol oxidase chain I:quinol oxidase aa3-600] [GN:qoxB ] [CL:cytochrome-c oxidase chain I:cytochrome-c oxidase chain I homology] [OR:Bacillus subtilis] [EC:1.10.3.-] [DB:pir2] >gp:[GI:g143397] [LN:BACQOXA] [AC:M86548] [PN:quinol oxidase] [GN:QOXB] [OR:Bacillus subtilis] [SR:Bacillus subtilis DNA] [DB:genpept-bct1] [DE:Bacillus subtilis AA3-600 quinol oxidase (QOXA, QOXB, QOXC, QOXD)genes, complete cds.] [LE:1846] [RE:3795] [DI:direct] >gp:[GI:g413962] [LN:BSGENR] [AC:X73124] [GN:ipa-38d qoxB] [OR:Bacillus subtilis] [DB:genpept-bct1] [DE:B.subtilis genomic region (325 to 333).] [SP:P34956] [LE:40298] [RE:42247] [DI:direct] >gp:[GI:e1186315:g2636351] [LN:BSUB0020] [AC:Z99123:AL009126] [PN:cytochrome aa3 quinol oxidase (subunit I)] [GN:qoxB] [OR:Bacillus subtilis] [DB:genpept-bct1] [DE:Bacillus subtilis complete genome (section 20 of 21): from 3798401to 4010550.] [NT:alternate gene name: ipa-38d] [SP:P34956] [LE:115715] [RE:117664] [DI:complement]

| ORF Name | NTID | AAID | NT Length | AA Length | score | probability |
|---|---|---|---|---|---|---|
| AI7503000990_31272062_f1_183 | 1843 | 5615 | 171 | 56 | | |

Description
NO-HIT

| ORF Name | NTID | AAID | NT Length | AA Length | score | probability |
|---|---|---|---|---|---|---|
| AI7503000990_32242890_f2_397 | 1844 | 5616 | 1701 | 566 | 1986 | 2.6e-205 |

Description
sp:[LN:YKQC_BACSU] [AC:Q45493] [GN:YKQC] [OR:BACILLUS SUBTILIS] [DE:HYPOTHETICAL 61.5 KD PROTEIN IN ADEC-PDHA INTERGENIC REGION] [SP:Q45493] [DB:swissprot] >pir:[LN:B69862] [AC:B69862 ] [PN:conserved hypothetical protein ykqC] [GN:ykqC ] [CL:conserved hypothetical protein MG139] [OR:Bacillus subtilis] [DB:pir2] >gp:[GI:e1185043:g2633824] [LN:BSUB0008] [AC:Z99111:AL009126] [GN:ykqC] [FN:unknown] [OR:Bacillus subtilis] [DB:genpept-bct1] [DE:Bacillus subtilis complete genome (section 8 of 21): from 1394791to 1603020.] [NT:similar to hypothetical proteins] [SP:Q45493] [LE:127733] [RE:129400] [DI:complement] >gp:[GI:g3282138] [LN:AF012285] [AC:AF012285:AF012284:U51911] [PN:unknown] [GN:ykqC] [FN:unknown] [OR:Bacillus subtilis] [DB:genpept-bct2] [DE:Bacillus subtilis mobA-nprE gene region.] [NT:similar to aminopeptidase AMPS with Swiss-Prot] [LE:28221] [RE:29888] [DI:complement]

| ORF Name | NTID | AAID | NT Length | AA Length | score | probability |
|---|---|---|---|---|---|---|
| AI7503000990_32667138_f1_135 | 1845 | 5617 | 177 | 58 | | |

Description
NO-HIT

| ORF Name | NTID | AAID | NT Length | AA Length | score | probability |
|---|---|---|---|---|---|---|
| AI7503000990_32756_f3_601 | 1846 | 5618 | 1401 | 466 | 748 | 4.0e-74 |

Description
pir:[LN:S62667] [AC:S62667 ] [PN:Nramp1 protein] [CL:natural resistance-associated macrophage protein 1] [OR:Oryza sativa] [SR:, rice] [DB:pir2]

| ORF Name | NTID | AAID | NT Length | AA Length | score | probability |
|---|---|---|---|---|---|---|
| AI7503000990_3314128_f2_238 | 1847 | 5619 | 234 | 77 | | |

Description
NO-HIT

| ORF Name | NTID | AAID | NT Length | AA Length | score | probability |
|---|---|---|---|---|---|---|
| AI7503000990_33153_c2_834 | 1848 | 5620 | 900 | 299 | 454 | 5.8e-43 |

Description
gp:[GI:g4981938] [LN:AE001791] [AC:AE001791:AE000512] [PN:spermidine/putrescine ABC transporter, permease] [GN:TM1377] [OR:Thermotoga maritima] [DB:genpept-bct2] [DE:Thermotoga maritima section 103 of 136 of the complete genome.] [NT:similar to GB:L42023 SP:P45170 PID:1007357] [LE:8884] [RE:9672] [DI:direct]

| ORF Name | NTID | AAID | NT Length | AA Length | score | probability |
|---|---|---|---|---|---|---|
| AI7503000990_33367325_c1_706 | 1849 | 5621 | 168 | 55 | | |

Description
NO-HIT

| ORF Name | NTID | AAID | NT Length | AA Length | score | probability |
|---|---|---|---|---|---|---|
| AI7503000990_33594187_c1_728 | 1850 | 5622 | 303 | 100 | 150 | 7.1e-10 |

Description gp:[GI:g2668605] [LN:AF015453] [AC:AF015453] [PN:unknown] [OR:Lactobacillus rhamnosus] [DB:genpept-bct2] [DE:Lactobacillus rhamnosus 6-phospho-beta-glucosidase homolog gene,partial cds; GNTR transcriptional regulator homolog and surfacelocated protein genes, complete cds.] [NT:3.0E-ORF-1] [LE:2236] [RE:>3603] [DI:complement]

| ORF Name | NTID | AAID | NT Length | AA Length | score | probability |
|---|---|---|---|---|---|---|
| AI7503000990_33595178_f3_476 | 1851 | 5623 | 129 | 42 | | |

Description

NO-HIT

| ORF Name | NTID | AAID | NT Length | AA Length | score | probability |
|---|---|---|---|---|---|---|
| AI7503000990_33651636_c3_981 | 1852 | 5624 | 1776 | 591 | 1528 | 9.0e-157 |

Description pir:[LN:C69985] [AC:C69985 ] [PN:probable DNA-dependent DNA polymerase beta chain yshC] [GN:yshC ] [OR:Bacillus subtilis] [DB:pir2] >gp:[GI:e1184108:g2635324] [LN:BSUB0015] [AC:Z99118:AL009126] [GN:yshC] [FN:unknown] [OR:Bacillus subtilis] [DB:genpept-bct1] [DE:Bacillus subtilis complete genome (section 15 of 21): from 2795131to 3013540.] [NT:similar to DNA polymerase beta] [LE:127286] [RE:128998] [DI:complement] >gp:[GI:e1165329:g1770035] [LN:BSZ75208] [AC:Z75208] [PN:hypothetical protein] [GN:yshC] [OR:Bacillus subtilis] [DB:genpept-bct1] [DE:B.subtilis genomic sequence 89009bp.] [NT:unknown function;putative] [LE:40909] [RE:42621] [DI:direct]

| ORF Name | NTID | AAID | NT Length | AA Length | score | probability |
|---|---|---|---|---|---|---|
| AI7503000990_34017812_f3_480 | 1853 | 5625 | 1722 | 573 | 1369 | 6.3e-140 |

Description pir:[LN:G69877] [AC:G69877 ] [PN:fibronectin-binding protein homolog yloA] [GN:yloA ] [OR:Bacillus subtilis] [DB:pir2] >gp:[GI:e332190:g2462963] [LN:BSPYREYLO] [AC:AJ000974] [PN:putative fibronectin-binding protein] [GN:yloA] [OR:Bacillus subtilis] [DB:genpept-bct1] [DE:Bacillus subtilis pyrE to yloA gene region.] [NT:protein A-like] [LE:6297] [RE:8015] [DI:complement] >gp:[GI:e1185156:g2633937] [LN:BSUB0009] [AC:Z99112:AL009126] [GN:yloA] [FN:unknown] [OR:Bacillus subtilis] [DB:genpept-bct1] [DE:Bacillus subtilis complete genome (section 9 of 21): from 1598421to 1807200.] [NT:similar to fibronectin-binding protein] [LE:37110] [RE:38828] [DI:complement]

| ORF Name | NTID | AAID | NT Length | AA Length | score | probability |
|---|---|---|---|---|---|---|
| AI7503000990_34100626_f3_494 | 1854 | 5626 | 159 | 52 | | |

Description

NO-HIT

| ORF Name | NTID | AAID | NT Length | AA Length | score | probability |
|---|---|---|---|---|---|---|
| AI7503000990_34175686_c1_686 | 1855 | 5627 | 513 | 170 | 502 | 4.7e-48 |

Description
sp:[LN:PUR6_BACSU] [AC:P12044] [GN:PURE] [OR:BACILLUS SUBTILIS] [EC:4.1.1.21] [DE:(EC 4.1.1.21) (AIR CARBOXYLASE) (AIRC)] [SP:P12044] [DB:swissprot] >pir:[LN:DEBSPE] [AC:A29326:D69684 ] [PN:phosphoribosylaminoimidazole carboxylase, catalytic chain:phosphoribosylaminoimidazole carboxylase chain I] [GN:purE ] [CL:phosphoribosylaminoimidazole carboxylase catalytic chain:phosphoribosylaminoimidazole carboxylase catalytic chain homology] [OR:Bacillus subtilis] [EC:4.1.1.21] [DB:pir1] [MP:18 min ] >gp:[GI:g143364] [LN:BACPURF] [AC:J02732:K00047] [OR:Bacillus subtilis] [SR:B.subtilis (strain DE1 (prototroph DER. or W168)) DNA, clone pPZ] [DB:genpept-bct1] [DE:B.subtilis pur operon encoding purine biosynthesis enzymes, 12genes.] [NT:phosphoribosyl aminoimidazole carboxylase I] [LE:439] [RE:927] [DI:direct] >gp:[GI:e1182622:g2632956] [LN:BSUB0004] [AC:Z99107:AL009126] [PN:phosphoribosylaminoimidazole carboxylase I] [GN:purE] [FN:purine biosynthesis] [OR:Bacillus subtilis] [DB:genpept-bct1] [EC:4.1.1.21] [DE:Bacillus subtilis complete genome (section 4 of 21): from 600701 to813890.] [SP:P12044] [LE:97421] [RE:97909] [DI:direct]

| ORF Name | NTID | AAID | NT Length | AA Length | score | probability |
|---|---|---|---|---|---|---|
| AI7503000990_34407750_f2_368 | 1856 | 5628 | 162 | 53 | 119 | 1.8e-07 |

Description
pir:[LN:G69872] [AC:G69872 ] [PN:hypothetical protein ylaI] [GN:ylaI ] [OR:Bacillus subtilis] [DB:pir2] >gp:[GI:e1185069:g2633850] [LN:BSUB0008] [AC:Z99111:AL009126] [GN:ylaI] [FN:unknown] [OR:Bacillus subtilis] [DB:genpept-bct1] [DE:Bacillus subtilis complete genome (section 8 of 21): from 1394791to 1603020.] [LE:153004] [RE:153213] [DI:complement] >gp:[GI:e324322:g2224768] [LN:BSZ97025] [AC:Z97025] [GN:ylaI] [OR:Bacillus subtilis] [DB:genpept-bct1] [DE:Bacillus subtilis nprE, yla[A,B,C,D,E,F,G,H,I,J,K,L,M,N,O] and pycAgenes.] [LE:7263] [RE:7472] [DI:complement]

| ORF Name | NTID | AAID | NT Length | AA Length | score | probability |
|---|---|---|---|---|---|---|
| AI7503000990_34642213_c2_877 | 1857 | 5629 | 615 | 204 | 681 | 5.1e-67 |

Description
gp:[GI:g4009494] [LN:AF068904] [AC:AF068904] [PN:YlmF] [GN:ylmF] [OR:Staphylococcus aureus] [DB:genpept-bct2] [DE:Staphylococcus aureus cell division protein FtsZ (ftsZ) gene,partial cds; YlmD (ylmD), YlmE (ylmE), YlmF (ylmF), YlmG (ylmG),and YlmH (ylmH) genes, complete cds; and cell division proteinDivIVA (divIVA) gene, partial cds.] [NT:similar to Bacillus subtilis YlmF] [LE:1926] [RE:2480] [DI:direct]

| ORF Name | NTID | AAID | NT Length | AA Length | score | probability |
|---|---|---|---|---|---|---|
| AI7503000990_34644125_c2_876 | 1858 | 5630 | 1416 | 471 | 1792 | 9.5e-185 |

Description
sp:[LN:FTSA_STAAU] [AC:O07325] [GN:FTSA] [OR:STAPHYLOCOCCUS AUREUS] [DE:CELL DIVISION PROTEIN FTSA] [SP:O07325] [DB:swissprot] >gp:[GI:g2149897] [LN:SAU94706] [AC:U94706] [PN:cell division protein] [GN:ftsA] [OR:Staphylococcus aureus] [DB:genpept-bct2] [DE:Staphylococcus aureus strain ATCC 8325-4 cell wall/cell divisiongene cluster, yllB, yllC, yllD, pbpA, mraY, murD, divIB, ftsA andftsZ genes, complete cds.] [LE:8604] [RE:10019] [DI:direct]

| ORF Name | NTID | AAID | NT Length | AA Length | score | probability |
|---|---|---|---|---|---|---|
| AI7503000990_34646937_c3_983 | 1859 | 5631 | 336 | 111 | 512 | 4.1e-49 |

Description
gp:[GI:e1333201:g3776111] [LN:SATRXA] [AC:AJ223480] [PN:thioredoxin] [GN:trxA]
[FN:thiol:disulfide interchange] [OR:Staphylococcus aureus] [DB:genpept-bct1]
[DE:Staphylococcus aureus trxA and uvrC genes and partial mutS and dhsCgenes.]
[LE:2334] [RE:2648] [DI:direct]

| ORF Name | NTID | AAID | NT Length | AA Length | score | probability |
|---|---|---|---|---|---|---|
| AI7503000990_34650452_c1_782 | 1860 | 5632 | 225 | 74 | 87 | 0.00078 |

Description
gp:[GI:g488925] [LN:A13473] [AC:A13473] [PN:41kd antigen] [OR:Plasmodium falciparum]
[SR:malaria parasite P. falciparum] [DB:genpept-pat] [DE:P.falciparum gene for 41kd
antigen, clone 41-14.] [LE:<1] [RE:>532] [DI:direct]

| ORF Name | NTID | AAID | NT Length | AA Length | score | probability |
|---|---|---|---|---|---|---|
| AI7503000990_35285902_c2_859 | 1861 | 5633 | 150 | 49 | 46 | 0.042 |

Description
sp:[LN:PGH2_MUSVI] [AC:O62725] [GN:PTGS2:COX2] [OR:MUSTELA VISON] [SR:,AMERICAN MINK]
[EC:1.14.99.1] [DE:SYNTHASE 2) (PGH SYNTHASE 2) (PGHS-2) (PHS II)] [SP:O62725]
[DB:swissprot] >gp:[GI:g2959708] [LN:AF047841] [AC:AF047841] [PN:prostaglandin synthase
2] [OR:Mustela vison] [SR:American mink] [DB:genpept-mam] [DE:Mustela vison
prostaglandin synthase 2 mRNA, complete cds.] [NT:cyclooxygenase 2] [LE:11] [RE:1825]
[DI:direct]

| ORF Name | NTID | AAID | NT Length | AA Length | score | probability |
|---|---|---|---|---|---|---|
| AI7503000990_353427_f2_302 | 1862 | 5634 | 165 | 54 | | |

Description
NO-HIT

| ORF Name | NTID | AAID | NT Length | AA Length | score | probability |
|---|---|---|---|---|---|---|
| AI7503000990_35365635_c2_846 | 1863 | 5635 | 156 | 51 | | |

Description
NO-HIT

| ORF Name | NTID | AAID | NT Length | AA Length | score | probability |
|---|---|---|---|---|---|---|
| AI7503000990_35947191_c2_835 | 1864 | 5636 | 1155 | 384 | 149 | 6.3e-07 |

Description
gp:[GI:g1633572] [LN:KSU52064] [AC:U52064] [OR:Kaposi's sarcoma-associated herpesvirus]
[SR:Kaposi's sarcoma-associated herpesvirus - Human herpesvirus 8] [DB:genpept-vrl]
[DE:Kaposi's sarcoma-associated herpes-like virus ORF73 homolog gene,complete cds.]
[NT:Herpesvirus saimiri ORF73 homolog] [LE:1] [RE:3489] [DI:direct] >gp:[GI:g1718329]
[LN:KSU75698] [AC:U75698] [OR:Kaposi's sarcoma-associated herpesvirus] [SR:Kaposi's
sarcoma-associated herpesvirus - Human herpesvirus 8] [DB:genpept-vrl] [DE:Kaposi's
sarcoma-associated herpesvirus long unique region, 80putative ORF's and kaposin gene,
complete cds.] [NT:ORF 73; extensive acidic domains, potential leucine] [LE:123809]
[RE:127297] [DI:complement]

| ORF Name | NTID | AAID | NT Length | AA Length | score | probability |
|---|---|---|---|---|---|---|
| AI7503000990_35978392_c1_788 | 1865 | 5637 | 2007 | 668 | 949 | 2.0e-95 |

Description
pir:[LN:H69878] [AC:H69878 ] [PN:protein kinase homolog yloP] [GN:yloP ] [CL:protein kinase homology] [OR:Bacillus subtilis] [DB:pir2] >gp:[GI:e1185168:g2633949] [LN:BSUB0009] [AC:Z99112:AL009126] [GN:yloP] [FN:unknown] [OR:Bacillus subtilis] [DB:genpept-bct1] [DE:Bacillus subtilis complete genome (section 9 of 21): from 1598421to 1807200.] [NT:similar to protein kinase] [LE:52121] [RE:54067] [DI:direct] >gp:[GI:e323506:g2337806] [LN:BSY13937] [AC:Y13937] [PN:putative Pkn2 protein] [GN:yloP] [FN:unknown] [OR:Bacillus subtilis] [DB:genpept-bct1] [DE:Bacillus subtilis genomic DNA from the spoVM region.] [LE:13893] [RE:15839] [DI:direct]

| ORF Name | NTID | AAID | NT Length | AA Length | score | probability |
|---|---|---|---|---|---|---|
| AI7503000990_35980062_f2_357 | 1866 | 5638 | 162 | 53 | | |

Description
NO-HIT

| ORF Name | NTID | AAID | NT Length | AA Length | score | probability |
|---|---|---|---|---|---|---|
| AI7503000990_36129451_c1_702 | 1867 | 5639 | 288 | 95 | 408 | 4.3e-38 |

Description
sp:[LN:PTHP_STACA] [AC:P23534] [GN:PTSH] [OR:STAPHYLOCOCCUS CARNOSUS] [DE:PHOSPHOCARRIER PROTEIN HPR (HISTIDINE-CONTAINING PROTEIN)] [SP:P23534] [DB:swissprot] >pir:[LN:A42374] [AC:S15367:A42374 ] [PN:phosphotransferase system phosphohistidine-containing protein :phosphotransferase system HPr] [CL:phosphotransferase system phosphohistidine-containing protein:phosphotransferase system phosphohistidine-containing protein homology] [OR:Staphylococcus carnosus] [DB:pir1] >gp:[GI:g46908] [LN:SCPTSH] [AC:X60766] [PN:Histidine-containing protein (HPr)] [GN:ptsH] [OR:Staphylococcus carnosus] [DB:genpept-bct1] [DE:S.carnosus ptsH gene for histidine-containing protein (HPr).] [SP:P23534] [LE:270] [RE:536] [DI:direct]

| ORF Name | NTID | AAID | NT Length | AA Length | score | probability |
|---|---|---|---|---|---|---|
| AI7503000990_36141893_c3_1039 | 1868 | 5640 | 1248 | 415 | 1166 | 2.1e-118 |

Description
gp:[GI:e1185186:g2633967] [LN:BSUB0009] [AC:Z99112:AL009126] [PN:signal recognition particle (docking protein)] [GN:ftsY] [FN:involved in secretion of extracellular proteins] [OR:Bacillus subtilis] [DB:genpept-bct1] [DE:Bacillus subtilis complete genome (section 9 of 21): from 1598421to 1807200.] [NT:alternate gene name: srb] [SP:P51835] [LE:71119] [RE:72108] [DI:direct]

| ORF Name | NTID | AAID | NT Length | AA Length | score | probability |
|---|---|---|---|---|---|---|
| AI7503000990_36142817_c1_717 | 1869 | 5641 | 1149 | 382 | 925 | 7.1e-93 |

Description
pir:[LN:A70180] [AC:A70180 ] [PN:spermidine/putrescine ABC transporter, ATP-binding protein (potA) homolog] [CL:ATP-binding cassette homology] [OR:Borrelia burgdorferi] [SR:, Lyme disease spirochete] [DB:pir2] >gp:[GI:g2688562] [LN:AE001165] [AC:AE001165:AE000783] [PN:spermidine/putrescine ABC transporter,] [GN:BB0642] [OR:Borrelia burgdorferi] [SR:Lyme disease spirochete] [DB:genpept-bct2] [DE:Borrelia burgdorferi (section 51 of 70) of the complete genome.] [NT:similar to GB:M64519 SP:P23858 PID:147326 GB:U00096] [LE:11911] [RE:12954] [DI:complement]

| ORF Name | NTID | AAID | NT Length | AA Length | score | probability |
|---|---|---|---|---|---|---|
| AI7503000990_36147150_c1_757 | 1870 | 5642 | 609 | 202 | 492 | 5.4e-47 |

Description
pir:[LN:C69986] [AC:C69986 ] [PN:conserved hypothetical protein ysnA] [GN:ysnA ] [CL:Methanococcus jannaschii conserved hypothetical protein MJ0226] [OR:Bacillus subtilis] [DB:pir2] >gp:[GI:e1184085:g2635301] [LN:BSUB0015] [AC:Z99118:AL009126] [GN:ysnA] [FN:unknown] [OR:Bacillus subtilis] [DB:genpept-bct1] [DE:Bacillus subtilis complete genome (section 15 of 21): from 2795131to 3013540.] [NT:similar to hypothetical proteins] [LE:104515] [RE:105111] [DI:complement]
>gp:[GI:e1165357:g1770060] [LN:BSZ75208] [AC:Z75208] [PN:hypothetical protein] [GN:ysnA] [OR:Bacillus subtilis] [DB:genpept-bct1] [DE:B.subtilis genomic sequence 89009bp.] [NT:homology to ORFo197 of Escherichia coli; unknown] [LE:64796] [RE:65392] [DI:direct]

| ORF Name | NTID | AAID | NT Length | AA Length | score | probability |
|---|---|---|---|---|---|---|
| AI7503000990_36219187_c3_920 | 1871 | 5643 | 2208 | 735 | 2062 | 2.3e-213 |

Description
sp:[LN:PURL_BACSU] [AC:P12042] [GN:PURL] [OR:BACILLUS SUBTILIS] [EC:6.3.5.3] [DE:SYNTHASE II)] [SP:P12042] [DB:swissprot] >pir:[LN:SYBS2G] [AC:G29326:C69685 ] [PN:phosphoribosylformylglycinamidine synthase, component II:formylglycinamide ribotide amidotransferase] [GN:purL ] [CL:phosphoribosylformylglycinamidine synthase component II] [OR:Bacillus subtilis] [EC:6.3.5.3] [DB:pir1] [MP:18 min ] >gp:[GI:g143369] [LN:BACPURF] [AC:J02732:K00047] [OR:Bacillus subtilis] [SR:B.subtilis (strain DE1 (prototroph DER. or W168)) DNA, clone pPZ] [DB:genpept-bct1] [DE:B.subtilis pur operon encoding purine biosynthesis enzymes, 12genes.] [NT:phosphoribosylformyl glycinamidine synthetase II] [LE:5060] [RE:7288] [DI:direct] >gp:[GI:e1182628:g2632962] [LN:BSUB0004] [AC:Z99107:AL009126] [PN:phosphoribosylformylglycinamidine synthetase I] [GN:purQ] [FN:purine biosynthesis] [OR:Bacillus subtilis] [DB:genpept-bct1] [EC:6.3.5.3] [DE:Bacillus subtilis complete genome (section 4 of 21): from 600701 to813890.] [SP:P12042] [LE:102042] [RE:104270] [DI:direct]

| ORF Name | NTID | AAID | NT Length | AA Length | score | probability |
|---|---|---|---|---|---|---|
| AI7503000990_36445263_f2_320 | 1872 | 5644 | 147 | 48 | | |

Description
NO-HIT

| ORF Name | NTID | AAID | NT Length | AA Length | score | probability |
|---|---|---|---|---|---|---|
| AI7503000990_36520302_c2_870 | 1873 | 5645 | 189 | 62 | 250 | 2.4e-21 |

Description
sp:[LN:YLLB_STAAU] [AC:O07319] [GN:YLLB] [OR:STAPHYLOCOCCUS AUREUS] [DE:HYPOTHETICAL 17.4 KD PROTEIN] [SP:O07319] [DB:swissprot] >gp:[GI:g2149890] [LN:SAU94706] [AC:U94706] [PN:unknown] [GN:yllB] [OR:Staphylococcus aureus] [DB:genpept-bct2] [DE:Staphylococcus aureus strain ATCC 8325-4 cell wall/cell divisiongene cluster, yllB, yllC, yllD, pbpA, mraY, murD, divIB, ftsA andftsZ genes, complete cds.] [LE:537] [RE:971] [DI:direct]

| ORF Name | NTID | AAID | NT Length | AA Length | score | probability |
|---|---|---|---|---|---|---|
| AI7503000990_36601687_c1_692 | 1874 | 5646 | 1260 | 419 | 1016 | 1.6e-102 |

Description
sp:[LN:PUR2_BACSU] [AC:P12039] [GN:PURD] [OR:BACILLUS SUBTILIS] [EC:6.3.4.13]
[DE:RIBONUCLEOTIDE SYNTHETASE) (PHOSPHORIBOSYLGLYCINAMIDE SYNTHETASE)] [SP:P12039]
[DB:swissprot] >pir:[LN:AJBSAG] [AC:B29183:C69684 ] [PN:phosphoribosylamine--glycine
ligase,:phosphoribosylglycinamide synthetase] [GN:purD ]
[CL:phosphoribosylamine--glycine ligase: phosphoribosylamine--glycine ligase homology]
[OR:Bacillus subtilis] [EC:6.3.4.13] [DB:pir1] [MP:18 min ] >gp:[GI:g2465561]
[LN:AF011544] [AC:AF011544] [PN:phosphoribosylglycinamide synthetase] [GN:purD]
[OR:Bacillus subtilis] [DB:genpept-bct1] [DE:Bacillus subtilis
phosphoribosylaminoimidazole-carboxamideformyltransferase (purH-J) gene, partial
cds,phosphoribosylglycinamide synthetase (purD), YecA (yecA), putativeadenine deaminase
(yecB), YecC (yecC), and YecD (yecD) genes,complete cds, and putative glutamate
synthase (yecE) gene, partialcds.] [NT:identified by complementation of E.coli TX267,]
[LE:263] [RE:1531] [DI:direct] >gp:[GI:g143374] [LN:BACPURF] [AC:J02732:K00047]
[OR:Bacillus subtilis] [SR:B.subtilis (strain DE1 (prototroph DER. or W168)) DNA, clone
pPZ] [DB:genpept-bct1] [DE:B.subtilis pur operon encoding purine biosynthesis enzymes,
12genes.] [NT:phosphoribosyl glycinamide synthetase (PUR-D; gtg] [LE:11971] [RE:13239]
[DI:direct] >gp:[GI:e1182633:g2632967] [LN:BSUB0004] [AC:Z99107:AL009126]
[PN:phosphoribosylglycinamide synthetase] [GN:purD] [FN:purine biosynthesis]
[OR:Bacillus subtilis] [DB:genpept-bct1] [EC:6.3.4.13] [DE:Bacillus subtilis complete
genome (section 4 of 21): from 600701 to813890.] [SP:P12039] [LE:108953] [RE:110221]
[DI:direct]

| ORF Name | NTID | AAID | NT Length | AA Length | score | probability |
|---|---|---|---|---|---|---|
| AI7503000990_3912890_f3_463 | 1875 | 5647 | 222 | 73 | 246 | 6.4e-21 |

Description
sp:[LN:RL28_BACST] [AC:P23374] [GN:RPMB] [OR:BACILLUS STEAROTHERMOPHILUS] [DE:50S
RIBOSOMAL PROTEIN L28] [SP:P23374] [DB:swissprot] >pir:[LN:A48396] [AC:A48396 ]
[PN:ribosomal protein L28] [CL:Escherichia coli ribosomal protein L28] [OR:Bacillus
stearothermophilus] [DB:pir2]

| ORF Name | NTID | AAID | NT Length | AA Length | score | probability |
|---|---|---|---|---|---|---|
| AI7503000990_3945257_f3_664 | 1876 | 5648 | 1176 | 391 | 738 | 4.6e-73 |

Description
pir:[LN:E69687] [AC:E69687:A38129:S39692 ] [PN:cytochrome aa3 quinol oxidase (subunit
II) qoxA:quinol oxidase aa3-600 chain qoxA] [GN:qoxA ] [CL:bo-type ubiquinol oxidase
chain II precursor: cytochrome-c oxidase chain II homology] [OR:Bacillus subtilis]
[DB:pir2] >gp:[GI:e1186316:g2636352] [LN:BSUB0020] [AC:Z99123:AL009126] [PN:cytochrome
aa3 quinol oxidase (subunit II)] [GN:qoxA] [OR:Bacillus subtilis] [DB:genpept-bct1]
[DE:Bacillus subtilis complete genome (section 20 of 21): from 3798401to 4010550.]
[NT:alternate gene name: ipa-37d] [LE:117692] [RE:118657] [DI:complement]

| ORF Name | NTID | AAID | NT Length | AA Length | score | probability |
|---|---|---|---|---|---|---|
| AI7503000990_3960881_f3_483 | 1877 | 5649 | 129 | 42 | | |

Description
NO-HIT

| ORF Name | NTID | AAID | NT Length | AA Length | score | probability |
|---|---|---|---|---|---|---|
| AI7503000990_39808_f3_498 | 1878 | 5650 | 135 | 44 | | |

Description
NO-HIT

| ORF_Name | NTID | AAID | NT Length | AA Length | score | probability |
|---|---|---|---|---|---|---|
| AI7503000990_3992193_f3_496 | 1879 | 5651 | 177 | 58 | | |

Description
NO-HIT

| ORF_Name | NTID | AAID | NT Length | AA Length | score | probability |
|---|---|---|---|---|---|---|
| AI7503000990_4067342_c3_977 | 1880 | 5652 | 1086 | 361 | 1267 | 4.1e-129 |

Description
sp:[LN:SYFA_BACSU] [AC:P17921:P94539] [GN:PHES] [OR:BACILLUS SUBTILIS] [EC:6.1.1.20]
[DE:-TRNA LIGASE ALPHA CHAIN) (PHERS)] [SP:P17921:P94539] [DB:swissprot]
>pir:[LN:YFBSA] [AC:H69675:I40459:S11730 ] [PN:phenylalanine--tRNA ligase, alpha
chain:phenylalanyl-tRNA synthetase alpha chain] [GN:pheS ] [CL:phenylalanine--tRNA
ligase alpha chain] [OR:Bacillus subtilis] [EC:6.1.1.20] [DB:pir1]
>gp:[GI:e1184113:g2635329] [LN:BSUB0015] [AC:Z99118:AL009126] [PN:phenylalanyl-tRNA
synthetase (alpha subunit)] [GN:pheS] [OR:Bacillus subtilis] [DB:genpept-bct1]
[EC:6.1.1.20] [DE:Bacillus subtilis complete genome (section 15 of 21): from 2795131to
3013540.] [SP:P17921] [LE:133410] [RE:134444] [DI:complement]
>gp:[GI:e1165324:g1770030] [LN:BSZ75208] [AC:Z75208] [PN:phenylalany-tRNA synthetase
beta subunit] [GN:pheS] [OR:Bacillus subtilis] [DB:genpept-bct1] [EC:6.1.1.20]
[DE:B.subtilis genomic sequence 89009bp.] [NT:phenylalanyl-tRNA synthetase beta
subunit] [SP:P17921] [LE:35463] [RE:36497] [DI:direct]

| ORF_Name | NTID | AAID | NT Length | AA Length | score | probability |
|---|---|---|---|---|---|---|
| AI7503000990_4103438_c3_970 | 1881 | 5653 | 255 | 84 | 110 | 1.6e-06 |

Description
pir:[LN:D69874] [AC:D69874 ] [PN:conserved hypothetical protein ylbG] [GN:ylbG ]
[OR:Bacillus subtilis] [DB:pir2] >gp:[GI:e334775:g2340003] [LN:BS16823KB] [AC:Z98682]
[PN:YlbG protein] [GN:ylbG] [OR:Bacillus subtilis] [DB:genpept-bct1] [DE:Bacillus
subtilis genomic DNA 23.9kB fragment.] [LE:14055] [RE:14327] [DI:direct]
>gp:[GI:e1185090:g2633871] [LN:BSUB0008] [AC:Z99111:AL009126] [GN:ylbG] [FN:unknown]
[OR:Bacillus subtilis] [DB:genpept-bct1] [DE:Bacillus subtilis complete genome (section
8 of 21): from 1394791to 1603020.] [NT:similar to hypothetical proteins] [LE:173538]
[RE:173810] [DI:direct]

| ORF_Name | NTID | AAID | NT Length | AA Length | score | probability |
|---|---|---|---|---|---|---|
| AI7503000990_4298177_c1_776 | 1882 | 5654 | 126 | 41 | | |

Description
NO-HIT

| ORF_Name | NTID | AAID | NT Length | AA Length | score | probability |
|---|---|---|---|---|---|---|
| AI7503000990_4300332_c1_700 | 1883 | 5655 | 1329 | 442 | 98 | 0.00059 |

Description
gp:[GI:g5306148] [LN:AF160864] [AC:AF160864] [PN:orf365] [GN:orf365] [OR:Mitochondrion
Tetrahymena pyriformis] [SR:Tetrahymena pyriformis] [DB:genpept] [DE:Tetrahymena
pyriformis mitochondrial DNA, complete genome.] [NT:Open reading frame ymf65 (CPGN);
ATA initiation] [LE:15906] [RE:17003] [DI:complement]

| ORF Name | NTID | AAID | NT Length | AA Length | score | probability |
|---|---|---|---|---|---|---|
| AI7503000990_4306562_c1_760 | 1884 | 5656 | 306 | 101 | 469 | 1.5e-44 |

Description sp:[LN:YLLB_STAAU] [AC:O07319] [GN:YLLB] [OR:STAPHYLOCOCCUS AUREUS] [DE:HYPOTHETICAL 17.4 KD PROTEIN] [SP:O07319] [DB:swissprot] >gp:[GI:g2149890] [LN:SAU94706] [AC:U94706] [PN:unknown] [GN:yllB] [OR:Staphylococcus aureus] [DB:genpept-bct2] [DE:Staphylococcus aureus strain ATCC 8325-4 cell wall/cell divisiongene cluster, yllB, yllC, yllD, pbpA, mraY, murD, divlB, ftsA andftsZ genes, complete cds.] [LE:537] [RE:971] [DI:direct]

| ORF Name | NTID | AAID | NT Length | AA Length | score | probability |
|---|---|---|---|---|---|---|
| AI7503000990_4339053_c3_934 | 1885 | 5657 | 144 | 47 | | |

Description
NO-HIT

| ORF Name | NTID | AAID | NT Length | AA Length | score | probability |
|---|---|---|---|---|---|---|
| AI7503000990_4457788_f2_344 | 1886 | 5658 | 1716 | 571 | 285 | 5.3e-21 |

Description pir:[LN:D71623] [AC:D71623 ] [PN:erythrocyte membrane protein PfEMP3 PFB0095c] [GN:PFB0095c ] [OR:Plasmodium falciparum] [DB:pir2] >gp:[GI:g3845093] [LN:AE001371] [AC:AE001371:AE001362] [PN:erythrocyte membrane protein PfEMP3] [GN:PFB0095c] [OR:Plasmodium falciparum] [SR:malaria parasite P. falciparum] [DB:genpept-inv2] [DE:Plasmodium falciparum chromosome 2, section 8 of 73 of the completesequence.] [NT:identified by sequence similarity] [LE:1407:8817] [RE:8621:8927] [DI:complementJoin]

| ORF Name | NTID | AAID | NT Length | AA Length | score | probability |
|---|---|---|---|---|---|---|
| AI7503000990_4509661_c1_783 | 1887 | 5659 | 411 | 136 | 168 | 1.2e-12 |

Description gp:[GI:e1453986:g4835313] [LN:SC5H1] [AC:AL049863] [PN:hypothetical protein] [GN:SC5H1.10c] [OR:Streptomyces coelicolor] [DB:genpept-bct1] [DE:Streptomyces coelicolor cosmid 5H1.] [NT:SC5H1.10c, hypothetical protein, len: 160 aa;] [LE:8093] [RE:8575] [DI:complement]

| ORF Name | NTID | AAID | NT Length | AA Length | score | probability |
|---|---|---|---|---|---|---|
| AI7503000990_4532967_c3_982 | 1888 | 5660 | 2358 | 785 | 3159 | 0.0 |

Description gp:[GI:e1333200:g3776110] [LN:SATRXA] [AC:AJ223480] [PN:MutS-like protein] [GN:mutS] [FN:DNA mismatch repair protein] [OR:Staphylococcus aureus] [DB:genpept-bct1] [DE:Staphylococcus aureus trxA and uvrC genes and partial mutS and dhsCgenes.] [LE:<1] [RE:2161] [DI:direct]

| ORF Name | NTID | AAID | NT Length | AA Length | score | probability |
|---|---|---|---|---|---|---|
| AI7503000990_4696068_c1_741 | 1889 | 5661 | 186 | 61 | 237 | 5.7e-20 |

Description sp:[LN:RL32_BACST] [AC:P07840] [GN:RPMF] [OR:BACILLUS STEAROTHERMOPHILUS] [DE:50S RIBOSOMAL PROTEIN L32 (RIBOSOMAL PROTEIN I) (BL37)] [SP:P07840] [DB:swissprot] >pir:[LN:R5BS37] [AC:S07236 ] [PN:ribosomal protein L32:ribosomal protein BL37:ribosomal protein I] [CL:Escherichia coli ribosomal protein L32] [OR:Bacillus stearothermophilus] [DB:pir1]

| ORF Name | NTID | AAID | NT Length | AA Length | score | probability |
|---|---|---|---|---|---|---|
| AI7503000990_4725000_c1_797 | 1890 | 5662 | 3636 | 1211 | 2426 | 6.2e-252 |

Description
pir:[LN:G69708] [AC:G69708:JC4819:PC4029 ] [PN:chromosome segregation SMC protein:minichromosome stabilizing protein SMC] [GN:smc ] [CL:conserved hypothetical P115 protein] [OR:Bacillus subtilis] [DB:pir2] >gp:[GI:e1185185:g2633966] [LN:BSUB0009] [AC:Z99112:AL009126] [PN:chromosome segregation SMC protein homolg] [GN:smc] [OR:Bacillus subtilis] [DB:genpept-bct1] [DE:Bacillus subtilis complete genome (section 9 of 21): from 1598421to 1807200.] [NT:alternate gene name: ylqA] [LE:67539] [RE:71099] [DI:direct]

| ORF Name | NTID | AAID | NT Length | AA Length | score | probability |
|---|---|---|---|---|---|---|
| AI7503000990_4725415_c2_873 | 1891 | 5663 | 2337 | 778 | 3205 | 0.0 |

Description
gp:[GI:d1023422:g2463561] [LN:AB007500] [AC:AB007500:D28879] [PN:penicillin-binding protein 1] [GN:pbpA] [OR:Staphylococcus aureus] [SR:Staphylococcus aureus (strain:NCTC8325) DNA] [DB:genpept-bct1] [DE:Staphylococcus aureus genes for penicillin-binding protein 1, MraY,MurD, partial and complete cds.] [LE:594] [RE:2828] [DI:direct] >gp:[GI:g2149893] [LN:SAU94706] [AC:U94706] [PN:penicillin-binding protein 1] [GN:pbpA] [OR:Staphylococcus aureus] [DB:genpept-bct2] [DE:Staphylococcus aureus strain ATCC 8325-4 cell wall/cell divisiongene cluster, yllB, yllC, yllD, pbpA, mraY, murD, divIB, ftsA andftsZ genes, complete cds.] [LE:2318] [RE:4552] [DI:direct]

| ORF Name | NTID | AAID | NT Length | AA Length | score | probability |
|---|---|---|---|---|---|---|
| AI7503000990_4741010_c3_956 | 1892 | 5664 | 846 | 281 | 650 | 9.8e-64 |

Description
sp:[LN:SUHB_BACSU] [AC:Q45499] [GN:SUHB] [OR:BACILLUS SUBTILIS] [DE:EXTRAGENIC SUPPRESSOR PROTEIN SUHB HOMOLOG] [SP:Q45499] [DB:swissprot] >pir:[LN:E69864] [AC:E69864 ] [PN:myo-inositol-1(or 4)-monophosphatase homolog yktC] [GN:yktC ] [CL:suppressor protein suhB] [OR:Bacillus subtilis] [DB:pir2] >gp:[GI:e1185057:g2633838] [LN:BSUB0008] [AC:Z99111:AL009126] [GN:yktC] [FN:unknown] [OR:Bacillus subtilis] [DB:genpept-bct1] [DE:Bacillus subtilis complete genome (section 8 of 21): from 1394791to 1603020.] [NT:similar to myo-inositol-1(or 4)-monophosphatase] [SP:Q45499] [LE:142056] [RE:142853] [DI:direct] >gp:[GI:g3282150] [LN:AF012285] [AC:AF012285:AF012284:U51911] [PN:unknown] [GN:yktC] [FN:unknown] [OR:Bacillus subtilis] [DB:genpept-bct2] [DE:Bacillus subtilis mobA-nprE gene region.] [NT:similar to E. coli extragenic suppressor protein] [LE:42544] [RE:43341] [DI:direct]

| ORF Name | NTID | AAID | NT Length | AA Length | score | probability |
|---|---|---|---|---|---|---|
| AI7503000990_4741703_c2_894 | 1893 | 5665 | 2418 | 805 | 2153 | 5.3e-223 |

Description
sp:[LN:PRIA_BACSU] [AC:P94461:O34941] [GN:PRIA] [OR:BACILLUS SUBTILIS] [DE:PRIMOSOMAL PROTEIN N' (REPLICATION FACTOR Y)] [SP:P94461:O34941] [DB:swissprot] >pir:[LN:A69682] [AC:A69682 ] [PN:primosomal replication factor Y priA] [GN:priA ] [CL:unassigned DEAD/H box helicases:DEAD/H box helicase homology] [OR:Bacillus subtilis] [DB:pir2] >gp:[GI:e1185162:g2633943] [LN:BSUB0009] [AC:Z99112:AL009126] [PN:primosomal replication factor Y (primosomal] [GN:priA] [OR:Bacillus subtilis] [DB:genpept-bct1] [DE:Bacillus subtilis complete genome (section 9 of 21): from 1598421to 1807200.] [NT:alternate gene name: yloJ] [SP:P94461] [LE:45047] [RE:47464] [DI:direct] >gp:[GI:e323502:g2337800] [LN:BSY13937] [AC:Y13937] [PN:putative PriA protein] [GN:yloJ] [FN:unknown] [OR:Bacillus subtilis] [DB:genpept-bct1] [DE:Bacillus subtilis genomic DNA from the spoVM region.] [SP:P94461] [LE:6819] [RE:9236] [DI:direct]

| ORF Name | NTID | AAID | NT Length | AA Length | score | probability |
|---|---|---|---|---|---|---|
| AI7503000990_4769512_f2_349 | 1894 | 5666 | 135 | 44 | | |

Description
NO-HIT

| ORF Name | NTID | AAID | NT Length | AA Length | score | probability |
|---|---|---|---|---|---|---|
| AI7503000990_4781517_c2_888 | 1895 | 5667 | 129 | 42 | | |

Description
NO-HIT

| ORF Name | NTID | AAID | NT Length | AA Length | score | probability |
|---|---|---|---|---|---|---|
| AI7503000990_4859425_f2_276 | 1896 | 5668 | 141 | 46 | | |

Description
NO-HIT

| ORF Name | NTID | AAID | NT Length | AA Length | score | probability |
|---|---|---|---|---|---|---|
| AI7503000990_4875055_f1_23 | 1897 | 5669 | 225 | 74 | 74 | 0.015 |

Description
sp:[LN:Y27B_METJA] [AC:P81234] [GN:MJ0275.1] [OR:METHANOCOCCUS JANNASCHII]
[DE:HYPOTHETICAL PROTEIN MJ0275.1] [SP:P81234] [DB:swissprot] >gp:[GI:g2826269]
[LN:U67482] [AC:U67482:L77117] [PN:M. jannaschii predicted coding region MJ0275.1]
[GN:MJ0275.1] [OR:Methanococcus jannaschii] [DB:genpept-bct2] [DE:Methanococcus
jannaschii section 24 of 150 of the complete genome.] [NT:Brute Force ORF; identified
by GeneMark; putative] [LE:9344] [RE:9790] [DI:complement]

| ORF Name | NTID | AAID | NT Length | AA Length | score | probability |
|---|---|---|---|---|---|---|
| AI7503000990_4875327_f3_587 | 1898 | 5670 | 135 | 44 | | |

Description
NO-HIT

| ORF Name | NTID | AAID | NT Length | AA Length | score | probability |
|---|---|---|---|---|---|---|
| AI7503000990_4875452_c3_1034 | 1899 | 5671 | 645 | 214 | 521 | 4.6e-50 |

Description
gp:[GI:g4982295] [LN:AE001811] [AC:AE001811:AE000512] [PN:ribulose-phosphate
3-epimerase] [GN:TM1718] [OR:Thermotoga maritima] [DB:genpept-bct2] [DE:Thermotoga
maritima section 123 of 136 of the complete genome.] [NT:similar to GB:L77117 SP:Q58093
PID:1591395 percent] [LE:2607] [RE:3269] [DI:direct]

| ORF Name | NTID | AAID | NT Length | AA Length | score | probability |
|---|---|---|---|---|---|---|
| AI7503000990_4876542_f1_176 | 1900 | 5672 | 633 | 210 | 551 | 3.0e-53 |

Description
pir:[LN:D69862] [AC:D69862 ] [PN:formylmethionine deformylase homolog ykrB] [GN:ykrB ]
[CL:polypeptide deformylase] [OR:Bacillus subtilis] [DB:pir2]
>gp:[GI:e1185046:g2633827] [LN:BSUB0008] [AC:Z99111:AL009126] [GN:ykrB] [FN:unknown]
[OR:Bacillus subtilis] [DB:genpept-bct1] [DE:Bacillus subtilis complete genome (section
8 of 21): from 1394791to 1603020.] [NT:similar to formylmethionine deformylase]
[LE:130810] [RE:131364] [DI:complement] >gp:[GI:g3282140] [LN:AF012285]
[AC:AF012285:AF012284:U51911] [PN:unknown] [GN:ykrB] [FN:unknown] [OR:Bacillus
subtilis] [DB:genpept-bct2] [DE:Bacillus subtilis mobA-nprE gene region.] [NT:similar
to polypeptide deformylase from Mycoplasma] [LE:31298] [RE:31852] [DI:complement]

| ORF Name | NTID | AAID | NT Length | AA Length | score | probability |
|---|---|---|---|---|---|---|
| AI7503000990_4877203_c1_793 | 1901 | 5673 | 936 | 311 | 661 | 6.7e-65 |

Description
pir:[LN:H69620] [AC:H69620 ] [PN:malonyl CoA-acyl carrier protein transacylase fabD]
[GN:fabD ] [CL:[acyl-carrier-protein] S-malonyltransferase: [acyl-carrier-protein]
S-malonyltransferase homology] [OR:Bacillus subtilis] [DB:pir2]
>gp:[GI:e1185181:g2633962] [LN:BSUB0009] [AC:Z99112:AL009126] [PN:malonyl CoA-acyl
carrier protein transacylase] [GN:fabD] [FN:fatty acid biosynthesis] [OR:Bacillus
subtilis] [DB:genpept-bct1] [EC:2.3.1.39] [DE:Bacillus subtilis complete genome
(section 9 of 21): from 1598421to 1807200.] [NT:alternate gene name: ylpE] [LE:64546]
[RE:65499] [DI:direct] >gp:[GI:e323514:g2337819] [LN:BSY13937] [AC:Y13937] [PN:putative
FabD protein] [GN:ylpE] [FN:unknown] [OR:Bacillus subtilis] [DB:genpept-bct1]
[DE:Bacillus subtilis genomic DNA from the spoVM region.] [LE:26318] [RE:27271]
[DI:direct]

| ORF Name | NTID | AAID | NT Length | AA Length | score | probability |
|---|---|---|---|---|---|---|
| AI7503000990_4899187_f3_569 | 1902 | 5674 | 1149 | 382 | 402 | 1.9e-37 |

Description
pir:[LN:B69875] [AC:B69875 ] [PN:conserved hypothetical protein ylbM] [GN:ylbM ]
[OR:Bacillus subtilis] [DB:pir2] >gp:[GI:e334781:g2340009] [LN:BS16823KB] [AC:Z98682]
[PN:YlbM protein] [GN:ylbM] [OR:Bacillus subtilis] [DB:genpept-bct1] [DE:Bacillus
subtilis genomic DNA 23.9kB fragment.] [LE:18936] [RE:20183] [DI:complement]
>gp:[GI:e1185096:g2633877] [LN:BSUB0008] [AC:Z99111:AL009126] [GN:ylbM] [FN:unknown]
[OR:Bacillus subtilis] [DB:genpept-bct1] [DE:Bacillus subtilis complete genome (section
8 of 21): from 1394791to 1603020.] [NT:similar to hypothetical proteins] [LE:178419]
[RE:179666] [DI:complement]

| ORF Name | NTID | AAID | NT Length | AA Length | score | probability |
|---|---|---|---|---|---|---|
| AI7503000990_4970462_c2_904 | 1903 | 5675 | 750 | 249 | 837 | 1.5e-83 |

Description
sp:[LN:FABG_BACSU] [AC:P51831:O31733] [GN:FABG] [OR:BACILLUS SUBTILIS] [EC:1.1.1.100]
[DE:ACYL CARRIER PROTEIN REDUCTASE)] [SP:P51831:O31733] [DB:swissprot] >pir:[LN:A69621]
[AC:A69621:PC4176 ] [PN:3-oxoacyl-[acyl-carrier-protein] reductase,:3-ketoacyl-acyl
carrier protein reductase [GN:fabG:srb protein] [GN:fabG:srb ] [CL:ribitol
dehydrogenase:short-chain alcohol dehydrogenase homology] [OR:Bacillus subtilis]
[EC:1.1.1.100] [DB:pir2] >gp:[GI:e1185182:g2633963] [LN:BSUB0009] [AC:Z99112:AL009126]
[PN:3-ketoacyl-acyl carrier protein reductase] [GN:fabG] [FN:fatty acid biosynthesis]
[OR:Bacillus subtilis] [DB:genpept-bct1] [EC:1.1.1.100] [DE:Bacillus subtilis complete
genome (section 9 of 21): from 1598421to 1807200.] [NT:alternate gene name: ylpF]
[SP:P51831] [LE:65492] [RE:66232] [DI:direct]

| ORF Name | NTID | AAID | NT Length | AA Length | score | probability |
|---|---|---|---|---|---|---|
| AI7503000990_5080260_f1_43 | 1904 | 5676 | 141 | 46 | | |

Description
NO-HIT

| ORF Name | NTID | AAID | NT Length | AA Length | score | probability |
|---|---|---|---|---|---|---|
| AI7503000990_5096012_f3_481 | 1905 | 5677 | 231 | 76 | | |

Description
NO-HIT

| ORF Name | NTID | AAID | NT Length | AA Length | score | probability |
|---|---|---|---|---|---|---|
| AI7503000990_5117162_c2_826 | 1906 | 5678 | 1023 | 340 | 925 | 7.1e-93 |

Description gp:[GI:d1039221:g4514629] [LN:AB016894] [AC:AB016894] [PN:bd-type quinol oxidase subunit II] [GN:cbdB] [OR:Bacillus stearothermophilus] [SR:Bacillus stearothermophilus (strain:K1041) DNA] [DB:genpept-bct1] [DE:Bacillus stearothermophilus genes for bd-type quinol oxidasesubunit I and subunit II, complete cds.] [NT:cytochrome bd-type quinol oxidase] [LE:1706] [RE:2734] [DI:direct]

| ORF Name | NTID | AAID | NT Length | AA Length | score | probability |
|---|---|---|---|---|---|---|
| AI7503000990_5157963_f3_573 | 1907 | 5679 | 939 | 312 | 219 | 3.7e-22 |

Description pir:[LN:E69827] [AC:E69827 ] [PN:glycerophosphodiester phosphodiesterase homolog yhdW] [GN:yhdW ] [OR:Bacillus subtilis] [DB:pir2] >gp:[GI:e1182963:g2633297] [LN:BSUB0006] [AC:Z99109:AL009126] [GN:yhdW] [FN:unknown] [OR:Bacillus subtilis] [DB:genpept-bct1] [DE:Bacillus subtilis complete genome (section 6 of 21): from 999501 to1209940.] [NT:similar to glycerophosphodiester phosphodiesterase] [LE:37668] [RE:38399] [DI:complement] >gp:[GI:e1191883:g2226218] [LN:BSY14082] [AC:Y14082] [PN:hypothetical protein] [GN:yhdW] [OR:Bacillus subtilis] [DB:genpept-bct1] [DE:Bacillus subtilis chromosomal DNA, region 72 to 75 degrees: spoVRto sspB.] [NT:Similarity to glycerol diester phosphodiesterase] [LE:24316] [RE:25047] [DI:complement]

| ORF Name | NTID | AAID | NT Length | AA Length | score | probability |
|---|---|---|---|---|---|---|
| AI7503000990_5162760_f3_514 | 1908 | 5680 | 129 | 42 | | |

Description

NO-HIT

| ORF Name | NTID | AAID | NT Length | AA Length | score | probability |
|---|---|---|---|---|---|---|
| AI7503000990_5276712_c3_1016 | 1909 | 5681 | 708 | 235 | 659 | 1.1e-64 |

Description sp:[LN:DCOP_LACLC] [AC:P50924] [GN:PYRF] [OR:LACTOCOCCUS LACTIS] [SR:,SUBSPCREMORIS:STREPTOCOCCUS CREMORIS] [EC:4.1.1.23] [DE:DECARBOXYLASE)] [SP:P50924] [DB:swissprot] >gp:[GI:e264705:g1070361] [LN:LLCPYRDB] [AC:X74207] [PN:OMP decarboxylase] [GN:pyrF] [OR:Lactococcus lactis] [DB:genpept-bct1] [DE:L.lactis pyrD and pyrF genes.] [SP:P50924] [LE:5309] [RE:6022] [DI:direct]

| ORF Name | NTID | AAID | NT Length | AA Length | score | probability |
|---|---|---|---|---|---|---|
| AI7503000990_595312_c1_733 | 1910 | 5682 | 147 | 48 | | |

Description

NO-HIT

| ORF Name | NTID | AAID | NT Length | AA Length | score | probability |
|---|---|---|---|---|---|---|
| AI7503000990_5974138_f1_158 | 1911 | 5683 | 204 | 67 | | |

Description

NO-HIT

| ORF Name | NTID | AAID | NT Length | AA Length | score | probability |
|---|---|---|---|---|---|---|
| AI7503000990_5978453_c3_1029 | 1912 | 5684 | 492 | 163 | 261 | 1.6e-22 |

Description
sp:[LN:DEF_BACSU] [AC:P94462] [GN:DEF] [OR:BACILLUS SUBTILIS] [EC:3.5.1.31]
[DE:DEFORMYLASE)] [SP:P94462] [DB:swissprot] >pir:[LN:F69613] [AC:F69613 ]
[PN:polypeptide deformylase def] [GN:def ] [CL:polypeptide deformylase] [OR:Bacillus
subtilis] [DB:pir2] >gp:[GI:e290287:g1772499] [LN:BSPRIADFS] [AC:Y10304]
[PN:polypeptide deformylase] [GN:def] [OR:Bacillus subtilis] [DB:genpept-bct1]
[DE:B.subtilis priA, def, fmt, sun genes.] [SP:P94462] [LE:1762] [RE:2244] [DI:direct]
>gp:[GI:e1185163:g2633944] [LN:BSUB0009] [AC:Z99112:AL009126] [PN:polypeptide
deformylase] [GN:def] [OR:Bacillus subtilis] [DB:genpept-bct1] [EC:3.5.1.31]
[DE:Bacillus subtilis complete genome (section 9 of 21): from 1598421to 1807200.]
[NT:alternate gene name: yloK] [SP:P94462] [LE:47491] [RE:47973] [DI:direct]
>gp:[GI:e323523:g2337801] [LN:BSY13937] [AC:Y13937] [PN:putative Def protein] [GN:yloK]
[FN:unknown] [OR:Bacillus subtilis] [DB:genpept-bct1] [DE:Bacillus subtilis genomic DNA
from the spoVM region.] [SP:P94462] [LE:9263] [RE:9745] [DI:direct]

| ORF Name | NTID | AAID | NT Length | AA Length | score | probability |
|---|---|---|---|---|---|---|
| AI7503000990_6023593_c1_730 | 1913 | 5685 | 288 | 95 | 296 | 3.2e-26 |

Description
pir:[LN:D69873] [AC:D69873 ] [PN:hypothetical protein ylaN] [GN:ylaN ] [OR:Bacillus
subtilis] [DB:pir2] >gp:[GI:e1185074:g2633855] [LN:BSUB0008] [AC:Z99111:AL009126]
[GN:ylaN] [FN:unknown] [OR:Bacillus subtilis] [DB:genpept-bct1] [DE:Bacillus subtilis
complete genome (section 8 of 21): from 1394791to 1603020.] [LE:157027] [RE:157308]
[DI:direct] >gp:[GI:e1191897:g2224773] [LN:BSZ97025] [AC:Z97025] [GN:ylaN] [OR:Bacillus
subtilis] [DB:genpept-bct1] [DE:Bacillus subtilis nprE,
yla[A,B,C,D,E,F,G,H,I,J,K,L,M,N,O] and pycAgenes.] [LE:11286] [RE:11567] [DI:direct]

| ORF Name | NTID | AAID | NT Length | AA Length | score | probability |
|---|---|---|---|---|---|---|
| AI7503000990_6072125_c1_766 | 1914 | 5686 | 672 | 223 | 857 | 1.1e-85 |

Description
gp:[GI:g4009493] [LN:AF068904] [AC:AF068904] [PN:YlmE] [GN:ylmE] [OR:Staphylococcus
aureus] [DB:genpept-bct2] [DE:Staphylococcus aureus cell division protein FtsZ (ftsZ)
gene,partial cds; YlmD (ylmD), YlmE (ylmE), YlmF (ylmF), YlmG (ylmG),and YlmH (ylmH)
genes, complete cds; and cell division proteinDivIVA (divIVA) gene, partial cds.]
[NT:similar to Bacillus subtilis YlmE] [LE:1246] [RE:1920] [DI:direct]

| ORF Name | NTID | AAID | NT Length | AA Length | score | probability |
|---|---|---|---|---|---|---|
| AI7503000990_6115700_f3_647 | 1915 | 5687 | 1404 | 467 | 356 | 7.8e-64 |

Description
pir:[LN:H69858] [AC:H69858 ] [PN:cation ABC transporter (ATP-binding protei) homolog
ykoD] [GN:ykoD ] [CL:ATP-binding cassette homology] [OR:Bacillus subtilis] [DB:pir2]
>gp:[GI:e1181522:g2632042] [LN:BSAJ2571] [AC:AJ002571] [PN:YkoD] [GN:ykoD] [OR:Bacillus
subtilis] [DB:genpept-bct1] [DE:Bacillus subtilis 168 56 kb DNA fragment between xlyA
and ykoR.] [NT:homologous to cobalt transport ATP binding protein] [LE:41106]
[RE:42578] [DI:complement] >gp:[GI:e1183342:g2633676] [LN:BSUB0007]
[AC:Z99110:AL009126] [GN:ykoD] [FN:unknown] [OR:Bacillus subtilis] [DB:genpept-bct1]
[DE:Bacillus subtilis complete genome (section 7 of 21): from 1194391to 1411140.]
[NT:similar to cation ABC transporter (ATP-binding] [LE:194055] [RE:195527]
[DI:complement]

| ORF Name | NTID | AAID | NT Length | AA Length | score | probability |
|---|---|---|---|---|---|---|
| AI7503000990_6131693_c1_762 | 1916 | 5688 | 414 | 137 | 574 | 1.1e-55 |

Description
gp:[GI:d1023421:g2463560] [LN:AB007500] [AC:AB007500:D28879] [OR:Staphylococcus aureus]
[SR:Staphylococcus aureus (strain:NCTC8325) DNA] [DB:genpept-bct1] [DE:Staphylococcus
aureus genes for penicillin-binding protein 1, MraY,MurD, partial and complete cds.]
[NT:unnamed protein product] [LE:212] [RE:613] [DI:direct] >gp:[GI:g2149892]
[LN:SAU94706] [AC:U94706] [PN:cell division protein] [GN:yllD] [OR:Staphylococcus
aureus] [DB:genpept-bct2] [DE:Staphylococcus aureus strain ATCC 8325-4 cell wall/cell
divisiongene cluster, yllB, yllC, yllD, pbpA, mraY, murD, divIB, ftsA andftsZ genes,
complete cds.] [LE:1936] [RE:2337] [DI:direct]

| ORF Name | NTID | AAID | NT Length | AA Length | score | probability |
|---|---|---|---|---|---|---|
| AI7503000990_6149077_c3_1033 | 1917 | 5689 | 891 | 296 | 708 | 7.0e-70 |

Description
pir:[LN:A69879] [AC:A69879 ] [PN:conserved hypothetical protein yloQ] [GN:yloQ ]
[CL:conserved hypothetical protein HI1714] [OR:Bacillus subtilis] [DB:pir2]
>gp:[GI:e1185169:g2633950] [LN:BSUB0009] [AC:Z99112:AL009126] [GN:yloQ] [FN:unknown]
[OR:Bacillus subtilis] [DB:genpept-bct1] [DE:Bacillus subtilis complete genome (section
9 of 21): from 1598421to 1807200.] [NT:similar to hypothetical proteins] [LE:54082]
[RE:54978] [DI:direct] >gp:[GI:e323525:g2337807] [LN:BSY13937] [AC:Y13937] [PN:YloQ
protein] [GN:yloQ] [FN:unknown] [OR:Bacillus subtilis] [DB:genpept-bct1] [DE:Bacillus
subtilis genomic DNA from the spoVM region.] [LE:15854] [RE:16750] [DI:direct]

| ORF Name | NTID | AAID | NT Length | AA Length | score | probability |
|---|---|---|---|---|---|---|
| AI7503000990_632762_f3_671 | 1918 | 5690 | 222 | 73 | | |

Description
NO-HIT

| ORF Name | NTID | AAID | NT Length | AA Length | score | probability |
|---|---|---|---|---|---|---|
| AI7503000990_642_c3_1005 | 1919 | 5691 | 2784 | 927 | 4356 | 0.0 |

Description
sp:[LN:SYI_STAAU] [AC:P41972] [GN:ILES] [OR:STAPHYLOCOCCUS AUREUS] [EC:6.1.1.5]
[DE:(ILERS)] [SP:P41972] [DB:swissprot] >pir:[LN:S40178] [AC:S40178 ]
[PN:isoleucine--tRNA ligase,:isoleucyl-tRNA synthetase] [CL:isoleucine--tRNA ligase]
[OR:Staphylococcus aureus] [EC:6.1.1.5] [DB:pir2] >gp:[GI:g437916] [LN:SAILES]
[AC:X74219] [PN:isoleucyl-tRNA synthetase] [GN:ileS] [OR:Staphylococcus aureus]
[DB:genpept-bct1] [DE:S.aureus gene for isoleucyl-tRNA synthetase.] [SP:P41972] [LE:91]
[RE:2844] [DI:direct]

| ORF Name | NTID | AAID | NT Length | AA Length | score | probability |
|---|---|---|---|---|---|---|
| AI7503000990_6720452_c3_936 | 1920 | 5692 | 1356 | 451 | 1266 | 5.2e-129 |

Description
gp:[GI:d1039220:g4514628] [LN:AB016894] [AC:AB016894] [PN:bd-type quinol oxidase
subunit I] [GN:cbdA] [OR:Bacillus stearothermophilus] [SR:Bacillus stearothermophilus
(strain:K1041) DNA] [DB:genpept-bct1] [DE:Bacillus stearothermophilus genes for bd-type
quinol oxidasesubunit I and subunit II, complete cds.] [NT:cytochrome bd-type quinol
oxidase] [LE:363] [RE:1709] [DI:direct]

| ORF Name | NTID | AAID | NT Length | AA Length | score | probability |
|---|---|---|---|---|---|---|
| AI7503000990_6720655_f3_530 | 1921 | 5693 | 147 | 48 | 68 | 0.045 |

Description
gp:[GI:g4049913] [LN:AF063866] [AC:AF063866] [PN:ORF MSV141 hypothetical protein]
[GN:MSV141] [OR:Melanoplus sanguinipes entomopoxvirus] [DB:genpept-vrl] [DE:Melanoplus sanguinipes entomopoxvirus, complete genome.] [LE:121430] [RE:121630] [DI:complement]

| ORF Name | NTID | AAID | NT Length | AA Length | score | probability |
|---|---|---|---|---|---|---|
| AI7503000990_6834687_c2_831 | 1922 | 5694 | 309 | 102 | 209 | 5.3e-17 |

Description
pir:[LN:C69864] [AC:C69864 ] [PN:hypothetical protein yktA] [GN:yktA ] [OR:Bacillus subtilis] [DB:pir2] >gp:[GI:e1185054:g2633835] [LN:BSUB0008] [AC:Z99111:AL009126]
[GN:yktA] [FN:unknown] [OR:Bacillus subtilis] [DB:genpept-bct1] [DE:Bacillus subtilis complete genome (section 8 of 21): from 1394791to 1603020.] [LE:140551] [RE:140817]
[DI:direct] >gp:[GI:g3282148] [LN:AF012285] [AC:AF012285:AF012284:U51911] [PN:unknown]
[GN:yktA] [FN:unknown] [OR:Bacillus subtilis] [DB:genpept-bct2] [DE:Bacillus subtilis mobA-nprE gene region.] [LE:41039] [RE:41305] [DI:direct]

| ORF Name | NTID | AAID | NT Length | AA Length | score | probability |
|---|---|---|---|---|---|---|
| AI7503000990_7225000_c3_1038 | 1923 | 5695 | 1026 | 341 | 898 | 5.2e-90 |

Description
pir:[LN:H69679] [AC:H69679 ] [PN:involved in fatty acid/phospholipid synthesis plsX]
[GN:plsX ] [CL:phospholipid synthesis protein] [OR:Bacillus subtilis] [DB:pir2]
>gp:[GI:e1185180:g2633961] [LN:BSUB0009] [AC:Z99112:AL009126] [GN:plsX] [FN:involved in fatty acid/phospholipid synthesis] [OR:Bacillus subtilis] [DB:genpept-bct1]
[DE:Bacillus subtilis complete genome (section 9 of 21): from 1598421to 1807200.]
[NT:alternate gene name: ylpD] [LE:63526] [RE:64527] [DI:direct]
>gp:[GI:e323529:g2337818] [LN:BSY13937] [AC:Y13937] [PN:putative PlsX protein]
[GN:ylpD] [FN:unknown] [OR:Bacillus subtilis] [DB:genpept-bct1] [DE:Bacillus subtilis genomic DNA from the spoVM region.] [LE:25298] [RE:26299] [DI:direct]

| ORF Name | NTID | AAID | NT Length | AA Length | score | probability |
|---|---|---|---|---|---|---|
| AI7503000990_7320465_c1_719 | 1924 | 5696 | 831 | 276 | 525 | 1.7e-50 |

Description
pir:[LN:G70179] [AC:G70179 ] [PN:spermidine/putrescine ABC transporter, permease protein (potC) homolog] [CL:spermidine/putrescine transport system permease protein potI] [OR:Borrelia burgdorferi] [SR:, Lyme disease spirochete] [DB:pir2]
>gp:[GI:g2688564] [LN:AE001165] [AC:AE001165:AE000783] [PN:spermidine/putrescine ABC transporter, permease] [GN:BB0640] [OR:Borrelia burgdorferi] [SR:Lyme disease spirochete] [DB:genpept-bct2] [DE:Borrelia burgdorferi (section 51 of 70) of the complete genome.] [NT:similar to GB:M64519 SP:P23859 PID:147328 GB:U00096] [LE:10307]
[RE:11098] [DI:complement]

| ORF Name | NTID | AAID | NT Length | AA Length | score | probability |
|---|---|---|---|---|---|---|
| AI7503000990_867176_c3_924 | 1925 | 5697 | 1512 | 503 | 1090 | 2.3e-110 |

Description
pir:[LN:C70468] [AC:C70468 ] [PN:phosphoribosylaminoimidazolecarboxamide formyltransferase] [GN:purH ] [CL:purH bifunctional enzyme] [OR:Aquifex aeolicus]
[DB:pir2] >gp:[GI:g2984204] [LN:AE000765] [AC:AE000765:AE000657]
[PN:phosphoribosylaminoimidazolecarboxamide] [GN:purH] [OR:Aquifex aeolicus]
[DB:genpept-bct2] [DE:Aquifex aeolicus section 97 of 109 of the complete genome.]
[LE:7599] [RE:9119] [DI:complement]

| ORF Name | NTID | AAID | NT Length | AA Length | score | probability |
|---|---|---|---|---|---|---|
| AI7503000990_892141_f2_303 | 1926 | 5698 | 396 | 131 | 281 | 1.2e-24 |

Description
gp:[GI:e1487496:g5042304] [LN:MMU242955] [AC:AJ242955] [PN:hypothetical protein (P4(21)n)] [GN:P4(21)n] [OR:Mus musculus] [SR:house mouse] [DB:genpept-rod] [DE:Mus musculus partial mRNA for hypothetical protein (P4(21)n gene).] [NT:similar with amyh_yeast glucoamylase S1/S2] [LE:<1] [RE:1203] [DI:direct] >gp:[GI:d1042681:g5103287] [LN:AB028868] [AC:AB028868] [GN:P4(21)n] [OR:Mus musculus] [SR:Mus musculus mRNA] [DB:genpept] [DE:Mus musculus P4(21)n mRNA, partial cds.] [NT:The protein is similar with AMYH_YEAST GLUCOAMYLASE] [LE:<1] [RE:1203] [DI:direct]

| ORF Name | NTID | AAID | NT Length | AA Length | score | probability |
|---|---|---|---|---|---|---|
| AI7503000990_892312_c3_980 | 1927 | 5699 | 156 | 51 | | |

Description
NO-HIT

| ORF Name | NTID | AAID | NT Length | AA Length | score | probability |
|---|---|---|---|---|---|---|
| AI7503000990_968785_f2_361 | 1928 | 5700 | 939 | 312 | 1274 | 7.4e-130 |

Description
gp:[GI:g3320606] [LN:AF072726] [AC:AF072726] [PN:putative heme A synthase] [GN:ctaA] [OR:Staphylococcus aureus] [DB:genpept-bct2] [DE:Staphylococcus aureus putative heme A synthase (ctaA) gene,complete cds.] [NT:CtaA] [LE:139] [RE:1050] [DI:direct]

| ORF Name | NTID | AAID | NT Length | AA Length | score | probability |
|---|---|---|---|---|---|---|
| AI7503000990_968811_c1_753 | 1929 | 5701 | 651 | 216 | 599 | 2.5e-58 |

Description
sp:[LN:DHSC_BACSU] [AC:P08064] [GN:SDHC] [OR:BACILLUS SUBTILIS] [DE:SUCCINATE DEHYDROGENASE CYTOCHROME B-558 SUBUNIT] [SP:P08064] [DB:swissprot] >pir:[LN:DEBSSC] [AC:A29843:I39972:E69704 ] [PN:succinate dehydrogenase, cytochrome b558:fumarate reductase C protein] [GN:sdhC:sdhA ] [CL:succinate dehydrogenase cytochrome b558] [OR:Bacillus subtilis] [EC:1.3.99.1] [DB:pir1] [MP:70 ] >gp:[GI:g143525] [LN:BACSDHAB] [AC:M13470:M15107] [OR:Bacillus subtilis] [SR:B.subtilis DNA, clone pKIM4] [DB:genpept-bct1] [DE:B.subtilis succinate dehydrogenase complex encoding cytochromeb-558 subunit, complete cds, and flavoprotein subunit, 5' end.] [NT:succinate dehydrogenase cytochrome b-558 subunit] [LE:265] [RE:873] [DI:direct] >gp:[GI:e1184094:g2635310] [LN:BSUB0015] [AC:Z99118:AL009126] [PN:succinate dehydrogenase (cytochrome b558) [GN:sdhC] [OR:Bacillus subtilis] [DB:genpept-bct1] [DE:Bacillus subtilis complete genome (section 15 of 21): from 2795131to 3013540.] [SP:P08064] [LE:112102] [RE:112710] [DI:complement] >gp:[GI:e1165347:g1770051] [LN:BSZ75208] [AC:Z75208] [PN:cytochrome b558 subunit of succinate] [GN:sdhC] [OR:Bacillus subtilis] [DB:genpept-bct1] [EC:1.3.99.1] [DE:B.subtilis genomic sequence 89009bp.] [SP:P08064] [LE:57197] [RE:57805] [DI:direct]

| ORF Name | NTID | AAID | NT Length | AA Length | score | probability |
|---|---|---|---|---|---|---|
| AI7503000990_969052_f2_434 | 1930 | 5702 | 129 | 42 | | |

Description
NO-HIT

| ORF Name | NTID | AAID | NT Length | AA Length | score | probability |
|---|---|---|---|---|---|---|
| AI7503000990_9881927_f1_75 | 1931 | 5703 | 180 | 59 | | |

Description
NO-HIT

| ORF Name | NTID | AAID | NT Length | AA Length | score | probability |
|---|---|---|---|---|---|---|
| AI7503000990_990702_c1_765 | 1932 | 5704 | 1185 | 394 | 1809 | 1.5e-186 |

Description sp:[LN:FTSZ_STAAU] [AC:P45498] [GN:FTSZ] [OR:STAPHYLOCOCCUS AUREUS] [DE:CELL DIVISION PROTEIN FTSZ] [SP:P45498] [DB:swissprot] >pir:[LN:S58814] [AC:S58814 ] [PN:cell division protein ftsZ] [CL:cell division protein ftsZ] [OR:Staphylococcus aureus] [DB:pir1] >gp:[GI:g458428] [LN:SAU06462] [AC:U06462] [PN:FtsZ] [GN:ftsZ] [OR:Staphylococcus aureus] [DB:genpept-bct1] [DE:Staphylococcus aureus SA4 FtsZ (ftsZ) gene, complete cds.] [LE:27] [RE:1199] [DI:direct] >gp:[GI:g2149898] [LN:SAU94706] [AC:U94706] [PN:cell division protein] [GN:ftsZ] [OR:Staphylococcus aureus] [DB:genpept-bct2] [DE:Staphylococcus aureus strain ATCC 8325-4 cell wall/cell divisiongene cluster, yllB, yllC, yllD, pbpA, mraY, murD, divlB, ftsA andftsZ genes, complete cds.] [LE:10052] [RE:11224] [DI:direct]

| ORF Name | NTID | AAID | NT Length | AA Length | score | probability |
|---|---|---|---|---|---|---|
| AI7503000990_9923437_f2_345 | 1933 | 5705 | 141 | 46 | | |

Description

NO-HIT

| ORF Name | NTID | AAID | NT Length | AA Length | score | probability |
|---|---|---|---|---|---|---|
| AI7503000990_9925910_c2_813 | 1934 | 5706 | 597 | 198 | 430 | 2.0e-40 |

Description sp:[LN:PUR3_BACSU] [AC:P12040] [GN:PURN] [OR:BACILLUS SUBTILIS] [EC:2.1.2.2] [DE:TRANSFORMYLASE) (5'-PHOSPHORIBOSYLGLYCINAMIDE TRANSFORMYLASE)] [SP:P12040] [DB:swissprot] >pir:[LN:XYBSGF] [AC:I29326:B69685 ] [PN:phosphoribosylglycinamide formyltransferase,] [GN:purN ] [CL:phosphoribosylglycinamide formyltransferase: phosphoribosylglycinamide formyltransferase homology] [OR:Bacillus subtilis] [EC:2.1.2.2] [DB:pir1] [MP:18 min ] >gp:[GI:g143372] [LN:BACPURF] [AC:J02732:K00047] [OR:Bacillus subtilis] [SR:B.subtilis (strain DE1 (prototroph DER. or W168)) DNA, clone pPZ] [DB:genpept-bct1] [DE:B.subtilis pur operon encoding purine biosynthesis enzymes, 12genes.] [NT:phosphoribosyl glycinamide formyltransferase] [LE:9833] [RE:10420] [DI:direct] >gp:[GI:e1182631:g2632965] [LN:BSUB0004] [AC:Z99107:AL009126] [PN:phosphoribosylglycinamide formyltransferase] [GN:purN] [FN:purine biosynthesis] [OR:Bacillus subtilis] [DB:genpept-bct1] [EC:2.1.2.2] [DE:Bacillus subtilis complete genome (section 4 of 21): from 600701 to813890.] [SP:P12040] [LE:106815] [RE:107402] [DI:direct]

| ORF Name | NTID | AAID | NT Length | AA Length | score | probability |
|---|---|---|---|---|---|---|
| AI7503000990_9933463_c3_933 | 1935 | 5707 | 1188 | 395 | 897 | 6.6e-90 |

Description sp:[LN:YWBD_BACSU] [AC:P39587] [GN:YWBD:IPA-19D] [OR:BACILLUS SUBTILIS] [DE:HYPOTHETICAL 44.4 KD PROTEIN IN EPR-GALK INTERGENIC REGION] [SP:P39587] [DB:swissprot] >pir:[LN:S39674] [AC:S39674:B70051 ] [PN:ywbD protein:hypothetical protein ipa-19d] [GN:ywbD ] [CL:probable methyltransferase b0967] [OR:Bacillus subtilis] [DB:pir2] >gp:[GI:g413943] [LN:BSGENR] [AC:X73124] [GN:ipa-19d] [OR:Bacillus subtilis] [DB:genpept-bct1] [DE:B.subtilis genomic region (325 to 333).] [SP:P39587] [LE:20551] [RE:21741] [DI:direct] >gp:[GI:e1186335:g2636371] [LN:BSUB0020] [AC:Z99123:AL009126] [GN:ywbD] [FN:unknown] [OR:Bacillus subtilis] [DB:genpept-bct1] [DE:Bacillus subtilis complete genome (section 20 of 21): from 3798401to 4010550.] [NT:alternate gene name: ipa-19d; similar to] [SP:P39587] [LE:136218] [RE:137408] [DI:complement]

| ORF Name | NTID | AAID | NT Length | AA Length | score | probability |
|---|---|---|---|---|---|---|
| AI7503000990_9954640_f3_487 | 1936 | 5708 | 228 | 75 | 117 | 3.0e-07 |

Description
gp:[GI:g2196686] [LN:EFU25090] [AC:U25090] [PN:pyrimidine biosynthesis protein Ab] [GN:pyrAb] [OR:Enterococcus faecalis] [DB:genpept-bct1] [DE:Enterococcus faecalis plasmid pKV48 pyrimidine biosynthesis proteinAb (pyrAb) gene, partial cds.] [LE:<1] [RE:>253] [DI:direct]

| ORF Name | NTID | AAID | NT Length | AA Length | score | probability |
|---|---|---|---|---|---|---|
| AI7503000991_10928_f1_70 | 1937 | 5709 | 1242 | 413 | 238 | 1.4e-17 |

Description
pir:[LN:T03492] [AC:T03492 ] [PN:hypothetical protein] [OR:Rhodobacter capsulatus] [DB:pir2] [MP:1 ] >gp:[GI:g3128293] [LN:AF010496] [AC:AF010496] [PN:hypothetical protein] [OR:Rhodobacter capsulatus] [DB:genpept-bct2] [DE:Rhodobacter capsulatus strain SB1003, partial genome.] [LE:54291] [RE:55613] [DI:complement]

| ORF Name | NTID | AAID | NT Length | AA Length | score | probability |
|---|---|---|---|---|---|---|
| AI7503000991_10948587_c1_430 | 1938 | 5710 | 822 | 273 | 757 | 4.5e-75 |

Description
gp:[GI:g4160468] [LN:AF109909] [AC:AF109909] [PN:putative protein] [GN:ykoY] [OR:Bacillus megaterium] [DB:genpept-bct2] [DE:Bacillus megaterium polyhydroxyalkanoate gene cluster, completesequence.] [NT:similar to toxic anion resistance protein] [LE:277] [RE:1092] [DI:direct]

| ORF Name | NTID | AAID | NT Length | AA Length | score | probability |
|---|---|---|---|---|---|---|
| AI7503000991_11210760_f2_261 | 1939 | 5711 | 162 | 53 | | |

Description
NO-HIT

| ORF Name | NTID | AAID | NT Length | AA Length | score | probability |
|---|---|---|---|---|---|---|
| AI7503000991_11220301_c2_523 | 1940 | 5712 | 126 | 41 | 108 | 3.4e-06 |

Description
pir:[LN:QQSA8T] [AC:A04493 ] [PN:hypothetical protein B-189] [OR:Staphylococcus aureus] [DB:pir1]

| ORF Name | NTID | AAID | NT Length | AA Length | score | probability |
|---|---|---|---|---|---|---|
| AI7503000991_1180328_c3_606 | 1941 | 5713 | 816 | 271 | 372 | 2.8e-34 |

Description
pir:[LN:H70003] [AC:H70003 ] [PN:probable prolyl aminopeptidase, ytxM:cytosol aminopeptidase V:Pro-X aminopeptidase:proline aminopeptidase:proline iminopeptidase] [GN:ytxM ] [OR:Bacillus subtilis] [EC:3.4.11.5] [DB:pir2] >gp:[GI:e1185954:g2635565] [LN:BSUB0016] [AC:Z99119:AL009126] [GN:ytxM] [FN:unknown] [OR:Bacillus subtilis] [DB:genpept-bct1] [DE:Bacillus subtilis complete genome (section 16 of 21): from 2997771to 3213410.] [NT:alternate gene name: ytfB; similar to prolyl] [LE:151061] [RE:151885] [DI:complement] >gp:[GI:g2293147] [LN:AF008220] [AC:AF008220] [PN:YtxM] [GN:ytxM] [OR:Bacillus subtilis] [DB:genpept-bct2] [DE:Bacillus subtilis rrnB-dnaB genomic region.] [NT:similarity with 2-hydroxy-6-oxo-2,4-heptadienoate] [LE:28542] [RE:29366] [DI:direct]

| ORF Name | NTID | AAID | NT Length | AA Length | score | probability |
|---|---|---|---|---|---|---|
| AI7503000991_12239817_c2_520 | 1942 | 5714 | 168 | 55 | | |

Description
NO-HIT

| ORF Name | NTID | AAID | NT Length | AA Length | score | probability |
|---|---|---|---|---|---|---|
| AI7503000991_12681510_f3_365 | 1943 | 5715 | 825 | 274 | 702 | 3.0e-69 |

Description
pir:[LN:F69841] [AC:F69841 ] [PN:conserved hypothetical protein yitU] [GN:yitU ]
[OR:Bacillus subtilis] [DB:pir2] >gp:[GI:e261990:g1620926] [LN:BS168NPRB] [AC:Z79580]
[GN:putative orf] [FN:unknown] [OR:Bacillus subtilis] [DB:genpept-bct1] [DE:B.subtilis
nprB gene.] [LE:4492] [RE:5304] [DI:complement] >gp:[GI:e1183116:g2633450]
[LN:BSUB0006] [AC:Z99109:AL009126] [GN:yitU] [FN:unknown] [OR:Bacillus subtilis]
[DB:genpept-bct1] [DE:Bacillus subtilis complete genome (section 6 of 21): from 999501
to1209940.] [NT:similar to hypothetical proteins] [LE:190463] [RE:191275]
[DI:complement] >gp:[GI:e1173548:g2145415] [LN:BSY09476] [AC:Y09476] [PN:YitU]
[OR:Bacillus subtilis] [DB:genpept-bct1] [DE:B.subtilis 54kb genomic DNA fragment.]
[NT:putative ORF] [LE:47689] [RE:48501] [DI:complement]

| ORF Name | NTID | AAID | NT Length | AA Length | score | probability |
|---|---|---|---|---|---|---|
| AI7503000991_12750290_c1_400 | 1944 | 5716 | 1122 | 373 | 1233 | 1.6e-125 |

Description
pir:[LN:B69669] [AC:B69669:S15233:D38447 ] [PN:oligopeptide transport ATP-binding
protein oppD:sporulation initiation protein spo0KD] [GN:spo0KD:oppD ] [CL:inner
membrane protein malK:ATP-binding cassette homology] [OR:Bacillus subtilis] [DB:pir2]
>gp:[GI:e1183166:g2633500] [LN:BSUB0007] [AC:Z99110:AL009126] [PN:oligopeptide ABC
transporter (ATP-binding) [GN:oppD] [FN:required for initiation of sporulation,]
[OR:Bacillus subtilis] [DB:genpept-bct1] [DE:Bacillus subtilis complete genome (section
7 of 21): from 1194391to 1411140.] [NT:alternate gene name: spo0KD] [LE:28537]
[RE:29613] [DI:direct]

| ORF Name | NTID | AAID | NT Length | AA Length | score | probability |
|---|---|---|---|---|---|---|
| AI7503000991_13089052_f3_290 | 1945 | 5717 | 240 | 79 | 112 | 1.0e-06 |

Description
pir:[LN:A60998] [AC:A60998 ] [PN:replication protein REP] [OR:Staphylococcus aureus]
[DB:pir2] >gp:[GI:g295834] [LN:SAPOX2000] [AC:X55798] [OR:Staphylococcus aureus]
[DB:genpept-bct1] [DE:S.aureus plasmid pOX2000.] [NT:ORF 154] [LE:587] [RE:1051]
[DI:direct]

| ORF Name | NTID | AAID | NT Length | AA Length | score | probability |
|---|---|---|---|---|---|---|
| AI7503000991_13829403_f1_46 | 1946 | 5718 | 129 | 42 | | |

Description
NO-HIT

| ORF Name | NTID | AAID | NT Length | AA Length | score | probability |
|---|---|---|---|---|---|---|
| AI7503000991_13848387_f2_141 | 1947 | 5719 | 240 | 79 | 131 | 9.8e-09 |

Description
pir:[LN:S75993] [AC:S75993 ] [PN:hypothetical protein] [OR:Synechocystis sp.] [SR:PCC 6803, , PCC 6803] [SR:PCC 6803, ] [DB:pir2] >gp:[GI:d1011491:g1001353] [LN:SYCSLLLH] [AC:D64006:AB001339] [PN:hypothetical protein] [GN:clpP] [OR:Synechocystis sp.] [SR:Synechocystis sp. (strain:PCC6803) DNA] [DB:genpept-bct1] [DE:Synechocystis sp. PCC6803 complete genome, 25/27, 3138604-3270709.] [NT:ORF_ID:sll0498] [LE:80076] [RE:80528] [DI:complement]

| ORF Name | NTID | AAID | NT Length | AA Length | score | probability |
|---|---|---|---|---|---|---|
| AI7503000991_1445930_f2_152 | 1948 | 5720 | 621 | 206 | 103 | 0.0023 |

Description
pir:[LN:A70417] [AC:A70417 ] [PN:hypothetical protein aq_1349] [GN:aq_1349 ] [OR:Aquifex aeolicus] [DB:pir2] >gp:[GI:g2983776] [LN:AE000736] [AC:AE000736:AE000657] [PN:putative protein] [GN:aq_1349] [OR:Aquifex aeolicus] [DB:genpept-bct2] [DE:Aquifex aeolicus section 68 of 109 of the complete genome.] [LE:1950] [RE:2756] [DI:direct]

| ORF Name | NTID | AAID | NT Length | AA Length | score | probability |
|---|---|---|---|---|---|---|
| AI7503000991_14460882_c1_443 | 1949 | 5721 | 1722 | 573 | 1304 | 4.9e-133 |

Description
gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF Name | NTID | AAID | NT Length | AA Length | score | probability |
|---|---|---|---|---|---|---|
| AI7503000991_14460887_f1_3 | 1950 | 5722 | 153 | 50 | 115 | 1.7e-06 |

Description
gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF Name | NTID | AAID | NT Length | AA Length | score | probability |
|---|---|---|---|---|---|---|
| AI7503000991_14484553_c2_467 | 1951 | 5723 | 1356 | 451 | 1726 | 9.3e-178 |

Description
sp:[LN:G6PA_BACST] [AC:P13375] [GN:PGIA] [OR:BACILLUS STEAROTHERMOPHILUS] [EC:5.3.1.9] [DE:ISOMERASE A)] [SP:P13375] [DB:swissprot] >pir:[LN:NUBSSA] [AC:S15936:S06196 ] [PN:glucose-6-phosphate isomerase, A:phosphoglucose isomerase:phosphohexose isomerase] [CL:glucose-6-phosphate isomerase] [OR:Bacillus stearothermophilus] [EC:5.3.1.9] [DB:pir1] >gp:[GI:g40046] [LN:BSPGIA] [AC:X16639] [OR:Bacillus stearothermophilus] [DB:genpept-bct1] [DE:Bacillus stearothermophilus pgiA gene for phosphoglucoisomeraseisoenzyme A (EC 5.3.1.9).] [NT:phosphoglucose isomerase A (AA 1-449)] [SP:P13375] [LE:95] [RE:1444] [DI:direct]

| ORF Name | NTID | AAID | NT Length | AA Length | score | probability |
|---|---|---|---|---|---|---|
| AI7503000991_14648512_c3_585 | 1952 | 5724 | 126 | 41 | | |

Description
NO-HIT

| ORF Name | NTID | AAID | NT Length | AA Length | score | probability |
|---|---|---|---|---|---|---|
| AI7503000991_14656432_c3_582 | 1953 | 5725 | 168 | 55 | 78 | 0.033 |

Description gp:[GI:g3158514] [LN:CELT04D1] [AC:AF067617] [GN:T04D1.2] [OR:Caenorhabditis elegans]
[DB:genpept-invl] [DE:Caenorhabditis elegans cosmid T04D1.]
[LE:10425:10567:11420:12480] [RE:10517:10646:11689:12789] [DI:directJoin]

| ORF Name | NTID | AAID | NT Length | AA Length | score | probability |
|---|---|---|---|---|---|---|
| AI7503000991_14884437_c1_437 | 1954 | 5726 | 165 | 54 | | |

Description

NO-HIT

| ORF Name | NTID | AAID | NT Length | AA Length | score | probability |
|---|---|---|---|---|---|---|
| AI7503000991_15038450_c2_469 | 1955 | 5727 | 135 | 44 | | |

Description

NO-HIT

| ORF Name | NTID | AAID | NT Length | AA Length | score | probability |
|---|---|---|---|---|---|---|
| AI7503000991_16683437_f1_5 | 1956 | 5728 | 1023 | 340 | 571 | 2.3e-55 |

Description pir:[LN:A69863] [AC:A69863 ] [PN:conserved hypothetical protein ykrP] [GN:ykrP ]
[OR:Bacillus subtilis] [DB:pir2] >gp:[GI:e1184942:g2633723] [LN:BSUB0008]
[AC:Z99111:AL009126] [GN:ykrP] [FN:unknown] [OR:Bacillus subtilis] [DB:genpept-bct1]
[DE:Bacillus subtilis complete genome (section 8 of 21): from 1394791to 1603020.]
[NT:similar to hypothetical proteins] [LE:22614] [RE:23636] [DI:complement]

| ORF Name | NTID | AAID | NT Length | AA Length | score | probability |
|---|---|---|---|---|---|---|
| AI7503000991_16832562_f1_67 | 1957 | 5729 | 804 | 267 | 320 | 4.5e-36 |

Description pir:[LN:H69843] [AC:H69843 ] [PN:hypothetical protein yjbH] [GN:yjbH ] [OR:Bacillus
subtilis] [DB:pir2] >gp:[GI:e1183175:g2633509] [LN:BSUB0007] [AC:Z99110:AL009126]
[GN:yjbH] [FN:unknown] [OR:Bacillus subtilis] [DB:genpept-bct1] [DE:Bacillus subtilis
complete genome (section 7 of 21): from 1194391to 1411140.] [LE:38695] [RE:39522]
[DI:complement]

| ORF Name | NTID | AAID | NT Length | AA Length | score | probability |
|---|---|---|---|---|---|---|
| AI7503000991_187683_c1_417 | 1958 | 5730 | 228 | 75 | 256 | 1.3e-23 |

Description sp:[LN:BIN3_STAAU] [AC:P20384] [GN:BIN3] [OR:STAPHYLOCOCCUS AUREUS] [DE:POTENTIAL
DNA-INVERTASE BIN3 (TRANSPOSON TN552)] [SP:P20384] [DB:swissprot] >gp:[GI:g398182]
[LN:SABINR3] [AC:X16298] [OR:Staphylococcus aureus] [DB:genpept-bct1]
[DE:Staphylococcus aureus plasmid pI9789 DNA with binR and bin3 genes,derived from
transposon TN552.] [NT:bin3 product] [SP:P20384] [LE:1049] [RE:1657] [DI:direct]

| ORF Name | NTID | AAID | NT Length | AA Length | score | probability |
|---|---|---|---|---|---|---|
| AI7503000991_195177_c2_521 | 1959 | 5731 | 141 | 46 | 127 | 2.6e-08 |

Description
pir:[LN:S42239] [AC:S42239 ] [PN:hypothetical protein 3] [OR:Staphylococcus aureus] [DB:pir2] >gp:[GI:g501834] [LN:PNS1CG] [AC:M16217] [OR:Plasmid pNS1] [SR:Plasmid pNS1 from Staphylococcus aureus, plasmid pTP5 DNA] [DB:genpept-bct1] [DE:Plasmid pNS1 (from Staphylococcus aureus) encodingtetracycline-resistance (tet), complete genome.] [NT:ORF C; putative] [LE:1870] [RE:2409] [DI:direct]

| ORF Name | NTID | AAID | NT Length | AA Length | score | probability |
|---|---|---|---|---|---|---|
| AI7503000991_19531626_f3_304 | 1960 | 5732 | 126 | 41 | | |

Description
NO-HIT

| ORF Name | NTID | AAID | NT Length | AA Length | score | probability |
|---|---|---|---|---|---|---|
| AI7503000991_19547938_c2_498 | 1961 | 5733 | 372 | 123 | 224 | 7.4e-18 |

Description
sp:[LN:G6PD_LEUME] [AC:P11411] [GN:ZWF] [OR:LEUCONOSTOC MESENTEROIDES] [EC:1.1.1.49] [DE:GLUCOSE-6-PHOSPHATE 1-DEHYDROGENASE, (G6PD)] [SP:P11411] [DB:swissprot]

| ORF Name | NTID | AAID | NT Length | AA Length | score | probability |
|---|---|---|---|---|---|---|
| AI7503000991_19566553_c1_428 | 1962 | 5734 | 159 | 52 | | |

Description
NO-HIT

| ORF Name | NTID | AAID | NT Length | AA Length | score | probability |
|---|---|---|---|---|---|---|
| AI7503000991_1960952_c2_473 | 1963 | 5735 | 906 | 301 | 575 | 8.7e-56 |

Description
pir:[LN:C69837] [AC:C69837 ] [PN:5-oxo-1,2,5-tricarboxilic-3-penten acid de homolog yisK] [GN:yisK ] [CL:2-hydroxyhepta-2,4-diene-1,7-dioate isomerase] [OR:Bacillus subtilis] [DB:pir2] >gp:[GI:e1183077:g2633411] [LN:BSUB0006] [AC:Z99109:AL009126] [GN:yisK] [FN:unknown] [OR:Bacillus subtilis] [DB:genpept-bct1] [DE:Bacillus subtilis complete genome (section 6 of 21): from 999501 to1209940.] [NT:similar to 5-oxo-1,2,5-tricarboxilic-3-penten acid] [LE:152216] [RE:153121] [DI:direct] >gp:[GI:e1173509:g2145376] [LN:BSY09476] [AC:Y09476] [PN:YisK] [OR:Bacillus subtilis] [DB:genpept-bct1] [DE:B.subtilis 54kb genomic DNA fragment.] [NT:putative - Homology with oxo-tricarboxilic-pentene] [LE:9442] [RE:10347] [DI:direct]

| ORF Name | NTID | AAID | NT Length | AA Length | score | probability |
|---|---|---|---|---|---|---|
| AI7503000991_19610442_f1_56 | 1964 | 5736 | 246 | 81 | 219 | 4.6e-18 |

Description
gp:[GI:d1045996:g5360820] [LN:D86934] [AC:D86934] [PN:transposase] [OR:Staphylococcus aureus] [SR:Staphylococcus aureus (strain:N315) DNA, clone_lib:library of N31] [DB:genpept] [DE:Staphylococcus aureus genes, mec region, partial and complete cds.] [NT:ORF N026; putative] [LE:19527] [RE:19751] [DI:direct]

| ORF Name | NTID | AAID | NT Length | AA Length | score | probability |
|---|---|---|---|---|---|---|
| AI7503000991_19790902_c2_493 | 1965 | 5737 | 813 | 270 | 919 | 3.1e-92 |

Description
pir:[LN:F69844] [AC:F69844 ] [PN:conserved hypothetical protein yjbN] [GN:yjbN ] [CL:conserved hypothetical protein HI0072] [OR:Bacillus subtilis] [DB:pir2] >gp:[GI:e1183181:g2633515] [LN:BSUB0007] [AC:Z99110:AL009126] [GN:yjbN] [FN:unknown] [OR:Bacillus subtilis] [DB:genpept-bct1] [DE:Bacillus subtilis complete genome (section 7 of 21): from 1194391to 1411140.] [NT:similar to hypothetical proteins] [LE:42741] [RE:43541] [DI:direct]

| ORF Name | NTID | AAID | NT Length | AA Length | score | probability |
|---|---|---|---|---|---|---|
| AI7503000991_20517062_c2_478 | 1966 | 5738 | 1002 | 333 | 961 | 1.1e-96 |

Description
pir:[LN:F69842] [AC:F69842 ] [PN:3-oxoacyl- acyl-carrier protein synthase homolog yjaX] [GN:yjaX ] [CL:3-oxoacyl-[acyl-carrier-protein] synthase III] [OR:Bacillus subtilis] [DB:pir2] >gp:[GI:e1183136:g2633470] [LN:BSUB0006] [AC:Z99109:AL009126] [GN:yjaX] [FN:unknown] [OR:Bacillus subtilis] [DB:genpept-bct1] [DE:Bacillus subtilis complete genome (section 6 of 21): from 999501 to1209940.] [NT:similar to 3-oxoacyl- acyl-carrier protein] [LE:208189] [RE:209127] [DI:direct] >gp:[GI:e1183153:g2633487] [LN:BSUB0007] [AC:Z99110:AL009126] [GN:yjaX] [FN:unknown] [OR:Bacillus subtilis] [DB:genpept-bct1] [DE:Bacillus subtilis complete genome (section 7 of 21): from 1194391to 1411140.] [NT:similar to 3-oxoacyl- acyl-carrier protein] [LE:13299] [RE:14237] [DI:direct]

| ORF Name | NTID | AAID | NT Length | AA Length | score | probability |
|---|---|---|---|---|---|---|
| AI7503000991_20585302_f2_149 | 1967 | 5739 | 126 | 41 | | |

Description
NO-HIT

| ORF Name | NTID | AAID | NT Length | AA Length | score | probability |
|---|---|---|---|---|---|---|
| AI7503000991_20739037_c1_452 | 1968 | 5740 | 426 | 141 | 690 | 5.7e-68 |

Description
gp:[GI:g2267243] [LN:SEU71377] [AC:U71377] [PN:putative transcriptional regulator AtlR] [OR:Staphylococcus epidermidis] [DB:genpept-bct1] [DE:Staphylococcus epidermidis autolysin AtlE and putativetranscriptional regulator AtlR genes, complete cds.] [LE:6867] [RE:7286] [DI:complement]

| ORF Name | NTID | AAID | NT Length | AA Length | score | probability |
|---|---|---|---|---|---|---|
| AI7503000991_2125903_f3_313 | 1969 | 5741 | 1239 | 412 | 197 | 6.2e-13 |

Description
pir:[LN:D71112] [AC:D71112 ] [PN:hypothetical protein PH0667] [GN:PH0667 ] [OR:Pyrococcus horikoshii] [DB:pir2] >gp:[GI:d1030701:g3257075] [LN:AP000003] [AC:AP000003:AB009484:AB009485:AB009486:AB009487:AB009488:AB009489] [PN:413aa long hypothetical protein] [GN:PH0667] [OR:Pyrococcus horikoshii] [SR:Pyrococcus horikoshii (strain:OT3) DNA] [DB:genpept-bct1] [DE:Pyrococcus horikoshii OT3 genomic DNA, 544001-777000 nt. position(3/7).] [LE:51915] [RE:53156] [DI:complement]

| ORF Name | NTID | AAID | NT Length | AA Length | score | probability |
|---|---|---|---|---|---|---|
| AI7503000991_21571937_f3_380 | 1970 | 5742 | 213 | 70 | 54 | 0.015 |

Description
pir:[LN:F71120] [AC:F71120 ] [PN:hypothetical protein PH0733] [GN:PH0733 ]
[OR:Pyrococcus horikoshii] [DB:pir2] >gp:[GI:d1030767:g3257141] [LN:AP000003]
[AC:AP000003:AB009484:AB009485:AB009486:AB009487:AB009488:AB009489] [PN:150aa long
hypothetical protein] [GN:PH0733] [OR:Pyrococcus horikoshii] [SR:Pyrococcus horikoshii
(strain:OT3) DNA] [DB:genpept-bct1] [DE:Pyrococcus horikoshii OT3 genomic DNA,
544001-777000 nt. position(3/7).] [LE:107943] [RE:108395] [DI:complement]

| ORF Name | NTID | AAID | NT Length | AA Length | score | probability |
|---|---|---|---|---|---|---|
| AI7503000991_21594202_f2_167 | 1971 | 5743 | 1176 | 391 | 1674 | 3.0e-172 |

Description
gp:[GI:e1301685:g3256224] [LN:SAY14370] [AC:Y14370] [GN:ypfP] [OR:Staphylococcus
aureus] [DB:genpept-bct1] [DE:Staphylococcus aureus RF3, murE, ypfP genes.] [LE:5160]
[RE:6335] [DI:direct]

| ORF Name | NTID | AAID | NT Length | AA Length | score | probability |
|---|---|---|---|---|---|---|
| AI7503000991_21753125_c2_481 | 1972 | 5744 | 1194 | 397 | 664 | 2.0e-79 |

Description
pir:[LN:S16649] [AC:S16649:S18271:E69618:I40001 ] [PN:dipeptide ABC transporter
(permease):dciAC protein] [GN:dppC:dciAC ] [CL:oligopeptide permease protein oppB]
[OR:Bacillus subtilis] [DB:pir2] >gp:[GI:e1181495:g2632015] [LN:BSAJ2571] [AC:AJ002571]
[PN:DppC] [GN:dppC] [FN:ABC-type dipeptide transport system] [OR:Bacillus subtilis]
[DB:genpept-bct1] [DE:Bacillus subtilis 168 56 kb DNA fragment between xlyA and ykoR.]
[LE:14301] [RE:15263] [DI:direct] >gp:[GI:e1183314:g2633648] [LN:BSUB0007]
[AC:Z99110:AL009126] [PN:dipeptide ABC transporter (permease)] [GN:dppC] [OR:Bacillus
subtilis] [DB:genpept-bct1] [DE:Bacillus subtilis complete genome (section 7 of 21):
from 1194391to 1411140.] [NT:alternate gene name: dciAC] [LE:167250] [RE:168212]
[DI:direct]

| ORF Name | NTID | AAID | NT Length | AA Length | score | probability |
|---|---|---|---|---|---|---|
| AI7503000991_22272583_f3_291 | 1973 | 5745 | 123 | 40 | 86 | 0.0040 |

Description
gp:[GI:g4098413] [LN:LOU77495] [AC:U77495] [PN:putative integrase] [GN:int]
[OR:Leuconostoc oenos bacteriophage 10MC] [DB:genpept-phg] [DE:Leuconostoc oenos
bacteriophage 10MC putative integrase (int) gene,complete cds.] [NT:site-specific
recombinase] [LE:119] [RE:1165] [DI:direct]

| ORF Name | NTID | AAID | NT Length | AA Length | score | probability |
|---|---|---|---|---|---|---|
| AI7503000991_22456512_f3_286 | 1974 | 5746 | 147 | 48 | | |

Description
NO-HIT

| ORF Name | NTID | AAID | NT Length | AA Length | score | probability |
|---|---|---|---|---|---|---|
| AI7503000991_22462787_c1_392 | 1975 | 5747 | 525 | 174 | 535 | 1.5e-51 |

Description
sp:[LN:LEPH_STAAU] [AC:P72364] [GN:SPSA] [OR:STAPHYLOCOCCUS AUREUS] [DE:INACTIVE SIGNAL PEPTIDASE IA] [SP:P72364] [DB:swissprot] >gp:[GI:g1595809] [LN:SAU65000] [AC:U65000] [PN:type-I signal peptidase SpsA] [GN:spsA] [OR:Staphylococcus aureus] [DB:genpept-bct2] [DE:Staphylococcus aureus type-I signal peptidase SpsA (spsA) gene, andtype-I signal peptidase SpsB (spsB) gene, complete cds.] [NT:inactive signal peptidase homologue; protein lacks] [LE:40] [RE:564] [DI:direct]

| ORF Name | NTID | AAID | NT Length | AA Length | score | probability |
|---|---|---|---|---|---|---|
| AI7503000991_22665887_c3_598 | 1976 | 5748 | 129 | 42 | 120 | 2.4e-07 |

Description
pir:[LN:D69838] [AC:D69838 ] [PN:conserved hypothetical protein yisU] [GN:yisU ] [OR:Bacillus subtilis] [DB:pir2] >gp:[GI:e1183088:g2633422] [LN:BSUB0006] [AC:Z99109:AL009126] [GN:yisU] [FN:unknown] [OR:Bacillus subtilis] [DB:genpept-bct1] [DE:Bacillus subtilis complete genome (section 6 of 21): from 999501 to1209940.] [NT:similar to hypothetical proteins] [LE:165981] [RE:166643] [DI:complement] >gp:[GI:e1173520:g2145387] [LN:BSY09476] [AC:Y09476] [PN:YisU] [OR:Bacillus subtilis] [DB:genpept-bct1] [DE:B.subtilis 54kb genomic DNA fragment.] [NT:putative] [LE:23207] [RE:23869] [DI:complement]

| ORF Name | NTID | AAID | NT Length | AA Length | score | probability |
|---|---|---|---|---|---|---|
| AI7503000991_22703588_f2_137 | 1977 | 5749 | 954 | 317 | 803 | 6.0e-80 |

Description
sp:[LN:MENA_BACSU] [AC:P39582] [GN:MENA:IPA-6D] [OR:BACILLUS SUBTILIS] [EC:2.5.1.-] [DE:(DHNA-OCTAPRENYLTRANSFERASE)] [SP:P39582] [DB:swissprot] >pir:[LN:S39661] [AC:S39661:B70050 ] [PN:menaquinone biosynthesis protein homolog ywaB:protein ipa-6d] [GN:ywaB ] [CL:quinone biosynthesis homolog ywaB] [OR:Bacillus subtilis] [DB:pir2] >gp:[GI:g413930] [LN:BSGENR] [AC:X73124] [GN:ipa-6d] [OR:Bacillus subtilis] [DB:genpept-bct1] [DE:B.subtilis genomic region (325 to 333).] [SP:P39582] [LE:5904] [RE:6839] [DI:direct] >gp:[GI:e1186348:g2636384] [LN:BSUB0020] [AC:Z99123:AL009126] [GN:ywaB] [FN:unknown] [OR:Bacillus subtilis] [DB:genpept-bct1] [DE:Bacillus subtilis complete genome (section 20 of 21): from 3798401to 4010550.] [NT:alternate gene name: ipa-6d; similar to quinone] [SP:P39582] [LE:151120] [RE:152055] [DI:complement]

| ORF Name | NTID | AAID | NT Length | AA Length | score | probability |
|---|---|---|---|---|---|---|
| AI7503000991_23438827_c3_566 | 1978 | 5750 | 129 | 42 | | |

Description
NO-HIT

| ORF Name | NTID | AAID | NT Length | AA Length | score | probability |
|---|---|---|---|---|---|---|
| AI7503000991_23535910_c1_391 | 1979 | 5751 | 603 | 200 | 499 | 9.8e-48 |

Description
gp:[GI:g4185300] [LN:AF089862] [AC:AF089862] [PN:unknown] [OR:Staphylococcus carnosus] [DB:genpept-bct2] [DE:Staphylococcus carnosus type-I signal peptidase SipA (sipA) andtype-I signal peptidase SipB (sipB) genes, complete cds; andunknown gene.] [NT:Orf1; similar to Bacillus subtilis yhjE] [LE:271] [RE:948] [DI:direct]

| ORF_Name | NTID | AAID | NT Length | AA Length | score | probability |
|---|---|---|---|---|---|---|
| AI7503000991_23593932_f2_166 | 1980 | 5752 | 126 | 41 | | |

Description
NO-HIT

| ORF_Name | NTID | AAID | NT Length | AA Length | score | probability |
|---|---|---|---|---|---|---|
| AI7503000991_23611563_c3_600 | 1981 | 5753 | 141 | 46 | | |

Description
NO-HIT

| ORF_Name | NTID | AAID | NT Length | AA Length | score | probability |
|---|---|---|---|---|---|---|
| AI7503000991_23625637_c2_526 | 1982 | 5754 | 183 | 60 | | |

Description
NO-HIT

| ORF_Name | NTID | AAID | NT Length | AA Length | score | probability |
|---|---|---|---|---|---|---|
| AI7503000991_23634641_c1_398 | 1983 | 5755 | 1248 | 415 | 1475 | 3.7e-151 |

Description
pir:[LN:G69842] [AC:G69842 ] [PN:3-oxoacyl-[acyl-carrier-protein] synthase,] [GN:yjaY ]
[CL:3-oxoacyl-[acyl-carrier-protein] synthase I: 3-oxoacyl-[acyl-carrier-protein]
synthase I homology] [OR:Bacillus subtilis] [EC:2.3.1.41] [DB:pir2]
>gp:[GI:e1183137:g2633471] [LN:BSUB0006] [AC:Z99109:AL009126] [GN:yjaY] [FN:unknown]
[OR:Bacillus subtilis] [DB:genpept-bct1] [DE:Bacillus subtilis complete genome (section
6 of 21): from 999501 to1209940.] [NT:similar to 3-oxoacyl- acyl-carrier protein]
[LE:209150] [RE:210391] [DI:direct] >gp:[GI:e1183154:g2633488] [LN:BSUB0007]
[AC:Z99110:AL009126] [GN:yjaY] [FN:unknown] [OR:Bacillus subtilis] [DB:genpept-bct1]
[DE:Bacillus subtilis complete genome (section 7 of 21): from 1194391to 1411140.]
[NT:similar to 3-oxoacyl- acyl-carrier protein] [LE:14260] [RE:15501] [DI:direct]

| ORF_Name | NTID | AAID | NT Length | AA Length | score | probability |
|---|---|---|---|---|---|---|
| AI7503000991_23678800_c3_561 | 1984 | 5756 | 399 | 132 | 395 | 1.0e-36 |

Description
pir:[LN:H69841] [AC:H69841 ] [PN:conserved hypothetical protein yitW] [GN:yitW ]
[CL:conserved hypothetical protein MJ1129] [OR:Bacillus subtilis] [DB:pir2]
>gp:[GI:e261991:g1620928] [LN:BS168NPRB] [AC:Z79580] [GN:putative orf] [FN:unknown]
[OR:Bacillus subtilis] [DB:genpept-bct1] [DE:B.subtilis nprB gene.] [LE:6256] [RE:6564]
[DI:direct] >gp:[GI:e1183118:g2633452] [LN:BSUB0006] [AC:Z99109:AL009126] [GN:yitW]
[FN:unknown] [OR:Bacillus subtilis] [DB:genpept-bct1] [DE:Bacillus subtilis complete
genome (section 6 of 21): from 999501 to1209940.] [NT:similar to hypothetical proteins]
[LE:192227] [RE:192535] [DI:direct] >gp:[GI:e1173550:g2145417] [LN:BSY09476]
[AC:Y09476] [PN:YitW] [OR:Bacillus subtilis] [DB:genpept-bct1] [DE:B.subtilis 54kb
genomic DNA fragment.] [NT:putative orf] [LE:49453] [RE:49761] [DI:direct]

| ORF_Name | NTID | AAID | NT Length | AA Length | score | probability |
|---|---|---|---|---|---|---|
| AI7503000991_2392300_f2_176 | 1985 | 5757 | 138 | 45 | | |

Description
NO-HIT

| ORF_Name | NTID | AAID | NT Length | AA Length | score | probability |
|---|---|---|---|---|---|---|
| AI7503000991_24022191_f2_232 | 1986 | 5758 | 222 | 73 | 97 | 3.9e-05 |

Description
pir:[LN:G69854] [AC:G69854 ] [PN:hypothetical protein yjzD] [GN:yjzD ] [OR:Bacillus subtilis] [DB:pir2] >gp:[GI:e1183130:g2633464] [LN:BSUB0006] [AC:Z99109:AL009126] [GN:yjzD] [FN:unknown] [OR:Bacillus subtilis] [DB:genpept-bct1] [DE:Bacillus subtilis complete genome (section 6 of 21): from 999501 to1209940.] [LE:204697] [RE:204882] [DI:complement] >gp:[GI:e1183147:g2633481] [LN:BSUB0007] [AC:Z99110:AL009126] [GN:yjzD] [FN:unknown] [OR:Bacillus subtilis] [DB:genpept-bct1] [DE:Bacillus subtilis complete genome (section 7 of 21): from 1194391to 1411140.] [LE:9807] [RE:9992] [DI:complement] >gp:[GI:d1023798:g2564027] [LN:D86376] [AC:D86376] [OR:Bacillus subtilis] [SR:Bacillus subtilis (strain:CU741) DNA] [DB:genpept-bct1] [DE:Bacillus subtilis ArgF and med genes, partial and complete cds.] [NT:unnamed protein product] [LE:1027] [RE:1212] [DI:complement]

| ORF_Name | NTID | AAID | NT Length | AA Length | score | probability |
|---|---|---|---|---|---|---|
| AI7503000991_24024142_c2_496 | 1987 | 5759 | 315 | 104 | 93 | 0.00010 |

Description
gp:[GI:g2654481] [LN:BFU89914] [AC:U89914] [PN:hypothetical 10.1 kDa protein] [OR:Bacillus firmus] [DB:genpept-bct2] [DE:Bacillus firmus hypothetical 34.0 kDa protein, hypothetical 8.9 kDaprotein, hypothetical 10.1 kDa protein, hypothetical 21.0 kDaprotein, putative thiosulfate sulfurtransferase, hypothetical 16.1kDa transcriptional regulator and hypothetical 18.2 kDa proteingenes, complete cds, and Na+/H+ antiporter homolog gene, partialcds.] [NT:orf4] [LE:1601] [RE:1882] [DI:direct]

| ORF_Name | NTID | AAID | NT Length | AA Length | score | probability |
|---|---|---|---|---|---|---|
| AI7503000991_24070137_c3_602 | 1988 | 5760 | 150 | 49 | | |

Description
NO-HIT

| ORF_Name | NTID | AAID | NT Length | AA Length | score | probability |
|---|---|---|---|---|---|---|
| AI7503000991_24105342_c1_448 | 1989 | 5761 | 831 | 276 | 1242 | 1.8e-126 |

Description
pir:[LN:F69656] [AC:F69656:A42715:S27512 ] [PN:naphthoate synthase, menB:DHNA synthase:dihydroxynaphthoate synthase: dihydroxynapthoic acid synthetase menB:menaquinone biosynthesis enzyme/enoyl CoA hydratase homolog] [GN:menB ] [CL:naphthoate synthase:enoyl-CoA hydratase homology] [OR:Bacillus subtilis] [EC:4.1.3.36] [DB:pir2] >gp:[GI:e1185953:g2635564] [LN:BSUB0016] [AC:Z99119:AL009126] [PN:dihydroxynapthoic acid synthetase] [GN:menB] [FN:menaquinone biosynthesis] [OR:Bacillus subtilis] [DB:genpept-bct1] [EC:4.1.3.36] [DE:Bacillus subtilis complete genome (section 16 of 21): from 2997771to 3213410.] [LE:150211] [RE:151026] [DI:complement] >gp:[GI:g2293148] [LN:AF008220] [AC:AF008220] [PN:dihydroxynaphthoate synthase] [GN:menB] [OR:Bacillus subtilis] [DB:genpept-bct2] [DE:Bacillus subtilis rrnB-dnaB genomic region.] [LE:29401] [RE:30216] [DI:direct]

| ORF_Name | NTID | AAID | NT Length | AA Length | score | probability |
|---|---|---|---|---|---|---|
| AI7503000991_24225010_c2_536 | 1990 | 5762 | 168 | 55 | | |

Description
NO-HIT

| ORF Name | NTID | AAID | NT Length | AA Length | score | probability |
|---|---|---|---|---|---|---|
| AI7503000991_24270451_c1_432 | 1991 | 5763 | 135 | 44 | | |

Description
NO-HIT

| ORF Name | NTID | AAID | NT Length | AA Length | score | probability |
|---|---|---|---|---|---|---|
| AI7503000991_24409428_c1_438 | 1992 | 5764 | 258 | 85 | 357 | 1.1e-32 |

Description
gp:[GI:g1731452] [LN:SAU38429] [AC:U38429] [PN:recombination protein] [GN:pre]
[OR:Staphylococcus aureus] [DB:genpept-bct1] [DE:Staphylococcus aureus chloramphenicol
resistance plasmid pKH7,complete sequence.] [LE:2074] [RE:3285] [DI:direct]

| ORF Name | NTID | AAID | NT Length | AA Length | score | probability |
|---|---|---|---|---|---|---|
| AI7503000991_24412517_c3_581 | 1993 | 5765 | 393 | 130 | 213 | 1.2e-16 |

Description
sp:[LN:G6PD_BACSU] [AC:P54547] [GN:ZWF] [OR:BACILLUS SUBTILIS] [EC:1.1.1.49]
[DE:PROTEIN 11) (VEG11)] [SP:P54547] [DB:swissprot] >pir:[LN:B69964] [AC:B69964 ]
[PN:probable glucose-6-phosphate 1-dehydrogenase, yqjJ] [GN:yqjJ ]
[CL:glucose-6-phosphate dehydrogenase] [OR:Bacillus subtilis] [EC:1.1.1.49] [DB:pir2]
>gp:[GI:d1013296:g1303961] [LN:BACJH642] [AC:D84432:D82370] [PN:YqjJ] [OR:Bacillus
subtilis] [SR:Bacillus subtilis (strain:JH642(trpC2 PheA1)) DNA] [DB:genpept-bct1]
[DE:Bacillus subtilis DNA, 283 Kb region containing skin element.] [LE:239025]
[RE:240494] [DI:complement] >gp:[GI:e1185654:g2634820] [LN:BSUB0013]
[AC:Z99116:AL009126] [GN:yqjJ] [FN:unknown] [OR:Bacillus subtilis] [DB:genpept-bct1]
[DE:Bacillus subtilis complete genome (section 13 of 21): from 2395261to 2613730.]
[NT:similar to glucose-6-phosphate 1-dehydrogenase] [SP:P54547] [LE:83125] [RE:84594]
[DI:direct]

| ORF Name | NTID | AAID | NT Length | AA Length | score | probability |
|---|---|---|---|---|---|---|
| AI7503000991_24415632_c1_393 | 1994 | 5766 | 579 | 192 | 827 | 1.7e-82 |

Description
sp:[LN:LEP_STAAU] [AC:P72365] [GN:SPSB] [OR:STAPHYLOCOCCUS AUREUS] [EC:3.4.21.89]
[DE:SIGNAL PEPTIDASE IB, (SPASE IB) (LEADER PEPTIDASE IB)] [SP:P72365] [DB:swissprot]
>gp:[GI:g1595810] [LN:SAU65000] [AC:U65000] [PN:type-I signal peptidase SpsB] [GN:spsB]
[OR:Staphylococcus aureus] [DB:genpept-bct2] [DE:Staphylococcus aureus type-I signal
peptidase SpsA (spsA) gene, andtype-I signal peptidase SpsB (spsB) gene, complete cds.]
[NT:signal peptidase, leader peptidase, serine] [LE:580] [RE:1155] [DI:direct]

| ORF Name | NTID | AAID | NT Length | AA Length | score | probability |
|---|---|---|---|---|---|---|
| AI7503000991_24416702_f2_125 | 1995 | 5767 | 4008 | 1335 | 7001 | 0.0 |

Description
gp:[GI:g2267242] [LN:SEU71377] [AC:U71377] [PN:autolysin AtlE] [OR:Staphylococcus
epidermidis] [DB:genpept-bct1] [DE:Staphylococcus epidermidis autolysin AtlE and
putativetranscriptional regulator AtlR genes, complete cds.] [NT:primary attachment to
a polystyrene surface] [LE:2620] [RE:6627] [DI:direct]

| ORF Name | NTID | AAID | NT Length | AA Length | score | probability |
|---|---|---|---|---|---|---|
| AI7503000991_24428543_f3_297 | 1996 | 5768 | 174 | 57 | 72 | 0.017 |

Description
gp:[GI:g153715] [LN:STRMLIKEE] [AC:L05021] [PN:M-like protein] [OR:Streptococcus
pyogenes] [SR:Streptococcus pyogenes DNA] [DB:genpept-bct1] [DE:Streptococcus pyogenes
M-like protein gene, partial cds.] [LE:<1] [RE:>243] [DI:direct]

| ORF Name | NTID | AAID | NT Length | AA Length | score | probability |
|---|---|---|---|---|---|---|
| AI7503000991_24475252_f3_289 | 1997 | 5769 | 159 | 52 | | |

Description
NO-HIT

| ORF Name | NTID | AAID | NT Length | AA Length | score | probability |
|---|---|---|---|---|---|---|
| AI7503000991_24646886_c3_594 | 1998 | 5770 | 1557 | 518 | 296 | 2.0e-23 |

Description
pir:[LN:B71973] [AC:B71973 ] [PN:2',3'-cyclic-nucleotide 2'-phosphodiesterase] [GN:cpdB ] [CL:2',3'-cyclic-nucleotide 2'-phosphodiesterase: 2',3'-cyclic-nucleotide 2'-phosphodiesterase homology:phosphoesterase core homology] [OR:Helicobacter pylori] [SR:strain J99, , strain J99] [SR:strain J99, ] [DB:pir2] >gp:[GI:g4154615] [LN:AE001449] [AC:AE001449:AE001439] [PN:2',3'-CYCLIC-NUCLEOTIDE 2'-PHOSPHODIESTERASE] [GN:cpdB] [OR:Helicobacter pylori J99] [DB:genpept-bct2] [DE:Helicobacter pylori, strain J99 section 10 of 132 of the completegenome.] [NT:similar to H. pylori 26695 gene HP0104] [LE:139] [RE:1884] [DI:complement]

| ORF Name | NTID | AAID | NT Length | AA Length | score | probability |
|---|---|---|---|---|---|---|
| AI7503000991_24648412_c1_406 | 1999 | 5771 | 642 | 213 | 683 | 3.1e-67 |

Description
pir:[LN:E69844] [AC:E69844 ] [PN:GTP pyrophosphokinase homolog yjbM] [GN:yjbM ] [CL:GTP pyrophosphokinase related protein] [OR:Bacillus subtilis] [DB:pir2]
>gp:[GI:e1183180:g2633514] [LN:BSUB0007] [AC:Z99110:AL009126] [GN:yjbM] [FN:unknown] [OR:Bacillus subtilis] [DB:genpept-bct1] [DE:Bacillus subtilis complete genome (section 7 of 21): from 1194391to 1411140.] [NT:similar to GTP pyrophosphokinase] [LE:42087] [RE:42722] [DI:direct]

| ORF Name | NTID | AAID | NT Length | AA Length | score | probability |
|---|---|---|---|---|---|---|
| AI7503000991_24745437_c3_539 | 2000 | 5772 | 1263 | 420 | 1659 | 1.2e-170 |

Description
sp:[LN:YPCA_BACSU] [AC:P50735] [GN:YPCA] [OR:BACILLUS SUBTILIS] [EC:1.4.1.-] [DE:(EC 1.4.1.-)] [SP:P50735] [DB:swissprot] >pir:[LN:G69933] [AC:G69933 ] [PN:glutamate dehydrogenase homolog ypcA] [GN:ypcA ] [CL:glutamate dehydrogenase (NAD(P)+)] [OR:Bacillus subtilis] [DB:pir2] >gp:[GI:e1183741:g2634714] [LN:BSUB0012] [AC:Z99115:AL009126] [GN:ypcA] [FN:unknown] [OR:Bacillus subtilis] [DB:genpept-bct1] [DE:Bacillus subtilis complete genome (section 12 of 21): from 2195541to 2409220.] [NT:similar to glutamate dehydrogenase] [SP:P50735] [LE:205764] [RE:207044] [DI:complement] >gp:[GI:e1185565:g2634731] [LN:BSUB0013] [AC:Z99116:AL009126] [GN:ypcA] [FN:unknown] [OR:Bacillus subtilis] [DB:genpept-bct1] [DE:Bacillus subtilis complete genome (section 13 of 21): from 2395261to 2613730.] [NT:similar to glutamate dehydrogenase] [SP:P50735] [LE:6044] [RE:7324] [DI:complement] >gp:[GI:g1146206] [LN:BACSERA] [AC:L47648] [PN:glutamate dehydrogenase] [GN:ypcA] [OR:Bacillus subtilis] [DB:genpept-bct2] [DE:Bacillus subtilis phosphoglycerate dehydrogenase (serA), ypaA,ferredoxin (fer), ypbB, recS, ypbD, ypbE, ypbF, ypbG, ypbH,glutamate dehydrogenase (ypcA), ypdA, ypdB, ypdC, spore cortexlytic enzyme (sleB), ypeB, ypfA, ypfB, cytidine monophosphatekinase (cmk), ypfD, ypgA, yphA, yphB, yphC, NAD+ dependentglycerol-3-phosphate dehydrogenase (glyc), yphE and yphF genes,complete cds.] [NT:similar to Clostridium difficile glutamate] [LE:9353] [RE:10633] [DI:direct]

| ORF Name | NTID | AAID | NT Length | AA Length | score | probability |
|---|---|---|---|---|---|---|
| AI7503000991_24804677_c3_597 | 2001 | 5773 | 366 | 121 | 117 | 1.5e-06 |

Description
gp:[GI:g2541936] [LN:PSU27310] [AC:U27310] [PN:unknown] [OR:Pseudomonas syringae] [DB:genpept-bct2] [DE:Pseudomonas syringae phaseolotoxin gene cluster, complete sequence.] [NT:ORF6; similar to Pseudomonas syringae fatty acid] [LE:5079] [RE:6062] [DI:direct]

| ORF Name | NTID | AAID | NT Length | AA Length | score | probability |
|---|---|---|---|---|---|---|
| AI7503000991_25392826_f2_175 | 2002 | 5774 | 1146 | 381 | 557 | 7.0e-54 |

Description
pir:[LN:G70007] [AC:G70007 ] [PN:conserved hypothetical protein yueF] [GN:yueF ] [CL:Bacillus subtilis conserved hypothetical protein yueF] [OR:Bacillus subtilis] [DB:pir2] >gp:[GI:e1184257:g2635675] [LN:BSUB0017] [AC:Z99120:AL009126] [GN:yueF] [FN:unknown] [OR:Bacillus subtilis] [DB:genpept-bct1] [DE:Bacillus subtilis complete genome (section 17 of 21): from 3197001to 3414420.] [NT:similar to hypothetical proteins] [LE:64687] [RE:65796] [DI:complement]

| ORF Name | NTID | AAID | NT Length | AA Length | score | probability |
|---|---|---|---|---|---|---|
| AI7503000991_25429512_c3_593 | 2003 | 5775 | 1392 | 463 | 1130 | 1.3e-114 |

Description
pir:[LN:H69862] [AC:H69862 ] [PN:Na+-transporting ATP synthase homolog ykrM] [GN:ykrM ] [CL:Na+-ATP synthase chain J] [OR:Bacillus subtilis] [DB:pir2] >gp:[GI:e1184940:g2633721] [LN:BSUB0008] [AC:Z99111:AL009126] [GN:ykrM] [FN:unknown] [OR:Bacillus subtilis] [DB:genpept-bct1] [DE:Bacillus subtilis complete genome (section 8 of 21): from 1394791to 1603020.] [NT:similar to Na+-transporting ATP synthase] [LE:20743] [RE:22092] [DI:direct]

| ORF Name | NTID | AAID | NT Length | AA Length | score | probability |
|---|---|---|---|---|---|---|
| AI7503000991_25430316_c2_522 | 2004 | 5776 | 171 | 56 | 171 | 5.6e-13 |

Description
pir:[LN:QQSA8T] [AC:A04493 ] [PN:hypothetical protein B-189] [OR:Staphylococcus aureus] [DB:pir1]

| ORF Name | NTID | AAID | NT Length | AA Length | score | probability |
|---|---|---|---|---|---|---|
| AI7503000991_26178400_c3_542 | 2005 | 5777 | 186 | 61 | 71 | 0.042 |

Description
sp:[LN:AOPP_HUMAN] [AC:P30044] [OR:HOMO SAPIENS] [SR:,HUMAN] [DE:71B)] [SP:P30044] [DB:swissprot]

| ORF Name | NTID | AAID | NT Length | AA Length | score | probability |
|---|---|---|---|---|---|---|
| AI7503000991_26212787_f3_335 | 2006 | 5778 | 612 | 203 | 308 | 1.7e-27 |

Description
pir:[LN:C69844] [AC:C69844 ] [PN:hypothetical protein yjbK] [GN:yjbK ] [OR:Bacillus subtilis] [DB:pir2] >gp:[GI:e1183178:g2633512] [LN:BSUB0007] [AC:Z99110:AL009126] [GN:yjbK] [FN:unknown] [OR:Bacillus subtilis] [DB:genpept-bct1] [DE:Bacillus subtilis complete genome (section 7 of 21): from 1194391to 1411140.] [LE:40993] [RE:41565] [DI:complement]

| ORF Name | NTID | AAID | NT Length | AA Length | score | probability |
|---|---|---|---|---|---|---|
| AI7503000991_26377340_c2_488 | 2007 | 5779 | 999 | 332 | 208 | 4.6e-15 |

Description
gp:[GI:e257629:g1771202] [LN:LLLVSFPEP] [AC:X99710] [PN:transcription factor]
[OR:Lactococcus lactis] [DB:genpept-bct1] [DE:L.lactis ORF, genes homologous to vsf-1
and pepF2 and gene encodingprotein homologous to methyltransferase.] [NT:weak homology
with vsf-1 gene (X73635)] [LE:934] [RE:1917] [DI:direct]

| ORF Name | NTID | AAID | NT Length | AA Length | score | probability |
|---|---|---|---|---|---|---|
| AI7503000991_26564012_c2_477 | 2008 | 5780 | 2616 | 871 | 2649 | 1.5e-275 |

Description
gp:[GI:g3150046] [LN:AF016634] [AC:AF016634] [PN:ClpB chaperone homolog] [GN:clpB]
[OR:Lactococcus lactis subsp. cremoris] [DB:genpept-bct2] [DE:Lactococcus lactis
cremoris ClpB chaperone homolog (clpB) andphosphoribosylformylglycinamide cyclo-ligase
(pur5) genes, completecds; and phosphoribosylglycinamide formyltransferase (pur3)
gene,partial cds.] [LE:183] [RE:2786] [DI:direct]

| ORF Name | NTID | AAID | NT Length | AA Length | score | probability |
|---|---|---|---|---|---|---|
| AI7503000991_26567557_c3_558 | 2009 | 5781 | 138 | 45 | | |

Description
NO-HIT

| ORF Name | NTID | AAID | NT Length | AA Length | score | probability |
|---|---|---|---|---|---|---|
| AI7503000991_26604662_c2_495 | 2010 | 5782 | 630 | 209 | | |

Description
NO-HIT

| ORF Name | NTID | AAID | NT Length | AA Length | score | probability |
|---|---|---|---|---|---|---|
| AI7503000991_26775637_c1_447 | 2011 | 5783 | 1389 | 462 | 599 | 2.5e-58 |

Description
sp:[LN:MENF_BACSU] [AC:P23973:P23972] [GN:menF:ICSM] [OR:BACILLUS SUBTILIS]
[EC:5.4.99.6] [DE:MENAQUINONE-SPECIFIC ISOCHORISMATE SYNTHASE,] [SP:P23973:P23972]
[DB:swissprot] >pir:[LN:A69657] [AC:A69657:S27507:S27508:I39883 ] [PN:probable
isochorismate synthase, menaquinone-specific menF] [GN:menF ] [CL:isochorismate
synthase] [OR:Bacillus subtilis] [EC:5.4.99.6] [DB:pir2] >gp:[GI:e1185956:g2635567]
[LN:BSUB0016] [AC:Z99119:AL009126] [PN:menaquinone-specific isochorismate synthase]
[GN:menF] [FN:menaquinone biosynthesis] [OR:Bacillus subtilis] [DB:genpept-bct1]
[EC:5.4.99.6] [DE:Bacillus subtilis complete genome (section 16 of 21): from 2997771to
3213410.] [NT:alternate gene name: icsM, entC] [SP:P23973] [LE:153612] [RE:155027]
[DI:complement] >gp:[GI:g2293145] [LN:AF008220] [AC:AF008220] [PN:isochorismate
synthase] [GN:menF] [OR:Bacillus subtilis] [DB:genpept-bct2] [DE:Bacillus subtilis
rrnB-dnaB genomic region.] [LE:25400] [RE:26815] [DI:direct] >gp:[GI:g1185288]
[LN:BACMENAQOP] [AC:M74538:M74182:M74183] [PN:isochorismate synthase] [GN:menF]
[OR:Bacillus subtilis] [SR:Bacillus subtilis (strain RB1) DNA] [DB:genpept-bct2]
[DE:Bacillus subtilis menaquinone operon: menF, menD, menB and menEgenes, complete
cds.] [NT:based on similarity to E. coli EntC, A. hydrophila] [LE:143] [RE:1558]
[DI:direct]

| ORF Name | NTID | AAID | NT Length | AA Length | score | probability |
|---|---|---|---|---|---|---|
| AI7503000991_2848308_c3_607 | 2012 | 5784 | 135 | 44 | | |

Description
NO-HIT

| ORF Name | NTID | AAID | NT Length | AA Length | score | probability |
|---|---|---|---|---|---|---|
| AI7503000991_289802_f2_227 | 2013 | 5785 | 189 | 62 | 89 | 0.0019 |

Description
pir:[LN:F22845] [AC:F22845 ] [PN:hypothetical protein 6] [OR:mitochondrion Trypanosoma brucei] [DB:pir2]

| ORF Name | NTID | AAID | NT Length | AA Length | score | probability |
|---|---|---|---|---|---|---|
| AI7503000991_2922260_c3_574 | 2014 | 5786 | 384 | 127 | 174 | 2.7e-13 |

Description
pir:[LN:D69844] [AC:D69844 ] [PN:hypothetical protein yjbL] [GN:yjbL ] [OR:Bacillus subtilis] [DB:pir2] >gp:[GI:e1183179:g2633513] [LN:BSUB0007] [AC:Z99110:AL009126] [GN:yjbL] [FN:unknown] [OR:Bacillus subtilis] [DB:genpept-bct1] [DE:Bacillus subtilis complete genome (section 7 of 21): from 1194391to 1411140.] [LE:41690] [RE:42058] [DI:direct]

| ORF Name | NTID | AAID | NT Length | AA Length | score | probability |
|---|---|---|---|---|---|---|
| AI7503000991_29335888_c3_562 | 2015 | 5787 | 135 | 44 | | |

Description
NO-HIT

| ORF Name | NTID | AAID | NT Length | AA Length | score | probability |
|---|---|---|---|---|---|---|
| AI7503000991_29570302_f1_24 | 2016 | 5788 | 132 | 43 | | |

Description
NO-HIT

| ORF Name | NTID | AAID | NT Length | AA Length | score | probability |
|---|---|---|---|---|---|---|
| AI7503000991_31281253_c3_538 | 2017 | 5789 | 1221 | 406 | 1513 | 3.5e-155 |

Description
sp:[LN:OAT_BACSU] [AC:P38021] [GN:ROCD] [OR:BACILLUS SUBTILIS] [EC:2.6.1.13] [DE:AMINOTRANSFERASE)] [SP:P38021] [DB:swissprot] >pir:[LN:S55793] [AC:S55793:S49267:B53370:H69693 ] [PN:ornithine--oxo-acid transaminase, rocD:ornithine aminotransferase:ornithine--oxo-acid aminotransferase] [GN:rocD ] [CL:ornithine--oxo-acid aminotransferase] [OR:Bacillus subtilis] [EC:2.6.1.13] [DB:pir2] >gp:[GI:d1011955:g1064807] [LN:BACGNTZA] [AC:D78193] [PN:orthinine aminotransferase] [GN:rocD] [OR:Bacillus subtilis] [SR:Bacillus subtilis (strain:168) DNA] [DB:genpept-bct1] [DE:Bacillus subtilis 36kb sequence between gntZ and trnY genesencoding 34 ORFs.] [LE:25845] [RE:27050] [DI:complement] >gp:[GI:g550311] [LN:BSROCDEF] [AC:X81802] [PN:ornithine< aminotransferase] [GN:rocD] [OR:Bacillus subtilis] [DB:genpept-bct1] [DE:B.subtilis rocD, rocE and rocF genes.] [SP:P38021] [LE:241] [RE:1446] [DI:direct] >gp:[GI:e1184760:g2636581] [LN:BSUB0021] [AC:Z99124:AL009126] [PN:ornithine aminotransferase] [GN:rocD] [FN:arginine and ornithine utilization] [OR:Bacillus subtilis] [DB:genpept-bct1] [EC:2.6.1.13] [DE:Bacillus subtilis complete genome (section 21 of 21): from 3999281to 4214814.] [SP:P38021] [LE:144229] [RE:145434] [DI:complement]

| ORF Name | NTID | AAID | NT Length | AA Length | score | probability |
|---|---|---|---|---|---|---|
| AI7503000991_31300807_c1_436 | 2018 | 5790 | 156 | 51 | | |

Description
NO-HIT

| ORF Name | NTID | AAID | NT Length | AA Length | score | probability |
|---|---|---|---|---|---|---|
| AI7503000991_31525260_c3_579 | 2019 | 5791 | 135 | 44 | | |

Description
NO-HIT

| ORF Name | NTID | AAID | NT Length | AA Length | score | probability |
|---|---|---|---|---|---|---|
| AI7503000991_32062875_c1_439 | 2020 | 5792 | 291 | 96 | 333 | 3.8e-30 |

Description
gp:[GI:g1731452] [LN:SAU38429] [AC:U38429] [PN:recombination protein] [GN:pre] [OR:Staphylococcus aureus] [DB:genpept-bct1] [DE:Staphylococcus aureus chloramphenicol resistance plasmid pKH7,complete sequence.] [LE:2074] [RE:3285] [DI:direct]

| ORF Name | NTID | AAID | NT Length | AA Length | score | probability |
|---|---|---|---|---|---|---|
| AI7503000991_32067937_f2_247 | 2021 | 5793 | 1365 | 454 | 1790 | 1.5e-184 |

Description
gp:[GI:g2792490] [LN:AF041467] [AC:AF041467] [PN:coenzyme A disulfide reductase] [FN:pyridine nucleotide disulfide oxidoreductase] [OR:Staphylococcus aureus] [DB:genpept-bct2] [DE:Staphylococcus aureus coenzyme A disulfide reductase gene, completecds.] [NT:CoADR; flavoenzyme (FAD); single catalytic cysteine] [LE:66] [RE:1382] [DI:direct]

| ORF Name | NTID | AAID | NT Length | AA Length | score | probability |
|---|---|---|---|---|---|---|
| AI7503000991_32132183_c1_455 | 2022 | 5794 | 132 | 43 | | |

Description
NO-HIT

| ORF Name | NTID | AAID | NT Length | AA Length | score | probability |
|---|---|---|---|---|---|---|
| AI7503000991_32457312_c2_501 | 2023 | 5795 | 495 | 164 | 233 | 1.5e-19 |

Description
gp:[GI:e303881:g1850807] [LN:CPCPEAA] [AC:X71844] [PN:putative transposase] [OR:Clostridium perfringens] [DB:genpept-bct1] [DE:C.perfringens uapC, cpe, and nadC genes.] [LE:2477] [RE:2932] [DI:direct]

| ORF Name | NTID | AAID | NT Length | AA Length | score | probability |
|---|---|---|---|---|---|---|
| AI7503000991_32635937_c1_429 | 2024 | 5796 | 1503 | 500 | 2239 | 4.1e-232 |

Description
gp:[GI:e1301684:g3256223] [LN:SAY14370] [AC:Y14370] [PN:UDP-N-acetylmuramyl-tripeptide synthetase] [GN:murE] [OR:Staphylococcus aureus] [DB:genpept-bct1] [DE:Staphylococcus aureus RF3, murE, ypfP genes.] [LE:3244] [RE:4722] [DI:complement]

| ORF Name | NTID | AAID | NT Length | AA Length | score | probability |
|---|---|---|---|---|---|---|
| AI7503000991_33364067_c1_431 | 2025 | 5797 | 1782 | 593 | 542 | 2.7e-52 |

Description
gp:[GI:g2109443] [LN:SPDNAARG] [AC:AF000658] [PN:putative serine protease] [GN:sphtra] [OR:Streptococcus pneumoniae] [DB:genpept-bct2] [DE:Streptococcus pneumoniae R801 tRNA-Arg gene, partial sequence, andputative serine protease (sphtra), SPSpoJ (spspoJ), initiatorprotein (spdnaa) and beta subunit of DNA polymerase III (spdnan)genes, complete cds.] [NT:SPHtra] [LE:765] [RE:1958] [DI:direct]

| ORF Name | NTID | AAID | NT Length | AA Length | score | probability |
|---|---|---|---|---|---|---|
| AI7503000991_3371067_c2_482 | 2026 | 5798 | 954 | 317 | 1033 | 2.5e-104 |

Description
pir:[LN:E38447] [AC:E38447:S15234:C69669 ] [PN:oligopeptide transport ATP-binding protein oppF:sporulation initiation protein spo0KE] [GN:spo0KE:oppF ] [CL:inner membrane protein malK:ATP-binding cassette homology] [OR:Bacillus subtilis] [DB:pir2] >gp:[GI:g143608] [LN:BACSPO0K] [AC:M57689] [PN:sporulation protein] [GN:spo0KE] [OR:Bacillus subtilis] [SR:B.subtilis (strain JH642) DNA, clones pDR20/21, pJL2/3 and pJL7] [DB:genpept-bct1] [DE:Bacillus subtilis spo0K operon.] [LE:5152] [RE:6078] [DI:direct]

| ORF Name | NTID | AAID | NT Length | AA Length | score | probability |
|---|---|---|---|---|---|---|
| AI7503000991_33710968_f2_124 | 2027 | 5799 | 453 | 150 | 742 | 1.7e-73 |

Description
gp:[GI:g2267241] [LN:SEU71377] [AC:U71377] [OR:Staphylococcus epidermidis] [DB:genpept-bct1] [DE:Staphylococcus epidermidis autolysin AtlE and putativetranscriptional regulator AtlR genes, complete cds.] [NT:ORF3] [LE:1957] [RE:2379] [DI:direct]

| ORF Name | NTID | AAID | NT Length | AA Length | score | probability |
|---|---|---|---|---|---|---|
| AI7503000991_3394540_f2_138 | 2028 | 5800 | 312 | 103 | | |

Description
NO-HIT

| ORF Name | NTID | AAID | NT Length | AA Length | score | probability |
|---|---|---|---|---|---|---|
| AI7503000991_34006561_f3_312 | 2029 | 5801 | 150 | 49 | | |

Description
NO-HIT

| ORF Name | NTID | AAID | NT Length | AA Length | score | probability |
|---|---|---|---|---|---|---|
| AI7503000991_34062930_c1_440 | 2030 | 5802 | 273 | 90 | 290 | 1.4e-25 |

Description
sp:[LN:PRE3_STAAU] [AC:P03864] [OR:STAPHYLOCOCCUS AUREUS] [DE:PLASMID RECOMBINATION ENZYME (MOBILIZATION PROTEIN)] [SP:P03864] [DB:swissprot] >gp:[GI:g151683] [LN:PT1CG] [AC:J01764:J01765] [OR:Plasmid pT181] [SR:Plasmid pT181 DNA from Staphylococcus aureus] [DB:genpept-bct1] [DE:Plasmid pT181, complete genome.] [NT:Pre protein (plasmid recombination)] [LE:2521] [RE:3762] [DI:direct]

| ORF Name | NTID | AAID | NT Length | AA Length | score | probability |
|---|---|---|---|---|---|---|
| AI7503000991_34073552_c2_509 | 2031 | 5803 | 1545 | 514 | 2291 | 1.3e-237 |

Description
gp:[GI:e1301683:g3256222] [LN:SAY14370] [AC:Y14370] [PN:peptide chain release factor 3] [GN:RF3] [OR:Staphylococcus aureus] [DB:genpept-bct1] [DE:Staphylococcus aureus RF3, murE, ypfP genes.] [LE:1435] [RE:3000] [DI:complement]

| ORF Name | NTID | AAID | NT Length | AA Length | score | probability |
|---|---|---|---|---|---|---|
| AI7503000991_34163562_f3_322 | 2032 | 5804 | 486 | 161 | 329 | 1.0e-29 |

Description
pir:[LN:D69583] [AC:D69583 ] [PN:alcohol dehydrogenase, adhB] [GN:adhB ] [CL:alcohol dehydrogenase:long-chain alcohol dehydrogenase homology] [OR:Bacillus subtilis] [EC:1.1.1.1] [DB:pir2] >gp:[GI:e209890:g2108273] [LN:BS233DEG] [AC:X92868:X79978] [PN:NAD alcohol dehydrogenase] [GN:adhB] [OR:Bacillus subtilis] [DB:genpept-bct1] [DE:B.subtilis 23.9kb fragment from map position 233 degrees on thechromosome.] [LE:13725] [RE:14861] [DI:complement] >gp:[GI:e1183926:g2635142] [LN:BSUB0014] [AC:Z99117:AL009126] [PN:alcohol dehydrogenase] [GN:adhB] [OR:Bacillus subtilis] [DB:genpept-bct1] [DE:Bacillus subtilis complete genome (section 14 of 21): from 2599451to 2812870.] [LE:153270] [RE:154406] [DI:direct]

| ORF Name | NTID | AAID | NT Length | AA Length | score | probability |
|---|---|---|---|---|---|---|
| AI7503000991_34179031_f2_122 | 2033 | 5805 | 135 | 44 | | |

Description
NO-HIT

| ORF Name | NTID | AAID | NT Length | AA Length | score | probability |
|---|---|---|---|---|---|---|
| AI7503000991_34398505_f3_354 | 2034 | 5806 | 222 | 73 | | |

Description
NO-HIT

| ORF Name | NTID | AAID | NT Length | AA Length | score | probability |
|---|---|---|---|---|---|---|
| AI7503000991_34407888_c3_572 | 2035 | 5807 | 729 | 242 | 288 | 1.9e-37 |

Description
gp:[GI:g2952027] [LN:BFU88888] [AC:U88888] [PN:MecA homolog] [GN:mecA] [OR:Bacillus firmus] [DB:genpept-bct2] [DE:Bacillus firmus MecA homolog (mecA) and cardiolipin synthase (cls)genes, complete cds.] [LE:349] [RE:1002] [DI:direct]

| ORF Name | NTID | AAID | NT Length | AA Length | score | probability |
|---|---|---|---|---|---|---|
| AI7503000991_35158177_c1_408 | 2036 | 5808 | 1407 | 468 | 903 | 1.5e-90 |

Description
gp:[GI:d1039121:g4514345] [LN:AB013374] [AC:AB013374] [PN:Ykok] [GN:ykoK] [OR:Bacillus halodurans] [SR:Bacillus halodurans (strain:C-125) DNA] [DB:genpept-bct1] [DE:Bacillus halodurans C-125 mamX, yjdA, ykoK and yvfK genes, partialand complete cds.] [LE:1793] [RE:3142] [DI:complement]

| ORF Name | NTID | AAID | NT Length | AA Length | score | probability |
|---|---|---|---|---|---|---|
| AI7503000991_35937827_c2_505 | 2037 | 5809 | 510 | 169 | 343 | 3.3e-31 |

Description
pir:[LN:G69846] [AC:G69846 ] [PN:hypothetical protein yjcG] [GN:yjcG ] [OR:Bacillus subtilis] [DB:pir2] >gp:[GI:e1183205:g2633539] [LN:BSUB0007] [AC:Z99110:AL009126] [GN:yjcG] [FN:unknown] [OR:Bacillus subtilis] [DB:genpept-bct1] [DE:Bacillus subtilis complete genome (section 7 of 21): from 1194391to 1411140.] [LE:61943] [RE:62458] [DI:complement]

| ORF_Name | NTID | AAID | NT Length | AA Length | score | probability |
|---|---|---|---|---|---|---|
| AI7503000991_36128387_c3_621 | 2038 | 5810 | 165 | 55 | | |

Description
NO-HIT

| ORF_Name | NTID | AAID | NT Length | AA Length | score | probability |
|---|---|---|---|---|---|---|
| AI7503000991_36134717_c1_401 | 2039 | 5811 | 1647 | 548 | 889 | 4.6e-89 |

Description
pir:[LN:A53310] [AC:A53310 ] [PN:pheromone cAD1 binding protein precursor:TraC]
[GN:traC ] [CL:dipeptide transport protein] [OR:Enterococcus faecalis] [DB:pir2]
>gp:[GI:g388269] [LN:AD1TRAC] [AC:L19532] [GN:traC] [OR:Plasmid pAD1] [SR:Plasmid pAD1
DNA] [DB:genpept-bct1] [DE:Plasmid pAD1 (from Enterococcus faecalis strain: DS16)
hemolysinbacteriocin (traC) gene, complete cds, traA and traB genes, 3' end.] [LE:166]
[RE:1797] [DI:direct]

| ORF_Name | NTID | AAID | NT Length | AA Length | score | probability |
|---|---|---|---|---|---|---|
| AI7503000991_36229625_f3_295 | 2040 | 5812 | 204 | 67 | 195 | 1.6e-15 |

Description
pir:[LN:B69869] [AC:B69869 ] [PN:hypothetical protein ykvS] [GN:ykvS ] [OR:Bacillus
subtilis] [DB:pir2] >gp:[GI:e1184971:g2633752] [LN:BSUB0008] [AC:Z99111:AL009126]
[GN:ykvS] [FN:unknown] [OR:Bacillus subtilis] [DB:genpept-bct1] [DE:Bacillus subtilis
complete genome (section 8 of 21): from 1394791to 1603020.] [LE:52338] [RE:52769]
[DI:complement]

| ORF_Name | NTID | AAID | NT Length | AA Length | score | probability |
|---|---|---|---|---|---|---|
| AI7503000991_36611062_c3_557 | 2041 | 5813 | 420 | 139 | 174 | 2.7e-13 |

Description
pir:[LN:D69837] [AC:D69837 ] [PN:hypothetical protein yisL] [GN:yisL ] [OR:Bacillus
subtilis] [DB:pir2] >gp:[GI:e1183078:g2633412] [LN:BSUB0006] [AC:Z99109:AL009126]
[GN:yisL] [FN:unknown] [OR:Bacillus subtilis] [DB:genpept-bct1] [DE:Bacillus subtilis
complete genome (section 6 of 21): from 999501 to1209940.] [LE:153237] [RE:153593]
[DI:direct] >gp:[GI:e1173510:g2145377] [LN:BSY09476] [AC:Y09476] [PN:YisL] [OR:Bacillus
subtilis] [DB:genpept-bct1] [DE:B.subtilis 54kb genomic DNA fragment.] [NT:putative]
[LE:10463] [RE:10819] [DI:direct]

| ORF_Name | NTID | AAID | NT Length | AA Length | score | probability |
|---|---|---|---|---|---|---|
| AI7503000991_37777_c1_434 | 2042 | 5814 | 168 | 55 | | |

Description
NO-HIT

| ORF Name | NTID | AAID | NT Length | AA Length | score | probability |
|---|---|---|---|---|---|---|
| AI7503000991_3954718_c1_394 | 2043 | 5815 | 3489 | 1162 | 1331 | 6.7e-136 |

Description
sp:[LN:ADDB_BACSU] [AC:P23477] [GN:ADDB] [OR:BACILLUS SUBTILIS] [DE:ATP-DEPENDENT NUCLEASE SUBUNIT B] [SP:P23477] [DB:swissprot] >pir:[LN:A39432] [AC:A39432:S61272:A69583 ] [PN:ATP-dependent deoxyribonuclease chain B addB:ATP-dependent exonuclease synthesis protein AddB] [GN:addB ] [OR:Bacillus subtilis] [DB:pir2] >gp:[GI:g142439] [LN:BACADDAA] [AC:M63489] [PN:ATP-dependent nuclease] [GN:addA] [OR:Bacillus subtilis] [SR:B.subtilis DNA] [DB:genpept-bct1] [DE:Bacillus subtilis ATP-dependent nuclease (addA) and (addB), andopen reading frame 3, partial cds.] [LE:502] [RE:4002] [DI:direct] >gp:[GI:e1183064:g2633398] [LN:BSUB0006] [AC:Z99109:AL009126] [PN:ATP-dependent deoxyribonuclease (subunit B)] [GN:addB] [OR:Bacillus subtilis] [DB:genpept-bct1] [DE:Bacillus subtilis complete genome (section 6 of 21): from 999501 to1209940.] [SP:P23477] [LE:136293] [RE:139793] [DI:direct] >gp:[GI:e1364880:g2226191] [LN:BSY14081] [AC:Y14081] [PN:ATP-dependent nuclease] [GN:addB] [OR:Bacillus subtilis] [DB:genpept-bct1] [DE:Bacillus subtilis chromosomal DNA, region 92 degrees: regionbetween comK and addAB.] [NT:TTG start; see ref [3]; In EMBL entry M63489 this] [LE:18588] [RE:22088] [DI:direct]

| ORF Name | NTID | AAID | NT Length | AA Length | score | probability |
|---|---|---|---|---|---|---|
| AI7503000991_4019193_c1_418 | 2044 | 5816 | 783 | 260 | 749 | 3.2e-74 |

Description
pir:[LN:G69845] [AC:G69845 ] [PN:enoyl-[acyl-carrier-protein] reductase (NADH), yjbW] [GN:yjbW ] [CL:enoyl-[acyl-carrier-protein] reductase (NADH): short-chain alcohol dehydrogenase homology] [OR:Bacillus subtilis] [EC:1.3.1.9] [DB:pir2] >gp:[GI:e1183192:g2633526] [LN:BSUB0007] [AC:Z99110:AL009126] [GN:yjbW] [FN:unknown] [OR:Bacillus subtilis] [DB:genpept-bct1] [DE:Bacillus subtilis complete genome (section 7 of 21): from 1194391to 1411140.] [NT:similar to enoyl- acyl-carrier protein reductase] [LE:52836] [RE:53645] [DI:direct]

| ORF Name | NTID | AAID | NT Length | AA Length | score | probability |
|---|---|---|---|---|---|---|
| AI7503000991_4070151_c2_472 | 2045 | 5817 | 447 | 148 | 165 | 2.4e-12 |

Description
gp:[GI:e1173495:g2145362] [LN:BSY09476] [AC:Y09476] [PN:AddA] [OR:Bacillus subtilis] [DB:genpept-bct1] [DE:B.subtilis 54kb genomic DNA fragment.] [SP:P23478] [LE:<1] [RE:702] [DI:direct]

| ORF Name | NTID | AAID | NT Length | AA Length | score | probability |
|---|---|---|---|---|---|---|
| AI7503000991_4080443_c1_409 | 2046 | 5818 | 1854 | 617 | 1574 | 1.2e-161 |

Description
pir:[LN:A69845] [AC:A69845 ] [PN:Na+/H+ antiporter homolog yjbQ] [GN:yjbQ ] [OR:Bacillus subtilis] [DB:pir2] >gp:[GI:e1183184:g2633518] [LN:BSUB0007] [AC:Z99110:AL009126] [GN:yjbQ] [FN:unknown] [OR:Bacillus subtilis] [DB:genpept-bct1] [DE:Bacillus subtilis complete genome (section 7 of 21): from 1194391to 1411140.] [NT:similar to Na+/H+ antiporter] [LE:45437] [RE:47281] [DI:direct]

| ORF Name | NTID | AAID | NT Length | AA Length | score | probability |
|---|---|---|---|---|---|---|
| AI7503000991_4088962_c2_508 | 2047 | 5819 | 279 | 92 | 76 | 0.0065 |

Description pir:[LN:A70008] [AC:A70008 ] [PN:hypothetical protein yueH] [GN:yueH ] [OR:Bacillus subtilis] [DB:pir2] >gp:[GI:e1184255:g2635673] [LN:BSUB0017] [AC:Z99120:AL009126] [GN:yueH] [FN:unknown] [OR:Bacillus subtilis] [DB:genpept-bct1] [DE:Bacillus subtilis complete genome (section 17 of 21): from 3197001to 3414420.] [LE:64085] [RE:64333] [DI:complement]

| ORF Name | NTID | AAID | NT Length | AA Length | score | probability |
|---|---|---|---|---|---|---|
| AI7503000991_4094433_f1_72 | 2048 | 5820 | 999 | 332 | 1184 | 2.5e-120 |

Description sp:[LN:SYW_BACSU] [AC:P21656] [GN:TRPS] [OR:BACILLUS SUBTILIS] [EC:6.1.1.2] [DE:(TRPRS)] [SP:P21656] [DB:swissprot] >pir:[LN:YWBS] [AC:JT0481:A32452:E69726 ] [PN:tryptophan--tRNA ligase,:tryptophanyl-tRNA synthetase] [GN:trpS ] [CL:tryptophan--tRNA ligase] [OR:Bacillus subtilis] [EC:6.1.1.2] [DB:pir1] >gp:[GI:g143786] [LN:BACTRPSA] [AC:M24068] [OR:Bacillus subtilis] [SR:B.subtilis (strain QB928) DNA, clone pTSQ2] [DB:genpept-bct1] [DE:B.subtilis trpS gene encoding tryptophanyl-tRNA synthetase,complete cds.] [NT:tryptophanyl-tRNA synthetase (EC 6.1.1.2)] [LE:171] [RE:1163] [DI:direct] >gp:[GI:e1183162:g2633496] [LN:BSUB0007] [AC:Z99110:AL009126] [PN:tryptophanyl-tRNA synthetase] [GN:trpS] [OR:Bacillus subtilis] [DB:genpept-bct1] [EC:6.1.1.2] [DE:Bacillus subtilis complete genome (section 7 of 21): from 1194391to 1411140.] [SP:P21656] [LE:23195] [RE:24187] [DI:complement]

| ORF Name | NTID | AAID | NT Length | AA Length | score | probability |
|---|---|---|---|---|---|---|
| AI7503000991_40957_c1_407 | 2049 | 5821 | 858 | 285 | 513 | 3.2e-49 |

Description sp:[LN:YJBO_BACSU] [AC:O31613] [GN:YJBO] [OR:BACILLUS SUBTILIS] [DE:HYPOTHETICAL 31.5 KD PROTEIN IN MECA-TENA INTERGENIC REGION] [SP:O31613] [DB:swissprot] >pir:[LN:G69844] [AC:G69844 ] [PN:conserved hypothetical protein yjbO] [GN:yjbO ] [CL:conserved hypothetical protein HI0176] [OR:Bacillus subtilis] [DB:pir2] >gp:[GI:e1183182:g2633516] [LN:BSUB0007] [AC:Z99110:AL009126] [GN:yjbO] [FN:unknown] [OR:Bacillus subtilis] [DB:genpept-bct1] [DE:Bacillus subtilis complete genome (section 7 of 21): from 1194391to 1411140.] [NT:similar to hypothetical proteins] [SP:O31613] [LE:43604] [RE:44455] [DI:direct]

| ORF Name | NTID | AAID | NT Length | AA Length | score | probability |
|---|---|---|---|---|---|---|
| AI7503000991_4100393_f3_379 | 2050 | 5822 | 1215 | 404 | 1458 | 2.3e-149 |

Description pir:[LN:B69589] [AC:B69589 ] [PN:argininosuccinate synthase argG] [GN:argG ] [CL:argininosuccinate synthase] [OR:Bacillus subtilis] [DB:pir2] >gp:[GI:e1184194:g2635410] [LN:BSUB0015] [AC:Z99118:AL009126] [PN:argininosuccinate synthase] [GN:argG] [FN:arginine biosynthesis] [OR:Bacillus subtilis] [DB:genpept-bct1] [EC:6.3.4.5] [DE:Bacillus subtilis complete genome (section 15 of 21): from 2795131to 3013540.] [LE:217075] [RE:218286] [DI:complement] >gp:[GI:e1185818:g2635429] [LN:BSUB0016] [AC:Z99119:AL009126] [PN:argininosuccinate synthase] [GN:argG] [FN:arginine biosynthesis] [OR:Bacillus subtilis] [DB:genpept-bct1] [EC:6.3.4.5] [DE:Bacillus subtilis complete genome (section 16 of 21): from 2997771to 3213410.] [LE:14435] [RE:15646] [DI:complement] >gp:[GI:g2293242] [LN:AF008220] [AC:AF008220] [PN:arginine succinate synthase] [GN:argG] [OR:Bacillus subtilis] [DB:genpept-bct2] [DE:Bacillus subtilis rrnB-dnaB genomic region.] [LE:164781] [RE:165992] [DI:direct]

| ORF Name | NTID | AAID | NT Length | AA Length | score | probability |
|---|---|---|---|---|---|---|
| AI7503000991_4173410_c2_504 | 2051 | 5823 | 792 | 263 | 485 | 3.0e-46 |

Description
pir:[LN:H69846] [AC:H69846 ] [PN:hypothetical protein yjcH] [GN:yjcH ] [OR:Bacillus subtilis] [DB:pir2] >gp:[GI:e1183206:g2633540] [LN:BSUB0007] [AC:Z99110:AL009126] [GN:yjcH] [FN:unknown] [OR:Bacillus subtilis] [DB:genpept-bct1] [DE:Bacillus subtilis complete genome (section 7 of 21): from 1194391to 1411140.] [LE:62495] [RE:63217] [DI:complement]

| ORF Name | NTID | AAID | NT Length | AA Length | score | probability |
|---|---|---|---|---|---|---|
| AI7503000991_4181312_c2_527 | 2052 | 5824 | 606 | 201 | 93 | 0.010 |

Description
pir:[LN:A71455] [AC:A71455 ] [PN:probable acetyltransferase] [GN:PH0296 ] [OR:Pyrococcus horikoshii] [DB:pir2] >gp:[GI:d1030311:g3256685] [LN:AP000001] [AC:AP000001:AB009465:AB009464:AB009466:AB009467:AB009468:AB009469] [PN:172aa long hypothetical acetyltransferase] [GN:PH0296] [OR:Pyrococcus horikoshii] [SR:Pyrococcus horikoshii (strain:OT3) DNA] [DB:genpept-bct1] [DE:Pyrococcus horikoshii OT3 genomic DNA, 1-287000 nt. position (1/7).] [NT:similar to PIR:A64491 percent identity: 42.029 in] [LE:262066] [RE:262584] [DI:complement]

| ORF Name | NTID | AAID | NT Length | AA Length | score | probability |
|---|---|---|---|---|---|---|
| AI7503000991_4335752_f1_4 | 2053 | 5825 | 171 | 56 | | |

Description
NO-HIT

| ORF Name | NTID | AAID | NT Length | AA Length | score | probability |
|---|---|---|---|---|---|---|
| AI7503000991_4546890_f2_174 | 2054 | 5826 | 150 | 49 | | |

Description
NO-HIT

| ORF Name | NTID | AAID | NT Length | AA Length | score | probability |
|---|---|---|---|---|---|---|
| AI7503000991_4687518_c2_519 | 2055 | 5827 | 585 | 194 | 179 | 8.0e-14 |

Description
sp:[LN:COMK_BACSU] [AC:P40396] [GN:COMK] [OR:BACILLUS SUBTILIS] [DE:COMPETENCE TRANSCRIPTION FACTOR (CTF) (COMPETENCE PROTEIN K)] [SP:P40396] [DB:swissprot] >pir:[LN:S43611] [AC:S43611:A69604 ] [PN:competence transcription factor (CTF) comK] [GN:comK ] [OR:Bacillus subtilis] [DB:pir2] >gp:[GI:e1183044:g2633378] [LN:BSUB0006] [AC:Z99109:AL009126] [PN:competence transcription factor (CTF)] [GN:comK] [FN:final autoregulatory control switch prior to] [OR:Bacillus subtilis] [DB:genpept-bct1] [DE:Bacillus subtilis complete genome (section 6 of 21): from 999501 to1209940.] [SP:P40396] [LE:117081] [RE:117659] [DI:direct] >gp:[GI:g546917] [LN:S70734] [AC:S70734] [GN:comK] [OR:Bacillus subtilis] [SR:Bacillus subtilis E26] [DB:genpept-bct1] [DE:comK [Bacillus subtilis, E26, Genomic, 3 genes, 1947 nt].] [NT:This sequence comes from Fig. 3.] [LE:900] [RE:1478] [DI:direct]

| ORF Name | NTID | AAID | NT Length | AA Length | score | probability |
|---|---|---|---|---|---|---|
| AI7503000991_4688750_f3_283 | 2056 | 5828 | 174 | 57 | | |

Description
NO-HIT

| ORF Name | NTID | AAID | NT Length | AA Length | score | probability |
|---|---|---|---|---|---|---|
| AI7503000991_4726010_c1_413 | 2057 | 5829 | 2304 | 767 | 1777 | 3.7e-183 |

Description
gp:[GI:g1196907] [LN:STMDRRC] [AC:L76359] [PN:daunorubicin resistance protein]
[GN:drrC] [OR:Streptomyces peucetius] [DB:genpept-bct1] [DE:Streptomyces peucetius
daunorubicin resistance protein (drrC) gene,complete cds.] [LE:991] [RE:3285]
[DI:direct]

| ORF Name | NTID | AAID | NT Length | AA Length | score | probability |
|---|---|---|---|---|---|---|
| AI7503000991_4781275_f2_194 | 2058 | 5830 | 249 | 82 | | |

Description
NO-HIT

| ORF Name | NTID | AAID | NT Length | AA Length | score | probability |
|---|---|---|---|---|---|---|
| AI7503000991_4812675_c1_412 | 2059 | 5831 | 321 | 106 | 273 | 3.1e-23 |

Description
sp:[LN:G6PD_BACSU] [AC:P54547] [GN:ZWF] [OR:BACILLUS SUBTILIS] [EC:1.1.1.49]
[DE:PROTEIN 11) (VEG11)] [SP:P54547] [DB:swissprot] >pir:[LN:B69964] [AC:B69964 ]
[PN:probable glucose-6-phosphate 1-dehydrogenase, yqjJ] [GN:yqjJ ]
[CL:glucose-6-phosphate dehydrogenase] [OR:Bacillus subtilis] [EC:1.1.1.49] [DB:pir2]
>gp:[GI:d1013296:g1303961] [LN:BACJH642] [AC:D84432:D82370] [PN:YqjJ] [OR:Bacillus
subtilis] [SR:Bacillus subtilis (strain:JH642(trpC2 PheA1)) DNA] [DB:genpept-bct1]
[DE:Bacillus subtilis DNA, 283 Kb region containing skin element.] [LE:239025]
[RE:240494] [DI:complement] >gp:[GI:e1185654:g2634820] [LN:BSUB0013]
[AC:Z99116:AL009126] [GN:yqjJ] [FN:unknown] [OR:Bacillus subtilis] [DB:genpept-bct1]
[DE:Bacillus subtilis complete genome (section 13 of 21): from 2395261to 2613730.]
[NT:similar to glucose-6-phosphate 1-dehydrogenase] [SP:P54547] [LE:83125] [RE:84594]
[DI:direct]

| ORF Name | NTID | AAID | NT Length | AA Length | score | probability |
|---|---|---|---|---|---|---|
| AI7503000991_48587_f3_381 | 2060 | 5832 | 1062 | 353 | 729 | 4.2e-72 |

Description
sp:[LN:GLPQ_BACSU] [AC:P37965] [GN:GLPQ] [OR:BACILLUS SUBTILIS] [EC:3.1.4.46]
[DE:(GLYCEROPHOSPHODIESTER PHOSPHODIESTERASE)] [SP:P37965] [DB:swissprot]
>pir:[LN:I40418] [AC:I40418:E69634:S37251 ] [PN:glycerophosphoryl diester
phosphodiesterase glpQ] [GN:glpQ ] [OR:Bacillus subtilis] [DB:pir2]
>gp:[GI:d1034076:g3599635] [LN:AB006424] [AC:AB006424] [GN:ybeD] [OR:Bacillus subtilis]
[SR:Bacillus subtilis (strain:168) DNA] [DB:genpept-bct1] [DE:Bacillus subtilis genomic
DNA, 70 kb region between 17 and 23degree.] [LE:36004] [RE:36885] [DI:complement]
>gp:[GI:g403373] [LN:BSGLPTQ] [AC:Z26522] [PN:glycerophosphoryl diester
phosphodiesterase] [GN:glpQ] [FN:hydrolysis of deacylated phospholipids] [OR:Bacillus
subtilis] [DB:genpept-bct1] [DE:B.subtilis glpT and glpQ genes for glycerol 3-phosphate
permeaseand glycerophosphoryl diester phosphodiesterase.] [SP:P37965] [LE:1748]
[RE:2629] [DI:direct] >gp:[GI:e1182165:g2632499] [LN:BSUB0002] [AC:Z99105:AL009126]
[PN:glycerophosphoryl diester phosphodiesterase] [GN:glpQ] [FN:hydrolysis of deacylated
phospholipids] [OR:Bacillus subtilis] [DB:genpept-bct1] [EC:3.1.4.46] [DE:Bacillus
subtilis complete genome (section 2 of 21): from 194651 to415810.] [NT:alternate gene
name: ybeD] [SP:P37965] [LE:38353] [RE:39234] [DI:complement]

| ORF Name | NTID | AAID | NT Length | AA Length | score | probability |
|---|---|---|---|---|---|---|
| AI7503000991_4882133_c1_435 | 2061 | 5833 | 150 | 49 | | |

Description
NO-HIT

| ORF Name | NTID | AAID | NT Length | AA Length | score | probability |
|---|---|---|---|---|---|---|
| AI7503000991_4882806_c2_524 | 2062 | 5834 | 522 | 173 | 399 | 3.9e-37 |

Description
pir:[LN:D69838] [AC:D69838 ] [PN:conserved hypothetical protein yisU] [GN:yisU ]
[OR:Bacillus subtilis] [DB:pir2] >gp:[GI:e1183088:g2633422] [LN:BSUB0006]
[AC:Z99109:AL009126] [GN:yisU] [FN:unknown] [OR:Bacillus subtilis] [DB:genpept-bct1]
[DE:Bacillus subtilis complete genome (section 6 of 21): from 999501 to1209940.]
[NT:similar to hypothetical proteins] [LE:165981] [RE:166643] [DI:complement]
>gp:[GI:e1173520:g2145387] [LN:BSY09476] [AC:Y09476] [PN:YisU] [OR:Bacillus subtilis]
[DB:genpept-bct1] [DE:B.subtilis 54kb genomic DNA fragment.] [NT:putative] [LE:23207]
[RE:23869] [DI:complement]

| ORF Name | NTID | AAID | NT Length | AA Length | score | probability |
|---|---|---|---|---|---|---|
| AI7503000991_4961000_f1_6 | 2063 | 5835 | 123 | 40 | | |

Description
NO-HIT

| ORF Name | NTID | AAID | NT Length | AA Length | score | probability |
|---|---|---|---|---|---|---|
| AI7503000991_5085003_f1_118 | 2064 | 5836 | 1455 | 484 | 1439 | 2.4e-147 |

Description
pir:[LN:C69589] [AC:C69589 ] [PN:argininosuccinate lyase argH] [GN:argH ]
[CL:argininosuccinate lyase] [OR:Bacillus subtilis] [DB:pir2]
>gp:[GI:e1184193:g2635409] [LN:BSUB0015] [AC:Z99118:AL009126] [PN:argininosuccinate
lyase] [GN:argH] [FN:arginine biosynthesis] [OR:Bacillus subtilis] [DB:genpept-bct1]
[EC:4.3.2.1] [DE:Bacillus subtilis complete genome (section 15 of 21): from 2795131to
3013540.] [LE:215693] [RE:217078] [DI:complement] >gp:[GI:e1185817:g2635428]
[LN:BSUB0016] [AC:Z99119:AL009126] [PN:argininosuccinate lyase] [GN:argH] [FN:arginine
biosynthesis] [OR:Bacillus subtilis] [DB:genpept-bct1] [EC:4.3.2.1] [DE:Bacillus
subtilis complete genome (section 16 of 21): from 2997771to 3213410.] [LE:13053]
[RE:14438] [DI:complement] >gp:[GI:g2293243] [LN:AF008220] [AC:AF008220] [PN:arginine
succinate lyase] [GN:argH] [OR:Bacillus subtilis] [DB:genpept-bct2] [DE:Bacillus
subtilis rrnB-dnaB genomic region.] [LE:165989] [RE:167374] [DI:direct]

| ORF Name | NTID | AAID | NT Length | AA Length | score | probability |
|---|---|---|---|---|---|---|
| AI7503000991_5115927_c2_528 | 2065 | 5837 | 1680 | 559 | 340 | 1.3e-59 |

Description
pir:[LN:S76520] [AC:S76520 ] [PN:hypothetical protein] [OR:Synechocystis sp.] [SR:PCC
6803, , PCC 6803] [SR:PCC 6803, ] [DB:pir2] >gp:[GI:d1011017:g1001635] [LN:SYCSLRD]
[AC:D64002:AB001339] [PN:2-succinyl-6-hydroxy-2,] [GN:menD] [OR:Synechocystis sp.]
[SR:Synechocystis sp. (strain:PCC6803) DNA] [DB:genpept-bct1] [DE:Synechocystis sp.
PCC6803 complete genome, 21/27, 2644795-2755702.] [NT:ORF_ID:sll0603] [LE:25321]
[RE:27108] [DI:complement]

| ORF Name | NTID | AAID | NT Length | AA Length | score | probability |
|---|---|---|---|---|---|---|
| AI7503000991_5165711_f3_336 | 2066 | 5838 | 447 | 148 | 338 | 1.1e-30 |

Description
pir:[LN:A69844] [AC:A69844 ] [PN:hypothetical protein yjbI] [GN:yjbI ] [OR:Bacillus
subtilis] [DB:pir2] >gp:[GI:e1183176:g2633510] [LN:BSUB0007] [AC:Z99110:AL009126]
[GN:yjbI] [FN:unknown] [OR:Bacillus subtilis] [DB:genpept-bct1] [DE:Bacillus subtilis
complete genome (section 7 of 21): from 1194391to 1411140.] [LE:39591] [RE:39989]
[DI:complement]

| ORF Name | NTID | AAID | NT Length | AA Length | score | probability |
|---|---|---|---|---|---|---|
| AI7503000991_5250258_c1_403 | 2067 | 5839 | 1839 | 612 | 1741 | 2.4e-179 |

Description
gp:[GI:d1014255:g1651216] [LN:D88209] [AC:D88209] [PN:Pz-peptidase] [OR:Bacillus licheniformis] [SR:Bacillus licheniformis (strain:N22) DNA] [DB:genpept-bct1] [DE:Bacillus licheniformis DNA for Pz-peptidase, complete cds.] [LE:238] [RE:2124] [DI:direct]

| ORF Name | NTID | AAID | NT Length | AA Length | score | probability |
|---|---|---|---|---|---|---|
| AI7503000991_579441_c1_386 | 2068 | 5840 | 150 | 49 | | |

Description
NO-HIT

| ORF Name | NTID | AAID | NT Length | AA Length | score | probability |
|---|---|---|---|---|---|---|
| AI7503000991_580307_f2_246 | 2069 | 5841 | 132 | 43 | | |

Description
NO-HIT

| ORF Name | NTID | AAID | NT Length | AA Length | score | probability |
|---|---|---|---|---|---|---|
| AI7503000991_6057943_c2_517 | 2070 | 5842 | 999 | 332 | 990 | 9.2e-100 |

Description
pir:[LN:G69830] [AC:G69830 ] [PN:lipoate-protein ligase homolog yhfJ] [GN:yhfJ ] [CL:lipoate-protein ligase] [OR:Bacillus subtilis] [DB:pir2] >gp:[GI:e1183027:g2633361] [LN:BSUB0006] [AC:Z99109:AL009126] [GN:yhfJ] [FN:unknown] [OR:Bacillus subtilis] [DB:genpept-bct1] [DE:Bacillus subtilis complete genome (section 6 of 21): from 999501 to1209940.] [NT:similar to lipoate-protein ligase] [LE:99131] [RE:100126] [DI:direct] >gp:[GI:e325016:g2226243] [LN:BSY14083] [AC:Y14083] [PN:hypothetical protein] [GN:yhfJ] [OR:Bacillus subtilis] [DB:genpept-bct1] [DE:Bacillus subtilis chromosomal DNA, region 76-78 degrees: betweenglyB-aprE.] [NT:Similarity to several lipoate-protein ligases] [LE:18990] [RE:19985] [DI:direct]

| ORF Name | NTID | AAID | NT Length | AA Length | score | probability |
|---|---|---|---|---|---|---|
| AI7503000991_6688757_f2_123 | 2071 | 5843 | 507 | 168 | 823 | 4.6e-82 |

Description
gp:[GI:g2267240] [LN:SEU71377] [AC:U71377] [OR:Staphylococcus epidermidis] [DB:genpept-bct1] [DE:Staphylococcus epidermidis autolysin AtlE and putativetranscriptional regulator AtlR genes, complete cds.] [NT:ORF2] [LE:913] [RE:1383] [DI:direct]

| ORF Name | NTID | AAID | NT Length | AA Length | score | probability |
|---|---|---|---|---|---|---|
| AI7503000991_6921877_c1_410 | 2072 | 5844 | 219 | 72 | 192 | 2.3e-14 |

Description
sp:[LN:G6PD_BACSU] [AC:P54547] [GN:ZWF] [OR:BACILLUS SUBTILIS] [EC:1.1.1.49]
[DE:PROTEIN 11) (VEG11)] [SP:P54547] [DB:swissprot] >pir:[LN:B69964] [AC:B69964 ]
[PN:probable glucose-6-phosphate 1-dehydrogenase, yqjJ] [GN:yqjJ ]
[CL:glucose-6-phosphate dehydrogenase] [OR:Bacillus subtilis] [EC:1.1.1.49] [DB:pir2]
>gp:[GI:d1013296:g1303961] [LN:BACJH642] [AC:D84432:D82370] [PN:YqjJ] [OR:Bacillus
subtilis] [SR:Bacillus subtilis (strain:JH642(trpC2 PheA1)) DNA] [DB:genpept-bct1]
[DE:Bacillus subtilis DNA, 283 Kb region containing skin element.] [LE:239025]
[RE:240494] [DI:complement] >gp:[GI:e1185654:g2634820] [LN:BSUB0013]
[AC:Z99116:AL009126] [GN:yqjJ] [FN:unknown] [OR:Bacillus subtilis] [DB:genpept-bct1]
[DE:Bacillus subtilis complete genome (section 13 of 21): from 2395261to 2613730.]
[NT:similar to glucose-6-phosphate 1-dehydrogenase] [SP:P54547] [LE:83125] [RE:84594]
[DI:direct]

| ORF Name | NTID | AAID | NT Length | AA Length | score | probability |
|---|---|---|---|---|---|---|
| AI7503000991_7032752_f3_268 | 2073 | 5845 | 795 | 264 | 1335 | 2.5e-136 |

Description
gp:[GI:g2267239] [LN:SEU71377] [AC:U71377] [OR:Staphylococcus epidermidis]
[DB:genpept-bct1] [DE:Staphylococcus epidermidis autolysin AtlE and
putativetranscriptional regulator AtlR genes, complete cds.] [NT:ORF1] [LE:<1] [RE:865]
[DI:direct]

| ORF Name | NTID | AAID | NT Length | AA Length | score | probability |
|---|---|---|---|---|---|---|
| AI7503000991_7081712_f1_27 | 2074 | 5846 | 234 | 77 | 84 | 0.00093 |

Description
pir:[LN:H69835] [AC:H69835 ] [PN:hypothetical protein yhzC] [GN:yhzC ] [OR:Bacillus
subtilis] [DB:pir2] >gp:[GI:e1183043:g2633377] [LN:BSUB0006] [AC:Z99109:AL009126]
[GN:yhzC] [FN:unknown] [OR:Bacillus subtilis] [DB:genpept-bct1] [DE:Bacillus subtilis
complete genome (section 6 of 21): from 999501 to1209940.] [LE:116555] [RE:116788]
[DI:complement]

| ORF Name | NTID | AAID | NT Length | AA Length | score | probability |
|---|---|---|---|---|---|---|
| AI7503000991_7145260_f3_337 | 2075 | 5847 | 243 | 80 | | |

Description
NO-HIT

| ORF Name | NTID | AAID | NT Length | AA Length | score | probability |
|---|---|---|---|---|---|---|
| AI7503000991_7228438_c2_471 | 2076 | 5848 | 3231 | 1076 | 1793 | 7.4e-185 |

Description
sp:[LN:ADDA_BACSU] [AC:P23478] [GN:ADDA] [OR:BACILLUS SUBTILIS] [DE:ATP-DEPENDENT NUCLEASE SUBUNIT A] [SP:P23478] [DB:swissprot] >pir:[LN:B39432] [AC:B39432:H69582 ] [PN:ATP-dependent deoxyribonuclease chain A addA:ATP-dependent exonuclease synthesis protein AddA] [GN:addA ] [OR:Bacillus subtilis] [DB:pir2] >gp:[GI:g142440] [LN:BACADDAA] [AC:M63489] [PN:ATP-dependent nuclease] [GN:addB] [OR:Bacillus subtilis] [SR:B.subtilis DNA] [DB:genpept-bct1] [DE:Bacillus subtilis ATP-dependent nuclease (addA) and (addB), andopen reading frame 3, partial cds.] [LE:3988] [RE:7687] [DI:direct] >gp:[GI:e1183065:g2633399] [LN:BSUB0006] [AC:Z99109:AL009126] [PN:ATP-dependent deoxyribonuclease (subunit A)] [GN:addA] [OR:Bacillus subtilis] [DB:genpept-bct1] [DE:Bacillus subtilis complete genome (section 6 of 21): from 999501 to1209940.] [NT:alternate gene name: recE5] [SP:P23478] [LE:139780] [RE:143478] [DI:direct] >gp:[GI:e1364881:g2226192] [LN:BSY14081] [AC:Y14081] [PN:ATP-dependent nuclease] [GN:addA] [OR:Bacillus subtilis] [DB:genpept-bct1] [DE:Bacillus subtilis chromosomal DNA, region 92 degrees: regionbetween comK and addAB.] [NT:see ref [3]; In EMBL entry M63489 this gene is] [LE:22075] [RE:25773] [DI:direct]

| ORF Name | NTID | AAID | NT Length | AA Length | score | probability |
|---|---|---|---|---|---|---|
| AI7503000991_7241300_c2_502 | 2077 | 5849 | 135 | 44 | | |

Description
NO-HIT

| ORF Name | NTID | AAID | NT Length | AA Length | score | probability |
|---|---|---|---|---|---|---|
| AI7503000991_7308375_c3_567 | 2078 | 5850 | 942 | 313 | 791 | 1.1e-78 |

Description
pir:[LN:H69668] [AC:H69668:S15231:B38447 ] [PN:oligopeptide transport system permease protein oppB:sporulation initiation protein spo0KB] [GN:oppB:spo0KB ] [CL:oligopeptide permease protein oppB] [OR:Bacillus subtilis] [DB:pir2] >gp:[GI:e1183164:g2633498] [LN:BSUB0007] [AC:Z99110:AL009126] [PN:oligopeptide ABC transporter (permease)] [GN:oppB] [FN:required for initiation of sporulation,] [OR:Bacillus subtilis] [DB:genpept-bct1] [DE:Bacillus subtilis complete genome (section 7 of 21): from 1194391to 1411140.] [NT:alternate gene name: spo0KB] [LE:26676] [RE:27611] [DI:direct]

| ORF Name | NTID | AAID | NT Length | AA Length | score | probability |
|---|---|---|---|---|---|---|
| AI7503000991_782816_c1_396 | 2079 | 5851 | 1857 | 618 | 776 | 3.7e-116 |

Description
pir:[LN:C69975] [AC:C69975 ] [PN:acyltransferase homolog yrhL] [GN:yrhL ] [OR:Bacillus subtilis] [DB:pir2] >gp:[GI:g1934616] [LN:BSU93874] [AC:U93874] [PN:hypothetical protein YrhL] [GN:yrhL] [OR:Bacillus subtilis] [DB:genpept-bct1] [DE:Bacillus subtilis cysteine synthase (yrhA), cystathioninegamma-lyase (yrhB), YrhC (yrhC), YrhD (yrhD), formate dehydrogenasechain A (yrhE), YrhF (yrhF), formate dehydrogenase (yrhG), YrhH(yrhH), regulatory protein (yrhI), cytochrome P450 102 (yrhJ), YrhK(yrhK), hypothetical protein YrhL (yrhL), putative anti-SigV factor(yrhM), RNA polymerase sigma factor SigV (sigV) and YrhO (yrhO)genes, complete cds, and YrhP (yrhP) gene, partial cds.] [NT:similar to Haemophilus influenzae hypothetical] [LE:13904] [RE:15808] [DI:complement] >gp:[GI:e1183944:g2635160] [LN:BSUB0014] [AC:Z99117:AL009126] [GN:yrhL] [FN:unknown] [OR:Bacillus subtilis] [DB:genpept-bct1] [DE:Bacillus subtilis complete genome (section 14 of 21): from 2599451to 2812870.] [NT:similar to acyltransferase] [LE:171138] [RE:173042] [DI:direct]

| ORF_Name | NTID | AAID | NT Length | AA Length | score | probability |
|---|---|---|---|---|---|---|
| AI7503000991_813412_c1_411 | 2080 | 5852 | 156 | 51 | 191 | 3.0e-14 |

Description
sp:[LN:G6PD_BACSU] [AC:P54547] [GN:ZWF] [OR:BACILLUS SUBTILIS] [EC:1.1.1.49]
[DE:PROTEIN 11) (VEG11)] [SP:P54547] [DB:swissprot] >pir:[LN:B69964] [AC:B69964 ]
[PN:probable glucose-6-phosphate 1-dehydrogenase, yqjJ] [GN:yqjJ ]
[CL:glucose-6-phosphate dehydrogenase] [OR:Bacillus subtilis] [EC:1.1.1.49] [DB:pir2]
>gp:[GI:d1013296:g1303961] [LN:BACJH642] [AC:D84432:D82370] [PN:YqjJ] [OR:Bacillus
subtilis] [SR:Bacillus subtilis (strain:JH642(trpC2 PheA1)) DNA] [DB:genpept-bct1]
[DE:Bacillus subtilis DNA, 283 Kb region containing skin element.] [LE:239025]
[RE:240494] [DI:complement] >gp:[GI:e1185654:g2634820] [LN:BSUB0013]
[AC:Z99116:AL009126] [GN:yqjJ] [FN:unknown] [OR:Bacillus subtilis] [DB:genpept-bct1]
[DE:Bacillus subtilis complete genome (section 13 of 21): from 2395261to 2613730.]
[NT:similar to glucose-6-phosphate 1-dehydrogenase] [SP:P54547] [LE:83125] [RE:84594]
[DI:direct]

| ORF_Name | NTID | AAID | NT Length | AA Length | score | probability |
|---|---|---|---|---|---|---|
| AI7503000991_859838_f3_357 | 2081 | 5853 | 384 | 127 | | |

Description
NO-HIT

| ORF_Name | NTID | AAID | NT Length | AA Length | score | probability |
|---|---|---|---|---|---|---|
| AI7503000991_978436_f2_126 | 2082 | 5854 | 1188 | 395 | 867 | 9.9e-87 |

Description
sp:[LN:PATA_BACSU] [AC:P16524] [GN:PATA:UAT] [OR:BACILLUS SUBTILIS] [EC:2.6.1.-]
[DE:PUTATIVE AMINOTRANSFERASE A,] [SP:P16524] [DB:swissprot] >gp:[GI:e1181905:g2632221]
[LN:BS16829KB] [AC:AJ222587] [PN:PatA protein] [GN:patA] [OR:Bacillus subtilis]
[DB:genpept-bct1] [DE:Bacillus subtilis 29kB DNA fragment from ykwC gene to cse15
gene.] [NT:hisC homologue] [SP:P16524] [LE:6213] [RE:7391] [DI:complement]

| ORF_Name | NTID | AAID | NT Length | AA Length | score | probability |
|---|---|---|---|---|---|---|
| AI7503000991_985887_c3_570 | 2083 | 5855 | 435 | 144 | 570 | 2.9e-55 |

Description
pir:[LN:D69843] [AC:D69843 ] [PN:conserved hypothetical protein yjbD] [GN:yjbD ]
[CL:hypothetical protein yjbD] [OR:Bacillus subtilis] [DB:pir2]
>gp:[GI:e1183170:g2633504] [LN:BSUB0007] [AC:Z99110:AL009126] [GN:yjbD] [FN:unknown]
[OR:Bacillus subtilis] [DB:genpept-bct1] [DE:Bacillus subtilis complete genome (section
7 of 21): from 1194391to 1411140.] [NT:similar to hypothetical proteins] [LE:32779]
[RE:33174] [DI:direct]

| ORF_Name | NTID | AAID | NT Length | AA Length | score | probability |
|---|---|---|---|---|---|---|
| AI7503000991_9927077_f3_378 | 2084 | 5856 | 147 | 48 | | |

Description
NO-HIT

| ORF_Name | NTID | AAID | NT Length | AA Length | score | probability |
|---|---|---|---|---|---|---|
| AI7503000992_10008513_c3_117 | 2085 | 5857 | 2667 | 888 | 3361 | 0.0 |

Description
pir:[LN:SYBSVS] [AC:A26738 ] [PN:valine--tRNA ligase,:valyl-tRNA synthetase] [GN:valS ]
[CL:valine--tRNA ligase] [OR:Bacillus stearothermophilus] [EC:6.1.1.9] [DB:pir1]

| ORF Name | NTID | AAID | NT Length | AA Length | score | probability |
|---|---|---|---|---|---|---|
| AI7503000992_10720877_c1_78 | 2086 | 5858 | 1329 | 442 | 1343 | 3.6e-137 |

Description
pir:[LN:F69723] [AC:F69723 ] [PN:trigger factor (prolyl isomerase) tig] [GN:tig ] [CL:trigger factor] [OR:Bacillus subtilis] [DB:pir2] >gp:[GI:e1184072:g2635288] [LN:BSUB0015] [AC:Z99118:AL009126] [PN:trigger factor (prolyl isomerase)] [GN:tig] [OR:Bacillus subtilis] [DB:genpept-bct1] [DE:Bacillus subtilis complete genome (section 15 of 21): from 2795131to 3013540.] [NT:alternate gene name: yzzH] [SP:P80698] [LE:90286] [RE:91560] [DI:complement] >gp:[GI:e1165373:g1770074] [LN:BSZ75208] [AC:Z75208] [PN:trigger factor] [GN:tig] [OR:Bacillus subtilis] [DB:genpept-bct1] [DE:B.subtilis genomic sequence 89009bp.] [NT:homology to trigger factor of Haemophilus] [SP:P80698] [LE:78347] [RE:79621] [DI:direct]

| ORF Name | NTID | AAID | NT Length | AA Length | score | probability |
|---|---|---|---|---|---|---|
| AI7503000992_11954500_f3_71 | 2087 | 5859 | 174 | 57 | | |

Description
NO-HIT

| ORF Name | NTID | AAID | NT Length | AA Length | score | probability |
|---|---|---|---|---|---|---|
| AI7503000992_1211562_c2_94 | 2088 | 5860 | 1269 | 422 | 1518 | 1.0e-155 |

Description
gp:[GI:e221213:g1296452] [LN:BSCLPXGEN] [AC:X95306] [PN:ClpX protein] [GN:clpX] [OR:Bacillus subtilis] [DB:genpept-bct1] [DE:B.subtilis clpX gene.] [NT:ATP-dependent protease] [SP:P50866] [LE:168] [RE:1430] [DI:direct]

| ORF Name | NTID | AAID | NT Length | AA Length | score | probability |
|---|---|---|---|---|---|---|
| AI7503000992_14725300_c3_108 | 2089 | 5861 | 123 | 40 | | |

Description
NO-HIT

| ORF Name | NTID | AAID | NT Length | AA Length | score | probability |
|---|---|---|---|---|---|---|
| AI7503000992_15820252_c1_81 | 2090 | 5862 | 141 | 46 | | |

Description
NO-HIT

| ORF Name | NTID | AAID | NT Length | AA Length | score | probability |
|---|---|---|---|---|---|---|
| AI7503000992_16835900_c2_104 | 2091 | 5863 | 147 | 48 | 74 | 0.011 |

Description
gp:[GI:g1123053] [LN:CELF59A6] [AC:U41994] [GN:F59A6.2] [OR:Caenorhabditis elegans] [SR:Caenorhabditis elegans strain=Bristol N2] [DB:genpept-inv1] [DE:Caenorhabditis elegans cosmid F59A6.] [LE:19719:20072] [RE:19904:20242] [DI:directJoin]

| ORF Name | NTID | AAID | NT Length | AA Length | score | probability |
|---|---|---|---|---|---|---|
| AI7503000992_188388_c3_122 | 2092 | 5864 | 579 | 192 | 220 | 3.6e-18 |

Description
sp:[LN:MREC_BACSU] [AC:Q01466] [GN:MREC] [OR:BACILLUS SUBTILIS] [DE:ROD SHAPE-DETERMINING PROTEIN MREC] [SP:Q01466] [DB:swissprot] >pir:[LN:JC4595] [AC:JC4595 ] [PN:cell shape determinant MreC:protease secretion stimulating protein, MreC] [GN:mreC ] [OR:Bacillus stearothermophilus] [DB:pir2] >pir:[LN:C45240] [AC:C45240:D45239:S27518 ] [PN:cell shape determinant mreC] [GN:mreC ] [OR:Bacillus subtilis] [DB:pir2] >gp:[GI:g143213] [LN:BACMREMIN] [AC:M95582] [GN:mreC] [FN:cell shape determining] [OR:Bacillus subtilis] [SR:Bacillus subtilis (strain W168) DNA] [DB:genpept-bct1] [DE:Bacillus subtilis (mreB) gene complete cds, (mreC) gene completecds, (mreD) gene complete cds, (minC) gene complete cds, (minD)gene complete cds.] [NT:putative] [LE:1370] [RE:2242] [DI:direct]

| ORF Name | NTID | AAID | NT Length | AA Length | score | probability |
|---|---|---|---|---|---|---|
| AI7503000992_19707767_f1_4 | 2093 | 5865 | 324 | 107 | | |

Description
NO-HIT

| ORF Name | NTID | AAID | NT Length | AA Length | score | probability |
|---|---|---|---|---|---|---|
| AI7503000992_20348160_f1_1 | 2094 | 5866 | 222 | 73 | 71 | 0.022 |

Description
gp:[GI:g1131474] [LN:PBU42580] [AC:U42580:U17055:U32570] [GN:A130R] [OR:Paramecium bursaria Chlorella virus 1] [DB:genpept-vrl] [DE:Paramecium bursaria Chlorella virus 1, complete genome.] [LE:69061] [RE:69378] [DI:direct]

| ORF Name | NTID | AAID | NT Length | AA Length | score | probability |
|---|---|---|---|---|---|---|
| AI7503000992_21500253_c3_109 | 2095 | 5867 | 177 | 58 | | |

Description
NO-HIT

| ORF Name | NTID | AAID | NT Length | AA Length | score | probability |
|---|---|---|---|---|---|---|
| AI7503000992_21563137_c2_102 | 2096 | 5868 | 135 | 44 | | |

Description
NO-HIT

| ORF Name | NTID | AAID | NT Length | AA Length | score | probability |
|---|---|---|---|---|---|---|
| AI7503000992_23444187_f3_62 | 2097 | 5869 | 162 | 53 | | |

Description
NO-HIT

| ORF Name | NTID | AAID | NT Length | AA Length | score | probability |
|---|---|---|---|---|---|---|
| AI7503000992_23522567_c2_91 | 2098 | 5870 | 381 | 126 | 450 | 1.5e-42 |

Description
sp:[LN:RL20_BACSU] [AC:P55873] [GN:RPLT] [OR:BACILLUS SUBTILIS] [DE:50S RIBOSOMAL PROTEIN L20] [SP:P55873] [DB:swissprot] >pir:[LN:F69696] [AC:F69696 ] [PN:ribosomal protein L20 rplT] [GN:rplT ] [CL:Escherichia coli ribosomal protein L20] [OR:Bacillus subtilis] [DB:pir2] >gp:[GI:e1184134:g2635350] [LN:BSUB0015] [AC:Z99118:AL009126] [PN:ribosomal protein L20] [GN:rplT] [OR:Bacillus subtilis] [DB:genpept-bct1] [DE:Bacillus subtilis complete genome (section 15 of 21): from 2795131to 3013540.] [SP:P55873] [LE:156202] [RE:156561] [DI:complement] >gp:[GI:e1165301:g1770009] [LN:BSZ75208] [AC:Z75208] [PN:ribosomal protein L20] [GN:rplT] [OR:Bacillus subtilis] [DB:genpept-bct1] [DE:B.subtilis genomic sequence 89009bp.] [NT:homology to rplT of Bacillus stearothermphilus;] [SP:P55873] [LE:13346] [RE:13705] [DI:direct]

| ORF Name | NTID | AAID | NT Length | AA Length | score | probability |
|---|---|---|---|---|---|---|
| AI7503000992_23531628_f2_28 | 2099 | 5871 | 144 | 47 | | |

Description
NO-HIT

| ORF Name | NTID | AAID | NT Length | AA Length | score | probability |
|---|---|---|---|---|---|---|
| AI7503000992_23697141_c2_97 | 2100 | 5872 | 930 | 309 | 1327 | 1.8e-135 |

Description
gp:[GI:g2589181] [LN:SAU89396] [AC:U89396] [PN:porphobilinogen deaminase] [GN:hemC] [OR:Staphylococcus aureus] [DB:genpept-bct2] [EC:4.3.1.8] [DE:Staphylococcus aureus hemCDBL gene cluster: porphobilinogendeaminase (hemC), uroporphyrinogen III synthase (hemD),d-aminolevulinic acid dehydratase (hemB) and GSA-1-aminotransferase(hemL) genes, complete cds.] [LE:219] [RE:1145] [DI:direct]

| ORF Name | NTID | AAID | NT Length | AA Length | score | probability |
|---|---|---|---|---|---|---|
| AI7503000992_24017052_c2_103 | 2101 | 5873 | 150 | 49 | | |

Description
NO-HIT

| ORF Name | NTID | AAID | NT Length | AA Length | score | probability |
|---|---|---|---|---|---|---|
| AI7503000992_24240877_c3_119 | 2102 | 5874 | 522 | 173 | | |

Description
NO-HIT

| ORF Name | NTID | AAID | NT Length | AA Length | score | probability |
|---|---|---|---|---|---|---|
| AI7503000992_24625161_c1_87 | 2103 | 5875 | 141 | 46 | 160 | 8.2e-12 |

Description
sp:[LN:RADC_STAAU] [AC:P31337] [GN:RADC] [OR:STAPHYLOCOCCUS AUREUS] [DE:DNA REPAIR PROTEIN RADC HOMOLOG (25 KD PROTEIN) (FRAGMENT)] [SP:P31337] [DB:swissprot] >gp:[GI:g551992] [LN:STATNIS5] [AC:K02985] [OR:Staphylococcus aureus] [SR:S.aureus (strain RN450) DNA] [DB:genpept-bct1] [DE:S.aureus (strain RN450) transposon Tn554 insertion site.] [NT:25 kD protein (putative); putative] [LE:<1] [RE:>249] [DI:direct]

| ORF Name | NTID | AAID | NT Length | AA Length | score | probability |
|---|---|---|---|---|---|---|
| AI7503000992_24897312_c3_112 | 2104 | 5876 | 186 | 61 | 255 | 7.1e-22 |

Description
sp:[LN:HEM2_STAAU] [AC:P50915] [GN:HEMB] [OR:STAPHYLOCOCCUS AUREUS] [EC:4.2.1.24]
[DE:SYNTHASE) (ALAD) (ALADH)] [SP:P50915] [DB:swissprot] >gp:[GI:g2589183]
[LN:SAU89396] [AC:U89396] [PN:d-aminolevulinic acid dehydratase] [GN:hemB]
[OR:Staphylococcus aureus] [DB:genpept-bct2] [EC:4.2.1.24] [DE:Staphylococcus aureus
hemCDBL gene cluster: porphobilinogendeaminase (hemC), uroporphyrinogen III synthase
(hemD),d-aminolevulinic acid dehydratase (hemB) and GSA-1-aminotransferase(hemL) genes,
complete cds.] [LE:1838] [RE:2809] [DI:direct]

| ORF Name | NTID | AAID | NT Length | AA Length | score | probability |
|---|---|---|---|---|---|---|
| AI7503000992_25582912_f2_23 | 2105 | 5877 | 123 | 40 | | |

Description
NO-HIT

| ORF Name | NTID | AAID | NT Length | AA Length | score | probability |
|---|---|---|---|---|---|---|
| AI7503000992_25596000_c3_111 | 2106 | 5878 | 825 | 274 | 460 | 1.3e-43 |

Description
sp:[LN:HEMX_BACSU] [AC:P16645] [GN:HEMX] [OR:BACILLUS SUBTILIS] [DE:HEMX PROTEIN]
[SP:P16645] [DB:swissprot] >pir:[LN:B35252] [AC:B35252:C69640 ] [PN:hemA concentration
negative effector hemX] [GN:hemX ] [OR:Bacillus subtilis] [DB:pir2] >gp:[GI:g143036]
[LN:BACHEMAXC] [AC:M57676:M32130] [GN:hemX] [OR:Bacillus subtilis] [SR:B.subtilis DNA]
[DB:genpept-bct1] [DE:Bacillus subtilis hemAXCDBL gene cluster.] [NT:unidentified gene
product] [LE:1607] [RE:2437] [DI:direct] >gp:[GI:e1184065:g2635281] [LN:BSUB0015]
[AC:Z99118:AL009126] [PN:membrane-bound protein] [GN:hemX] [FN:negative effector of the
concentration of HemA] [OR:Bacillus subtilis] [DB:genpept-bct1] [DE:Bacillus subtilis
complete genome (section 15 of 21): from 2795131to 3013540.] [SP:P16645] [LE:80898]
[RE:81728] [DI:complement] >gp:[GI:e1165382:g1770082] [LN:BSZ75208] [AC:Z75208]
[PN:membrane-bound protein] [GN:hemX] [OR:Bacillus subtilis] [DB:genpept-bct1]
[DE:B.subtilis genomic sequence 89009bp.] [NT:membrane bound protein dispensable for
heme] [SP:P16645] [LE:88179] [RE:89009] [DI:direct]

| ORF Name | NTID | AAID | NT Length | AA Length | score | probability |
|---|---|---|---|---|---|---|
| AI7503000992_2866255_f3_65 | 2107 | 5879 | 264 | 87 | 74 | 0.045 |

Description
gp:[GI:e1250026:g2842472] [LN:SPBC20F10] [AC:AL021747] [PN:preg-like protein.]
[GN:SPBC20F10.10] [OR:Schizosaccharomyces pombe] [SR:fission yeast] [DB:genpept-pln1]
[DE:S.pombe chromosome II cosmid c20F10.] [NT:SPBC20F10.10, len:243,
SIMILARITY:Arabidopsis] [LE:20474] [RE:21205] [DI:direct]

| ORF Name | NTID | AAID | NT Length | AA Length | score | probability |
|---|---|---|---|---|---|---|
| AI7503000992_31510_f3_55 | 2108 | 5880 | 627 | 208 | 435 | 6.0e-41 |

Description
sp:[LN:3MGA_HAEIN] [AC:P44321] [GN:TAG:HI0654] [OR:HAEMOPHILUS INFLUENZAE]
[EC:3.2.2.20] [DE:GLYCOSYLASE) (TAG)] [SP:P44321] [DB:swissprot] >pir:[LN:G64084]
[AC:G64084 ] [PN:3-methyladenine DNA glycosylase, I] [CL:3-methyladenine DNA
glycosylase I] [OR:Haemophilus influenzae] [EC:3.2.2.-] [DB:pir2] >gp:[GI:g1573653]
[LN:U32748] [AC:U32748:L42023] [PN:DNA-3-methyladenine glycosidase I (tagI)]
[GN:HI0654] [OR:Haemophilus influenzae Rd] [DB:genpept-bct2] [DE:Haemophilus influenzae
Rd section 63 of 163 of the complete genome.] [NT:similar to SP:P05100 GB:J02606
GB:X03845 PID:147920] [LE:6773] [RE:7330] [DI:complement]

| ORF Name | NTID | AAID | NT Length | AA Length | score | probability |
|---|---|---|---|---|---|---|
| AI7503000992_33395050_c2_95 | 2109 | 5881 | 618 | 205 | 577 | 5.3e-56 |

Description
sp:[LN:YSXC_BACSU] [AC:P38424] [GN:YSXC] [OR:BACILLUS SUBTILIS] [DE:(ORFX)] [SP:P38424] [DB:swissprot] >pir:[LN:I40422] [AC:I40422:C69987:S45102 ] [PN:conserved hypothetical protein ysxC] [GN:ysxC ] [CL:Bacillus subtilis conserved hypothetical protein ysxC:translation elongation factor Tu homology] [OR:Bacillus subtilis] [DB:pir2] >gp:[GI:g496558] [LN:BSLONLA] [AC:X76424] [OR:Bacillus subtilis] [DB:genpept-bct1] [DE:B.subtilis lon gene for protease La.] [NT:orfX] [SP:P38424] [LE:2669] [RE:3256] [DI:direct] >gp:[GI:e1184068:g2635284] [LN:BSUB0015] [AC:Z99118:AL009126] [GN:ysxC] [FN:unknown] [OR:Bacillus subtilis] [DB:genpept-bct1] [DE:Bacillus subtilis complete genome (section 15 of 21): from 2795131to 3013540.] [NT:similar to hypothetical proteins] [SP:P38424] [LE:83852] [RE:84439] [DI:complement] >gp:[GI:e1165379:g1770079] [LN:BSZ75208] [AC:Z75208] [PN:hypothetical protein] [GN:ysxC] [OR:Bacillus subtilis] [DB:genpept-bct1] [DE:B.subtilis genomic sequence 89009bp.] [NT:unknown function; putative] [SP:P38424] [LE:85468] [RE:86055] [DI:direct]

| ORF Name | NTID | AAID | NT Length | AA Length | score | probability |
|---|---|---|---|---|---|---|
| AI7503000992_33517_c1_82 | 2110 | 5882 | 1077 | 358 | 258 | 2.8e-21 |

Description
pir:[LN:E69834] [AC:E69834 ] [PN:hypothetical protein yhjN] [GN:yhjN ] [OR:Bacillus subtilis] [DB:pir2] >gp:[GI:e1183059:g2633393] [LN:BSUB0006] [AC:Z99109:AL009126] [GN:yhjN] [FN:unknown] [OR:Bacillus subtilis] [DB:genpept-bct1] [DE:Bacillus subtilis complete genome (section 6 of 21): from 999501 to1209940.] [LE:130891] [RE:132045] [DI:complement] >gp:[GI:e324987:g2226186] [LN:BSY14081] [AC:Y14081] [PN:hypothetical protein] [GN:yhjN] [OR:Bacillus subtilis] [DB:genpept-bct1] [DE:Bacillus subtilis chromosomal DNA, region 92 degrees: regionbetween comK and addAB.] [NT:TTG start; Similarity to a hypothetical protein] [LE:13186] [RE:14340] [DI:complement]

| ORF Name | NTID | AAID | NT Length | AA Length | score | probability |
|---|---|---|---|---|---|---|
| AI7503000992_34642092_c1_85 | 2111 | 5883 | 1284 | 427 | 907 | 5.7e-91 |

Description
sp:[LN:FOLC_BACSU] [AC:Q05865] [GN:FOLC] [OR:BACILLUS SUBTILIS] [EC:6.3.2.17] [DE:SYNTHETASE) (FPGS)] [SP:Q05865] [DB:swissprot] >pir:[LN:B40646] [AC:B40646:B33490:D69626 ] [PN:folyl-polyglutamate synthetase folC] [GN:folC ] [OR:Bacillus subtilis] [DB:pir2] >gp:[GI:g142936] [LN:BACFOLC] [AC:L04520] [PN:folyl-polyglutamate synthetase] [GN:folC] [OR:Bacillus subtilis] [SR:Bacillus subtilis (sub_strain PY79, strain W168) DNA] [DB:genpept-bct1] [DE:Bacillus subtilis valyl tRNA synthetase (valS) gene, 3' end cds;folyl-polyglutamate synthetase (folC) gene, complete cds; comCgene, 5' end cds.] [LE:231] [RE:1523] [DI:direct] >gp:[GI:e1184057:g2635273] [LN:BSUB0015] [AC:Z99118:AL009126] [PN:folyl-polyglutamate synthetase] [GN:folC] [FN:folate biosynthesis] [OR:Bacillus subtilis] [DB:genpept-bct1] [EC:6.3.2.17] [DE:Bacillus subtilis complete genome (section 15 of 21): from 2795131to 3013540.] [SP:Q05865] [LE:69443] [RE:70735] [DI:complement]

| ORF Name | NTID | AAID | NT Length | AA Length | score | probability |
|---|---|---|---|---|---|---|
| AI7503000992_3914012_c2_98 | 2112 | 5884 | 690 | 229 | 710 | 4.3e-70 |

Description
gp:[GI:g2589182] [LN:SAU89396] [AC:U89396] [PN:uroporphyrinogen III synthase] [GN:hemD] [OR:Staphylococcus aureus] [DB:genpept-bct2] [EC:4.2.1.75] [DE:Staphylococcus aureus hemCDBL gene cluster: porphobilinogendeaminase (hemC), uroporphyrinogen III synthase (hemD),d-aminolevulinic acid dehydratase (hemB) and GSA-1-aminotransferase(hemL) genes, complete cds.] [LE:1167] [RE:1835] [DI:direct]

| ORF_Name | NTID | AAID | NT Length | AA Length | score | probability |
|---|---|---|---|---|---|---|
| AI7503000992_4080443_c3_113 | 2113 | 5885 | 1296 | 431 | 2041 | 3.9e-211 |

Description
sp:[LN:GSA_STAAU] [AC:O34092] [GN:HEML] [OR:STAPHYLOCOCCUS AUREUS] [EC:5.4.3.8]
[DE:(GLUTAMATE-1-SEMIALDEHYDE AMINOTRANSFERASE) (GSA-AT)] [SP:O34092] [DB:swissprot]
>gp:[GI:g2589184] [LN:SAU89396] [AC:U89396] [PN:GSA-1-aminotransferase] [GN:hemL]
[OR:Staphylococcus aureus] [DB:genpept-bct2] [EC:5.4.3.8] [DE:Staphylococcus aureus
hemCDBL gene cluster: porphobilinogendeaminase (hemC), uroporphyrinogen III synthase
(hemD),d-aminolevulinic acid dehydratase (hemB) and GSA-1-aminotransferase(hemL) genes,
complete cds.] [LE:2857] [RE:4143] [DI:direct]

| ORF_Name | NTID | AAID | NT Length | AA Length | score | probability |
|---|---|---|---|---|---|---|
| AI7503000992_439183_f1_14 | 2114 | 5886 | 297 | 98 | 208 | 6.8e-17 |

Description
gp:[GI:e1165375:g1770076] [LN:BSZ75208] [AC:Z75208] [PN:hypothetical protein] [GN:ysoC]
[OR:Bacillus subtilis] [DB:genpept-bct1] [DE:B.subtilis genomic sequence 89009bp.]
[NT:unknown function; putative] [LE:80592] [RE:81206] [DI:complement]

| ORF_Name | NTID | AAID | NT Length | AA Length | score | probability |
|---|---|---|---|---|---|---|
| AI7503000992_4729837_c2_92 | 2115 | 5887 | 624 | 207 | 416 | 6.1e-39 |

Description
sp:[LN:YMAB_BACSU] [AC:P50619] [GN:YMAB] [OR:BACILLUS SUBTILIS] [DE:HYPOTHETICAL 23.4
KD PROTEIN IN NRDF-CWLC INTERGENIC REGION] [SP:P50619] [DB:swissprot] >pir:[LN:D69883]
[AC:D69883 ] [PN:hypothetical protein ymaB] [GN:ymaB ] [OR:Bacillus subtilis] [DB:pir2]
>gp:[GI:e218063:g1154634] [LN:BSNRDYMA] [AC:Z68500] [PN:YmaB] [GN:ymaB] [FN:unknown]
[OR:Bacillus subtilis] [DB:genpept-bct1] [DE:B.subtilis cwlC, nrdE, nrdF, ymaA and ymaB
genes.] [NT:no similarities, cannot be inactivated] [SP:P50619] [LE:4450] [RE:5070]
[DI:direct] >gp:[GI:e1183399:g2634124] [LN:BSUB0010] [AC:Z99113:AL009126] [GN:ymaB]
[FN:unknown] [OR:Bacillus subtilis] [DB:genpept-bct1] [DE:Bacillus subtilis complete
genome (section 10 of 21): from 1781201to 2014980.] [LE:90169] [RE:90789] [DI:direct]

| ORF_Name | NTID | AAID | NT Length | AA Length | score | probability |
|---|---|---|---|---|---|---|
| AI7503000992_4891876_f3_45 | 2116 | 5888 | 141 | 46 | | |

Description
NO-HIT

| ORF Name | NTID | AAID | NT Length | AA Length | score | probability |
|---|---|---|---|---|---|---|
| AI7503000992_500052_c3_118 | 2117 | 5889 | 669 | 222 | 440 | 1.8e-41 |

Description sp:[LN:RADC_BACSU] [AC:Q02170] [GN:YSXA] [OR:BACILLUS SUBTILIS] [DE:DNA REPAIR PROTEIN RADC HOMOLOG (ORFB)] [SP:Q02170] [DB:swissprot] >pir:[LN:B45239] [AC:B45239:B45240:I39881:A69987 ] [PN:DNA repair protein homolog ysxA] [GN:ysxA ] [CL:DNA repair protein radc] [OR:Bacillus subtilis] [DB:pir2] >gp:[GI:g142854] [LN:BACDIVREG] [AC:M96343] [GN:orfB] [OR:Bacillus subtilis] [SR:Bacillus subtilis (sub_strain PY79, strain W168) DNA] [DB:genpept-bct1] [DE:Bacillus subtilis orfA, orfB, mreB, mreC, mreD, minC, and minDgenes, complete coding regions.] [NT:homologous to E. coli radC gene product and to] [LE:762] [RE:1457] [DI:direct] >gp:[GI:g143162] [LN:BACMAFMREB] [AC:L08793] [OR:Bacillus subtilis] [SR:Bacillus subtilis (strain W168) DNA] [DB:genpept-bct1] [DE:Bacillus subtilis maf gene, complete cds; orfB, complete cds; mreBgene, 5' end.] [NT:putative] [LE:1557] [RE:2252] [DI:direct] >gp:[GI:e1184053:g2635269] [LN:BSUB0015] [AC:Z99118:AL009126] [GN:ysxA] [FN:unknown] [OR:Bacillus subtilis] [DB:genpept-bct1] [DE:Bacillus subtilis complete genome (section 15 of 21): from 2795131to 3013540.] [NT:similar to DNA repair protein] [SP:Q02170] [LE:65971] [RE:66666] [DI:complement]

| ORF Name | NTID | AAID | NT Length | AA Length | score | probability |
|---|---|---|---|---|---|---|
| AI7503000992_5268775_c3_105 | 2118 | 5890 | 960 | 319 | 138 | 8.5e-07 |

Description pir:[LN:H69986] [AC:H69986 ] [PN:hypothetical protein ysoA] [GN:ysoA ] [OR:Bacillus subtilis] [DB:pir2] >gp:[GI:e1184073:g2635289] [LN:BSUB0015] [AC:Z99118:AL009126] [GN:ysoA] [FN:unknown] [OR:Bacillus subtilis] [DB:genpept-bct1] [DE:Bacillus subtilis complete genome (section 15 of 21): from 2795131to 3013540.] [LE:91788] [RE:92720] [DI:complement] >gp:[GI:e1165372:g1770073] [LN:BSZ75208] [AC:Z75208] [PN:hypothetical protein] [GN:ysoA] [OR:Bacillus subtilis] [DB:genpept-bct1] [DE:B.subtilis genomic sequence 89009bp.] [NT:unknown function; putative] [LE:77187] [RE:78119] [DI:direct]

| ORF Name | NTID | AAID | NT Length | AA Length | score | probability |
|---|---|---|---|---|---|---|
| AI7503000992_5860827_c3_110 | 2119 | 5891 | 1347 | 448 | 1172 | 4.8e-119 |

Description sp:[LN:HEM1_BACSU] [AC:P16618] [GN:HEMA] [OR:BACILLUS SUBTILIS] [EC:1.2.1.-] [DE:GLUTAMYL-TRNA REDUCTASE, (GLUTR)] [SP:P16618] [DB:swissprot] >pir:[LN:A35252] [AC:A35252:C69639 ] [PN:glutamyl-tRNA reductase, hemA:hemA protein] [GN:hemA ] [CL:glutamyl-tRNA reductase] [OR:Bacillus subtilis] [EC:1.2.1.-] [DB:pir2] >gp:[GI:g143035] [LN:BACHEMAXC] [AC:M57676:M32190] [PN:NAD(P)H:glutamyl-transfer RNA reductase] [GN:hemA] [OR:Bacillus subtilis] [SR:B.subtilis DNA] [DB:genpept-bct1] [DE:Bacillus subtilis hemAXCDBL gene cluster.] [NT:The product of this hemA gene is not an] [LE:232] [RE:1599] [DI:direct] >gp:[GI:e1184066:g2635282] [LN:BSUB0015] [AC:Z99118:AL009126] [PN:glutamyl-tRNA reductase] [GN:hemA] [FN:porphyrin biosynthesis] [OR:Bacillus subtilis] [DB:genpept-bct1] [EC:1.2.1.-] [DE:Bacillus subtilis complete genome (section 15 of 21): from 2795131to 3013540.] [SP:P16618] [LE:81736] [RE:83103] [DI:complement] >gp:[GI:e1165381:g1770081] [LN:BSZ75208] [AC:Z75208] [PN:NAD(P)H:glutamyl-transfer RNA reductase] [GN:hemA] [OR:Bacillus subtilis] [DB:genpept-bct1] [EC:2.3.1.37] [DE:B.subtilis genomic sequence 89009bp.] [NT:NAD(P)H:glutamyl-t-RNA reductase of the C-5 pathway] [SP:P16618] [LE:86804] [RE:88171] [DI:direct]

| ORF Name | NTID | AAID | NT Length | AA Length | score | probability |
|---|---|---|---|---|---|---|
| AI7503000992_6845382_f2_26 | 2120 | 5892 | 219 | 72 | 72 | 0.034 |

Description
gp:[GI:e1358367:g3979946] [LN:CEY18D10A] [AC:AL034393] [GN:Y18D10A.14]
[OR:Caenorhabditis elegans] [DB:genpept-invl] [DE:Caenorhabditis elegans cosmid
Y18D10A, complete sequence.] [LE:113813:114013:114203] [RE:113961:114112:114448]
[DI:directJoin]

| ORF Name | NTID | AAID | NT Length | AA Length | score | probability |
|---|---|---|---|---|---|---|
| AI7503000992_7050319_c2_90 | 2121 | 5893 | 237 | 78 | 226 | 8.4e-19 |

Description
sp:[LN:RL35_BACSU] [AC:P55874] [GN:RPMI] [OR:BACILLUS SUBTILIS] [DE:50S RIBOSOMAL
PROTEIN L35] [SP:P55874] [DB:swissprot]

| ORF Name | NTID | AAID | NT Length | AA Length | score | probability |
|---|---|---|---|---|---|---|
| AI7503000992_7283437_c1_89 | 2122 | 5894 | 162 | 54 | | |

Description
NO-HIT

| ORF Name | NTID | AAID | NT Length | AA Length | score | probability |
|---|---|---|---|---|---|---|
| AI7503000992_806510_c1_86 | 2123 | 5895 | 714 | 237 | 189 | 7.0e-15 |

Description
sp:[LN:LEP3_BACSU] [AC:P15378] [GN:COMC] [OR:BACILLUS SUBTILIS] [EC:3.4.99.-] [DE:(LATE
COMPETENCE PROTEIN COMC)] [SP:P15378] [DB:swissprot] >pir:[LN:A33490]
[AC:A33490:E40646:F40646:B69602 ] [PN:type IV prepilin peptidase, :genetic
transformation late competence protein ComC] [GN:comC ] [CL:type IV prepilin peptidase]
[OR:Bacillus subtilis] [EC:3.4.99.-] [DB:pir2] >gp:[GI:g142704] [LN:BACCOMC]
[AC:M30805] [PN:late competence protein] [GN:comC] [OR:Bacillus subtilis]
[SR:Bacillus subtilis (strain IS75) DNA] [DB:genpept-bctl] [DE:Bacillus subtilis late competence
protein (comC) gene, completecds.] [LE:819] [RE:1565] [DI:direct]
>gp:[GI:e1184056:g2635272] [LN:BSUB0015] [AC:Z99119:AL009126] [PN:DNA-binding protein]
[GN:comC] [FN:required for the processing and translocation] [OR:Bacillus subtilis]
[DB:genpept-bctl] [DE:Bacillus subtilis complete genome (section 15 of 21): from
2795131to 3013540.] [SP:P15378] [LE:68557] [RE:69303] [DI:complement]

| ORF Name | NTID | AAID | NT Length | AA Length | score | probability |
|---|---|---|---|---|---|---|
| AI7503000992_820253_f1_15 | 2124 | 5896 | 297 | 98 | 206 | 1.1e-16 |

Description
gp:[GI:e1165375:g1770076] [LN:BSZ75208] [AC:Z75208] [PN:hypothetical protein] [GN:ysoC]
[OR:Bacillus subtilis] [DB:genpept-bctl] [DE:B.subtilis genomic sequence 89009bp.]
[NT:unknown function; putative] [LE:80592] [RE:81206] [DI:complement]

| ORF Name | NTID | AAID | NT Length | AA Length | score | probability |
|---|---|---|---|---|---|---|
| AI7503000992_978562_c1_79 | 2125 | 5897 | 861 | 286 | 1261 | 1.8e-128 |

Description
sp:[LN:HEM2_STAAU] [AC:P50915] [GN:HEMB] [OR:STAPHYLOCOCCUS AUREUS] [EC:4.2.1.24]
[DE:SYNTHASE) (ALAD) (ALADH)] [SP:P50915] [DB:swissprot] >gp:[GI:g2589183]
[LN:SAU89396] [AC:U89396] [PN:d-aminolevulinic acid dehydratase] [GN:hemB]
[OR:Staphylococcus aureus] [DB:genpept-bct2] [EC:4.2.1.24] [DE:Staphylococcus aureus
hemCDBL gene cluster: porphobilinogendeaminase (hemC), uroporphyrinogen III synthase
(hemD),d-aminolevulinic acid dehydratase (hemB) and GSA-1-aminotransferase(hemL) genes,
complete cds.] [LE:1838] [RE:2809] [DI:direct]

| ORF Name | NTID | AAID | NT Length | AA Length | score | probability |
|---|---|---|---|---|---|---|
| AI7503000993_10266875_c2_761 | 2126 | 5898 | 156 | 51 | | |

Description
NO-HIT

| ORF Name | NTID | AAID | NT Length | AA Length | score | probability |
|---|---|---|---|---|---|---|
| AI7503000993_10463_c2_803 | 2127 | 5899 | 504 | 167 | 315 | 3.1e-28 |

Description
sp:[LN:YTXG_BACSU] [AC:P40779] [GN:YTXG] [OR:BACILLUS SUBTILIS] [DE:HYPOTHETICAL 15.7 KD PROTEIN IN MURC-AROA INTERGENIC REGION (ORF1)] [SP:P40779] [DB:swissprot] >pir:[LN:D70003] [AC:D70003;S71001 ] [PN:general stress protein homolog ytxG] [GN:ytxG ] [OR:Bacillus subtilis] [DB:pir2] >gp:[GI:g556015] [LN:BACUNAM] [AC:L31845] [OR:Bacillus subtilis] [DB:genpept-bct1] [DE:Bacillus subtilis UDP-N-acetylmuramate-alanine ligase gene, partialcds, and 3 ORF's.] [NT:ORF1] [LE:1211] [RE:1642] [DI:direct] >gp:[GI:e1185851:g2635462] [LN:BSUB0016] [AC:Z99119:AL009126] [GN:ytxG] [FN:unknown] [OR:Bacillus subtilis] [DB:genpept-bct1] [DE:Bacillus subtilis complete genome (section 16 of 21): from 2997771to 3213410.] [NT:alternate gene name: csb40; similar to general] [SP:P40779] [LE:48897] [RE:49328] [DI:complement] >gp:[GI:g2293217] [LN:AF008220] [AC:AF008220] [PN:YtxG] [GN:ytxG] [OR:Bacillus subtilis] [DB:genpept-bct2] [DE:Bacillus subtilis rrnB-dnaB genomic region.] [LE:131098] [RE:131529] [DI:direct]

| ORF Name | NTID | AAID | NT Length | AA Length | score | probability |
|---|---|---|---|---|---|---|
| AI7503000993_10548383_f1_3 | 2128 | 5900 | 237 | 78 | | |

Description
NO-HIT

| ORF Name | NTID | AAID | NT Length | AA Length | score | probability |
|---|---|---|---|---|---|---|
| AI7503000993_10564375_f3_510 | 2129 | 5901 | 123 | 40 | | |

Description
NO-HIT

| ORF Name | NTID | AAID | NT Length | AA Length | score | probability |
|---|---|---|---|---|---|---|
| AI7503000993_1056693_c2_793 | 2130 | 5902 | 1101 | 366 | 774 | 7.1e-77 |

Description
pir:[LN:B69998] [AC:B69998 ] [PN:endo-1,4-beta-glucanase homolog ytoP] [GN:ytoP ] [CL:thermophilic aminopeptidase I alpha chain] [OR:Bacillus subtilis] [DB:pir2] >gp:[GI:e1185859:g2635470] [LN:BSUB0016] [AC:Z99119:AL009126] [GN:ytoP] [FN:unknown] [OR:Bacillus subtilis] [DB:genpept-bct1] [DE:Bacillus subtilis complete genome (section 16 of 21): from 2997771to 3213410.] [NT:similar to endo-1,4-beta-glucanase] [LE:56559] [RE:57632] [DI:complement] >gp:[GI:g2293210] [LN:AF008220] [AC:AF008220] [PN:YtoP] [GN:ytoP] [OR:Bacillus subtilis] [DB:genpept-bct2] [DE:Bacillus subtilis rrnB-dnaB genomic region.] [NT:similar to hypothetical protein f356 from E. coli] [LE:122794] [RE:123867] [DI:direct]

| ORF Name | NTID | AAID | NT Length | AA Length | score | probability |
|---|---|---|---|---|---|---|
| AI7503000993_10588877_f1_52 | 2131 | 5903 | 138 | 45 | | |

Description
NO-HIT

| ORF Name | NTID | AAID | NT Length | AA Length | score | probability |
|---|---|---|---|---|---|---|
| AI7503000993_10667002_f1_111 | 2132 | 5904 | 165 | 54 | | |

Description
NO-HIT

| ORF Name | NTID | AAID | NT Length | AA Length | score | probability |
|---|---|---|---|---|---|---|
| AI7503000993_109430_f3_485 | 2133 | 5905 | 144 | 47 | | |

Description
NO-HIT

| ORF Name | NTID | AAID | NT Length | AA Length | score | probability |
|---|---|---|---|---|---|---|
| AI7503000993_10969427_f3_448 | 2134 | 5906 | 156 | 51 | | |

Description
NO-HIT

| ORF Name | NTID | AAID | NT Length | AA Length | score | probability |
|---|---|---|---|---|---|---|
| AI7503000993_112525_f3_546 | 2135 | 5907 | 141 | 46 | | |

Description
NO-HIT

| ORF Name | NTID | AAID | NT Length | AA Length | score | probability |
|---|---|---|---|---|---|---|
| AI7503000993_116337_f2_251 | 2136 | 5908 | 627 | 208 | 199 | 6.1e-16 |

Description
gp:[GI:g3043872] [LN:LLU95837] [AC:U95837] [PN:transmembrane protein Tmp3]
[OR:Lactococcus lactis] [DB:genpept-bct2] [DE:Lactococcus lactis transmembrane protein
Tmp3 gene, partial cds.] [NT:PBP1A homolog; identified as a fusion to a signal] [LE:<1]
[RE:588] [DI:complement]

| ORF Name | NTID | AAID | NT Length | AA Length | score | probability |
|---|---|---|---|---|---|---|
| AI7503000993_11881325_f3_568 | 2137 | 5909 | 147 | 48 | | |

Description
NO-HIT

| ORF Name | NTID | AAID | NT Length | AA Length | score | probability |
|---|---|---|---|---|---|---|
| AI7503000993_1203827_c3_893 | 2138 | 5910 | 639 | 212 | 475 | 3.4e-45 |

Description
sp:[LN:RISA_ACTPL] [AC:P50854] [GN:RIBE:RIBB] [OR:ACTINOBACILLUS PLEUROPNEUMONIAE]
[SR:,HAEMOPHILUS PLEUROPNEUMONIAE] [EC:2.5.1.9] [DE:RIBOFLAVIN SYNTHASE ALPHA CHAIN,]
[SP:P50854] [DB:swissprot] >gp:[GI:g1173517] [LN:APU27202] [AC:U27202] [PN:riboflavin
synthase alpha subunit] [GN:ribB] [OR:Actinobacillus pleuropneumoniae]
[DB:genpept-bct1] [DE:Actinobacillus pleuropneumoniae riboflavin biosynthesis
operon,riboflavin-specific deaminase (ribG), riboflavin synthase alphasubunit (ribB),
bifunctional GTP cyclohydraseII/3,4-dihydroxy-2-butanone-4-phosphate synthase (ribA),
andriboflavin synthase beta subunit (ribH) genes, complete cds.] [NT:lumazine synthase;
similar to Bacillus subtilis] [LE:1685] [RE:2332] [DI:direct]

| ORF Name | NTID | AAID | NT Length | AA Length | score | probability |
|---|---|---|---|---|---|---|
| AI7503000993_1209417_c3_959 | 2139 | 5911 | 1704 | 567 | 797 | 2.6e-79 |

Description sp:[LN:PHOR_BACSU] [AC:P23545] [GN:PHOR] [OR:BACILLUS SUBTILIS] [EC:2.7.3.-] [DE:ALKALINE PHOSPHATASE SYNTHESIS SENSOR PROTEIN PHOR,] [SP:P23545] [DB:swissprot] >pir:[LN:A27650] [AC:A27650:G69676 ] [PN:phosphate response regulator histidine kinase phoR] [GN:phoR ] [OR:Bacillus subtilis] [DB:pir2] >gp:[GI:g143331] [LN:BACPHORP] [AC:M23549] [PN:alkaline phosphatase regulatory protein] [GN:phoR] [OR:Bacillus subtilis] [SR:Bacillus subtilis DNA] [DB:genpept-bct1] [DE:Bacillus subtilis alkaline phosphatase regulatory protein (phoPgene, 3' end and phoR gene, complete cds).] [LE:85] [RE:1824] [DI:direct] >gp:[GI:e1184159:g2635375] [LN:BSUB0015] [AC:Z99118:AL009126] [PN:two-component sensor histidine kinase] [GN:phoR] [FN:involved in phosphate regulation] [OR:Bacillus subtilis] [DB:genpept-bct1] [DE:Bacillus subtilis complete genome (section 15 of 21): from 2795131to 3013540.] [SP:P23545] [LE:180011] [RE:181750] [DI:complement] >gp:[GI:g2293271] [LN:AF008220] [AC:AF008220] [PN:signal transduction protein kinase] [GN:phoR] [OR:Bacillus subtilis] [DB:genpept-bct2] [DE:Bacillus subtilis rrnB-dnaB genomic region.] [LE:201317] [RE:203056] [DI:direct]

| ORF Name | NTID | AAID | NT Length | AA Length | score | probability |
|---|---|---|---|---|---|---|
| AI7503000993_125880_f2_361 | 2140 | 5912 | 309 | 102 | | |

Description

NO-HIT

| ORF Name | NTID | AAID | NT Length | AA Length | score | probability |
|---|---|---|---|---|---|---|
| AI7503000993_1284381_c1_652 | 2141 | 5913 | 741 | 246 | 297 | 2.5e-26 |

Description sp:[LN:TAL_METJA] [AC:Q58370] [GN:TAL:MJ0960] [OR:METHANOCOCCUS JANNASCHII] [EC:2.2.1.-] [DE:TRANSALDOLASE-LIKE PROTEIN,] [SP:Q58370] [DB:swissprot] >pir:[LN:H64419] [AC:H64419 ] [PN:transaldolase,] [CL:Bacillus subtilis 23K phosphoprotein orfU] [OR:Methanococcus jannaschii] [EC:2.2.1.2] [DB:pir2] [MP:REV892437-891784 ] >gp:[GI:g1591624] [LN:U67539] [AC:U67539:L77117] [PN:transaldolase] [GN:MJ0960] [OR:Methanococcus jannaschii] [DB:genpept-bct2] [DE:Methanococcus jannaschii section 81 of 150 of the complete genome.] [NT:similar to SP:P19669 PID:853766 GB:AL009126 percent] [LE:7990] [RE:8643] [DI:complement]

| ORF Name | NTID | AAID | NT Length | AA Length | score | probability |
|---|---|---|---|---|---|---|
| AI7503000993_12894378_f2_347 | 2142 | 5914 | 177 | 58 | | |

Description

NO-HIT

| ORF Name | NTID | AAID | NT Length | AA Length | score | probability |
|---|---|---|---|---|---|---|
| AI7503000993_13001537_f3_444 | 2143 | 5915 | 249 | 82 | | |

Description

NO-HIT

| ORF Name | NTID | AAID | NT Length | AA Length | score | probability |
|---|---|---|---|---|---|---|
| AI7503000993_13089052_f3_538 | 2144 | 5916 | 141 | 46 | | |

Description

NO-HIT

| ORF Name | NTID | AAID | NT Length | AA Length | score | probability |
|---|---|---|---|---|---|---|
| AI7503000993_1352042_c2_777 | 2145 | 5917 | 180 | 59 | | |

Description
NO-HIT

| ORF Name | NTID | AAID | NT Length | AA Length | score | probability |
|---|---|---|---|---|---|---|
| AI7503000993_13678452_c1_628 | 2146 | 5918 | 1263 | 420 | 438 | 2.9e-41 |

Description
sp:[LN:ECSB_BACSU] [AC:P55340] [GN:ECSB:PRST] [OR:BACILLUS SUBTILIS] [DE:PROTEIN ECSB]
[SP:P55340] [DB:swissprot] >pir:[LN:G69619] [AC:G69619 ] [PN:ABC transporter (membrane
protein) ecsB] [GN:ecsB ] [OR:Bacillus subtilis] [DB:pir2] >gp:[GI:e183450:g1177254]
[LN:BSECSABCG] [AC:X87807] [PN:hypothetical EcsB protein] [GN:ecsB] [OR:Bacillus
subtilis] [DB:genpept-bct1] [DE:B.subtilis ecsA, ecsB, and ecsC genes.] [SP:P55340]
[LE:984] [RE:2210] [DI:direct] >gp:[GI:e1183007:g2633341] [LN:BSUB0006]
[AC:Z99109:AL009126] [PN:ABC transporter (membrane protein)] [GN:ecsB] [FN:regulates
both components of the protein] [OR:Bacillus subtilis] [DB:genpept-bct1] [DE:Bacillus
subtilis complete genome (section 6 of 21): from 999501 to1209940.] [NT:alternate gene
name: prsT, yhaC] [SP:P55340] [LE:78149] [RE:79375] [DI:direct]
>gp:[GI:e324951:g2226114] [LN:BSY14077] [AC:Y14077] [PN:Hypothetical protein] [GN:yhaC]
[OR:Bacillus subtilis] [DB:genpept-bct1] [DE:Bacillus subitlis 10.6 Kb chromosomal DNA:
glyB-prsA region.] [NT:Identified as ecsB. Hypothetical integral membrane] [SP:P55340]
[LE:1538] [RE:2764] [DI:complement]

| ORF Name | NTID | AAID | NT Length | AA Length | score | probability |
|---|---|---|---|---|---|---|
| AI7503000993_13722338_c3_943 | 2147 | 5919 | 507 | 168 | 505 | 2.3e-48 |

Description
pir:[LN:F69992] [AC:F69992 ] [PN:thiol peroxidase homolog ytgI] [GN:ytgI ] [CL:thiol
peroxidase] [OR:Bacillus subtilis] [DB:pir2] >gp:[GI:e1185822:g2635433] [LN:BSUB0016]
[AC:Z99119:AL009126] [GN:ytgI] [FN:unknown] [OR:Bacillus subtilis] [DB:genpept-bct1]
[DE:Bacillus subtilis complete genome (section 16 of 21): from 2997771to 3213410.]
[NT:similar to thiol peroxidase] [LE:18998] [RE:19501] [DI:complement]
>gp:[GI:g2293238] [LN:AF008220] [AC:AF008220] [PN:YtgI] [GN:ytgI] [OR:Bacillus
subtilis] [DB:genpept-bct2] [DE:Bacillus subtilis rrnB-dnaB genomic region.]
[NT:similarity to tagD protein from V.cholerae] [LE:160926] [RE:161429] [DI:direct]

| ORF Name | NTID | AAID | NT Length | AA Length | score | probability |
|---|---|---|---|---|---|---|
| AI7503000993_13723318_c3_945 | 2148 | 5920 | 1149 | 382 | 1230 | 3.4e-125 |

Description
pir:[LN:JE0388] [AC:JE0388 ] [PN:alanine dehydrogenase,] [OR:Enterobacter aerogenes]
[EC:1.4.1.1] [DB:pir3] >gp:[GI:d1041279:g4803749] [LN:AB013821] [AC:AB013821]
[PN:alanine dehydrogenase] [GN:aladh] [OR:Enterobacter aerogenes] [SR:Enterobacter
aerogenes DNA] [DB:genpept-bct1] [EC:1.4.1.1] [DE:Enterobacter aerogenes aladh gene for
alanine dehydrogenase,complete cds.] [LE:174] [RE:1307] [DI:direct]

| ORF Name | NTID | AAID | NT Length | AA Length | score | probability |
|---|---|---|---|---|---|---|
| AI7503000993_13787912_c3_891 | 2149 | 5921 | 1524 | 507 | 118 | 1.7e-05 |

Description
pir:[LN:D64924] [AC:D64924 ] [PN:hypothetical protein b1668] [OR:Escherichia coli] [DB:pir2] >gp:[GI:g1549279] [LN:ECU68703] [AC:U68703] [OR:Escherichia coli] [DB:genpept-bct1] [DE:Escherichia coli K-12 MG1655 genome, ribC-pykF region.] [NT:hypothetical protein] [LE:4535] [RE:6139] [DI:direct] >gp:[GI:g1787957] [LN:AE000262] [AC:AE000262:U00096] [PN:orf, hypothetical protein] [GN:b1668] [FN:orf; Unknown] [OR:Escherichia coli] [DB:genpept-bct2] [DE:Escherichia coli K-12 MG1655 section 152 of 400 of the completegenome.] [NT:o534; This 534 aa ORF is 38 pct identical (6 gaps)] [LE:872] [RE:2476] [DI:direct]

| ORF Name | NTID | AAID | NT Length | AA Length | score | probability |
|---|---|---|---|---|---|---|
| AI7503000993_13852187_f1_136 | 2150 | 5922 | 186 | 61 | 113 | 4.5e-06 |

Description
pir:[LN:S77632] [AC:S77632:S52761 ] [PN:probable integrase] [GN:int ] [OR:Staphylococcus aureus phage phi-13] [DB:pir2] >gp:[GI:g758229] [LN:PHI13INT] [AC:X82312] [PN:integrase] [GN:int] [FN:integration of phi-13 in S.aureus genome] [OR:Bacteriophage phi-13] [DB:genpept-phg] [DE:Bacteriophage phi-13 integrase gene.] [LE:461] [RE:1498] [DI:direct]

| ORF Name | NTID | AAID | NT Length | AA Length | score | probability |
|---|---|---|---|---|---|---|
| AI7503000993_13939027_f3_560 | 2151 | 5923 | 186 | 61 | | |

Description
NO-HIT

| ORF Name | NTID | AAID | NT Length | AA Length | score | probability |
|---|---|---|---|---|---|---|
| AI7503000993_14251933_f2_239 | 2152 | 5924 | 663 | 220 | 818 | 1.5e-81 |

Description
pir:[LN:A37146] [AC:A37146:A44901:S11354:C69699:I39962 ] [PN:ribosomal protein S4:ribosomal protein BS4 (rpsD)] [GN:rpsD ] [CL:Escherichia coli ribosomal protein S4] [OR:Bacillus subtilis] [DB:pir2] >gp:[GI:g143467] [LN:BACRPSD] [AC:M59358:M34718] [PN:ribosomal protein S4] [GN:rpsD] [OR:Bacillus subtilis] [SR:B.subtilis (strain 168, isolate BR151) DNA] [DB:genpept-bct1] [DE:B.subtilis ribosomal protein S4 gene, complete cds and tyrosyl tRNAsynthetase (tyrS) gene, 3' end.] [LE:756] [RE:1358] [DI:direct] >gp:[GI:e1185839:g2635450] [LN:BSUB0016] [AC:Z99119:AL009126] [PN:ribosomal protein S4 (BS4)] [GN:rpsD] [OR:Bacillus subtilis] [DB:genpept-bct1] [DE:Bacillus subtilis complete genome (section 16 of 21): from 2997771to 3213410.] [SP:P21466] [LE:37035] [RE:37637] [DI:direct] >gp:[GI:g2293319] [LN:AF008220] [AC:AF008220] [PN:ribosomal protein S4] [GN:rpsD] [OR:Bacillus subtilis] [DB:genpept-bct2] [DE:Bacillus subtilis rrnB-dnaB genomic region.] [LE:142790] [RE:143392] [DI:complement]

| ORF Name | NTID | AAID | NT Length | AA Length | score | probability |
|---|---|---|---|---|---|---|
| AI7503000993_14460877_c3_963 | 2153 | 5925 | 138 | 45 | 131 | 2.8e-08 |

Description
gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF_Name | NTID | AAID | NT Length | AA Length | score | probability |
|---|---|---|---|---|---|---|
| AI7503000993_14460882_c1_649 | 2154 | 5926 | 177 | 58 | 227 | 6.6e-19 |

Description
gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF_Name | NTID | AAID | NT Length | AA Length | score | probability |
|---|---|---|---|---|---|---|
| AI7503000993_14460932_c1_612 | 2155 | 5927 | 177 | 58 | 211 | 3.3e-17 |

Description
gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF_Name | NTID | AAID | NT Length | AA Length | score | probability |
|---|---|---|---|---|---|---|
| AI7503000993_14460932_f2_226 | 2156 | 5928 | 168 | 55 | 196 | 1.3e-15 |

Description
gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF_Name | NTID | AAID | NT Length | AA Length | score | probability |
|---|---|---|---|---|---|---|
| AI7503000993_14656327_c2_751 | 2157 | 5929 | 624 | 207 | 799 | 1.6e-79 |

Description
gp:[GI:g1916729] [LN:AF134905] [AC:AF134905:U76550] [PN:CadD] [GN:cadD] [OR:Staphylococcus aureus] [DB:genpept-bct2] [DE:Staphylococcus aureus plasmid pRW001 CadD (cadD) gene, completecds.] [NT:confers low level cadmium resistance] [LE:2328] [RE:2957] [DI:direct]

| ORF_Name | NTID | AAID | NT Length | AA Length | score | probability |
|---|---|---|---|---|---|---|
| AI7503000993_14658152_f3_589 | 2158 | 5930 | 156 | 51 | | |

Description
NO-HIT

| ORF_Name | NTID | AAID | NT Length | AA Length | score | probability |
|---|---|---|---|---|---|---|
| AI7503000993_14742937_c2_774 | 2159 | 5931 | 231 | 76 | | |

Description
NO-HIT

| ORF Name | NTID | AAID | NT Length | AA Length | score | probability |
|---|---|---|---|---|---|---|
| AI7503000993_14877316_f1_64 | 2160 | 5932 | 483 | 160 | 407 | 5.5e-38 |

Description
sp:[LN:YEBR_ECOLI] [AC:P76270:007976:007978] [GN:YEBR] [OR:ESCHERICHIA COLI] [DE:HYPOTHETICAL 20.3 KD PROTEIN IN PRC-PPHA INTERGENIC REGION] [SP:P76270:007976:007978] [DB:swissprot] >pir:[LN:H64944] [AC:H64944 ] [PN:probable membrane protein b1832] [CL:hypothetical protein YKL069w] [OR:Escherichia coli] [DB:pir2] >gp:[GI:d1016364:g1736473] [LN:D90826] [AC:D90826:AB001340] [GN:YKL069W, YKL340] [OR:Escherichia coli] [SR:Escherichia coli (strain:K12) DNA, clone_lib:Kohara lambda minise] [DB:genpept-bct1] [DE:E.coli genomic DNA, Kohara clone #335(40.9-41.3 min.).] [NT:ORF_ID:o335#13; similar to [SwissProt Accession] [LE:16795] [RE:17346] [DI:complement] >gp:[GI:d1016369:g1736479] [LN:D90827] [AC:D90827:AB001340] [GN:YKL069W, YKL340] [OR:Escherichia coli] [SR:Escherichia coli (strain:K12) DNA, clone_lib:Kohara lambda minise] [DB:genpept-bct1] [DE:E.coli genomic DNA, Kohara clone #336(41.2-41.6 min.).] [NT:ORF_ID:o335#13; similar to [SwissProt Accession] [LE:2748] [RE:3299] [DI:complement] >gp:[GI:g1788136] [LN:AE000277] [AC:AE000277:U00096] [PN:orf, hypothetical protein] [GN:b1832] [FN:orf; Unknown] [OR:Escherichia coli] [DB:genpept-bct2] [DE:Escherichia coli K-12 MG1655 section 167 of 400 of the completegenome.] [NT:f183; residues 72-127 are 57 pct identical to] [LE:7076] [RE:7627] [DI:complement]

| ORF Name | NTID | AAID | NT Length | AA Length | score | probability |
|---|---|---|---|---|---|---|
| AI7503000993_14882928_c3_923 | 2161 | 5933 | 1098 | 365 | 1279 | 2.2e-130 |

Description
gp:[GI:e220317:g1177684] [LN:SXCCPA] [AC:X95439] [PN:chorismate mutase] [GN:aroA] [OR:Staphylococcus xylosus] [DB:genpept-bct1] [EC:5.4.99.5] [DE:S.xylosus aroA, ccpA, acuC and acuA genes.] [LE:<1] [RE:807] [DI:direct]

| ORF Name | NTID | AAID | NT Length | AA Length | score | probability |
|---|---|---|---|---|---|---|
| AI7503000993_15650303_c3_882 | 2162 | 5934 | 207 | 68 | | |

Description
NO-HIT

| ORF Name | NTID | AAID | NT Length | AA Length | score | probability |
|---|---|---|---|---|---|---|
| AI7503000993_163151_c3_886 | 2163 | 5935 | 1248 | 415 | 1800 | 1.3e-185 |

Description
sp:[LN:METK_STAAU] [AC:P50307] [GN:METK] [OR:STAPHYLOCOCCUS AUREUS] [EC:2.5.1.6] [DE:ADENOSYLTRANSFERASE) (ADOMET SYNTHETASE)] [SP:P50307] [DB:swissprot] >gp:[GI:g1020317] [LN:SAU36379] [AC:U36379] [PN:S-adenosylmethionine synthetase] [FN:catalyses the synthesis of SAM] [OR:Staphylococcus aureus] [DB:genpept-bct1] [DE:Staphylococcus aureus S-adenosylmethionine synthetase gene,complete cds.] [NT:SAM synthetase] [LE:212] [RE:1405] [DI:direct]

| ORF Name | NTID | AAID | NT Length | AA Length | score | probability |
|---|---|---|---|---|---|---|
| AI7503000993_16533442_c2_738 | 2164 | 5936 | 522 | 173 | 546 | 1.0e-52 |

Description
gp:[GI:g1381681] [LN:BSU58864] [AC:U58864] [PN:CspR] [GN:cspR] [OR:Bacillus subtilis] [SR:Bacillus subtilis strain=JH642] [DB:genpept-bct1] [DE:Bacillus subtilis methylase homolog (cspR) gene, complete cds.] [NT:methylase homolog] [LE:573] [RE:1046] [DI:direct]

| ORF_Name | NTID | AAID | NT Length | AA Length | score | probability |
|---|---|---|---|---|---|---|
| AI7503000993_16586012_f2_308 | 2165 | 5937 | 588 | 195 | 456 | 3.5e-43 |

Description pir:[LN:E69999] [AC:E69999 ] [PN:hypothetical protein ytqB] [GN:ytqB ] [OR:Bacillus subtilis] [DB:pir2] >gp:[GI:e1185922:g2635533] [LN:BSUB0016] [AC:Z99119:AL009126] [GN:ytqB] [FN:unknown] [OR:Bacillus subtilis] [DB:genpept-bct1] [DE:Bacillus subtilis complete genome (section 16 of 21): from 2997771to 3213410.] [LE:122275] [RE:122859] [DI:direct] >gp:[GI:g2293301] [LN:AF008220] [AC:AF008220] [PN:YtqB] [GN:ytqB] [OR:Bacillus subtilis] [DB:genpept-bct2] [DE:Bacillus subtilis rrnB-dnaB genomic region.] [LE:57568] [RE:58152] [DI:complement]

| ORF_Name | NTID | AAID | NT Length | AA Length | score | probability |
|---|---|---|---|---|---|---|
| AI7503000993_165908_f2_353 | 2166 | 5938 | 507 | 168 | 182 | 3.8e-14 |

Description sp:[LN:YHGC_BACSU] [AC:P38049] [GN:YHGC] [OR:BACILLUS SUBTILIS] [DE:HYPOTHETICAL 18.8 KD PROTEIN IN ECSC-PBPF INTERGENIC REGION] [SP:P38049] [DB:swissprot] >pir:[LN:B40614] [AC:B40614:F69832 ] [PN:conserved hypothetical protein yhgC:hypothetical protein X (pbpF 5' region)] [GN:yhgC ] [OR:Bacillus subtilis] [DB:pir2] >gp:[GI:g304160] [LN:BACPBPF] [AC:L10630] [OR:Bacillus subtilis] [SR:Bacillus subtilis (strain W168) DNA] [DB:genpept-bct1] [DE:Bacillus subtilis penicillin-binding protein (pbpF) gene, 5' end.] [NT:product unknown] [LE:247] [RE:747] [DI:complement] >gp:[GI:e1183012:g2633346] [LN:BSUB0006] [AC:Z99109:AL009126] [GN:yhgC] [FN:unknown] [OR:Bacillus subtilis] [DB:genpept-bct1] [DE:Bacillus subtilis complete genome (section 6 of 21): from 999501 to1209940.] [NT:alternate gene name: yixC; similar to hypothetical] [SP:P38049] [LE:83202] [RE:83702] [DI:complement] >gp:[GI:e325006:g2226228] [LN:BSY14083] [AC:Y14083] [PN:Hypothetical protein] [GN:yixC] [OR:Bacillus subtilis] [DB:genpept-bct1] [DE:Bacillus subtilis chromosomal DNA, region 76-78 degrees: betweenglyB-aprE.] [NT:See Swiss Prot P38049; YIXC_BACSU] [SP:P38049] [LE:3061] [RE:3561] [DI:complement]

| ORF_Name | NTID | AAID | NT Length | AA Length | score | probability |
|---|---|---|---|---|---|---|
| AI7503000993_16835053_c2_758 | 2167 | 5939 | 168 | 55 | | |

Description

NO-HIT

| ORF_Name | NTID | AAID | NT Length | AA Length | score | probability |
|---|---|---|---|---|---|---|
| AI7503000993_16994043_c3_933 | 2168 | 5940 | 1128 | 375 | 81 | 0.0062 |

Description pir:[LN:E69106] [AC:E69106 ] [PN:hypothetical protein MTH1793] [GN:MTH1793 ] [OR:Methanobacterium thermoautotrophicum] [DB:pir2] >gp:[GI:g2622925] [LN:AE000934] [AC:AE000934:AE000666] [PN:unknown] [GN:MTH1793] [OR:Methanobacterium thermoautotrophicum] [DB:genpept-bct2] [DE:Methanobacterium thermoautotrophicum from bases 1640298 to 1655421(section 140 of 148) of the complete genome.] [NT:Function Code:14.00 - Unknown, ; similar to,] [LE:89] [RE:790] [DI:complement]

| ORF_Name | NTID | AAID | NT Length | AA Length | score | probability |
|---|---|---|---|---|---|---|
| AI7503000993_189437_f1_34 | 2169 | 5941 | 144 | 47 | | |

Description

NO-HIT

| ORF Name | NTID | AAID | NT Length | AA Length | score | probability |
|---|---|---|---|---|---|---|
| AI7503000993_191713_c3_904 | 2170 | 5942 | 1109 | 3696 | 1884 | 6.9e-195 |

Description
gp:[GI:e286140:g4775551] [LN:SACTORF13] [AC:Y09928] [OR:Staphylococcus aureus]
[DB:genpept-bct1] [DE:S.aureus CTORF1365, partial.] [NT:CTORF1365] [LE:<1] [RE:>3982]
[DI:direct]

| ORF Name | NTID | AAID | NT Length | AA Length | score | probability |
|---|---|---|---|---|---|---|
| AI7503000993_19565876_c3_915 | 2171 | 5943 | 201 | 66 | | |

Description
NO-HIT

| ORF Name | NTID | AAID | NT Length | AA Length | score | probability |
|---|---|---|---|---|---|---|
| AI7503000993_1960937_c3_964 | 2172 | 5944 | 177 | 58 | 228 | 5.1e-19 |

Description
gp:[GI:g1022726] [LN:SHU35635] [AC:U35635] [PN:unknown] [OR:Staphylococcus
haemolyticus] [SR:Staphylococcus haemolyticus strain=Y176] [DB:genpept-bct1]
[DE:Staphylococcus haemolyticus IS1272 ORF1 and ORF2 genes, completecds.] [NT:ORF1]
[LE:1101] [RE:1922] [DI:complement]

| ORF Name | NTID | AAID | NT Length | AA Length | score | probability |
|---|---|---|---|---|---|---|
| AI7503000993_19742842_c2_769 | 2173 | 5945 | 849 | 282 | 776 | 4.4e-77 |

Description
pir:[LN:C70040] [AC:C70040 ] [PN:plant-metabolite dehydrogenase homolog yvgN] [GN:yvgN
] [CL:aldehyde reductase] [OR:Bacillus subtilis] [DB:pir2] >gp:[GI:e1249784:g2832788]
[LN:BS43KBDNA] [AC:AJ223978] [PN:putative reductase protein, YvgN] [GN:yvgN]
[OR:Bacillus subtilis] [DB:genpept-bct1] [DE:Bacillus subtilis 42.7kB DNA fragment from
yvsA to yvqA.] [LE:646] [RE:1476] [DI:direct] >gp:[GI:e1186028:g2635853] [LN:BSUB0018]
[AC:Z99121:AL009126] [GN:yvgN] [FN:unknown] [OR:Bacillus subtilis] [DB:genpept-bct1]
[DE:Bacillus subtilis complete genome (section 18 of 21): from 3399551to 3609060.]
[NT:alternate gene name: yvsB; similar to] [LE:26261] [RE:27091] [DI:complement]

| ORF Name | NTID | AAID | NT Length | AA Length | score | probability |
|---|---|---|---|---|---|---|
| AI7503000993_19770437_c2_830 | 2174 | 5946 | 1332 | 443 | 1018 | 9.9e-103 |

Description
pir:[LN:A69998] [AC:A69998 ] [PN:hypothetical protein ytoI] [GN:ytoI ] [OR:Bacillus
subtilis] [DB:pir2] >gp:[GI:e1184176:g2635392] [LN:BSUB0015] [AC:Z99118:AL009126]
[GN:ytoI] [FN:unknown] [OR:Bacillus subtilis] [DB:genpept-bct1] [DE:Bacillus subtilis
complete genome (section 15 of 21): from 2795131to 3013540.] [LE:201244] [RE:202563]
[DI:complement] >gp:[GI:g2293258] [LN:AF008220] [AC:AF008220] [PN:YtoI] [GN:ytoI]
[OR:Bacillus subtilis] [DB:genpept-bct2] [DE:Bacillus subtilis rrnB-dnaB genomic
region.] [NT:similarity with hypothetical protein 3 from] [LE:180504] [RE:181823]
[DI:direct]

| ORF Name | NTID | AAID | NT Length | AA Length | score | probability |
|---|---|---|---|---|---|---|
| AI7503000993_1991325_f3_469 | 2175 | 5947 | 219 | 72 | | |

Description
NO-HIT

| ORF Name | NTID | AAID | NT Length | AA Length | score | probability |
|---|---|---|---|---|---|---|
| AI7503000993_19922162_c3_857 | 2176 | 5948 | 1161 | 386 | 527 | 1.1e-50 |

Description
gp:[GI:g3688818] [LN:AF084104] [AC:AF084104] [PN:hypothetical protein] [OR:Bacillus firmus] [DB:genpept-bct2] [DE:Bacillus firmus AcsA (acsA) gene, partial cds; SspA (sspA),hypothetical protein, maltose transportor ATP-binding protein(malK), leucine-rich protein transcriptional regulator (lrpR),hypothetical proteins, ABC transporter ATP-binding protein (natC),NatA (natA), NatB (natB), and hypothetical protein genes, completecds; and SpoIIIJ (spoIIIJ) gene, partial cds.] [NT:Orf10; similar to hypothetical protein YheB from] [LE:5845] [RE:6957] [DI:direct]

| ORF Name | NTID | AAID | NT Length | AA Length | score | probability |
|---|---|---|---|---|---|---|
| AI7503000993_1992943_f3_561 | 2177 | 5949 | 747 | 248 | 104 | 2.3e-05 |

Description
gp:[GI:g160225] [LN:PFACSPI] [AC:M18821] [PN:circumsporozoite protein] [GN:CSP] [OR:Plasmodium yoelii] [SR:Plasmodium yoelii (strain 17X NL) DNA] [DB:genpept-inv1] [DE:Plasmodium yoelii circumsporozoite protein (CSP) gene, 5' end.] [NT:precursor] [LE:1] [RE:>420] [DI:direct]

| ORF Name | NTID | AAID | NT Length | AA Length | score | probability |
|---|---|---|---|---|---|---|
| AI7503000993_20365892_c1_731 | 2178 | 5950 | 150 | 49 | | |

Description
NO-HIT

| ORF Name | NTID | AAID | NT Length | AA Length | score | probability |
|---|---|---|---|---|---|---|
| AI7503000993_2051502_f2_250 | 2179 | 5951 | 159 | 52 | | |

Description
NO-HIT

| ORF Name | NTID | AAID | NT Length | AA Length | score | probability |
|---|---|---|---|---|---|---|
| AI7503000993_20706557_c3_860 | 2180 | 5952 | 1254 | 417 | 592 | 1.4e-57 |

Description
pir:[LN:A69819] [AC:A69819 ] [PN:probable phosphoesterase, yhaO] [GN:yhaO ] [CL:unassigned probable phosphoesterases: phosphoesterase core homology] [OR:Bacillus subtilis] [EC:3.1.-.-] [DB:pir2] >gp:[GI:e1182993:g2633327] [LN:BSUB0006] [AC:Z99109:AL009126] [GN:yhaO] [FN:unknown] [OR:Bacillus subtilis] [DB:genpept-bct1] [DE:Bacillus subtilis complete genome (section 6 of 21): from 999501 to1209940.] [NT:similar to hypothetical proteins] [LE:64822] [RE:66048] [DI:direct] >gp:[GI:e324934:g2226129] [LN:BSY14078] [AC:Y14078] [PN:Hypothetical protein] [GN:yhaO] [OR:Bacillus subtilis] [DB:genpept-bct1] [DE:Bacillus subitilis 8.7 Kb chromosomal DNA: downstream glyB-prsAregion.] [NT:similarity to exonuclease sbcD from Escherichia] [LE:4292] [RE:5518] [DI:complement]

| ORF Name | NTID | AAID | NT Length | AA Length | score | probability |
|---|---|---|---|---|---|---|
| AI7503000993_20834812_f2_339 | 2181 | 5953 | 306 | 101 | 86 | 0.0039 |

Description
pir:[LN:S77632] [AC:S77632:S52761 ] [PN:probable integrase] [GN:int ] [OR:Staphylococcus aureus phage phi-13] [DB:pir2] >gp:[GI:g758229] [LN:PHI13INT] [AC:X82312] [PN:integrase] [GN:int] [FN:integration of phi-13 in S.aureus genome] [OR:Bacteriophage phi-13] [DB:genpept-phg] [DE:Bacteriophage phi-13 integrase gene.] [LE:461] [RE:1498] [DI:direct]

| ORF Name | NTID | AAID | NT Length | AA Length | score | probability |
|---|---|---|---|---|---|---|
| AI7503000993_20901713_c3_939 | 2182 | 5954 | 1707 | 568 | 613 | 8.2e-60 |

Description
pir:[LN:G70002] [AC:G70002 ] [PN:hypothetical protein ytwP] [GN:ytwP ] [OR:Bacillus subtilis] [DB:pir2] >gp:[GI:e1185834:g2635445] [LN:BSUB0016] [AC:Z99119:AL009126] [GN:ytwP] [FN:unknown] [OR:Bacillus subtilis] [DB:genpept-bct1] [DE:Bacillus subtilis complete genome (section 16 of 21): from 2997771to 3213410.] [LE:31035] [RE:32723] [DI:complement] >gp:[GI:g2293228] [LN:AF008220] [AC:AF008220] [PN:YtwP] [GN:ytwP] [OR:Bacillus subtilis] [DB:genpept-bct2] [DE:Bacillus subtilis rrnB-dnaB genomic region.] [NT:similarity to fcrA protein precursor from] [LE:147704] [RE:149392] [DI:direct]

| ORF Name | NTID | AAID | NT Length | AA Length | score | probability |
|---|---|---|---|---|---|---|
| AI7503000993_20947781_f2_348 | 2183 | 5955 | 126 | 41 | | |

Description
NO-HIT

| ORF Name | NTID | AAID | NT Length | AA Length | score | probability |
|---|---|---|---|---|---|---|
| AI7503000993_2115812_f2_222 | 2184 | 5956 | 1113 | 370 | 843 | 3.5e-84 |

Description
pir:[LN:G69869] [AC:G69869 ] [PN:Xaa-Pro dipeptidase homolog ykvY] [GN:ykvY ] [CL:X-Pro aminopeptidase] [OR:Bacillus subtilis] [DB:pir2] >gp:[GI:e1184976:g2633757] [LN:BSUB0008] [AC:Z99111:AL009126] [GN:ykvY] [FN:unknown] [OR:Bacillus subtilis] [DB:genpept-bct1] [DE:Bacillus subtilis complete genome (section 8 of 21): from 1394791to 1603020.] [NT:similar to Xaa-Pro dipeptidase] [LE:58367] [RE:59458] [DI:direct]

| ORF Name | NTID | AAID | NT Length | AA Length | score | probability |
|---|---|---|---|---|---|---|
| AI7503000993_2117077_f3_536 | 2185 | 5957 | 366 | 121 | 195 | 1.6e-15 |

Description
pir:[LN:A70341] [AC:A70341 ] [PN:conserved hypothetical protein aq_449] [GN:aq_449 ] [CL:hypothetical protein MJ1523] [OR:Aquifex aeolicus] [DB:pir2] >gp:[GI:g2983116] [LN:AE000690] [AC:AE000690:AE000657] [PN:hypothetical protein] [GN:aq_449] [OR:Aquifex aeolicus] [DB:genpept-bct2] [DE:Aquifex aeolicus section 22 of 109 of the complete genome.] [LE:10789] [RE:11163] [DI:direct]

| ORF Name | NTID | AAID | NT Length | AA Length | score | probability |
|---|---|---|---|---|---|---|
| AI7503000993_2126250_f2_305 | 2186 | 5958 | 210 | 69 | | |

Description
NO-HIT

| ORF Name | NTID | AAID | NT Length | AA Length | score | probability |
|---|---|---|---|---|---|---|
| AI7503000993_21491462_c1_722 | 2187 | 5959 | 1161 | 386 | 1188 | 9.6e-121 |

Description sp:[LN:CISZ_BACSU] [AC:P39120;O34435] [GN:CITZ;CITA2] [OR:BACILLUS SUBTILIS] [EC:4.1.3.7] [DE:CITRATE SYNTHASE II,] [SP:P39120;O34435] [DB:swissprot] >pir:[LN:G69600] [AC:G69600;I40381 ] [PN:citrate synthase II,] [GN:citZ ] [CL:citrate (si)-synthase] [OR:Bacillus subtilis] [EC:4.1.3.-] [DB:pir2] >gp:[GI:e1184163;g2635379] [LN:BSUB0015] [AC:Z99118;AL009126] [PN:citrate synthase II] [GN:citZ] [OR:Bacillus subtilis] [DB:genpept-bct1] [EC:4.1.3.7] [DE:Bacillus subtilis complete genome (section 15 of 21): from 2795131to 3013540.] [NT:alternate gene name: citA2] [SP:P39120] [LE:185094] [RE:186212] [DI:complement] >gp:[GI:g2293267] [LN:AF008220] [AC:AF008220] [PN:citrate synthase subunit II] [GN:citZ] [OR:Bacillus subtilis] [DB:genpept-bct2] [DE:Bacillus subtilis rrnB-dnaB genomic region.] [LE:196855] [RE:197973] [DI:direct]

| ORF Name | NTID | AAID | NT Length | AA Length | score | probability |
|---|---|---|---|---|---|---|
| AI7503000993_21520887_c2_781 | 2188 | 5960 | 135 | 44 | | |

Description
NO-HIT

| ORF Name | NTID | AAID | NT Length | AA Length | score | probability |
|---|---|---|---|---|---|---|
| AI7503000993_21522010_f2_331 | 2189 | 5961 | 1725 | 574 | 2393 | 2.0e-248 |

Description sp:[LN:PPCK_STAAU] [AC:P51065] [GN:PCKA] [OR:STAPHYLOCOCCUS AUREUS] [EC:4.1.1.49] [DE:PHOSPHOENOLPYRUVATE CARBOXYKINASE [ATP],] [SP:P51065] [DB:swissprot] >gp:[GI:g1255262] [LN:SAU51133] [AC:U51133] [PN:phosphoenolpyruvate carboxykinase] [GN:pcka] [OR:Staphylococcus aureus] [DB:genpept-bct1] [DE:Staphylococcus aureus phosphoenolpyruvate carboxykinase (pcka)gene, complete cds.] [LE:160] [RE:1752] [DI:direct] >gp:[GI:g860732] [LN:STAPEPCK] [AC:L42943] [PN:phosphoenolpyruvate carboxykinase] [GN:pckA] [OR:Staphylococcus aureus] [DB:genpept-bct1] [EC:4.1.1.32] [DE:Staphylococcus aureus (clone KIN50) phosphoenolpyruvatecarboxykinase (pckA) gene, complete cds.] [NT:PEPCK; homologue] [LE:409] [RE:2001] [DI:direct]

| ORF Name | NTID | AAID | NT Length | AA Length | score | probability |
|---|---|---|---|---|---|---|
| AI7503000993_21523400_f2_356 | 2190 | 5962 | 162 | 53 | | |

Description
NO-HIT

| ORF Name | NTID | AAID | NT Length | AA Length | score | probability |
|---|---|---|---|---|---|---|
| AI7503000993_21645967_f3_575 | 2191 | 5963 | 993 | 330 | 368 | 7.5e-34 |

Description sp:[LN:PRSA_BACSU] [AC:P24327] [GN:PRSA] [OR:BACILLUS SUBTILIS] [DE:PROTEIN EXPORT
PROTEIN PRSA PRECURSOR] [SP:P24327] [DB:swissprot] >pir:[LN:S15269]
[AC:S15269:I40003:H69682 ] [PN:post-translocation molecular chaperone prsA:33K
lipoprotein prsA] [GN:prsA ] [OR:Bacillus subtilis] [DB:pir2] >gp:[GI:g39782]
[LN:BS33KDA] [AC:X57271:S67658] [PN:33kDa lipoprotein] [GN:prsA] [OR:Bacillus subtilis]
[DB:genpept-bct1] [DE:B.subtilis prsA gene for a 33kDa lipoprotein.] [SP:P24327]
[LE:63] [RE:941] [DI:direct] >gp:[GI:e1182997:g2633331] [LN:BSUB0006]
[AC:Z99109:AL009126] [PN:molecular chaperonin] [GN:prsA] [FN:essential for the
stability of secreted] [OR:Bacillus subtilis] [DB:genpept-bct1] [DE:Bacillus subtilis
complete genome (section 6 of 21): from 999501 to1209940.] [SP:P24327] [LE:70340]
[RE:71218] [DI:complement] >gp:[GI:e325181:g2226124] [LN:BSY14077] [AC:Y14077]
[PN:33kDa lipoprotein] [GN:prsA] [OR:Bacillus subtilis] [DB:genpept-bct1] [DE:Bacillus
subitlis 10.6 Kb chromosomal DNA: glyB-prsA region.] [NT:See Swiss Prot P24327]
[SP:P24327] [LE:9695] [RE:10573] [DI:direct]

| ORF Name | NTID | AAID | NT Length | AA Length | score | probability |
|---|---|---|---|---|---|---|
| AI7503000993_2189718_f3_412 | 2192 | 5964 | 1371 | 456 | 1309 | 1.4e-133 |

Description sp:[LN:CYCA_ECOLI] [AC:P39312] [GN:CYCA:DAGA] [OR:ESCHERICHIA COLI]
[DE:D-SERINE/D-ALANINE/GLYCINE TRANSPORTER] [SP:P39312] [DB:swissprot] >pir:[LN:S56433]
[AC:S56433:C65232 ] [PN:d-serine/d-alanine/glycine transporter] [GN:cycA ] [CL:arginine
permease] [OR:Escherichia coli] [DB:pir2] >gp:[GI:g537049] [LN:ECOUW93] [AC:U14003]
[OR:Escherichia coli] [DB:genpept-bct1] [DE:Escherichia coli K-12 chromosomal region
from 92.8 to 00.1 minutes.] [NT:ORF_o470] [LE:120696] [RE:122108] [DI:direct]
>gp:[GI:g1790653] [LN:AE000492] [AC:AE000492:U00096] [PN:transport of D-alanine,
D-serine, and glycine] [GN:cycA] [FN:transport; Transport of small molecules: Amino]
[OR:Escherichia coli] [DB:genpept-bct2] [DE:Escherichia coli K-12 MG1655 section 382 of
400 of the completegenome.] [NT:o470; 100 pct identical amino acid sequence and]
[LE:2436] [RE:3848] [DI:direct]

| ORF Name | NTID | AAID | NT Length | AA Length | score | probability |
|---|---|---|---|---|---|---|
| AI7503000993_22078331_f3_564 | 2193 | 5965 | 252 | 83 | | |

Description
NO-HIT

| ORF Name | NTID | AAID | NT Length | AA Length | score | probability |
|---|---|---|---|---|---|---|
| AI7503000993_22164757_f2_244 | 2194 | 5966 | 132 | 43 | | |

Description
NO-HIT

| ORF Name | NTID | AAID | NT Length | AA Length | score | probability |
|---|---|---|---|---|---|---|
| AI7503000993_22271932_c1_651 | 2195 | 5967 | 132 | 43 | | |

Description
NO-HIT

| ORF_Name | NTID | AAID | NT Length | AA Length | score | probability |
|---|---|---|---|---|---|---|
| AI7503000993_22277327_c3_968 | 2196 | 5968 | 1371 | 456 | 496 | 2.0e-47 |

Description
sp:[LN:DNAB_BACSU] [AC:P07908] [GN:DNAB] [OR:BACILLUS SUBTILIS] [DE:REPLICATION INITIATION AND MEMBRANE ATTACHMENT PROTEIN] [SP:P07908] [DB:swissprot] >pir:[LN:B26580] [AC:B26580:A24720:A69617 ] [PN:chromosome replication initiation / membrane attachment protein dnaB:dnaB protein] [GN:dnaB ] [OR:Bacillus subtilis] [DB:pir2] >gp:[GI:g142863] [LN:BACDNAB] [AC:M15183] [PN:replication initiation protein] [GN:dnaB] [OR:Bacillus subtilis] [SR:Bacillus subtilis (sub_strain PY79, strain W168) DNA] [DB:genpept-bct1] [DE:B.subtilis dnaB gene, encoding the replication initiation andmembrane attachment protein, complete cds, clone pdnaB12.] [NT:The part of the protein encoded by 634-693 binds to] [LE:397] [RE:1815] [DI:direct] >gp:[GI:e1184148:g2635364] [LN:BSUB0015] [AC:Z99118:AL009126] [PN:membrane attachment protein] [GN:dnaB] [FN:initiation of chromosome replication (DNA) [OR:Bacillus subtilis] [DB:genpept-bct1] [DE:Bacillus subtilis complete genome (section 15 of 21): from 2795131to 3013540.] [LE:168092] [RE:169510] [DI:complement] >gp:[GI:e1165285:g1769995] [LN:BSZ75208] [AC:Z75208] [PN:replication initiation protein] [GN:dnaB] [OR:Bacillus subtilis] [DB:genpept-bct1] [DE:B.subtilis genomic sequence 89009bp.] [NT:the part of the protein encoded by 634-693 binds to] [SP:P07908] [LE:397] [RE:1815] [DI:direct] >gp:[GI:g2293280] [LN:AF008220] [AC:AF008220] [PN:DnaB] [GN:dnaB] [OR:Bacillus subtilis] [DB:genpept-bct2] [DE:Bacillus subtilis rrnB-dnaB genomic region.] [LE:213557] [RE:214975] [DI:direct]

| ORF_Name | NTID | AAID | NT Length | AA Length | score | probability |
|---|---|---|---|---|---|---|
| AI7503000993_22391432_f3_562 | 2197 | 5969 | 525 | 174 | 288 | 2.3e-25 |

Description
pir:[LN:S77632] [AC:S77632:S52761 ] [PN:probable integrase] [GN:int ] [OR:Staphylococcus aureus phage phi-13] [DB:pir2] >gp:[GI:g758229] [LN:PHI13INT] [AC:X82312] [PN:integrase] [GN:int] [FN:integration of phi-13 in S.aureus genome] [OR:Bacteriophage phi-13] [DB:genpept-phg] [DE:Bacteriophage phi-13 integrase gene.] [LE:461] [RE:1498] [DI:direct]

| ORF_Name | NTID | AAID | NT Length | AA Length | score | probability |
|---|---|---|---|---|---|---|
| AI7503000993_22459692_f1_125 | 2198 | 5970 | 201 | 66 | | |

Description
NO-HIT

| ORF_Name | NTID | AAID | NT Length | AA Length | score | probability |
|---|---|---|---|---|---|---|
| AI7503000993_22664125_c2_832 | 2199 | 5971 | 165 | 54 | | |

Description
NO-HIT

| ORF_Name | NTID | AAID | NT Length | AA Length | score | probability |
|---|---|---|---|---|---|---|
| AI7503000993_23438837_f3_600 | 2200 | 5972 | 132 | 43 | | |

Description
NO-HIT

| ORF_Name | NTID | AAID | NT Length | AA Length | score | probability |
|---|---|---|---|---|---|---|
| AI7503000993_23468812_f1_141 | 2201 | 5973 | 129 | 42 | | |

Description
NO-HIT

| ORF Name | NTID | AAID | NT Length | AA Length | score | probability |
|---|---|---|---|---|---|---|
| AI7503000993_23485443_c1_709 | 2202 | 5974 | 1239 | 412 | 931 | 1.6e-93 |

Description
sp:[LN:THII_BACSU] [AC:O34595] [GN:THII] [OR:BACILLUS SUBTILIS] [DE:PROBABLE THIAMIN BIOSYNTHESIS PROTEIN THII] [SP:O34595] [DB:swissprot] >pir:[LN:E69988] [AC:E69988 ] [PN:conserved hypothetical protein ytbJ] [GN:ytbJ ] [CL:Mycoplasma genitalium hypothetical protein MG372] [OR:Bacillus subtilis] [DB:pir2] >gp:[GI:e1185831:g2635442] [LN:BSUB0016] [AC:Z99119:AL009126] [GN:ytbJ] [FN:unknown] [OR:Bacillus subtilis] [DB:genpept-bct1] [DE:Bacillus subtilis complete genome (section 16 of 21): from 2997771to 3213410.] [NT:similar to hypothetical proteins] [SP:O34595] [LE:27183] [RE:28259] [DI:complement] >gp:[GI:g2293230] [LN:AF008220] [AC:AF008220] [PN:YtbJ] [GN:ytbJ] [OR:Bacillus subtilis] [DB:genpept-bct2] [DE:Bacillus subtilis rrnB-dnaB genomic region.] [NT:similar to hypothetical protein MG372 from M.] [LE:152168] [RE:153244] [DI:direct]

| ORF Name | NTID | AAID | NT Length | AA Length | score | probability |
|---|---|---|---|---|---|---|
| AI7503000993_23489090_c2_835 | 2203 | 5975 | 1038 | 345 | 1033 | 2.5e-104 |

Description
sp:[LN:K6PF_BACSU] [AC:O34529] [GN:PFKA:PFK] [OR:BACILLUS SUBTILIS] [EC:2.7.1.11] [DE:(PHOSPHOHEXOKINASE)] [SP:O34529] [DB:swissprot] >pir:[LN:A69675] [AC:A69675 ] [PN:6-phosphofructokinase pfk] [GN:pfk] [CL:6-phosphofructokinase:6-phosphofructokinase 1 homology] [OR:Bacillus subtilis] [DB:pir2] >gp:[GI:e1184168:g2635384] [LN:BSUB0015] [AC:Z99118:AL009126] [PN:6-phosphofructokinase] [GN:pfk] [FN:glycolysis] [OR:Bacillus subtilis] [DB:genpept-bct1] [EC:2.7.1.11] [DE:Bacillus subtilis complete genome (section 15 of 21): from 2795131to 3013540.] [SP:O34529] [LE:190531] [RE:191490] [DI:complement] >gp:[GI:g2293264] [LN:AF008220] [AC:AF008220] [PN:6-phosphofructokinase] [GN:pfk] [OR:Bacillus subtilis] [DB:genpept-bct2] [DE:Bacillus subtilis rrnB-dnaB genomic region.] [LE:191577] [RE:192536] [DI:direct]

| ORF Name | NTID | AAID | NT Length | AA Length | score | probability |
|---|---|---|---|---|---|---|
| AI7503000993_23555302_f2_233 | 2204 | 5976 | 387 | 128 | 91 | 0.00083 |

Description
gp:[GI:e1363147:g4127385] [LN:APR011678] [AC:AJ011678] [PN:immunodominant protein] [OR:Apple proliferation phytoplasma] [DB:genpept-bct1] [DE:Apple proliferation phytoplasma immunodominant protein gene, strainAT.] [LE:885] [RE:1382] [DI:direct]

| ORF Name | NTID | AAID | NT Length | AA Length | score | probability |
|---|---|---|---|---|---|---|
| AI7503000993_23601713_c3_894 | 2205 | 5977 | 1194 | 397 | 1108 | 2.9e-112 |

Description
sp:[LN:GCH2_BACAM] [AC:P51695] [GN:RIBA] [OR:BACILLUS AMYLOLIQUEFACIENS] [EC:3.5.4.25] [DE:PHOSPHATE SYNTHASE (DHBP SYNTHASE)] [SP:P51695] [DB:swissprot] >gp:[GI:e223994:g1212775] [LN:BARIBGENS] [AC:X95955] [PN:3,4-dihydroxy-2-butanone 4-phosphate synthase] [GN:ribA] [OR:Bacillus amyloliquefaciens] [DB:genpept-bct1] [DE:B.amyloliquefaciens ribB, ribG, ribA, ribH & ribT genes.] [NT:GTP cyclohydrolase II] [SP:P51695] [LE:2411] [RE:3607] [DI:direct]

| ORF Name | NTID | AAID | NT Length | AA Length | score | probability |
|---|---|---|---|---|---|---|
| AI7503000993_23603375_f2_219 | 2206 | 5978 | 417 | 138 | 139 | 1.4e-09 |

Description
sp:[LN:Y577_METJA] [AC:Q57997] [GN:MJ0577] [OR:METHANOCOCCUS JANNASCHII] [DE:PROTEIN MJ0577] [SP:Q57997] [DB:swissprot] >pir:[LN:A64372] [AC:A64372 ] [PN:hypothetical protein homolog MJ0577] [CL:Escherichia coli ybdQ protein] [OR:Methanococcus jannaschii] [DB:pir2] [MP:FOR512975-513463 ] >gp:[GI:g1591284] [LN:U67506] [AC:U67506:L77117] [PN:conserved hypothetical protein] [GN:MJ0577] [OR:Methanococcus jannaschii] [DB:genpept-bct2] [DE:Methanococcus jannaschii section 48 of 150 of the complete genome.] [NT:similar to SP:P42297 PID:603780 PID:849027] [LE:8204] [RE:8692] [DI:direct]

| ORF Name | NTID | AAID | NT Length | AA Length | score | probability |
|---|---|---|---|---|---|---|
| AI7503000993_2362587_f2_321 | 2207 | 5979 | 150 | 49 | | |

Description
NO-HIT

| ORF Name | NTID | AAID | NT Length | AA Length | score | probability |
|---|---|---|---|---|---|---|
| AI7503000993_23651567_c3_961 | 2208 | 5980 | 888 | 295 | 387 | 5.2e-41 |

Description
gp:[GI:d1025814:g2897751] [LN:AB008520] [AC:AB008520] [GN:mutM] [OR:Thermus thermophilus] [SR:Thermus thermophilus (strain:HB8) DNA] [DB:genpept-bct1] [DE:Thermus thermophilus MutM gene, complete cds.] [LE:297] [RE:1100] [DI:direct]

| ORF Name | NTID | AAID | NT Length | AA Length | score | probability |
|---|---|---|---|---|---|---|
| AI7503000993_23694052_f2_359 | 2209 | 5981 | 603 | 200 | 82 | 0.0040 |

Description
pir:[LN:E69818] [AC:E69818 ] [PN:hypothetical protein yhaK] [GN:yhaK ] [OR:Bacillus subtilis] [DB:pir2] >gp:[GI:e1182998:g2633332] [LN:BSUB0006] [AC:Z99109:AL009126] [GN:yhaK] [FN:unknown] [OR:Bacillus subtilis] [DB:genpept-bct1] [DE:Bacillus subtilis complete genome (section 6 of 21): from 999501 to1209940.] [LE:72018] [RE:72272] [DI:complement] >gp:[GI:e324957:g2226123] [LN:BSY14077] [AC:Y14077] [PN:Hypothetical protein] [GN:yhaK] [OR:Bacillus subtilis] [DB:genpept-bct1] [DE:Bacillus subitlis 10.6 Kb chromosomal DNA: glyB-prsA region.] [LE:8641] [RE:8895] [DI:direct]

| ORF Name | NTID | AAID | NT Length | AA Length | score | probability |
|---|---|---|---|---|---|---|
| AI7503000993_23710885_f2_167 | 2210 | 5982 | 147 | 48 | 76 | 0.027 |

Description
pir:[LN:S72289] [AC:S72289 ] [PN:ribosomal protein L2] [GN:rpl2 ] [OR:plastid Plasmodium falciparum] [DB:pir2] >gp:[GI:e220178:g1171595] [LN:PFCOMPIRB] [AC:X95276] [GN:rpl2] [OR:Plasmodium falciparum] [SR:malaria parasite P. falciparum] [DB:genpept-inv1] [DE:P.falciparum complete gene map of plastid-like DNA (IR-B).] [LE:2799] [RE:3536] [DI:direct]

| ORF Name | NTID | AAID | NT Length | AA Length | score | probability |
|---|---|---|---|---|---|---|
| AI7503000993_2380342_c2_741 | 2211 | 5983 | 636 | 211 | 463 | 6.4e-44 |

Description pir:[LN:F69824] [AC:F69824 ] [PN:two-component response regulator [YhcY] homolog yhcZ] [GN:yhcZ ] [CL:regulatory protein comA:response regulator homology] [OR:Bacillus subtilis] [DB:pir2] >gp:[GI:e1182922:g2633256] [LN:BSUB0005] [AC:Z99108:AL009126] [GN:yhcZ] [FN:unknown] [OR:Bacillus subtilis] [DB:genpept-bct1] [DE:Bacillus subtilis complete genome (section 5 of 21): from 802821 to1011250.] [NT:similar to two-component response regulator [YhcY]] [LE:206441] [RE:207085] [DI:direct] >gp:[GI:e1182934:g2633268] [LN:BSUB0006] [AC:Z99109:AL009126] [GN:yhcZ] [FN:unknown] [OR:Bacillus subtilis] [DB:genpept-bct1] [DE:Bacillus subtilis complete genome (section 6 of 21): from 999501 to1209940.] [NT:similar to two-component response regulator [YhcY]] [LE:9761] [RE:10405] [DI:direct] >gp:[GI:e324945:g2226141] [LN:BSY14079] [AC:Y14079] [PN:hypothetical protein] [GN:yhcZ] [OR:Bacillus subtilis] [DB:genpept-bct1] [DE:Bacillus subtilis chromosomal DNA, region 75 degrees: glpPFKDoperon and downstream.] [NT:similarity to the transcriptional regulator degU] [LE:9409] [RE:10053] [DI:direct]

| ORF Name | NTID | AAID | NT Length | AA Length | score | probability |
|---|---|---|---|---|---|---|
| AI7503000993_2383253_c1_635 | 2212 | 5984 | 198 | 65 | | |

Description

NO-HIT

| ORF Name | NTID | AAID | NT Length | AA Length | score | probability |
|---|---|---|---|---|---|---|
| AI7503000993_23984787_c3_924 | 2213 | 5985 | 1011 | 336 | 1404 | 1.2e-143 |

Description sp:[LN:CCPA_STAXY] [AC:Q56194] [GN:CCPA] [OR:STAPHYLOCOCCUS XYLOSUS] [DE:PROBABLE CATABOLITE CONTROL PROTEIN A] [SP:Q56194] [DB:swissprot] >gp:[GI:e220318:g1177685] [LN:SXCCPA] [AC:X95439] [GN:ccpA] [OR:Staphylococcus xylosus] [DB:genpept-bct1] [DE:S.xylosus aroA, ccpA, acuC and acuA genes.] [SP:Q56194] [LE:1305] [RE:2294] [DI:direct]

| ORF Name | NTID | AAID | NT Length | AA Length | score | probability |
|---|---|---|---|---|---|---|
| AI7503000993_24017890_c2_843 | 2214 | 5986 | 1428 | 476 | 1242 | 1.8e-126 |

Description sp:[LN:LYSP_ECOLI] [AC:P25737] [GN:LYSP:CADR] [OR:ESCHERICHIA COLI] [DE:LYSINE-SPECIFIC PERMEASE] [SP:P25737] [DB:swissprot]

| ORF Name | NTID | AAID | NT Length | AA Length | score | probability |
|---|---|---|---|---|---|---|
| AI7503000993_24020250_c1_654 | 2215 | 5987 | 882 | 293 | 551 | 6.5e-52 |

Description gp:[GI:e1295630:g3184134] [LN:SSAASPROT] [AC:AJ000007] [PN:AAS surface protein] [GN:aas] [OR:Staphylococcus saprophyticus] [DB:genpept-bct1] [DE:Staphylococcus saprophyticus aas gene.] [LE:203] [RE:4594] [DI:direct]

| ORF Name | NTID | AAID | NT Length | AA Length | score | probability |
|---|---|---|---|---|---|---|
| AI7503000993_24025463_c1_620 | 2216 | 5988 | 2952 | 983 | 1357 | 1.2e-138 |

Description gp:[GI:g710421] [LN:SAU21636] [AC:U21636] [PN:unknown] [OR:Staphylococcus aureus] [DB:genpept-bct2] [DE:Staphylococcus aureus cmp-binding-factor 1 (cbf1) and ORF X genes, complete cds.] [NT:ORF X] [LE:52] [RE:1158] [DI:direct]

| ORF Name | NTID | AAID | NT Length | AA Length | score | probability |
|---|---|---|---|---|---|---|
| AI7503000993_24226543_c1_704 | 2217 | 5989 | 783 | 260 | 365 | 1.6e-33 |

Description
pir:[LN:E69827] [AC:E69827 ] [PN:glycerophosphodiester phosphodiesterase homolog yhdW] [GN:yhdW ] [OR:Bacillus subtilis] [DB:pir2] >gp:[GI:e1182963:g2633297] [LN:BSUB0006] [AC:Z99109:AL009126] [GN:yhdW] [FN:unknown] [OR:Bacillus subtilis] [DB:genpept-bct1] [DE:Bacillus subtilis complete genome (section 6 of 21): from 999501 to1209940.] [NT:similar to glycerophosphodiester phosphodiesterase] [LE:37668] [RE:38399] [DI:complement] >gp:[GI:e1191883:g2226218] [LN:BSY14082] [AC:Y14082] [PN:hypothetical protein] [GN:yhdW] [OR:Bacillus subtilis] [DB:genpept-bct1] [DE:Bacillus subtilis chromosomal DNA, region 72 to 75 degrees: spoVRto sspB.] [NT:Similarity to glycerol diester phosphodiesterase] [LE:24316] [RE:25047] [DI:complement]

| ORF Name | NTID | AAID | NT Length | AA Length | score | probability |
|---|---|---|---|---|---|---|
| AI7503000993_2426312_f1_103 | 2218 | 5990 | 135 | 44 | | |

Description
NO-HIT

| ORF Name | NTID | AAID | NT Length | AA Length | score | probability |
|---|---|---|---|---|---|---|
| AI7503000993_24272568_c2_782 | 2219 | 5991 | 147 | 48 | | |

Description
NO-HIT

| ORF Name | NTID | AAID | NT Length | AA Length | score | probability |
|---|---|---|---|---|---|---|
| AI7503000993_2428950_c3_844 | 2220 | 5992 | 444 | 147 | 227 | 6.6e-19 |

Description
gp:[GI:g1022725] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF2] [LE:394] [RE:1083] [DI:complement] >gp:[GI:g295162] [LN:STAMECRA] [AC:L14017] [OR:Staphylococcus aureus] [SR:Staphylococcus aureus (strain COL) DNA] [DB:genpept-bct1] [DE:Staphylococcus aureus methicillin-resistance protein (mecR) geneand unknown ORF, complete cds.] [NT:unknown ORF1; putative] [LE:1492] [RE:2181] [DI:complement]

| ORF Name | NTID | AAID | NT Length | AA Length | score | probability |
|---|---|---|---|---|---|---|
| AI7503000993_24296925_f3_534 | 2221 | 5993 | 552 | 183 | 127 | 6.2e-08 |

Description
gp:[GI:e184374:g2104803] [LN:CBDNAPTCG] [AC:X87972] [GN:P-21] [OR:Clostridium botulinum] [DB:genpept-bct1] [DE:C.botulinum progenitor toxin complex genes.] [LE:2337] [RE:2882] [DI:direct]

| ORF Name | NTID | AAID | NT Length | AA Length | score | probability |
|---|---|---|---|---|---|---|
| AI7503000993_24307677_c2_772 | 2222 | 5994 | 144 | 47 | | |

Description
NO-HIT

| ORF Name | NTID | AAID | NT Length | AA Length | score | probability |
|---|---|---|---|---|---|---|
| AI7503000993_24334563_c2_789 | 2223 | 5995 | 453 | 150 | 109 | 1.5e-05 |

Description
gp:[GI:e1492342:g5262792] [LN:ATT13K14] [AC:AL080282] [PN:putative protein]
[GN:T13K14.180] [OR:Arabidopsis thaliana] [SR:thale cress] [DB:genpept] [DE:Arabidopsis
thaliana DNA chromosome 4, BAC clone T13K14 (ESSAproject).] [NT:similarity to
desiccation-related protein,] [LE:67362:67832] [RE:67502:68491] [DI:directJoin]

| ORF Name | NTID | AAID | NT Length | AA Length | score | probability |
|---|---|---|---|---|---|---|
| AI7503000993_24337750_c3_913 | 2224 | 5996 | 852 | 283 | 1238 | 4.8e-126 |

Description
sp:[LN:DAAA_STAHA] [AC:P54694] [GN:DAT] [OR:STAPHYLOCOCCUS HAEMOLYTICUS] [EC:2.6.1.21]
[DE:TRANSAMINASE)] [SP:P54694] [DB:swissprot] >gp:[GI:g517475] [LN:SHU12238]
[AC:U12238] [PN:D-amino acid transaminase] [GN:dat] [OR:Staphylococcus haemolyticus]
[DB:genpept-bct1] [DE:Staphylococcus haemolyticus Y176 D-amino acid transaminase
(dat)gene, complete cds.] [LE:216] [RE:1064] [DI:direct]

| ORF Name | NTID | AAID | NT Length | AA Length | score | probability |
|---|---|---|---|---|---|---|
| AI7503000993_24407577_c1_724 | 2225 | 5997 | 738 | 245 | 833 | 4.0e-83 |

Description
sp:[LN:PHOP_BACSU] [AC:P13792] [GN:PHOP] [OR:BACILLUS SUBTILIS] [DE:PHOP] [SP:P13792]
[DB:swissprot] >gp:[GI:g40056] [LN:BSPHOPDNA] [AC:X67676] [GN:phoP] [OR:Bacillus
subtilis] [DB:genpept-bct1] [DE:B.subtilis phoP gene.] [SP:P13792] [LE:199] [RE:921]
[DI:direct]

| ORF Name | NTID | AAID | NT Length | AA Length | score | probability |
|---|---|---|---|---|---|---|
| AI7503000993_24407765_c1_710 | 2226 | 5998 | 795 | 264 | 413 | 1.3e-38 |

Description
sp:[LN:YCB9_PSEDE] [AC:P29942] [OR:PSEUDOMONAS DENITRIFICANS] [DE:HYPOTHETICAL 27.4 KD
PROTEIN IN COBO 3'REGION (ORF9)] [SP:P29942] [DB:swissprot] >pir:[LN:I38164] [AC:I38164
] [PN:hypothetical protein 9] [OR:Pseudomonas sp.] [DB:pir2] >gp:[GI:g551929]
[LN:PSECOBGEN] [AC:M62866] [OR:Pseudomonas denitrificans] [SR:Pseudomonas denitrificans
(strain SC510) DNA] [DB:genpept-bct1] [DE:P.denitrificans cobN, cobO, cobP, cobQ, cobW,
and ORF6-9 genes,complete cds.] [NT:ORF9] [LE:12364] [RE:13149] [DI:complement]

| ORF Name | NTID | AAID | NT Length | AA Length | score | probability |
|---|---|---|---|---|---|---|
| AI7503000993_24409803_c1_633 | 2227 | 5999 | 123 | 40 | 81 | 0.019 |

Description
pir:[LN:S75730] [AC:S75730:S50064 ] [PN:8-amino-7-oxononanoate
synthase,:7-keto-8-aminopelargonic acid synthetase:protein
slr0917:7-keto-8-aminopelargonic acid synthetase:protein slr0917] [GN:bioF ]
[CL:5-aminolevulinate synthase] [OR:Synechocystis sp.] [SR:PCC 6803, , PCC 6803]
[SR:PCC 6803, ] [EC:2.3.1.47] [DB:pir2] >gp:[GI:d1011116:g1673311] [LN:SYCSLLE]
[AC:D64003:AB001339] [PN:7-keto-8-aminopelargonic acid synthetase] [GN:bioF]
[OR:Synechocystis sp.] [SR:Synechocystis sp. (strain:PCC6803) DNA] [DB:genpept-bct1]
[DE:Synechocystis sp. PCC6803 complete genome, 22/27, 2755703-2868766.]
[NT:ORF_ID:slr0917] [LE:35986] [RE:37299] [DI:direct]

| ORF Name | NTID | AAID | NT Length | AA Length | score | probability |
|---|---|---|---|---|---|---|
| AI7503000993_24417252_c3_902 | 2228 | 6000 | 1248 | 415 | 1038 | 7.5e-105 |

Description
pir:[LN:F70001] [AC:F70001 ] [PN:multidrug resistance protein homolog yttB] [GN:yttB ] [OR:Bacillus subtilis] [DB:pir2] >gp:[GI:e1185908:g2635519] [LN:BSUB0016] [AC:Z99119:AL009126] [GN:yttB] [FN:unknown] [OR:Bacillus subtilis] [DB:genpept-bct1] [DE:Bacillus subtilis complete genome (section 16 of 21): from 2997771to 3213410.] [NT:similar to multidrug resistance protein] [LE:108543] [RE:109736] [DI:complement] >gp:[GI:g2293179] [LN:AF008220] [AC:AF008220] [PN:YttB] [GN:yttB] [OR:Bacillus subtilis] [DB:genpept-bct2] [DE:Bacillus subtilis rrnB-dnaB genomic region.] [NT:similarity to tetracycline resistance protein from] [LE:70691] [RE:71884] [DI:direct]

| ORF Name | NTID | AAID | NT Length | AA Length | score | probability |
|---|---|---|---|---|---|---|
| AI7503000993_24428760_f3_509 | 2229 | 6001 | 129 | 42 | | |

Description
NO-HIT

| ORF Name | NTID | AAID | NT Length | AA Length | score | probability |
|---|---|---|---|---|---|---|
| AI7503000993_24475377_f3_537 | 2230 | 6002 | 159 | 52 | | |

Description
NO-HIT

| ORF Name | NTID | AAID | NT Length | AA Length | score | probability |
|---|---|---|---|---|---|---|
| AI7503000993_24490702_c1_616 | 2231 | 6003 | 405 | 134 | 74 | 0.011 |

Description
sp:[LN:Y70A_METJA] [AC:P81311] [GN:MJ0703.1] [OR:METHANOCOCCUS JANNASCHII] [DE:HYPOTHETICAL PROTEIN MJ0703.1] [SP:P81311] [DB:swissprot] >gp:[GI:g2826311] [LN:U67517] [AC:U67517:L77117] [PN:M. jannaschii predicted coding region MJ0703.1] [GN:MJ0703.1] [OR:Methanococcus jannaschii] [DB:genpept-bct2] [DE:Methanococcus jannaschii section 59 of 150 of the complete genome.] [NT:Brute Force ORF; identified by GeneMark; putative] [LE:94] [RE:402] [DI:direct]

| ORF Name | NTID | AAID | NT Length | AA Length | score | probability |
|---|---|---|---|---|---|---|
| AI7503000993_24492130_f1_70 | 2232 | 6004 | 123 | 40 | | |

Description
NO-HIT

| ORF Name | NTID | AAID | NT Length | AA Length | score | probability |
|---|---|---|---|---|---|---|
| AI7503000993_24508552_c3_971 | 2233 | 6005 | 1953 | 650 | 2471 | 1.1e-256 |

Description
sp:[LN:SYT1_BACSU] [AC:P18255:P06570] [GN:THRS:THRSV] [OR:BACILLUS SUBTILIS]
[EC:6.1.1.3] [DE:(THRRS)] [SP:P18255:P06570] [DB:swissprot] >pir:[LN:YSBST1]
[AC:B37770:E24720:B69723 ] [PN:threonine--tRNA ligase,, major (thrS):threonyl-tRNA
synthetase] [GN:thrS:thrSv ] [CL:threonine--tRNA ligase] [OR:Bacillus subtilis]
[EC:6.1.1.3] [DB:pir1] [MP:250 (degrees) ] >gp:[GI:g143766] [LN:BACTRNASB] [AC:M36594]
[OR:Bacillus subtilis] [SR:B.subtilis (strain 168) vegetative form DNA]
[DB:genpept-bct1] [DE:B.subtilis threonyl-tRNA synthetase (thrSv) gene, complete cds.]
[NT:(thrSv) (EC 6.1.1.3)] [LE:365] [RE:2296] [DI:direct] >gp:[GI:e1184144:g2635360]
[LN:BSUB0015] [AC:Z99118:AL009126] [PN:threonyl-tRNA synthetase] [GN:thrS] [OR:Bacillus
subtilis] [DB:genpept-bct1] [EC:6.1.1.3] [DE:Bacillus subtilis complete genome (section
15 of 21): from 2795131to 3013540.] [SP:P18255] [LE:163202] [RE:165133] [DI:complement]
>gp:[GI:e1165290:g1769999] [LN:BSZ75208] [AC:Z75208] [PN:threonyl-tRNA-synthetase]
[GN:thrS] [OR:Bacillus subtilis] [DB:genpept-bct1] [EC:6.1.1.3] [DE:B.subtilis genomic
sequence 89009bp.] [NT:thrs (111-180); Major threonyl-tRNA synthetase] [SP:P18255]
[LE:4774] [RE:6705] [DI:direct] >gp:[GI:g2293284] [LN:AF008220] [AC:AF008220]
[PN:threonine tRNA synthetase] [GN:thrS] [OR:Bacillus subtilis] [DB:genpept-bct2]
[DE:Bacillus subtilis rrnB-dnaB genomic region.] [LE:217934] [RE:219865] [DI:direct]

| ORF Name | NTID | AAID | NT Length | AA Length | score | probability |
|---|---|---|---|---|---|---|
| AI7503000993_24609676_c2_773 | 2234 | 6006 | 471 | 156 | 72 | 0.030 |

Description
sp:[LN:NULM_DASNO] [AC:O21333] [GN:MTND4L:ND4L:NADH4L] [OR:DASYPUS NOVEMCINCTUS]
[SR:,NINE-BANDED ARMADILLO] [EC:1.6.5.3] [DE:NADH-UBIQUINONE OXIDOREDUCTASE CHAIN 4L,]
[SP:O21333] [DB:swissprot] >gp:[GI:e311022:g2252509] [LN:MTDNCOMGN] [AC:Y11832]
[GN:NADH4L] [OR:Mitochondrion Dasypus novemcinctus] [SR:nine-banded armadillo]
[DB:genpept-mam] [DE:D.novemcinctus complete mitochondrial genome.] [SP:O21333]
[LE:9903] [RE:10199] [DI:direct]

| ORF Name | NTID | AAID | NT Length | AA Length | score | probability |
|---|---|---|---|---|---|---|
| AI7503000993_24662915_c3_960 | 2235 | 6007 | 2718 | 905 | 2572 | 2.1e-267 |

Description
sp:[LN:DPO1_BACSU] [AC:O34996] [GN:POLA] [OR:BACILLUS SUBTILIS] [EC:2.7.7.7] [DE:DNA
POLYMERASE I, (POL I)] [SP:O34996] [DB:swissprot] >pir:[LN:E69680] [AC:E69680 ] [PN:DNA
polymerase I polA] [GN:polA ] [CL:DNA-directed DNA polymerase I] [OR:Bacillus subtilis]
[DB:pir2] >gp:[GI:e1184158:g2635374] [LN:BSUB0015] [AC:Z99118:AL009126] [PN:DNA
polymerase I] [GN:polA] [FN:replication and DNA repair] [OR:Bacillus subtilis]
[DB:genpept-bct1] [EC:2.7.7.7] [DE:Bacillus subtilis complete genome (section 15 of
21): from 2795131to 3013540.] [SP:O34996] [LE:177125] [RE:179767] [DI:complement]
>gp:[GI:g2293272] [LN:AF008220] [AC:AF008220] [PN:DNA-polymerase I] [GN:polA]
[OR:Bacillus subtilis] [DB:genpept-bct2] [DE:Bacillus subtilis rrnB-dnaB genomic
region.] [LE:203300] [RE:205942] [DI:direct]

| ORF Name | NTID | AAID | NT Length | AA Length | score | probability |
|---|---|---|---|---|---|---|
| AI7503000993_24692338_c3_895 | 2236 | 6008 | 474 | 157 | 540 | 4.5e-52 |

Description
sp:[LN:RISB_BACAM] [AC:Q44681] [GN:RIBH] [OR:BACILLUS AMYLOLIQUEFACIENS] [EC:2.5.1.9]
[DE:(LUMAZINE SYNTHASE) (RIBOFLAVIN SYNTHASE BETA CHAIN)] [SP:Q44681] [DB:swissprot]
>gp:[GI:e223995:g1212776] [LN:BARIBGENS] [AC:X95955] [PN:lumazine synthase (b-subunit)]
[GN:ribH] [OR:Bacillus amyloliquefaciens] [DB:genpept-bct1] [DE:B.amyloliquefaciens
ribB, ribG, ribA, ribH & ribT genes.] [SP:Q44681] [LE:3639] [RE:4103] [DI:direct]

| ORF Name | NTID | AAID | NT Length | AA Length | score | probability |
|---|---|---|---|---|---|---|
| AI7503000993_24720291_f2_322 | 2237 | 6009 | 498 | 165 | | |

Description
NO-HIT

| ORF Name | NTID | AAID | NT Length | AA Length | score | probability |
|---|---|---|---|---|---|---|
| AI7503000993_24726077_c3_965 | 2238 | 6010 | 1026 | 341 | 1088 | 3.8e-110 |

Description
sp:[LN:G3P2_BACSU] [AC:O34425] [GN:GAPB] [OR:BACILLUS SUBTILIS] [EC:1.2.1.12]
[DE:GLYCERALDEHYDE 3-PHOSPHATE DEHYDROGENASE 2, (GAPDH)] [SP:O34425] [DB:swissprot]
>pir:[LN:G69628] [AC:G69628 ] [PN:glyceraldehyde-3-phosphate dehydrogenase, gapB]
[GN:gapB ] [CL:glyceraldehyde-3-phosphate dehydrogenase] [OR:Bacillus subtilis]
[EC:1.2.1.12] [DB:pir2] >gp:[GI:e1184151:g2635367] [LN:BSUB0015] [AC:Z99118:AL009126]
[PN:glyceraldehyde-3-phosphate dehydrogenase] [GN:gapB] [FN:glycolysis] [OR:Bacillus
subtilis] [DB:genpept-bct1] [EC:1.2.1.12] [DE:Bacillus subtilis complete genome
(section 15 of 21): from 2795131to 3013540.] [SP:O34425] [LE:170976] [RE:171998]
[DI:complement] >gp:[GI:g2293277] [LN:AF008220] [AC:AF008220]
[PN:glyceraldehyde-3-P-dehydrogenase] [GN:gapB] [OR:Bacillus subtilis]
[DB:genpept-bct2] [DE:Bacillus subtilis rrnB-dnaB genomic region.] [LE:211069]
[RE:212091] [DI:direct]

| ORF Name | NTID | AAID | NT Length | AA Length | score | probability |
|---|---|---|---|---|---|---|
| AI7503000993_24740701_c3_903 | 2239 | 6011 | 2508 | 835 | 3293 | 0.0 |

Description
sp:[LN:SYL_BACSU] [AC:P36430:O34465] [GN:LEUS] [OR:BACILLUS SUBTILIS] [EC:6.1.1.4]
[DE:LEUCYL-TRNA SYNTHETASE, (LEUCINE--TRNA LIGASE) (LEURS)] [SP:P36430:O34465]
[DB:swissprot] >pir:[LN:D69650] [AC:D69650:A41882 ] [PN:leucine--tRNA
ligase,:leucyl-tRNA synthetase] [GN:leuS ] [CL:leucine--tRNA ligase] [OR:Bacillus
subtilis] [EC:6.1.1.4] [DB:pir2] >gp:[GI:e1185905:g2635516] [LN:BSUB0016]
[AC:Z99119:AL009126] [PN:leucyl-tRNA synthetase] [GN:leuS] [OR:Bacillus subtilis]
[DB:genpept-bct1] [EC:6.1.1.4] [DE:Bacillus subtilis complete genome (section 16 of
21): from 2997771to 3213410.] [SP:P36430] [LE:103940] [RE:106354] [DI:complement]
>gp:[GI:g2293181] [LN:AF008220] [AC:AF008220] [PN:leucine tRNA synthetase] [GN:leuS]
[OR:Bacillus subtilis] [DB:genpept-bct2] [DE:Bacillus subtilis rrnB-dnaB genomic
region.] [LE:74073] [RE:76487] [DI:direct]

| ORF Name | NTID | AAID | NT Length | AA Length | score | probability |
|---|---|---|---|---|---|---|
| AI7503000993_24744077_c2_739 | 2240 | 6012 | 183 | 60 | 74 | 0.011 |

Description
pir:[LN:B60608] [AC:B60608 ] [PN:myosin heavy chain] [CL:myosin heavy chain:myosin
motor domain homology] [OR:Schistosoma mansoni] [DB:pir2]

| ORF Name | NTID | AAID | NT Length | AA Length | score | probability |
|---|---|---|---|---|---|---|
| AI7503000993_24797177_c1_689 | 2241 | 6013 | 3534 | 1177 | 1450 | 1.7e-148 |

Description pir:[LN:C69999] [AC:C69999 ] [PN:DNA translocase stage III sporulation prot homolog ytpT] [GN:ytpT ] [OR:Bacillus subtilis] [DB:pir2] >gp:[GI:e1185853:g2635464] [LN:BSUB0016] [AC:Z99119:AL009126] [GN:ytpT] [FN:unknown] [OR:Bacillus subtilis] [DB:genpept-bct1] [DE:Bacillus subtilis complete genome (section 16 of 21): from 2997771to 3213410.] [NT:similar to DNA translocase stage III sporulation] [LE:51038] [RE:53146] [DI:complement] >gp:[GI:g2293215] [LN:AF008220] [AC:AF008220] [PN:YtpT] [GN:ytpT] [OR:Bacillus subtilis] [DB:genpept-bct2] [DE:Bacillus subtilis rrnB-dnaB genomic region.] [NT:strong similarity to FtsK of E. coli and SpoIIIE of] [LE:127280] [RE:129388] [DI:direct]

| ORF Name | NTID | AAID | NT Length | AA Length | score | probability |
|---|---|---|---|---|---|---|
| AI7503000993_24853437_c1_661 | 2242 | 6014 | 831 | 276 | 423 | 1.1e-39 |

Description pir:[LN:D69998] [AC:D69998 ] [PN:lysophospholipase homolog ytpA] [GN:ytpA ] [OR:Bacillus subtilis] [DB:pir2] >gp:[GI:e1185924:g2635535] [LN:BSUB0016] [AC:Z99119:AL009126] [GN:ytpA] [FN:unknown] [OR:Bacillus subtilis] [DB:genpept-bct1] [DE:Bacillus subtilis complete genome (section 16 of 21): from 2997771to 3213410.] [NT:similar to lysophospholipase] [LE:123973] [RE:124752] [DI:complement] >gp:[GI:g2293167] [LN:AF008220] [AC:AF008220] [PN:probable lysophospholipase] [GN:ytpA] [OR:Bacillus subtilis] [DB:genpept-bct2] [DE:Bacillus subtilis rrnB-dnaB genomic region.] [LE:55675] [RE:56454] [DI:direct]

| ORF Name | NTID | AAID | NT Length | AA Length | score | probability |
|---|---|---|---|---|---|---|
| AI7503000993_2538252_c2_752 | 2243 | 6015 | 981 | 326 | 988 | 1.5e-99 |

Description sp:[LN:HEMZ_BACSU] [AC:P32396] [GN:HEMH:HEMF] [OR:BACILLUS SUBTILIS] [EC:4.99.1.1] [DE:SYNTHETASE)] [SP:P32396] [DB:swissprot] >pir:[LN:C47045] [AC:C47045:H69639 ] [PN:ferrochelatase, hemH] [GN:hemH ] [OR:Bacillus subtilis] [EC:4.99.1.1] [DB:pir2] >gp:[GI:g143044] [LN:BACHEMEHY] [AC:M97208] [PN:ferrochelatase] [GN:hemH] [FN:iron is inserted into protoporphyrin IX giving] [OR:Bacillus subtilis] [SR:Bacillus subtilis (strain W168) DNA] [DB:genpept-bct1] [EC:4.99.1.1] [DE:Bacillus subtilis penicillin binding protein 1A (ponA) gene;uroporphyrinogen decarboxylase (hemE) gene; ferrochelatase (hemH)gene complete cds, (hemY) gene, complete cds; ORFA, complete cds;ORFB 5' end.] [LE:3038] [RE:3970] [DI:direct] >gp:[GI:e1183015:g2633349] [LN:BSUB0006] [AC:Z99109:AL009126] [PN:ferrochelatase] [GN:hemH] [FN:incorporation of iron into protoporphyrin IX] [OR:Bacillus subtilis] [DB:genpept-bct1] [EC:4.99.1.1] [DE:Bacillus subtilis complete genome (section 6 of 21): from 999501 to1209940.] [NT:alternate gene name: hemF] [SP:P32396] [LE:87223] [RE:88155] [DI:direct] >gp:[GI:e1191886:g2226231] [LN:BSY14083] [AC:Y14083] [PN:Ferrochelatase (EC 4.99.1.1); incorporation of] [GN:hemH] [OR:Bacillus subtilis] [DB:genpept-bct1] [DE:Bacillus subtilis chromosomal DNA, region 76-78 degrees: betweenglyB-aprE.] [NT:see Swiss Prot P32396; HEMZ_BACSU.] [SP:P32396] [LE:7082] [RE:8014] [DI:direct]

| ORF Name | NTID | AAID | NT Length | AA Length | score | probability |
|---|---|---|---|---|---|---|
| AI7503000993_25398425_c2_824 | 2244 | 6016 | 1167 | 388 | 731 | 2.6e-72 |

Description
pir:[LN:F69666] [AC:F69666 ] [PN:NifS protein homolog nifZ] [GN:nifZ ] [CL:nitrogen fixation protein nifS] [OR:Bacillus subtilis] [DB:pir2] >gp:[GI:e1185832:g2635443] [LN:BSUB0016] [AC:Z99119:AL009126] [PN:NifS protein homolog] [GN:nifZ] [FN:unknown] [OR:Bacillus subtilis] [DB:genpept-bct1] [DE:Bacillus subtilis complete genome (section 16 of 21): from 2997771to 3213410.] [LE:28263] [RE:29408] [DI:complement] >gp:[GI:g2293229] [LN:AF008220] [AC:AF008220] [PN:NifS2] [GN:nifS2] [OR:Bacillus subtilis] [DB:genpept-bct2] [DE:Bacillus subtilis rrnB-dnaB genomic region.] [NT:similar to R.sphaeroides nitrogenase stabilizer] [LE:151019] [RE:152164] [DI:direct]

| ORF Name | NTID | AAID | NT Length | AA Length | score | probability |
|---|---|---|---|---|---|---|
| AI7503000993_25476375_c2_813 | 2245 | 6017 | 135 | 44 | | |

Description
NO-HIT

| ORF Name | NTID | AAID | NT Length | AA Length | score | probability |
|---|---|---|---|---|---|---|
| AI7503000993_2548537_c1_703 | 2246 | 6018 | 222 | 73 | | |

Description
NO-HIT

| ORF Name | NTID | AAID | NT Length | AA Length | score | probability |
|---|---|---|---|---|---|---|
| AI7503000993_25586632_c2_759 | 2247 | 6019 | 135 | 44 | | |

Description
NO-HIT

| ORF Name | NTID | AAID | NT Length | AA Length | score | probability |
|---|---|---|---|---|---|---|
| AI7503000993_25665878_c1_683 | 2248 | 6020 | 1665 | 554 | 1014 | 2.6e-102 |

Description
pir:[LN:G69992] [AC:G69992 ] [PN:spore cortex protein homolog ytgP] [GN:ytgP ] [OR:Bacillus subtilis] [DB:pir2] >gp:[GI:e1185878:g2635489] [LN:BSUB0016] [AC:Z99119:AL009126] [GN:ytgP] [FN:unknown] [OR:Bacillus subtilis] [DB:genpept-bct1] [DE:Bacillus subtilis complete genome (section 16 of 21): from 2997771to 3213410.] [NT:similar to spore cortex protein] [LE:74841] [RE:76475] [DI:complement] >gp:[GI:g2293198] [LN:AF008220] [AC:AF008220] [PN:YtgP] [GN:ytgP] [OR:Bacillus subtilis] [DB:genpept-bct2] [DE:Bacillus subtilis rrnB-dnaB genomic region.] [NT:similar to SpoVB protein from B. subtilis] [LE:103951] [RE:105585] [DI:direct]

| ORF Name | NTID | AAID | NT Length | AA Length | score | probability |
|---|---|---|---|---|---|---|
| AI7503000993_25667217_c3_962 | 2249 | 6021 | 627 | 208 | 405 | 9.0e-38 |

Description
sp:[LN:YTAG_BACSU] [AC:O34932] [GN:YTAG] [OR:BACILLUS SUBTILIS] [DE:HYPOTHETICAL 22.0 KD PROTEIN IN GAPB-MUTM INTERGENIC REGION] [SP:O34932] [DB:swissprot] >pir:[LN:A69988] [AC:A69988 ] [PN:conserved hypothetical protein ytaG] [GN:ytaG ] [CL:conserved hypothetical protein YDR196c] [OR:Bacillus subtilis] [DB:pir2] >gp:[GI:e1184155:g2635371] [LN:BSUB0015] [AC:Z99118:AL009126] [GN:ytaG] [FN:unknown] [OR:Bacillus subtilis] [DB:genpept-bct1] [DE:Bacillus subtilis complete genome (section 15 of 21): from 2795131to 3013540.] [NT:similar to hypothetical proteins] [SP:O34932] [LE:174866] [RE:175459] [DI:complement] >gp:[GI:g2293275] [LN:AF008220] [AC:AF008220] [PN:YtaG] [GN:ytaG] [OR:Bacillus subtilis] [DB:genpept-bct2] [DE:Bacillus subtilis rrnB-dnaB genomic region.] [NT:similar to hypothetical protein HI0890 from H.] [LE:207608] [RE:208201] [DI:direct]

| ORF Name | NTID | AAID | NT Length | AA Length | score | probability |
|---|---|---|---|---|---|---|
| AI7503000993_25972087_c3_846 | 2250 | 6022 | 147 | 48 | | |

Description
NO-HIT

| ORF Name | NTID | AAID | NT Length | AA Length | score | probability |
|---|---|---|---|---|---|---|
| AI7503000993_26175952_f3_532 | 2251 | 6023 | 258 | 85 | | |

Description
NO-HIT

| ORF Name | NTID | AAID | NT Length | AA Length | score | probability |
|---|---|---|---|---|---|---|
| AI7503000993_26181551_c2_834 | 2252 | 6024 | 948 | 315 | 1016 | 1.6e-102 |

Description
sp:[LN:ACCA_BACSU] [AC:O34847] [GN:ACCA] [OR:BACILLUS SUBTILIS] [EC:6.4.1.2] [DE:(EC 6.4.1.2)] [SP:O34847] [DB:swissprot] >pir:[LN:G69580] [AC:G69580 ] [PN:acetyl-CoA carboxylase,, carboxyltransferase alpha chain] [GN:accA ] [CL:acetyl-CoA carboxylase, carboxyltransferase alpha chain] [OR:Bacillus subtilis] [EC:6.4.1.2] [DB:pir2] >gp:[GI:e1184169:g2635385] [LN:BSUB0015] [AC:Z99118:AL009126] [PN:acetyl CoA carboxylase (alpha subunit)] [GN:accA] [FN:long-chain fatty acid biosynthesis] [OR:Bacillus subtilis] [DB:genpept-bct1] [DE:Bacillus subtilis complete genome (section 15 of 21): from 2795131to 3013540.] [SP:O34847] [LE:191674] [RE:192651] [DI:complement] >gp:[GI:g2293263] [LN:AF008220] [AC:AF008220] [PN:acetyl-CoA carboxylase subunit] [GN:accA] [OR:Bacillus subtilis] [DB:genpept-bct2] [DE:Bacillus subtilis rrnB-dnaB genomic region.] [LE:190416] [RE:191393] [DI:direct]

| ORF Name | NTID | AAID | NT Length | AA Length | score | probability |
|---|---|---|---|---|---|---|
| AI7503000993_26188891_f1_29 | 2253 | 6025 | 210 | 69 | 75 | 0.012 |

Description
pir:[LN:S58751] [AC:S58751 ] [PN:NADH dehydrogenase (ubiquinone), chain 3] [CL:NADH dehydrogenase (ubiquinone) chain 3] [OR:mitochondrion Hansenula wingei] [EC:1.6.5.3] [DB:pir2]

| ORF Name | NTID | AAID | NT Length | AA Length | score | probability |
|---|---|---|---|---|---|---|
| AI7503000993_26259686_f3_450 | 2254 | 6026 | 1242 | 413 | 801 | 9.8e-80 |

Description pir:[LN:A69643] [AC:A69643 ] [PN:serine proteinase Do, heat-shock protein htrA]
[GN:htrA ] [CL:proteinase hhoB] [OR:Bacillus subtilis] [DB:pir2]
>gp:[GI:e1181491:g2632011] [LN:BSAJ2571] [AC:AJ002571] [PN:YkdA] [GN:ykdA] [OR:Bacillus subtilis] [DB:genpept-bct1] [DE:Bacillus subtilis 168 56 kb DNA fragment between xlyA and ykoR.] [NT:putative serine protease, heat-shock inducible;] [LE:10063] [RE:11412]
[DI:complement] >gp:[GI:e1183310:g2633644] [LN:BSUB0007] [AC:Z99110:AL009126]
[PN:serine protease Do (heat-shock protein)] [GN:htrA] [OR:Bacillus subtilis]
[DB:genpept-bct1] [DE:Bacillus subtilis complete genome (section 7 of 21): from
1194391to 1411140.] [NT:alternate gene name: ykdA] [LE:163012] [RE:164361]
[DI:complement]

| ORF Name | NTID | AAID | NT Length | AA Length | score | probability |
|---|---|---|---|---|---|---|
| AI7503000993_26567062_c1_642 | 2255 | 6027 | 792 | 263 | 428 | 3.3e-40 |

Description pir:[LN:A69996] [AC:A69996 ] [PN:hypothetical protein ytmA] [GN:ytmA ] [OR:Bacillus subtilis] [DB:pir2] >gp:[GI:e1185931:g2635542] [LN:BSUB0016] [AC:Z99119:AL009126]
[GN:ytmA] [FN:unknown] [OR:Bacillus subtilis] [DB:genpept-bct1] [DE:Bacillus subtilis complete genome (section 16 of 21): from 2997771to 3213410.] [LE:132757] [RE:133530]
[DI:complement] >gp:[GI:g2293162] [LN:AF008220] [AC:AF008220] [PN:putative peptidase]
[GN:ytmA] [OR:Bacillus subtilis] [DB:genpept-bct2] [DE:Bacillus subtilis rrnB-dnaB
genomic region.] [LE:46897] [RE:47670] [DI:direct]

| ORF Name | NTID | AAID | NT Length | AA Length | score | probability |
|---|---|---|---|---|---|---|
| AI7503000993_26596062_f3_484 | 2256 | 6028 | 1284 | 427 | 1198 | 8.3e-122 |

Description gp:[GI:g2293312] [LN:AF008220] [AC:AF008220] [PN:YtfP] [GN:ytfP] [OR:Bacillus subtilis]
[DB:genpept-bct2] [DE:Bacillus subtilis rrnB-dnaB genomic region.] [NT:similarity to
hypothetical protein f400 from E.] [LE:102487] [RE:103704] [DI:complement]

| ORF Name | NTID | AAID | NT Length | AA Length | score | probability |
|---|---|---|---|---|---|---|
| AI7503000993_2741536_c2_805 | 2257 | 6029 | 162 | 53 | | |

Description
NO-HIT

| ORF Name | NTID | AAID | NT Length | AA Length | score | probability |
|---|---|---|---|---|---|---|
| AI7503000993_2757633_c2_765 | 2258 | 6030 | 1494 | 497 | 1275 | 1.9e-164 |

Description sp:[LN:MENE_STAAU] [AC:Q53634] [GN:MENE] [OR:STAPHYLOCOCCUS AUREUS] [EC:6.2.1.26]
[DE:(O-SUCCINYLBENZOATE-COA SYNTHASE)] [SP:Q53634] [DB:swissprot] >gp:[GI:g1255259]
[LN:SAU51132] [AC:U51132] [PN:o-succinylbenzoic acid (OSB) CoA ligase] [GN:mene]
[FN:converts OSB to OSB-CoA in menaquinone] [OR:Staphylococcus aureus]
[DB:genpept-bct1] [DE:Staphylococcus aureus o-succinylbenzoic acid CoA ligase
(mene),and o-succinylbenzoic acid synthetase (menc) genes, complete cds.] [LE:491]
[RE:1969] [DI:direct]

| ORF Name | NTID | AAID | NT Length | AA Length | score | probability |
|---|---|---|---|---|---|---|
| AI7503000993_2869676_f2_338 | 2259 | 6031 | 123 | 40 | | |

Description
NO-HIT

| ORF Name | NTID | AAID | NT Length | AA Length | score | probability |
|---|---|---|---|---|---|---|
| AI7503000993_2923202_c1_699 | 2260 | 6032 | 1473 | 490 | 1202 | 3.1e-122 |

Description gp:[GI:g1732197] [LN:VFU65014] [AC:U65014] [PN:PTS permease for N-acetylglucosamine and] [GN:nagE] [OR:Vibrio furnissii] [DB:genpept-bct2] [DE:Vibrio furnissii PTS permease for N-acetylglucosamine and glucose(nagE) gene, complete cds.] [NT:PTS enzyme IINag] [LE:115] [RE:1605] [DI:direct]

| ORF Name | NTID | AAID | NT Length | AA Length | score | probability |
|---|---|---|---|---|---|---|
| AI7503000993_29562552_f3_555 | 2261 | 6033 | 276 | 91 | 281 | 1.2e-24 |

Description pir:[LN:H69993] [AC:H69993 ] [PN:hypothetical protein ytjA] [GN:ytjA ] [CL:conserved hypothetical protein HI1000] [OR:Bacillus subtilis] [DB:pir2]
>gp:[GI:e1185941:g2635552] [LN:BSUB0016] [AC:Z99119:AL009126] [GN:ytjA] [FN:unknown] [OR:Bacillus subtilis] [DB:genpept-bct1] [DE:Bacillus subtilis complete genome (section 16 of 21): from 2997771to 3213410.] [LE:139407] [RE:139634] [DI:direct]
>gp:[GI:g2293294] [LN:AF008220] [AC:AF008220] [PN:YtjA] [GN:ytjA] [OR:Bacillus subtilis] [DB:genpept-bct2] [DE:Bacillus subtilis rrnB-dnaB genomic region.] [NT:similar to hypothetical 9.3 kD protein from P.] [LE:40793] [RE:41020] [DI:complement]

| ORF Name | NTID | AAID | NT Length | AA Length | score | probability |
|---|---|---|---|---|---|---|
| AI7503000993_30079651_f1_66 | 2262 | 6034 | 1620 | 539 | 1135 | 4.0e-115 |

Description sp:[LN:SERA_BACSU] [AC:P35136:O32011] [GN:SERA] [OR:BACILLUS SUBTILIS] [EC:1.1.1.95] [DE:D-3-PHOSPHOGLYCERATE DEHYDROGENASE, (PGDH)] [SP:P35136:O32011] [DB:swissprot]
>pir:[LN:C69705] [AC:C69705:S45534 ] [PN:phosphoglycerate dehydrogenase, serA] [GN:serA ] [CL:Bacillus phosphoglycerate dehydrogenase] [OR:Bacillus subtilis] [EC:1.1.1.95] [DB:pir2] >gp:[GI:e1185576:g2634742] [LN:BSUB0013] [AC:Z99116:AL009126] [PN:phosphoglycerate dehydrogenase] [GN:serA] [FN:serine biosynthesis] [OR:Bacillus subtilis] [DB:genpept-bct1] [EC:1.1.1.95] [DE:Bacillus subtilis complete genome (section 13 of 21): from 2395261to 2613730.] [SP:P35136] [LE:15060] [RE:16637] [DI:direct] >gp:[GI:g1146196] [LN:BACSERA] [AC:L47648] [PN:phosphoglycerate dehydrogenase] [GN:serA] [FN:serine biosynthesis] [OR:Bacillus subtilis] [DB:genpept-bct2] [DE:Bacillus subtilis phosphoglycerate dehydrogenase (serA), ypaA,ferredoxin (fer), ypbB, recS, ypbD, ypbE, ypbF, ypbG, ypbH,glutamate dehydrogenase (ypcA), ypdA, ypdB, ypdC, spore cortexlytic enzyme (sleB), ypeB, ypfA, ypfB, cytidine monophosphatekinase (cmk), ypfD, ypgA, yphA, yphB, yphC, NAD+ dependentglycerol-3-phosphate dehydrogenase (glyc), yphE and yphF genes,complete cds.] [LE:40] [RE:1617] [DI:complement]

| ORF Name | NTID | AAID | NT Length | AA Length | score | probability |
|---|---|---|---|---|---|---|
| AI7503000993_30084402_f3_446 | 2263 | 6035 | 1188 | 395 | 716 | 1.0e-70 |

Description sp:[LN:DHSS_SYNP1] [AC:P14776] [OR:SYNECHOCOCCUS SP] [SR:PCC 6716,] [EC:1.12.-.-] [DE:SUBUNIT)] [SP:P14776] [DB:swissprot] >pir:[LN:HQYCSS] [AC:S06919 ] [PN:soluble hydrogenase, small chain] [CL:serine--pyruvate aminotransferase] [OR:Synechococcus sp.] [EC:1.12.-.-] [DB:pir1] >gp:[GI:g48054] [LN:SYNSOLHY] [AC:X16658] [OR:Synechococcus sp.] [SR:Synechococcus sp] [DB:genpept-bct1] [DE:Synechococcus DNA for the small subunit of soluble hydrogenase.] [NT:small subunit of soluble hydrogenase (AA 1-384)] [SP:P14776] [LE:226] [RE:1380] [DI:direct]

| ORF Name | NTID | AAID | NT Length | AA Length | score | probability |
|---|---|---|---|---|---|---|
| AI7503000993_30114637_c3_847 | 2264 | 6036 | 1167 | 388 | 1177 | 1.4e-119 |

Description
pir:[LN:E69820] [AC:E69820 ] [PN:conserved hypothetical protein yhbA] [GN:yhbA ]
[OR:Bacillus subtilis] [DB:pir2] >gp:[GI:e1182880:g2633214] [LN:BSUB0005]
[AC:Z99108:AL009126] [GN:yhbA] [FN:unknown] [OR:Bacillus subtilis] [DB:genpept-bct1]
[DE:Bacillus subtilis complete genome (section 5 of 21): from 802821 to1011250.]
[NT:alternate gene name: ygaP; similar to hypothetical] [LE:164477] [RE:165784]
[DI:direct] >gp:[GI:e308636:g1903044] [LN:BSZ93102] [AC:Z93102] [PN:hypothetical 48.5
kd protein] [GN:ygaP] [OR:Bacillus subtilis] [DB:genpept-bct1] [DE:B.subtilis
yga[L,M,N,O,P,Q,R,S,T], yzdB and yze[A,C] genes.] [LE:6803] [RE:8110] [DI:direct]

| ORF Name | NTID | AAID | NT Length | AA Length | score | probability |
|---|---|---|---|---|---|---|
| AI7503000993_30274187_f3_522 | 2265 | 6037 | 969 | 322 | 1317 | 2.0e-134 |

Description
pir:[LN:D69999] [AC:D69999 ] [PN:conserved hypothetical protein ytqA] [GN:ytqA ]
[CL:Methanococcus jannaschii conserved hypothetical protein MJ0486] [OR:Bacillus
subtilis] [DB:pir2] >gp:[GI:e1185921:g2635532] [LN:BSUB0016] [AC:Z99119:AL009126]
[GN:ytqA] [FN:unknown] [OR:Bacillus subtilis] [DB:genpept-bct1] [DE:Bacillus subtilis
complete genome (section 16 of 21): from 2997771to 3213410.] [NT:similar to
hypothetical proteins] [LE:121310] [RE:122278] [DI:direct] >gp:[GI:g2293302]
[LN:AF008220] [AC:AF008220] [PN:YtqA] [GN:ytqA] [OR:Bacillus subtilis]
[DB:genpept-bct2] [DE:Bacillus subtilis rrnB-dnaB genomic region.] [NT:similarity to
biotine synthase from B.sphaericus] [LE:58149] [RE:59117] [DI:complement]

| ORF Name | NTID | AAID | NT Length | AA Length | score | probability |
|---|---|---|---|---|---|---|
| AI7503000993_30508255_c3_912 | 2266 | 6038 | 1416 | 471 | 1011 | 5.5e-102 |

Description
pir:[LN:S43914] [AC:S43914 ] [PN:hypothetical protein 1] [CL:peptidase V] [OR:Bacillus
stearothermophilus] [DB:pir2] >gp:[GI:g436965] [LN:BACMALA] [AC:L13418] [OR:Bacillus
stearothermophilus] [SR:Bacillus stearothermophilus (library: ATCC 7953) DNA]
[DB:genpept-bct1] [DE:Bacillus stearothermophilus maltose permease (malA) gene,
completecds.] [LE:24] [RE:1376] [DI:direct]

| ORF Name | NTID | AAID | NT Length | AA Length | score | probability |
|---|---|---|---|---|---|---|
| AI7503000993_31256568_c2_817 | 2267 | 6039 | 201 | 66 | 114 | 6.2e-07 |

Description
pir:[LN:F71011] [AC:F71011 ] [PN:hypothetical protein PH1388] [GN:PH1388 ]
[OR:Pyrococcus horikoshii] [DB:pir2] >gp:[GI:d1031437:g3257811] [LN:AP000006]
[AC:AP000006:AB005215:AB009510:AB009511:AB009512:AB009513:AB009514] [PN:119aa long
hypothetical protein] [GN:PH1388] [OR:Pyrococcus horikoshii] [SR:Pyrococcus horikoshii
(strain:OT3) DNA, clone:Pyrococcus horikoshi] [DB:genpept-bct1] [DE:Pyrococcus
horikoshii OT3 genomic DNA, 1166001-1485000 nt. position(6/7).] [LE:86760] [RE:87119]
[DI:direct]

| ORF Name | NTID | AAID | NT Length | AA Length | score | probability |
|---|---|---|---|---|---|---|
| AI7503000993_3140917_c3_954 | 2268 | 6040 | 189 | 62 | | |

Description
NO-HIT

| ORF Name | NTID | AAID | NT Length | AA Length | score | probability |
|---|---|---|---|---|---|---|
| AI7503000993_31539156_c3_874 | 2269 | 6041 | 204 | 67 | | |

Description
NO-HIT

| ORF Name | NTID | AAID | NT Length | AA Length | score | probability |
|---|---|---|---|---|---|---|
| AI7503000993_3158502_c2_792 | 2270 | 6042 | 225 | 74 | 122 | 2.7e-07 |

Description
pir:[LN:A69997] [AC:A69997 ] [PN:hypothetical protein ytmP] [GN:ytmP ] [OR:Bacillus subtilis] [DB:pir2] >gp:[GI:e1185865:g2635476] [LN:BSUB0016] [AC:Z99119:AL009126] [GN:ytmP] [FN:unknown] [OR:Bacillus subtilis] [DB:genpept-bct1] [DE:Bacillus subtilis complete genome (section 16 of 21): from 2997771to 3213410.] [LE:61986] [RE:62795] [DI:complement] >gp:[GI:g2293206] [LN:AF008220] [AC:AF008220] [PN:YtmP] [GN:ytmP] [OR:Bacillus subtilis] [DB:genpept-bct2] [DE:Bacillus subtilis rrnB-dnaB genomic region.] [LE:117631] [RE:118440] [DI:direct]

| ORF Name | NTID | AAID | NT Length | AA Length | score | probability |
|---|---|---|---|---|---|---|
| AI7503000993_33209677_c2_831 | 2271 | 6043 | 972 | 323 | 764 | 8.2e-76 |

Description
pir:[LN:F69999] [AC:F69999 ] [PN:conserved hypothetical protein ytqI] [GN:ytqI ] [OR:Bacillus subtilis] [DB:pir2] >gp:[GI:e1184174:g2635390] [LN:BSUB0015] [AC:Z99118:AL009126] [GN:ytqI] [FN:unknown] [OR:Bacillus subtilis] [DB:genpept-bct1] [DE:Bacillus subtilis complete genome (section 15 of 21): from 2795131to 3013540.] [NT:similar to hypothetical proteins] [LE:199851] [RE:200792] [DI:complement] >gp:[GI:g2293259] [LN:AF008220] [AC:AF008220] [PN:YtqI] [GN:ytqI] [OR:Bacillus subtilis] [DB:genpept-bct2] [DE:Bacillus subtilis rrnB-dnaB genomic region.] [NT:similarity to MGPA protein from M.genitalium] [LE:182275] [RE:183216] [DI:direct]

| ORF Name | NTID | AAID | NT Length | AA Length | score | probability |
|---|---|---|---|---|---|---|
| AI7503000993_33287515_f1_122 | 2272 | 6044 | 330 | 109 | 89 | 0.0022 |

Description
gp:[GI:g4091929] [LN:AF069752] [AC:AF069752] [PN:C5,6 desaturase] [GN:ERG3] [OR:Candida albicans] [DB:genpept-pln2] [DE:Candida albicans C5,6 desaturase (ERG3) gene, complete cds.] [LE:387] [RE:1547] [DI:direct]

| ORF Name | NTID | AAID | NT Length | AA Length | score | probability |
|---|---|---|---|---|---|---|
| AI7503000993_33292165_f1_155 | 2273 | 6045 | 156 | 51 | | |

Description
NO-HIT

| ORF Name | NTID | AAID | NT Length | AA Length | score | probability |
|---|---|---|---|---|---|---|
| AI7503000993_33317002_f1_114 | 2274 | 6046 | 123 | 40 | | |

Description
NO-HIT

| ORF Name | NTID | AAID | NT Length | AA Length | score | probability |
|---|---|---|---|---|---|---|
| AI7503000993_33360312_f1_74 | 2275 | 6047 | 420 | 139 | 295 | 1.6e-25 |

Description
gp:[GI:e1284114:g2982646] [LN:SPAJ2293] [AC:AJ002293] [PN:penicillin-binding protein 1b] [GN:pbp1b] [OR:Streptococcus pneumoniae] [DB:genpept-bct1] [DE:Streptococcus pneumoniae pbp1b gene, partial, beta-lactamresistant.] [LE:<1] [RE:>1600] [DI:direct]

| ORF Name | NTID | AAID | NT Length | AA Length | score | probability |
|---|---|---|---|---|---|---|
| AI7503000993_33647577_c2_740 | 2276 | 6048 | 1386 | 461 | 1586 | 6.4e-163 |

Description
gp:[GI:e1249821:g2832825] [LN:BS43KBDNA] [AC:AJ223978] [PN:fumarase protein, CitG] [GN:citG] [OR:Bacillus subtilis] [DB:genpept-bct1] [DE:Bacillus subtilis 42.7kB DNA fragment from yvsA to yvqA.] [LE:37816] [RE:39204] [DI:direct]
>gp:[GI:e1184383:g2635801] [LN:BSUB0017] [AC:Z99120:AL009126] [PN:fumarate hydratase] [GN:citG] [OR:Bacillus subtilis] [DB:genpept-bct1] [EC:4.2.1.2] [DE:Bacillus subtilis complete genome (section 17 of 21): from 3197001to 3414420.] [LE:191083] [RE:192471] [DI:complement]

| ORF Name | NTID | AAID | NT Length | AA Length | score | probability |
|---|---|---|---|---|---|---|
| AI7503000993_33650137_c2_794 | 2277 | 6049 | 207 | 68 | 177 | 1.3e-13 |

Description
pir:[LN:A69999] [AC:A69999 ] [PN:phenylalanyl-tRNA synthetase (beta subunit) homolog ytpR] [GN:ytpR ] [CL:Mycoplasma genitalium hypothetical protein MG449] [OR:Bacillus subtilis] [DB:pir2] >gp:[GI:e1185855:g2635466] [LN:BSUB0016] [AC:Z99119:AL009126] [GN:ytpR] [FN:unknown] [OR:Bacillus subtilis] [DB:genpept-bct1] [DE:Bacillus subtilis complete genome (section 16 of 21): from 2997771to 3213410.] [NT:similar to phenylalanyl-tRNA synthetase (beta] [LE:54055] [RE:54660] [DI:complement]
>gp:[GI:g2293213] [LN:AF008220] [AC:AF008220] [PN:YtpR] [GN:ytpR] [OR:Bacillus subtilis] [DB:genpept-bct2] [DE:Bacillus subtilis rrnB-dnaB genomic region.] [NT:similarity to phenylalanine tRNA ligase of E. coli] [LE:125766] [RE:126371] [DI:direct]

| ORF Name | NTID | AAID | NT Length | AA Length | score | probability |
|---|---|---|---|---|---|---|
| AI7503000993_3365887_c2_791 | 2278 | 6050 | 630 | 209 | 501 | 6.0e-48 |

Description
pir:[LN:A69997] [AC:A69997 ] [PN:hypothetical protein ytmP] [GN:ytmP ] [OR:Bacillus subtilis] [DB:pir2] >gp:[GI:e1185865:g2635476] [LN:BSUB0016] [AC:Z99119:AL009126] [GN:ytmP] [FN:unknown] [OR:Bacillus subtilis] [DB:genpept-bct1] [DE:Bacillus subtilis complete genome (section 16 of 21): from 2997771to 3213410.] [LE:61986] [RE:62795] [DI:complement] >gp:[GI:g2293206] [LN:AF008220] [AC:AF008220] [PN:YtmP] [GN:ytmP] [OR:Bacillus subtilis] [DB:genpept-bct2] [DE:Bacillus subtilis rrnB-dnaB genomic region.] [LE:117631] [RE:118440] [DI:direct]

| ORF Name | NTID | AAID | NT Length | AA Length | score | probability |
|---|---|---|---|---|---|---|
| AI7503000993_33792687_c1_629 | 2279 | 6051 | 129 | 42 | | |

Description
NO-HIT

| ORF Name | NTID | AAID | NT Length | AA Length | score | probability |
|---|---|---|---|---|---|---|
| AI7503000993_33831512_f2_373 | 2280 | 6052 | 234 | 77 | 82 | 0.0093 |

Description
gp:[GI:e1346461:g3876981] [LN:CEF40D4] [AC:Z81536] [GN:F40D4.10] [OR:Caenorhabditis elegans] [DB:genpept-inv1] [DE:Caenorhabditis elegans cosmid F40D4, complete sequence.] [LE:20486:20882:21041:21585] [RE:20830:20997:21200:21746] [DI:directJoin]

| ORF Name | NTID | AAID | NT Length | AA Length | score | probability |
|---|---|---|---|---|---|---|
| AI7503000993_33985077_c1_720 | 2281 | 6053 | 1230 | 409 | 1529 | 7.0e-157 |

Description
pir:[LN:C70001] [AC:C70001 ] [PN:malate dehydrogenase homolog ytsJ] [GN:ytsJ ] [CL:malate dehydrogenase (oxaloacetate-decarboxylating)] [OR:Bacillus subtilis] [DB:pir2] >gp:[GI:e1184171:g2635387] [LN:BSUB0015] [AC:Z99118:AL009126] [GN:ytsJ] [FN:unknown] [OR:Bacillus subtilis] [DB:genpept-bct1] [DE:Bacillus subtilis complete genome (section 15 of 21): from 2795131to 3013540.] [NT:similar to malate dehydrogenase] [LE:193843] [RE:195075] [DI:complement] >gp:[GI:g2293261] [LN:AF008220] [AC:AF008220] [PN:YtsJ] [GN:ytsJ] [OR:Bacillus subtilis] [DB:genpept-bct2] [DE:Bacillus subtilis rrnB-dnaB genomic region.] [NT:similarity to malate dehydrogenase (NADP+) from] [LE:187992] [RE:189224] [DI:direct]

| ORF Name | NTID | AAID | NT Length | AA Length | score | probability |
|---|---|---|---|---|---|---|
| AI7503000993_34177127_c1_721 | 2282 | 6054 | 1806 | 601 | 1853 | 3.3e-191 |

Description
sp:[LN:KPYK_BACLI] [AC:P51181] [GN:PYK] [OR:BACILLUS LICHENIFORMIS] [EC:2.7.1.40] [DE:PYRUVATE KINASE, (PK)] [SP:P51181] [DB:swissprot] >pir:[LN:JC4220] [AC:JC4220 ] [PN:pyruvate kinase,:ATP:pyruvate 2-O-phosphotransferase] [CL:pyruvate kinase] [OR:Bacillus licheniformis] [EC:2.7.1.40] [DB:pir2] >gp:[GI:d1007299:g1041099] [LN:BACPYK2] [AC:D31955] [PN:Pyruvate Kinase] [OR:Bacillus licheniformis] [SR:Bacillus licheniformis DNA] [DB:genpept-bct1] [DE:Bacillus licheniformis gene for pyruvate kinase, complete cds.] [LE:132] [RE:1889] [DI:direct]

| ORF Name | NTID | AAID | NT Length | AA Length | score | probability |
|---|---|---|---|---|---|---|
| AI7503000993_34178128_c3_888 | 2283 | 6055 | 216 | 71 | | |

Description
NO-HIT

| ORF_Name | NTID | AAID | NT Length | AA Length | score | probability |
|---|---|---|---|---|---|---|
| AI7503000993_34181551_c2_841 | 2284 | 6056 | 924 | 307 | 618 | 2.4e-60 |

Description sp:[LN:DNAI_BACSU] [AC:P06567] [GN:DNAI] [OR:BACILLUS SUBTILIS] [DE:PRIMOSOMAL PROTEIN DNAI] [SP:P06567] [DB:swissprot] >pir:[LN:IQBS44] [AC:B24720:C26580:F69617 ] [PN:primosome component (helicase loader) dnaI:dnaA protein homolog, 44K:hypothetical protein Y (dnaB 3' region)] [GN:dnaI ] [CL:44K dnaA protein homolog] [OR:Bacillus subtilis] [DB:pir1] >gp:[GI:g39881] [LN:BSDNAB] [AC:X04963] [OR:Bacillus subtilis] [DB:genpept-bct1] [DE:Bacillus subtilis dnaB gene for initiation of chromosomalreplication.] [NT:ORF 311 (AA 1-311)] [SP:P06567] [LE:1843] [RE:2778] [DI:direct] >gp:[GI:e1184147:g2635363] [LN:BSUB0015] [AC:Z99118:AL009126] [PN:helicase loader] [GN:dnaI] [FN:DNA synthesis] [OR:Bacillus subtilis] [DB:genpept-bct1] [DE:Bacillus subtilis complete genome (section 15 of 21): from 2795131to 3013540.] [NT:alternate gene name: ytxA, dnaY] [SP:P06567] [LE:167129] [RE:168064] [DI:complement] >gp:[GI:e1165286:g1769996] [LN:BSZ75208] [AC:Z75208] [PN:replication protein] [GN:dnaI] [OR:Bacillus subtilis] [DB:genpept-bct1] [DE:B.subtilis genomic sequence 89009bp.] [NT:DNA synthesis; putative primosome component] [SP:P06567] [LE:1843] [RE:2778] [DI:direct] >gp:[GI:g2293281] [LN:AF008220] [AC:AF008220] [PN:DnaI] [GN:dnaI] [OR:Bacillus subtilis] [DB:genpept-bct2] [DE:Bacillus subtilis rrnB-dnaB genomic region.] [LE:215003] [RE:215938] [DI:direct]

| ORF_Name | NTID | AAID | NT Length | AA Length | score | probability |
|---|---|---|---|---|---|---|
| AI7503000993_34199077_c3_883 | 2285 | 6057 | 1017 | 338 | 864 | 2.1e-86 |

Description gp:[GI:g1255260] [LN:SAU51132] [AC:U51132] [PN:o-succinylbenzoic acid (OSB) synthetase] [GN:menc] [FN:converts SHCHC to OSB in menaquinone] [OR:Staphylococcus aureus] [DB:genpept-bct1] [DE:Staphylococcus aureus o-succinylbenzoic acid CoA ligase (mene),and o-succinylbenzoic acid synthetase (menc) genes, complete cds.] [LE:1974] [RE:2975] [DI:direct]

| ORF_Name | NTID | AAID | NT Length | AA Length | score | probability |
|---|---|---|---|---|---|---|
| AI7503000993_34272752_c3_862 | 2286 | 6058 | 963 | 320 | 1413 | 1.4e-144 |

Description gp:[GI:g710422] [LN:SAU21636] [AC:U21636] [PN:cmp-binding-factor 1] [GN:cbf1] [OR:Staphylococcus aureus] [DB:genpept-bct2] [DE:Staphylococcus aureus cmp-binding-factor 1 (cbf1) and ORF X genes,complete cds.] [LE:1155] [RE:2096] [DI:direct]

| ORF_Name | NTID | AAID | NT Length | AA Length | score | probability |
|---|---|---|---|---|---|---|
| AI7503000993_34415925_c3_914 | 2287 | 6059 | 654 | 217 | 540 | 4.5e-52 |

Description pir:[LN:B69997] [AC:B69997 ] [PN:conserved hypothetical protein ytmQ] [GN:ytmQ ] [CL:hypothetical protein HI0340] [OR:Bacillus subtilis] [DB:pir2] >gp:[GI:e1185863:g2635474] [LN:BSUB0016] [AC:Z99119:AL009126] [GN:ytmQ] [FN:unknown] [OR:Bacillus subtilis] [DB:genpept-bct1] [DE:Bacillus subtilis complete genome (section 16 of 21): from 2997771to 3213410.] [NT:similar to hypothetical proteins] [LE:60859] [RE:61500] [DI:complement] >gp:[GI:g2293207] [LN:AF008220] [AC:AF008220] [PN:YtmQ] [GN:ytmQ] [OR:Bacillus subtilis] [DB:genpept-bct2] [DE:Bacillus subtilis rrnB-dnaB genomic region.] [NT:similar to hypothetical protein HI0340 from H.] [LE:118926] [RE:119567] [DI:direct]

| ORF Name | NTID | AAID | NT Length | AA Length | score | probability |
|---|---|---|---|---|---|---|
| AI7503000993_34429838_c3_884 | 2288 | 6060 | 483 | 160 | 261 | 1.6e-22 |

Description
pir:[LN:E69994] [AC:E69994 ] [PN:hypothetical protein ytkD] [GN:ytkD ] [OR:Bacillus subtilis] [DB:pir2] >gp:[GI:e1185936:g2635547] [LN:BSUB0016] [AC:Z99119:AL009126] [GN:ytkD] [FN:unknown] [OR:Bacillus subtilis] [DB:genpept-bct1] [DE:Bacillus subtilis complete genome (section 16 of 21): from 2997771to 3213410.] [LE:136293] [RE:136769] [DI:complement] >gp:[GI:g2293161] [LN:AF008220] [AC:AF008220] [PN:YtkD] [GN:ytkD] [OR:Bacillus subtilis] [DB:genpept-bct2] [DE:Bacillus subtilis rrnB-dnaB genomic region.] [LE:43658] [RE:44134] [DI:direct]

| ORF Name | NTID | AAID | NT Length | AA Length | score | probability |
|---|---|---|---|---|---|---|
| AI7503000993_34610925_f3_445 | 2289 | 6061 | 462 | 153 | 274 | 6.9e-24 |

Description
pir:[LN:F69883] [AC:F69883 ] [PN:conserved hypothetical protein ymaD] [GN:ymaD ] [OR:Bacillus subtilis] [DB:pir2] >gp:[GI:e1183387:g2634112] [LN:BSUB0010] [AC:Z99113:AL009126] [GN:ymaD] [FN:unknown] [OR:Bacillus subtilis] [DB:genpept-bct1] [DE:Bacillus subtilis complete genome (section 10 of 21): from 1781201to 2014980.] [NT:similar to hypothetical proteins] [LE:82267] [RE:82719] [DI:direct]

| ORF Name | NTID | AAID | NT Length | AA Length | score | probability |
|---|---|---|---|---|---|---|
| AI7503000993_34617017_c3_869 | 2290 | 6062 | 759 | 252 | 773 | 9.1e-77 |

Description
sp:[LN:ECSA_BACSU] [AC:P55339] [GN:ECSA:PRST] [OR:BACILLUS SUBTILIS] [DE:ABC-TYPE TRANSPORTER ATP-BINDING PROTEIN ECSA] [SP:P55339] [DB:swissprot] >pir:[LN:F69619] [AC:F69619 ] [PN:ABC transporter (ATP-binding protein) ecsA] [GN:ecsA ] [CL:ATP-binding cassette homology] [OR:Bacillus subtilis] [DB:pir2] >gp:[GI:e183449:g1177253] [LN:BSECSABCG] [AC:X87807] [PN:putative ATP-binding protein of ABC-type] [GN:ecsA] [OR:Bacillus subtilis] [DB:genpept-bct1] [DE:B.subtilis ecsA, ecsB, and ecsC genes.] [SP:P55339] [LE:248] [RE:991] [DI:direct] >gp:[GI:e1183006:g2633340] [LN:BSUB0006] [AC:Z99109:AL009126] [PN:ABC transporter (ATP-binding protein)] [GN:ecsA] [FN:regulates both components of the protein] [OR:Bacillus subtilis] [DB:genpept-bct1] [DE:Bacillus subtilis complete genome (section 6 of 21): from 999501 to1209940.] [NT:alternate gene name: prsT, ecs-26, yhaD] [SP:P55339] [LE:77413] [RE:78156] [DI:direct] >gp:[GI:e324952:g2226115] [LN:BSY14077] [AC:Y14077] [PN:Hypothetical protein] [GN:yhaD] [OR:Bacillus subtilis] [DB:genpept-bct1] [DE:Bacillus subitlis 10.6 Kb chromosomal DNA: glyB-prsA region.] [NT:Identified as ecsA. Similar to many ATP binding ABC] [SP:P55339] [LE:2757] [RE:3500] [DI:complement]

| ORF Name | NTID | AAID | NT Length | AA Length | score | probability |
|---|---|---|---|---|---|---|
| AI7503000993_35360932_c3_944 | 2291 | 6063 | 1278 | 425 | 1493 | 4.6e-153 |

Description
sp:[LN:ACKA_BACSU] [AC:P37877] [GN:ACKA] [OR:BACILLUS SUBTILIS] [EC:2.7.2.1] [DE:ACETATE KINASE, (ACETOKINASE)] [SP:P37877] [DB:swissprot] >pir:[LN:B49935] [AC:B49935:C69581 ] [PN:acetate kinase, ackA] [GN:ackA ] [CL:acetate kinase] [OR:Bacillus subtilis] [EC:2.7.2.1] [DB:pir2] >gp:[GI:e1185820:g2635431] [LN:BSUB0016] [AC:Z99119:AL009126] [PN:acetate kinase] [GN:ackA] [OR:Bacillus subtilis] [DB:genpept-bct1] [EC:2.7.2.1] [DE:Bacillus subtilis complete genome (section 16 of 21): from 2997771to 3213410.] [SP:P37877] [LE:16413] [RE:17600] [DI:complement] >gp:[GI:g2293240] [LN:AF008220] [AC:AF008220] [PN:acetate kinase] [GN:ackA] [OR:Bacillus subtilis] [DB:genpept-bct2] [DE:Bacillus subtilis rrnB-dnaB genomic region.] [LE:162827] [RE:164014] [DI:direct] >gp:[GI:g405134] [LN:BACACKA] [AC:L17320] [PN:acetate kinase] [GN:ackA] [OR:Bacillus subtilis] [SR:Bacillus subtilis (strain W168) DNA] [DB:genpept-bct2] [DE:Bacillus subtilis acetate kinase (ackA) gene, complete cds.] [LE:698] [RE:1885] [DI:direct]

| ORF Name | NTID | AAID | NT Length | AA Length | score | probability |
|---|---|---|---|---|---|---|
| AI7503000993_36152191_c3_863 | 2292 | 6064 | 126 | 41 | | |

Description
NO-HIT

| ORF Name | NTID | AAID | NT Length | AA Length | score | probability |
|---|---|---|---|---|---|---|
| AI7503000993_36541078_c1_647 | 2293 | 6065 | 171 | 56 | | |

Description
NO-HIT

| ORF Name | NTID | AAID | NT Length | AA Length | score | probability |
|---|---|---|---|---|---|---|
| AI7503000993_3906642_c1_632 | 2294 | 6066 | 600 | 199 | 244 | 1.0e-20 |

Description
pir:[LN:H69778] [AC:H69778 ] [PN:hypothetical protein ydeN] [GN:ydeN ] [OR:Bacillus subtilis] [DB:pir2] >gp:[GI:d1020114:g1881334] [LN:AB001488] [AC:AB001488] [GN:ydeN] [OR:Bacillus subtilis] [SR:Bacillus subtilis (strain:168) DNA] [DB:genpept-bct1] [DE:Bacillus subtilis genome sequence, 148 kb sequence of the regionbetween 35 and 47 degree.] [NT:FUNCTION UNKNOWN.] [LE:106671] [RE:107243] [DI:complement] >gp:[GI:e1182492:g2632826] [LN:BSUB0003] [AC:Z99106:AL009126] [GN:ydeN] [FN:unknown] [OR:Bacillus subtilis] [DB:genpept-bct1] [DE:Bacillus subtilis complete genome (section 3 of 21): from 402751 to611850.] [LE:170416] [RE:170988] [DI:complement]

| ORF Name | NTID | AAID | NT Length | AA Length | score | probability |
|---|---|---|---|---|---|---|
| AI7503000993_3944015_c1_608 | 2295 | 6067 | 540 | 179 | 331 | 6.2e-30 |

Description
pir:[LN:S68867] [AC:S68867:S54422 ] [PN:probable transport protein arpJ:ABC transporter arpJ] [OR:Listeria monocytogenes] [DB:pir2]

| ORF Name | NTID | AAID | NT Length | AA Length | score | probability |
|---|---|---|---|---|---|---|
| AI7503000993_4073892_c1_631 | 2296 | 6068 | 1458 | 485 | 1083 | 1.3e-109 |

Description sp:[LN:PPOX_BACSU] [AC:P32397] [GN:HEMY:HEMG] [OR:BACILLUS SUBTILIS] [EC:1.3.3.4] [DE:PROTOPORPHYRINOGEN OXIDASE, (PPO)] [SP:P32397] [DB:swissprot] >pir:[LN:D47045] [AC:D47045:D69640 ] [PN:coproporphyrinogen III oxidase / protoporphyrinogen IX oxidase hemY] [OR:Bacillus subtilis] [DB:pir2] >gp:[GI:g143045] [LN:BACHEMEHY] [AC:M97208] [GN:hemY] [FN:involved in a late step of protoheme IX] [OR:Bacillus subtilis] [SR:Bacillus subtilis (strain W168) DNA] [DB:genpept-bct1] [DE:Bacillus subtilis penicillin binding protein 1A (ponA) gene;uroporphyrinogen decarboxylase (hemE) gene; ferrochelatase (hemH)gene complete cds, (hemY) gene, complete cds; ORFA, complete cds;ORFB 5' end.] [LE:3985] [RE:5397] [DI:direct] >gp:[GI:e1183016:g2633350] [LN:BSUB0006] [AC:Z99109:AL009126] [PN:protoporphyrinogen IX and coproporphyrinogen III] [GN:hemY] [FN:late steps of protoheme IX synthesis (porphyrin] [OR:Bacillus subtilis] [DB:genpept-bct1] [EC:1.3.3.4] [DE:Bacillus subtilis complete genome (section 6 of 21): from 999501 to1209940.] [NT:alternate gene name: hemG] [SP:P32397] [LE:88170] [RE:89582] [DI:direct] >gp:[GI:e325009:g2226232] [LN:BSY14083] [AC:Y14083] [PN:Protoporphyrinogen IX oxidase] [GN:hemY] [OR:Bacillus subtilis] [DB:genpept-bct1] [DE:Bacillus subtilis chromosomal DNA, region 76-78 degrees: betweenglyB-aprE.] [NT:see Swiss Prot P32397; HEMG_BACSU.] [SP:P32397] [LE:8029] [RE:9441] [DI:direct]

| ORF Name | NTID | AAID | NT Length | AA Length | score | probability |
|---|---|---|---|---|---|---|
| AI7503000993_4110882_f3_473 | 2297 | 6069 | 351 | 116 | 90 | 0.00022 |

Description pir:[LN:D70004] [AC:D70004 ] [PN:hypothetical protein ytzB] [GN:ytzB ] [OR:Bacillus subtilis] [DB:pir2] >gp:[GI:e1185860:g2635471] [LN:BSUB0016] [AC:Z99119:AL009126] [GN:ytzB] [FN:unknown] [OR:Bacillus subtilis] [DB:genpept-bct1] [DE:Bacillus subtilis complete genome (section 16 of 21): from 2997771to 3213410.] [LE:57791] [RE:58108] [DI:direct]

| ORF Name | NTID | AAID | NT Length | AA Length | score | probability |
|---|---|---|---|---|---|---|
| AI7503000993_4173427_c2_742 | 2298 | 6070 | 474 | 157 | 82 | 0.0020 |

Description pir:[LN:A64334] [AC:A64334 ] [PN:hypothetical protein MJ0272] [OR:Methanococcus jannaschii] [DB:pir2] [MP:FOR257413-257652 ] >gp:[GI:g1590997] [LN:U67482] [AC:U67482:L77117] [PN:repressor protein, putative (yorfE)] [GN:MJ0272] [OR:Methanococcus jannaschii] [DB:genpept-bct2] [DE:Methanococcus jannaschii section 24 of 150 of the complete genome.] [NT:similar to GP:1536960 percent identity: 40.32;] [LE:5633] [RE:5872] [DI:direct]

| ORF Name | NTID | AAID | NT Length | AA Length | score | probability |
|---|---|---|---|---|---|---|
| AI7503000993_4183428_c3_921 | 2299 | 6071 | 1329 | 442 | 1966 | 3.5e-203 |

Description sp:[LN:MURC_STAAU] [AC:O31211] [GN:MURC] [OR:STAPHYLOCOCCUS AUREUS] [EC:6.3.2.8] [DE:ACETYLMURANOYL-L-ALANINE SYNTHETASE)] [SP:O31211] [DB:swissprot] >gp:[GI:g2642659] [LN:AF034076] [AC:AF034076] [PN:UDP-N-acetylmuramoyl-L-alanine synthetase] [GN:murC] [FN:cell wall biosynthesis] [OR:Staphylococcus aureus] [DB:genpept-bct2] [DE:Staphylococcus aureus UDP-N-acetylmuramoyl-L-alanine synthetase(murC) gene, complete cds.] [NT:MurC; UDP-N-acetylmuramate-alanine ligase] [LE:1] [RE:1314] [DI:direct]

| ORF Name | NTID | AAID | NT Length | AA Length | score | probability |
|---|---|---|---|---|---|---|
| AI7503000993_4296950_c2_764 | 2300 | 6072 | 198 | 65 | | |

Description
NO-HIT

| ORF Name | NTID | AAID | NT Length | AA Length | score | probability |
|---|---|---|---|---|---|---|
| AI7503000993_4299175_c1_637 | 2301 | 6073 | 240 | 79 | 102 | 0.00012 |

Description
pir:[LN:T00158] [AC:T00158 ] [PN:amidase,] [OR:Staphylococcus aureus phage phi PVL]
[EC:3.5.-.-] [DB:pir3] >gp:[GI:d1032859:g3341932] [LN:AB009866] [AC:AB009866]
[PN:amidase (peptidoglycan hydrolase)] [OR:bacteriophage phi PVL] [SR:bacteriophage phi
PVL (specific_host:Staphylococcus aureus ATC] [DB:genpept-phg] [DE:Bacteriophage phi
PVL proviral DNA, complete sequence.] [NT:orf 25] [LE:20199] [RE:21653] [DI:direct]

| ORF Name | NTID | AAID | NT Length | AA Length | score | probability |
|---|---|---|---|---|---|---|
| AI7503000993_4345967_f2_357 | 2302 | 6074 | 441 | 146 | 368 | 7.5e-34 |

Description
sp:[LN:HIT_BACSU] [AC:O07513] [GN:HIT] [OR:BACILLUS SUBTILIS] [DE:HIT PROTEIN]
[SP:O07513] [DB:swissprot] >pir:[LN:A69642] [AC:A69642 ] [PN:cell-cycle regulation
histidine triad (HIT) protein] [GN:hit ] [CL:protein kinase C inhibitor:histidine triad
homology] [OR:Bacillus subtilis] [DB:pir2] >gp:[GI:e1183005:g2633339] [LN:BSUB0006]
[AC:Z99109:AL009126] [PN:Hit-like protein] [GN:hit] [FN:cell-cycle regulation
(inhibition of cell] [OR:Bacillus subtilis] [DB:genpept-bct1] [DE:Bacillus subtilis
complete genome (section 6 of 21): from 999501 to1209940.] [NT:alternate gene name:
yhaE] [SP:O07513] [LE:76488] [RE:76925] [DI:complement] >gp:[GI:e325178:g2226116]
[LN:BSY14077] [AC:Y14077] [PN:Hypothetical protein] [GN:yhaE] [OR:Bacillus subtilis]
[DB:genpept-bct1] [DE:Bacillus subitilis 10.6 Kb chromosomal DNA: glyB-prsA region.]
[NT:Similarity to the Hit family of proteins] [SP:O07513] [LE:3988] [RE:4425]
[DI:direct]

| ORF Name | NTID | AAID | NT Length | AA Length | score | probability |
|---|---|---|---|---|---|---|
| AI7503000993_4453537_c3_937 | 2303 | 6075 | 159 | 52 | | |

Description
NO-HIT

| ORF Name | NTID | AAID | NT Length | AA Length | score | probability |
|---|---|---|---|---|---|---|
| AI7503000993_4459380_c1_712 | 2304 | 6076 | 207 | 68 | | |

Description
NO-HIT

| ORF Name | NTID | AAID | NT Length | AA Length | score | probability |
|---|---|---|---|---|---|---|
| AI7503000993_4502308_c2_812 | 2305 | 6077 | 636 | 211 | 502 | 4.7e-48 |

Description
pir:[LN:E69826] [AC:E69826 ] [PN:1-acylglycerol-3-phosphate O-acyltransfera homolog
yhdO] [GN:yhdO ] [OR:Bacillus subtilis] [DB:pir2] >gp:[GI:e1182955:g2633289]
[LN:BSUB0006] [AC:Z99109:AL009126] [GN:yhdO] [FN:unknown] [OR:Bacillus subtilis]
[DB:genpept-bct1] [DE:Bacillus subtilis complete genome (section 6 of 21): from 999501
to1209940.] [NT:similar to 1-acylglycerol-3-phosphate] [LE:31375] [RE:31974]
[DI:direct] >gp:[GI:e325031:g2226210] [LN:BSY14082] [AC:Y14082] [PN:hypothetical
protein] [GN:yhdO] [OR:Bacillus subtilis] [DB:genpept-bct1] [DE:Bacillus subtilis
chromosomal DNA, region 72 to 75 degrees: spoVRto sspB.] [NT:Similarity to a
hypothetical protein from] [LE:18023] [RE:18622] [DI:direct]

| ORF Name | NTID | AAID | NT Length | AA Length | score | probability |
|---|---|---|---|---|---|---|
| AI7503000993_4511283_c3_859 | 2306 | 6078 | 153 | 50 | | |

Description
NO-HIT

| ORF Name | NTID | AAID | NT Length | AA Length | score | probability |
|---|---|---|---|---|---|---|
| AI7503000993_4568761_c1_630 | 2307 | 6079 | 1116 | 371 | 1257 | 4.7e-128 |

Description
sp:[LN:DCUP_BACSU] [AC:P32395] [GN:HEME] [OR:BACILLUS SUBTILIS] [EC:4.1.1.37]
[DE:UROPORPHYRINOGEN DECARBOXYLASE, (UPD)] [SP:P32395] [DB:swissprot] >pir:[LN:B47045]
[AC:B47045:G69639 ] [PN:uroporphyrinogen decarboxylase, hemE:uroporphyrinogen III
decarboxylase hemE] [GN:hemE ] [CL:uroporphyrinogen decarboxylase] [OR:Bacillus
subtilis] [EC:4.1.1.37] [DB:pir2] >gp:[GI:g143043] [LN:BACHEMEHY] [AC:M97208]
[PN:uroporphyrinogen decarboxylase] [GN:hemE] [OR:Bacillus subtilis] [SR:Bacillus
subtilis (strain W168) DNA] [DB:genpept-bct1] [EC:4.1.1.37] [DE:Bacillus subtilis
penicillin binding protein 1A (ponA) gene;uroporphyrinogen decarboxylase (hemE) gene;
ferrochelatase (hemH)gene complete cds, (hemY) gene, complete cds; ORFA, complete
cds;ORFB 5' end.] [LE:1905] [RE:2966] [DI:direct] >gp:[GI:e1183014:g2633348]
[LN:BSUB0006] [AC:Z99109:AL009126] [PN:uroporphyrinogen III decarboxylase] [GN:hemE]
[FN:porphyrin biosynthesis] [OR:Bacillus subtilis] [DB:genpept-bct1] [EC:4.1.1.37]
[DE:Bacillus subtilis complete genome (section 6 of 21): from 999501 to1209940.]
[SP:P32395] [LE:86090] [RE:87151] [DI:direct] >gp:[GI:e325194:g2226230] [LN:BSY14083]
[AC:Y14083] [PN:Uroporphyrinogen III decarboxylase] [GN:hemE] [OR:Bacillus subtilis]
[DB:genpept-bct1] [EC:4.1.1.37] [DE:Bacillus subtilis chromosomal DNA, region 76-78
degrees: betweenglyB-aprE.] [NT:see Swiss Prot P32395; DCUP_BACSU.] [SP:P32395]
[LE:5949] [RE:7010] [DI:direct]

| ORF Name | NTID | AAID | NT Length | AA Length | score | probability |
|---|---|---|---|---|---|---|
| AI7503000993_4579675_f3_569 | 2308 | 6080 | 129 | 42 | | |

Description
NO-HIT

| ORF Name | NTID | AAID | NT Length | AA Length | score | probability |
|---|---|---|---|---|---|---|
| AI7503000993_4693800_f2_225 | 2309 | 6081 | 570 | 189 | 191 | 4.3e-15 |

Description
pir:[LN:A69220] [AC:A69220 ] [PN:conserved hypothetical protein MTH898] [GN:MTH898 ]
[CL:Escherichia coli ybdQ protein] [OR:Methanobacterium thermoautotrophicum] [DB:pir2]
>gp:[GI:g2621993] [LN:AE000865] [AC:AE000865:AE000666] [PN:conserved protein]
[GN:MTH898] [OR:Methanobacterium thermoautotrophicum] [DB:genpept-bct1]
[DE:Methanobacterium thermoautotrophicum from bases 808939 to 820180(section 71 of 148)
of the complete genome.] [NT:Function Code:14.01 - Unknown, Conserved protein;]
[LE:6700] [RE:7149] [DI:direct]

| ORF Name | NTID | AAID | NT Length | AA Length | score | probability |
|---|---|---|---|---|---|---|
| AI7503000993_4697318_c3_919 | 2310 | 6082 | 867 | 288 | 671 | 5.8e-66 |

Description
pir:[LN:H69998] [AC:H69998 ] [PN:hypothetical protein ytpQ] [GN:ytpQ ] [OR:Bacillus
subtilis] [DB:pir2] >gp:[GI:e1185856:g2635467] [LN:BSUB0016] [AC:Z99119:AL009126]
[GN:ytpQ] [FN:unknown] [OR:Bacillus subtilis] [DB:genpept-bct1] [DE:Bacillus subtilis
complete genome (section 16 of 21): from 2997771to 3213410.] [LE:54676] [RE:55485]
[DI:complement] >gp:[GI:g2293212] [LN:AF008220] [AC:AF008220] [PN:YtpQ] [GN:ytpQ]
[OR:Bacillus subtilis] [DB:genpept-bct2] [DE:Bacillus subtilis rrnB-dnaB genomic
region.] [LE:124941] [RE:125750] [DI:direct]

| ORF Name | NTID | AAID | NT Length | AA Length | score | probability |
|---|---|---|---|---|---|---|
| AI7503000993_472538_c1_707 | 2311 | 6083 | 144 | 47 | | |

Description
NO-HIT

| ORF Name | NTID | AAID | NT Length | AA Length | score | probability |
|---|---|---|---|---|---|---|
| AI7503000993_4776702_c1_669 | 2312 | 6084 | 312 | 103 | 164 | 3.1e-12 |

Description
sp:[LN:YRKF_BACSU] [AC:P54433] [GN:YRKF] [OR:BACILLUS SUBTILIS] [DE:HYPOTHETICAL 20.7 KD PROTEIN IN BLTR-SPOIIIC INTERGENIC REGION] [SP:P54433] [DB:swissprot] >pir:[LN:D69976] [AC:D69976 ] [PN:conserved hypothetical protein yrkF] [GN:yrkF ] [OR:Bacillus subtilis] [DB:pir2] >gp:[GI:d1013040:g1303705] [LN:BACJH642] [AC:D84432:D82370] [PN:YrkF] [OR:Bacillus subtilis] [SR:Bacillus subtilis (strain:JH642(trpC2 PheA1)) DNA] [DB:genpept-bct1] [DE:Bacillus subtilis DNA, 283 Kb region containing skin element.] [LE:6477] [RE:7034] [DI:direct] >gp:[GI:e1183882:g2635098] [LN:BSUB0014] [AC:Z99117:AL009126] [GN:yrkF] [FN:unknown] [OR:Bacillus subtilis] [DB:genpept-bct1] [DE:Bacillus subtilis complete genome (section 14 of 21): from 2599451to 2812870.] [NT:similar to hypothetical proteins from B. subtilis] [SP:P54433] [LE:112396] [RE:112953] [DI:complement]

| ORF Name | NTID | AAID | NT Length | AA Length | score | probability |
|---|---|---|---|---|---|---|
| AI7503000993_4876300_c2_806 | 2313 | 6085 | 1695 | 564 | 1845 | 2.3e-190 |

Description
sp:[LN:FTHS_STRMU] [AC:Q59925:Q59926] [GN:FHS] [OR:STREPTOCOCCUS MUTANS] [EC:6.3.4.3] [DE:SYNTHETASE) (FHS) (FTHFS)] [SP:Q59925:Q59926] [DB:swissprot] >gp:[GI:g1103865] [LN:SMU39612] [AC:U39612] [PN:formyl-tetrahydrofolate synthetase] [GN:fhs] [FN:enzyme involved in the formation of] [OR:Streptococcus mutans] [DB:genpept-bct1] [EC:6.3.4.3] [DE:Streptococcus mutans formyl-tetrahydrofolate synthetase (fhs) gene,complete cds.] [NT:formyl-tetrahydrofolate ligase; ATP-dependant] [LE:115] [RE:1785] [DI:direct]

| ORF Name | NTID | AAID | NT Length | AA Length | score | probability |
|---|---|---|---|---|---|---|
| AI7503000993_4876718_c1_617 | 2314 | 6086 | 1143 | 380 | 810 | 1.1e-80 |

Description
pir:[LN:E69824] [AC:E69824 ] [PN:two-component sensor histidine kinase homolog yhcY] [GN:yhcY ] [OR:Bacillus subtilis] [DB:pir2] >gp:[GI:e1182921:g2633255] [LN:BSUB0005] [AC:Z99108:AL009126] [GN:yhcY] [FN:unknown] [OR:Bacillus subtilis] [DB:genpept-bct1] [DE:Bacillus subtilis complete genome (section 5 of 21): from 802821 to1011250.] [NT:similar to two-component sensor histidine kinase] [LE:205305] [RE:206444] [DI:direct] >gp:[GI:e1182933:g2633267] [LN:BSUB0006] [AC:Z99109:AL009126] [GN:yhcY] [FN:unknown] [OR:Bacillus subtilis] [DB:genpept-bct1] [DE:Bacillus subtilis complete genome (section 6 of 21): from 999501 to1209940.] [NT:similar to two-component sensor histidine kinase] [LE:8625] [RE:9764] [DI:direct] >gp:[GI:e1191876:g2226140] [LN:BSY14079] [AC:Y14079] [PN:hypothetical protein] [GN:yhcY] [OR:Bacillus subtilis] [DB:genpept-bct1] [DE:Bacillus subtilis chromosomal DNA, region 75 degrees: glpPFKDoperon and downstream.] [NT:similarity to the sensory transduction kinase degS] [LE:8273] [RE:9412] [DI:direct]

| ORF Name | NTID | AAID | NT Length | AA Length | score | probability |
|---|---|---|---|---|---|---|
| AI7503000993_4882963_f3_591 | 2315 | 6087 | 834 | 277 | 457 | 2.8e-43 |

Description
sp:[LN:YHCT_BACSU] [AC:P54604] [GN:YHCT] [OR:BACILLUS SUBTILIS] [DE:HYPOTHETICAL 33.7 KD PROTEIN IN CSPB-GLPP INTERGENIC REGION] [SP:P54604] [DB:swissprot] >pir:[LN:H69823] [AC:H69823 ] [PN:conserved hypothetical protein yhcT] [GN:yhcT ] [CL:conserved hypothetical protein HI0176] [OR:Bacillus subtilis] [DB:pir2] >gp:[GI:e233879:g1239996] [LN:BS75DGREG] [AC:X96983] [PN:hypothetical protein] [GN:yhcT] [OR:Bacillus subtilis] [DB:genpept-bct1] [DE:B.subtilis chromosomal DNA (region 75 degrees: cspB upstream ofglpPFKD operon).] [NT:Similarity to DRAP deaminase from Saccharomyces] [SP:P54604] [LE:16504] [RE:17412] [DI:complement] >gp:[GI:e1182910:g2633244] [LN:BSUB0005] [AC:Z99108:AL009126] [GN:yhcT] [FN:unknown] [OR:Bacillus subtilis] [DB:genpept-bct1] [DE:Bacillus subtilis complete genome (section 5 of 21): from 802821 to1011250.] [NT:similar to hypothetical proteins] [SP:P54604] [LE:192310] [RE:193218] [DI:complement]

| ORF Name | NTID | AAID | NT Length | AA Length | score | probability |
|---|---|---|---|---|---|---|
| AI7503000993_4938877_c2_778 | 2316 | 6088 | 147 | 48 | | |

Description
NO-HIT

| ORF Name | NTID | AAID | NT Length | AA Length | score | probability |
|---|---|---|---|---|---|---|
| AI7503000993_5081252_f2_327 | 2317 | 6089 | 360 | 119 | 199 | 6.1e-16 |

Description
pir:[LN:A70341] [AC:A70341 ] [PN:conserved hypothetical protein aq_449] [GN:aq_449 ] [CL:hypothetical protein MJ1523] [OR:Aquifex aeolicus] [DB:pir2] >gp:[GI:g2983116] [LN:AE000690] [AC:AE000690:AE000657] [PN:hypothetical protein] [GN:aq_449] [OR:Aquifex aeolicus] [DB:genpept-bct2] [DE:Aquifex aeolicus section 22 of 109 of the complete genome.] [LE:10789] [RE:11163] [DI:direct]

| ORF Name | NTID | AAID | NT Length | AA Length | score | probability |
|---|---|---|---|---|---|---|
| AI7503000993_5132078_c3_845 | 2318 | 6090 | 729 | 242 | 752 | 1.5e-74 |

Description
pir:[LN:H69334] [AC:H69334 ] [PN:glutamine transport protein glnQ] [GN:glnQ ] [CL:inner membrane protein malK:ATP-binding cassette homology] [OR:Archaeoglobus fulgidus] [DB:pir2] >gp:[GI:g2649950] [LN:AE001058] [AC:AE001058:AE000782] [PN:glutamine ABC transporter, ATP-binding protein] [GN:AF0680] [OR:Archaeoglobus fulgidus] [DB:genpept-bct2] [DE:Archaeoglobus fulgidus section 49 of 172 of the complete genome.] [NT:similar to GB:M61017 SP:P27675 PID:142988 percent] [LE:10147] [RE:10875] [DI:complement]

| ORF Name | NTID | AAID | NT Length | AA Length | score | probability |
|---|---|---|---|---|---|---|
| AI7503000993_5135265_c3_967 | 2319 | 6091 | 504 | 167 | 438 | 2.9e-41 |

Description
gp:[GI:g4982284] [LN:AE001810] [AC:AE001810:AE000512] [PN:conserved hypothetical protein] [GN:TM1707] [OR:Thermotoga maritima] [DB:genpept-bct2] [DE:Thermotoga maritima section 122 of 136 of the complete genome.] [NT:similar to GB:M15183 PID:468267 PID:2293279] [LE:13832] [RE:14302] [DI:complement]

| ORF Name | NTID | AAID | NT Length | AA Length | score | probability |
|---|---|---|---|---|---|---|
| AI7503000993_5273425_c2_735 | 2320 | 6092 | 1053 | 350 | 473 | 5.6e-45 |

Description
gp:[GI:g4981111] [LN:AE001734] [AC:AE001734:AE000512] [PN:amino acid ABC transporter, permease protein] [GN:TM0592] [OR:Thermotoga maritima] [DB:genpept-bct2] [DE:Thermotoga maritima section 46 of 136 of the complete genome.] [NT:similar to GB:AE000782 percent identity: 72.86;] [LE:3214] [RE:3864] [DI:complement]

| ORF Name | NTID | AAID | NT Length | AA Length | score | probability |
|---|---|---|---|---|---|---|
| AI7503000993_5355250_c1_696 | 2321 | 6093 | 1284 | 427 | 1343 | 3.6e-137 |

Description
sp:[LN:SYY_BACST] [AC:P00952] [GN:TYRS] [OR:BACILLUS STEAROTHERMOPHILUS] [EC:6.1.1.1] [DE:TYROSYL-TRNA SYNTHETASE, (TYROSINE--TRNA LIGASE) (TYRRS)] [SP:P00952] [DB:swissprot] >pir:[LN:SYBSYF] [AC:A01179:I40506 ] [PN:tyrosine--tRNA ligase,:tyrosyl-tRNA synthetase] [CL:tyrosine--tRNA ligase] [OR:Bacillus stearothermophilus] [EC:6.1.1.1] [DB:pir1]

| ORF Name | NTID | AAID | NT Length | AA Length | score | probability |
|---|---|---|---|---|---|---|
| AI7503000993_551907_f3_559 | 2322 | 6094 | 708 | 235 | 183 | 3.0e-14 |

Description
gp:[GI:g2897104] [LN:AF020798] [AC:AF020798] [PN:putative host cell surface-exposed lipoprotein] [OR:Streptococcus thermophilus bacteriophage TP-J34] [DB:genpept-phg] [DE:Streptococcus thermophilus bacteriophage lysogeny module, integrasehomolog (int), putative host cell surface-exposed lipoprotein,putative metallo-proteinase, repressor, Cro-like regulatoryprotein, and P1-antirepressor homolog genes, complete cds.] [NT:orf142] [LE:3941] [RE:4369] [DI:complement]

| ORF Name | NTID | AAID | NT Length | AA Length | score | probability |
|---|---|---|---|---|---|---|
| AI7503000993_572186_c1_692 | 2323 | 6095 | 1284 | 427 | 190 | 2.4e-11 |

Description
pir:[LN:I51116] [AC:I51116 ] [PN:NF-180] [OR:Petromyzon marinus] [SR:, sea lamprey] [DB:pir2] >gp:[GI:g632549] [LN:PMU19361] [AC:U19361] [PN:NF-180] [OR:Petromyzon marinus] [SR:sea lamprey] [DB:genpept-vrt] [DE:Petromyzon marinus neurofilament subunit NF-180 mRNA, complete cds.] [NT:180 kDa neurofilament subunit] [LE:122] [RE:3454] [DI:direct]

| ORF Name | NTID | AAID | NT Length | AA Length | score | probability |
|---|---|---|---|---|---|---|
| AI7503000993_581382_f2_281 | 2324 | 6096 | 183 | 60 | 46 | 0.040 |

Description
sp:[LN:PA2A_PSETE] [AC:P23026] [OR:PSEUDONAJA TEXTILIS] [SR:,EASTERN BROWN SNAKE] [EC:3.1.1.4] [DE:PHOSPHOLIPASE A2 HOMOLOG, TEXTILOTOXIN A CHAIN,] [SP:P23026] [DB:swissprot] >pir:[LN:S29651] [AC:S29651 ] [PN:textilotoxin chain A] [CL:phospholipase A2] [OR:Pseudonaja textilis] [SR:, eastern brown snake] [DB:pir2]

| ORF Name | NTID | AAID | NT Length | AA Length | score | probability |
|---|---|---|---|---|---|---|
| AI7503000993_5882753_c3_956 | 2325 | 6097 | 273 | 90 | | |

Description
NO-HIT

| ORF Name | NTID | AAID | NT Length | AA Length | score | probability |
|---|---|---|---|---|---|---|
| AI7503000993_5911592_c3_887 | 2326 | 6098 | 924 | 307 | 89 | 0.0048 |

Description
gp:[GI:e1347496:g3877859] [LN:CEF58G6] [AC:Z68217] [GN:F58G6.1] [OR:Caenorhabditis elegans] [DB:genpept-inv1] [DE:Caenorhabditis elegans cosmid F58G6, complete sequence.] [NT:Similarity to Chicken amphiphysin (PIR Acc. No.] [LE:4939:5597:5746] [RE:5253:5662:5844] [DI:complementJoin]

| ORF Name | NTID | AAID | NT Length | AA Length | score | probability |
|---|---|---|---|---|---|---|
| AI7503000993_6070392_c3_911 | 2327 | 6099 | 708 | 235 | 458 | 2.2e-43 |

Description
gp:[GI:g4980760] [LN:AE001708] [AC:AE001708:AE000512] [PN:16S pseudouridylate synthase] [GN:TM0264] [OR:Thermotoga maritima] [DB:genpept-bct2] [DE:Thermotoga maritima section 20 of 136 of the complete genome.] [NT:similar to SP:P33918 PID:405907 GB:U00096] [LE:17059] [RE:17778] [DI:direct]

| ORF Name | NTID | AAID | NT Length | AA Length | score | probability |
|---|---|---|---|---|---|---|
| AI7503000993_6100150_c3_881 | 2328 | 6100 | 189 | 62 | | |

Description
NO-HIT

| ORF Name | NTID | AAID | NT Length | AA Length | score | probability |
|---|---|---|---|---|---|---|
| AI7503000993_6125262_c2_840 | 2329 | 6101 | 192 | 63 | 71 | 0.022 |

Description
pir:[LN:S72295] [AC:S72295 ] [PN:ribosomal protein S8] [GN:rps8 ] [OR:plastid Plasmodium falciparum] [DB:pir2] >gp:[GI:e220199:g1171601] [LN:PFCOMPIRB] [AC:X95276] [GN:rps8] [OR:Plasmodium falciparum] [SR:malaria parasite P. falciparum] [DB:genpept-inv1] [DE:P.falciparum complete gene map of plastid-like DNA (IR-B).] [LE:5492] [RE:5878] [DI:direct]

| ORF Name | NTID | AAID | NT Length | AA Length | score | probability |
|---|---|---|---|---|---|---|
| AI7503000993_6317_c1_687 | 2330 | 6102 | 411 | 136 | 267 | 3.8e-23 |

Description
pir:[LN:G69998] [AC:G69998 ] [PN:thioredoxin H1 homolog ytpP] [GN:ytpP ] [CL:thioredoxin:thioredoxin homology] [OR:Bacillus subtilis] [DB:pir2] >gp:[GI:e1185857:g2635468] [LN:BSUB0016] [AC:Z99119:AL009126] [GN:ytpP] [FN:unknown] [OR:Bacillus subtilis] [DB:genpept-bct1] [DE:Bacillus subtilis complete genome (section 16 of 21): from 2997771to 3213410.] [NT:similar to thioredoxin H1] [LE:55500] [RE:55823] [DI:complement] >gp:[GI:g2293211] [LN:AF008220] [AC:AF008220] [PN:putative thioredoxin] [GN:ytpP] [OR:Bacillus subtilis] [DB:genpept-bct2] [DE:Bacillus subtilis rrnB-dnaB genomic region.] [LE:124603] [RE:124926] [DI:direct]

| ORF Name | NTID | AAID | NT Length | AA Length | score | probability |
|---|---|---|---|---|---|---|
| AI7503000993_6689717_c3_849 | 2331 | 6103 | 615 | 204 | 72 | 0.0043 |

Description
gp:[GI:g4105715] [LN:AF050754] [AC:AF050754] [PN:glucose 6-phosphate isomerase] [GN:GPI1] [OR:Giardia intestinalis] [DB:genpept-inv2] [EC:5.3.1.10] [DE:Giardia intestinalis glucose 6-phosphate isomerase (GPI1) gene,complete cds.] [NT:aminating isomerase] [LE:432] [RE:1232] [DI:direct]

| ORF Name | NTID | AAID | NT Length | AA Length | score | probability |
|---|---|---|---|---|---|---|
| AI7503000993_6828305_f3_438 | 2332 | 6104 | 132 | 43 | | |

Description
NO-HIT

| ORF Name | NTID | AAID | NT Length | AA Length | score | probability |
|---|---|---|---|---|---|---|
| AI7503000993_6906300_c2_826 | 2333 | 6105 | 1014 | 337 | 519 | 7.5e-50 |

Description
sp:[LN:YTXK_BACSU] [AC:P37876] [GN:YTXK] [OR:BACILLUS SUBTILIS] [DE:HYPOTHETICAL 37.4
KD PROTEIN IN ACKA-SSPA INTERGENIC REGION] [SP:P37876] [DB:swissprot] >pir:[LN:G70003]
[AC:G70003:A49935 ] [PN:hypothetical protein ytxK:hypothetical protein (ackA 5'
region)] [GN:ytxK ] [OR:Bacillus subtilis] [DB:pir2] >gp:[GI:e1185821:g2635432]
[LN:BSUB0016] [AC:Z99119:AL009126] [GN:ytxK] [FN:unknown] [OR:Bacillus subtilis]
[DB:genpept-bct1] [DE:Bacillus subtilis complete genome (section 16 of 21): from
2997771to 3213410.] [NT:alternate gene name: ythI] [SP:P37876] [LE:17948] [RE:18937]
[DI:complement] >gp:[GI:g2293239] [LN:AF008220] [AC:AF008220] [PN:YtxK] [GN:ytxK]
[OR:Bacillus subtilis] [DB:genpept-bct2] [DE:Bacillus subtilis rrnB-dnaB genomic
region.] [NT:similarity to modification metilase AccI] [LE:161490] [RE:162479]
[DI:direct]

| ORF Name | NTID | AAID | NT Length | AA Length | score | probability |
|---|---|---|---|---|---|---|
| AI7503000993_6929651_c3_858 | 2334 | 6106 | 366 | 121 | 289 | 1.8e-25 |

Description
pir:[LN:A69828] [AC:A69828 ] [PN:hypothetical protein yheA] [GN:yheA ] [OR:Bacillus
subtilis] [DB:pir2] >gp:[GI:e1182981:g2633315] [LN:BSUB0006] [AC:Z99109:AL009126]
[GN:yheA] [FN:unknown] [OR:Bacillus subtilis] [DB:genpept-bct1] [DE:Bacillus subtilis
complete genome (section 6 of 21): from 999501 to1209940.] [LE:54726] [RE:55079]
[DI:direct] >gp:[GI:e324964:g2226157] [LN:BSY14080] [AC:Y14080] [PN:hypothetical
protein] [GN:yheA] [OR:Bacillus subtilis] [DB:genpept-bct1] [DE:Bacillus subtilis
chromosomal DNA, region 75 degrees: sspB upstreamof glyB.] [LE:6651] [RE:7004]
[DI:complement]

| ORF Name | NTID | AAID | NT Length | AA Length | score | probability |
|---|---|---|---|---|---|---|
| AI7503000993_7066588_c1_719 | 2335 | 6107 | 3204 | 1067 | 1849 | 5.1e-212 |

Description
sp:[LN:DP3A_BACSU] [AC:O34623] [GN:DNAE] [OR:BACILLUS SUBTILIS] [EC:2.7.7.7] [DE:DNA
POLYMERASE III, ALPHA CHAIN,] [SP:O34623] [DB:swissprot] >pir:[LN:D69617] [AC:D69617 ]
[PN:DNA polymerase III (alpha subunit) dnaE] [GN:dnaE ] [CL:DNA-directed DNA polymerase
III alpha chain] [OR:Bacillus subtilis] [DB:pir2] >gp:[GI:e1184172:g2635388]
[LN:BSUB0015] [AC:Z99118:AL009126] [PN:DNA polymerase III (alpha subunit)] [GN:dnaE]
[OR:Bacillus subtilis] [DB:genpept-bct1] [DE:Bacillus subtilis complete genome (section
15 of 21): from 2795131to 3013540.] [SP:O34623] [LE:195212] [RE:198559] [DI:complement]
>gp:[GI:g2293260] [LN:AF008220] [AC:AF008220] [PN:DNA-polymerase III alpha-chain]
[GN:dnaE] [OR:Bacillus subtilis] [DB:genpept-bct2] [DE:Bacillus subtilis rrnB-dnaB
genomic region.] [LE:184508] [RE:187855] [DI:direct]

| ORF Name | NTID | AAID | NT Length | AA Length | score | probability |
|---|---|---|---|---|---|---|
| AI7503000993_7244012_c1_723 | 2336 | 6108 | 1287 | 428 | 1768 | 3.3e-182 |

Description
gp:[GI:e320380:g2168132] [LN:BIISOCIT] [AC:Y13358] [PN:isocitrate dehyrogenase]
[OR:Bacillus israeli] [DB:genpept-bct1] [DE:Bacillus israeli isocitrate dehydrogenase
gene.] [LE:242] [RE:1519] [DI:direct]

| ORF Name | NTID | AAID | NT Length | AA Length | score | probability |
|---|---|---|---|---|---|---|
| AI7503000993_785952_c1_688 | 2337 | 6109 | 459 | 152 | 380 | 4.0e-35 |

Description
pir:[LN:A69999] [AC:A69999 ] [PN:phenylalanyl-tRNA synthetase (beta subunit) homolog ytpR] [GN:ytpR ] [CL:Mycoplasma genitalium hypothetical protein MG449] [OR:Bacillus subtilis] [DB:pir2] >gp:[GI:e1185855:g2635466] [LN:BSUB0016] [AC:Z99119:AL009126] [GN:ytpR] [FN:unknown] [OR:Bacillus subtilis] [DB:genpept-bct1] [DE:Bacillus subtilis complete genome (section 16 of 21): from 2997771to 3213410.] [NT:similar to phenylalanyl-tRNA synthetase (beta) [LE:54055] [RE:54660] [DI:complement] >gp:[GI:g2293213] [LN:AF008220] [AC:AF008220] [PN:YtpR] [GN:ytpR] [OR:Bacillus subtilis] [DB:genpept-bct2] [DE:Bacillus subtilis rrnB-dnaB genomic region.] [NT:similarity to phenylalanine tRNA ligase of E. coli] [LE:125766] [RE:126371] [DI:direct]

| ORF Name | NTID | AAID | NT Length | AA Length | score | probability |
|---|---|---|---|---|---|---|
| AI7503000993_803393_c3_947 | 2338 | 6110 | 732 | 243 | 536 | 1.2e-51 |

Description
pir:[LN:H69407] [AC:H69407 ] [PN:conserved hypothetical protein AF1265] [CL:conserved hypothetical protein MJ1163] [OR:Archaeoglobus fulgidus] [DB:pir2] >gp:[GI:g2649315] [LN:AE001017] [AC:AE001017:AE000782] [PN:conserved hypothetical protein] [GN:AF1265] [OR:Archaeoglobus fulgidus] [DB:genpept-bct2] [DE:Archaeoglobus fulgidus section 90 of 172 of the complete genome.] [NT:similar to GB:L77117 PID:1591789 percent identity:] [LE:9248] [RE:9943] [DI:complement]

| ORF Name | NTID | AAID | NT Length | AA Length | score | probability |
|---|---|---|---|---|---|---|
| AI7503000993_817555_f2_358 | 2339 | 6111 | 447 | 148 | | |

Description
NO-HIT

| ORF Name | NTID | AAID | NT Length | AA Length | score | probability |
|---|---|---|---|---|---|---|
| AI7503000993_824086_c3_952 | 2340 | 6112 | 882 | 293 | 859 | 7.0e-86 |

Description
pir:[LN:G70001] [AC:G70001 ] [PN:acetyl-CoA carboxylase homolog yttI] [GN:yttI ] [CL:acetyl-CoA carboxylase, carboxyltransferase beta chain] [OR:Bacillus subtilis] [DB:pir2] >gp:[GI:e1184170:g2635386] [LN:BSUB0015] [AC:Z99118:AL009126] [GN:yttI] [FN:unknown] [OR:Bacillus subtilis] [DB:genpept-bct1] [DE:Bacillus subtilis complete genome (section 15 of 21): from 2795131to 3013540.] [NT:similar to acetyl-CoA carboxylase] [LE:192636] [RE:193424] [DI:complement] >gp:[GI:g2293262] [LN:AF008220] [AC:AF008220] [PN:acetyl-CoA carboxylase subunit] [GN:yttI] [OR:Bacillus subtilis] [DB:genpept-bct2] [DE:Bacillus subtilis rrnB-dnaB genomic region.] [LE:189643] [RE:190431] [DI:direct]

| ORF Name | NTID | AAID | NT Length | AA Length | score | probability |
|---|---|---|---|---|---|---|
| AI7503000993_82562_f3_523 | 2341 | 6113 | 1110 | 369 | 680 | 6.5e-67 |

Description pir:[LN:H69758] [AC:H69758 ] [PN:proline oxidase homolog ycgM] [GN:ycgM ] [CL:proline dehydrogenase homolog yusM] [OR:Bacillus subtilis] [DB:pir2] >gp:[GI:e1182272:g2632606] [LN:BSUB0002] [AC:Z99105:AL009126] [GN:ycgM] [FN:unknown] [OR:Bacillus subtilis] [DB:genpept-bct1] [DE:Bacillus subtilis complete genome (section 2 of 21): from 194651 to415810.] [NT:similar to proline oxidase] [LE:149473] [RE:150384] [DI:direct] >gp:[GI:d1009589:g1805392] [LN:D50453] [AC:D50453] [GN:ycgM] [OR:Bacillus subtilis] [SR:Bacillus subtilis (strain:168 trpC2) DNA] [DB:genpept-bct1] [DE:Bacillus subtilis DNA for 25-36 degree region containing theamyE-srfA region, complete cds.] [LE:23774] [RE:24685] [DI:direct]

| ORF Name | NTID | AAID | NT Length | AA Length | score | probability |
|---|---|---|---|---|---|---|
| AI7503000993_867187_c3_851 | 2342 | 6114 | 126 | 41 | | |

Description

NO-HIT

| ORF Name | NTID | AAID | NT Length | AA Length | score | probability |
|---|---|---|---|---|---|---|
| AI7503000993_954768_c3_892 | 2343 | 6115 | 1053 | 350 | 611 | 1.3e-59 |

Description sp:[LN:RIBG_BACSU] [AC:P17618] [GN:RIBG] [OR:BACILLUS SUBTILIS] [EC:3.5.4.-] [DE:RIBOFLAVIN-SPECIFIC DEAMINASE,] [SP:P17618] [DB:swissprot] >pir:[LN:PN0100] [AC:S45543:PN0100:E69692 ] [PN:riboflavin-specific deaminase ribG] [GN:ribG ] [OR:Bacillus subtilis] [DB:pir2] >gp:[GI:g410125] [LN:BACDIA] [AC:L09228] [GN:ribG] [OR:Bacillus subtilis] [SR:Bacillus subtilis (strain 168, sub_species Marburg) DNA] [DB:genpept-bct1] [DE:Bacillus subtilis spoVA to serA region.] [LE:8266] [RE:9351] [DI:direct] >gp:[GI:g40085] [LN:BSRIB] [AC:X51510] [OR:Bacillus subtilis] [DB:genpept-bct1] [DE:B.subtilis riboflavin biosynthesis operon ribG, ribB, ribA, ribH,and ribT genes.] [NT:ribG protein product (AA 1-361)] [SP:P17618] [LE:1212] [RE:2297] [DI:direct] >gp:[GI:e1185597:g2634763] [LN:BSUB0013] [AC:Z99116:AL009126] [PN:riboflavin-specific deaminase] [GN:ribG] [FN:riboflavin biosynthesis] [OR:Bacillus subtilis] [DB:genpept-bct1] [DE:Bacillus subtilis complete genome (section 13 of 21): from 2395261to 2613730.] [SP:P17618] [LE:34232] [RE:35317] [DI:complement]

| ORF Name | NTID | AAID | NT Length | AA Length | score | probability |
|---|---|---|---|---|---|---|
| AI7503000993_960012_c1_663 | 2344 | 6116 | 450 | 149 | 123 | 6.9e-08 |

Description gp:[GI:g3283053] [LN:AF054173] [AC:AF054173] [PN:staphylococcal accessory regulator A homolog] [GN:sarA] [OR:Staphylococcus epidermidis] [DB:genpept-bct2] [DE:Staphylococcus epidermidis staphylococcal accessory regulator Ahomolog (sarA) gene, complete cds.] [LE:887] [RE:1261] [DI:direct]

| ORF Name | NTID | AAID | NT Length | AA Length | score | probability |
|---|---|---|---|---|---|---|
| AI7503000993_961562_f3_433 | 2345 | 6117 | 126 | 41 | | |

Description

NO-HIT

| ORF Name | NTID | AAID | NT Length | AA Length | score | probability |
|---|---|---|---|---|---|---|
| AI7503000993_9785187_c3_867 | 2346 | 6118 | 171 | 56 | | |

Description

NO-HIT

| ORF Name | NTID | AAID | NT Length | AA Length | score | probability |
|---|---|---|---|---|---|---|
| AI7503000993_9845327_c1_648 | 2347 | 6119 | 192 | 63 | | |

Description
NO-HIT

| ORF Name | NTID | AAID | NT Length | AA Length | score | probability |
|---|---|---|---|---|---|---|
| AI7503000993_9884378_c3_916 | 2348 | 6120 | 156 | 51 | | |

Description
NO-HIT

| ORF Name | NTID | AAID | NT Length | AA Length | score | probability |
|---|---|---|---|---|---|---|
| AI7503000994_10240925_c2_505 | 2349 | 6121 | 252 | 83 | 65 | 0.024 |

Description
gp:[GI:d1037669:g4126667] [LN:AB016427] [AC:AB016427] [PN:transmembrane protein]
[GN:bacM] [OR:Bacillus licheniformis] [SR:Bacillus licheniformis (strain:ATCC 10716)
DNA] [DB:genpept-bct1] [DE:Bacillus licheniformis genes for transmembrane
protein,thioesterase II-like protein and bacitracin synthetase 1 (BA1),complete and
partial cds.] [NT:putative] [LE:694] [RE:>1956] [DI:direct]

| ORF Name | NTID | AAID | NT Length | AA Length | score | probability |
|---|---|---|---|---|---|---|
| AI7503000994_10553827_c3_663 | 2350 | 6122 | 216 | 71 | 132 | 7.6e-09 |

Description
pir:[LN:F69808] [AC:F69808 ] [PN:hypothetical protein yfkK] [GN:yfkK ] [OR:Bacillus
subtilis] [DB:pir2] >gp:[GI:e1182777:g2633111] [LN:BSUB0005] [AC:Z99108:AL009126]
[GN:yfkK] [FN:unknown] [OR:Bacillus subtilis] [DB:genpept-bct1] [DE:Bacillus subtilis
complete genome (section 5 of 21): from 802821 to1011250.] [LE:58273] [RE:58488]
[DI:complement] >gp:[GI:d1024280:g2626823] [LN:D83967] [AC:D83967] [PN:YfkK]
[OR:Bacillus subtilis] [SR:Bacillus subtilis (strain:AC327) DNA] [DB:genpept-bct1]
[DE:Bacillus subtilis genomic DNA, 74 degree region.] [LE:9433] [RE:9648] [DI:direct]

| ORF Name | NTID | AAID | NT Length | AA Length | score | probability |
|---|---|---|---|---|---|---|
| AI7503000994_11125052_c1_439 | 2351 | 6123 | 1497 | 498 | 1715 | 1.4e-176 |

Description
pir:[LN:D70008] [AC:D70008 ] [PN:nicotinate phosphoribosyltransferase homolog yueK]
[GN:yueK ] [OR:Bacillus subtilis] [DB:pir2] >gp:[GI:e1184252:g2635670] [LN:BSUB0017]
[AC:Z99120:AL009126] [GN:yueK] [FN:unknown] [OR:Bacillus subtilis] [DB:genpept-bct1]
[DE:Bacillus subtilis complete genome (section 17 of 21): from 3197001to 3414420.]
[NT:similar to nicotinate phosphoribosyltransferase] [LE:61479] [RE:62951]
[DI:complement]

| ORF Name | NTID | AAID | NT Length | AA Length | score | probability |
|---|---|---|---|---|---|---|
| AI7503000994_11755317_c3_655 | 2352 | 6124 | 759 | 252 | 135 | 4.4e-07 |

Description
pir:[LN:G70045] [AC:G70045 ] [PN:hypothetical protein yvqF] [GN:yvqF ] [OR:Bacillus
subtilis] [DB:pir2] >gp:[GI:e1249815:g2832819] [LN:BS43KBDNA] [AC:AJ223978] [PN:YvqF
protein] [GN:yvqF] [OR:Bacillus subtilis] [DB:genpept-bct1] [DE:Bacillus subtilis
42.7kB DNA fragment from yvsA to yvqA.] [LE:31389] [RE:32114] [DI:direct]
>gp:[GI:e1184389:g2635807] [LN:BSUB0017] [AC:Z99120:AL009126] [GN:yvqF] [FN:unknown]
[OR:Bacillus subtilis] [DB:genpept-bct1] [DE:Bacillus subtilis complete genome (section
17 of 21): from 3197001to 3414420.] [LE:198173] [RE:198898] [DI:complement]

| ORF Name | NTID | AAID | NT Length | AA Length | score | probability |
|---|---|---|---|---|---|---|
| AI7503000994_117687_c1_441 | 2353 | 6125 | 1377 | 458 | 1704 | 2.0e-175 |

Description sp:[LN:PUR8_BACSU] [AC:P12047] [GN:PURB:PURE] [OR:BACILLUS SUBTILIS] [EC:4.3.2.2]
[DE:ADENYLOSUCCINATE LYASE, (ADENYLOSUCCINASE) (ASL)] [SP:P12047] [DB:swissprot]
>pir:[LN:WZBSDS] [AC:C29326:A69684 ] [PN:adenylosuccinate lyase,] [GN:purB ]
[CL:fumarate hydratase] [OR:Bacillus subtilis] [EC:4.3.2.2] [DB:pir1] [MP:18 min ]
>gp:[GI:g143366] [LN:BACPURF] [AC:J02732:K00047] [OR:Bacillus subtilis] [SR:B.subtilis
(strain DE1 (prototroph DER. or W168)) DNA, clone pPZ] [DB:genpept-bct1] [DE:B.subtilis
pur operon encoding purine biosynthesis enzymes, 12genes.] [NT:adenylosuccinate lyase
(PUR-B)] [LE:2056] [RE:3351] [DI:direct] >gp:[GI:e1182624:g2632958] [LN:BSUB0004]
[AC:Z99107:AL009126] [PN:adenylosuccinate lyase] [GN:purB] [FN:purine biosynthesis]
[OR:Bacillus subtilis] [DB:genpept-bct1] [EC:4.3.2.2] [DE:Bacillus subtilis complete
genome (section 4 of 21): from 600701 to813890.] [SP:P12047] [LE:99038] [RE:100333]
[DI:direct]

| ORF Name | NTID | AAID | NT Length | AA Length | score | probability |
|---|---|---|---|---|---|---|
| AI7503000994_11959438_c2_534 | 2354 | 6126 | 135 | 44 | | |

Description
NO-HIT

| ORF Name | NTID | AAID | NT Length | AA Length | score | probability |
|---|---|---|---|---|---|---|
| AI7503000994_1214075_f3_332 | 2355 | 6127 | 507 | 168 | 328 | 1.3e-29 |

Description gp:[GI:g4981674] [LN:AE001770] [AC:AE001770:AE000512] [PN:ferritin] [GN:TM1128]
[OR:Thermotoga maritima] [DB:genpept-bct2] [DE:Thermotoga maritima section 82 of 136 of
the complete genome.] [NT:similar to GB:AE000782 percent identity: 71.95;] [LE:15936]
[RE:16430] [DI:direct]

| ORF Name | NTID | AAID | NT Length | AA Length | score | probability |
|---|---|---|---|---|---|---|
| AI7503000994_12142768_f1_9 | 2356 | 6128 | 300 | 99 | 110 | 4.2e-06 |

Description pir:[LN:D71245] [AC:D71245 ] [PN:hypothetical protein PH0221] [GN:PH0221 ]
[OR:Pyrococcus horikoshii] [DB:pir2] >gp:[GI:d1030234:g3256608] [LN:AP000001]
[AC:AP000001:AB009465:AB009464:AB009466:AB009467:AB009468:AB009469] [PN:235aa long
hypothetical protein] [GN:PH0221] [OR:Pyrococcus horikoshii] [SR:Pyrococcus horikoshii
(strain:OT3) DNA] [DB:genpept-bct1] [DE:Pyrococcus horikoshii OT3 genomic DNA, 1-287000
nt. position (1/7).] [LE:194212] [RE:194919] [DI:complement]

| ORF Name | NTID | AAID | NT Length | AA Length | score | probability |
|---|---|---|---|---|---|---|
| AI7503000994_12270011_f2_269 | 2357 | 6129 | 180 | 59 | 239 | 3.5e-20 |

Description gp:[GI:e1311097:g3320009] [LN:SEHLDGN] [AC:Z49220] [GN:agrD] [OR:Staphylococcus
epidermidis] [DB:genpept-bct1] [DE:Staphylococcus epidermidis hld and agr[A,B,C,D]
genes.] [LE:1327] [RE:1467] [DI:direct]

| ORF Name | NTID | AAID | NT Length | AA Length | score | probability |
|---|---|---|---|---|---|---|
| AI7503000994_12531558_f3_283 | 2358 | 6130 | 351 | 116 | | |

Description
NO-HIT

| ORF Name | NTID | AAID | NT Length | AA Length | score | probability |
|---|---|---|---|---|---|---|
| AI7503000994_12603166_f3_301 | 2359 | 6131 | 303 | 100 | 100 | 1.9e-05 |

Description pir:[LN:G71244] [AC:G71244 ] [PN:hypothetical protein PH0217] [GN:PH0217 ]
[OR:Pyrococcus horikoshii] [DB:pir2] >gp:[GI:d1030229:g3256603] [LN:AP000001]
[AC:AP000001:AB009465:AB009464:AB009466:AB009467:AB009468:AB009469] [PN:106aa long
hypothetical protein] [GN:PH0217] [OR:Pyrococcus horikoshii] [SR:Pyrococcus horikoshii
(strain:OT3) DNA] [DB:genpept-bct1] [DE:Pyrococcus horikoshii OT3 genomic DNA, 1-287000
nt. position (1/7).] [LE:191072] [RE:191392] [DI:complement]

| ORF Name | NTID | AAID | NT Length | AA Length | score | probability |
|---|---|---|---|---|---|---|
| AI7503000994_1287557_f1_56 | 2360 | 6132 | 213 | 70 | | |

Description

NO-HIT

| ORF Name | NTID | AAID | NT Length | AA Length | score | probability |
|---|---|---|---|---|---|---|
| AI7503000994_13678131_f3_393 | 2361 | 6133 | 840 | 279 | 299 | 1.5e-26 |

Description pir:[LN:E69787] [AC:E69787 ] [PN:hypothetical protein ydiL] [GN:ydiL ] [OR:Bacillus
subtilis] [DB:pir2] >gp:[GI:e1182580:g2632914] [LN:BSUB0004] [AC:Z99107:AL009126]
[GN:ydiL] [FN:unknown] [OR:Bacillus subtilis] [DB:genpept-bct1] [DE:Bacillus subtilis
complete genome (section 4 of 21): from 600701 to813890.] [LE:47946] [RE:48680]
[DI:complement] >gp:[GI:d1020504:g1945117] [LN:D88802] [AC:D88802] [GN:ydiL]
[OR:Bacillus subtilis] [SR:Bacillus subtilis (sub_species:Marburg, strain:168,
isolate:JH642] [DB:genpept-bct1] [DE:Bacillus subtilis DNA for phoB-rrnE-groESL region,
complete cds.] [NT:transmembrane] [LE:34948] [RE:35682] [DI:complement]

| ORF Name | NTID | AAID | NT Length | AA Length | score | probability |
|---|---|---|---|---|---|---|
| AI7503000994_1377337_c3_668 | 2362 | 6134 | 840 | 279 | 602 | 1.2e-58 |

Description gp:[GI:g310603] [LN:STAORFPHI] [AC:L19300] [OR:Staphylococcus aureus]
[SR:Staphylococcus aureus (library: NCTC 8325) DNA] [DB:genpept-bct1]
[DE:Staphylococcus aureus DNA sequence encoding three ORFs, completecds; prophage
phi-11 sequence homology, 5' flank.] [LE:2651] [RE:3100] [DI:direct]

| ORF Name | NTID | AAID | NT Length | AA Length | score | probability |
|---|---|---|---|---|---|---|
| AI7503000994_13837927_c2_518 | 2363 | 6135 | 1155 | 384 | 621 | 1.2e-60 |

Description sp:[LN:TNPA_STAAU] [AC:P06696] [GN:TNPA] [OR:STAPHYLOCOCCUS AUREUS] [DE:TRANSPOSASE A
(TRANSPOSON TN554)] [SP:P06696] [DB:swissprot] >pir:[LN:A24584] [AC:A24584 ]
[PN:transposition regulatory protein tnpA] [GN:tnpA ] [OR:Staphylococcus aureus]
[DB:pir2] >gp:[GI:g581277] [LN:ISTN554] [AC:X03216:K02987] [PN:tnpA protein] [GN:tnpA]
[OR:Staphylococcus aureus] [DB:genpept-bct1] [DE:Staphylococcus aureus transposon
Tn554.] [NT:(aa 1-361)] [SP:P06696] [LE:134] [RE:1219] [DI:direct]
>gp:[GI:d1046007:g5360831] [LN:D86934] [AC:D86934] [PN:transposaseA] [OR:Staphylococcus
aureus] [SR:Staphylococcus aureus (strain:N315) DNA, clone_lib:library of N31]
[DB:genpept] [DE:Staphylococcus aureus genes, mec region, partial and complete cds.]
[NT:ORF N045; tnpA] [LE:29383] [RE:30468] [DI:direct]

| ORF Name | NTID | AAID | NT Length | AA Length | score | probability |
|---|---|---|---|---|---|---|
| AI7503000994_13851088_c3_609 | 2364 | 6136 | 1089 | 362 | 185 | 6.2e-14 |

Description
gp:[GI:g1947171] [LN:CELE03H12] [AC:AF000299] [GN:E03H12.5] [OR:Caenorhabditis elegans] [SR:Caenorhabditis elegans strain=Bristol N2] [DB:genpept-inv2] [DE:Caenorhabditis elegans cosmid E03H12.] [NT:coded for by C. elegans cDNA yk170g3.5] [LE:1043:1176:1733] [RE:1131:1689:1762] [DI:directJoin]

| ORF Name | NTID | AAID | NT Length | AA Length | score | probability |
|---|---|---|---|---|---|---|
| AI7503000994_1385927_c1_442 | 2365 | 6137 | 711 | 236 | 851 | 4.9e-85 |

Description
sp:[LN:PCRB_STAAU] [AC:Q53726] [OR:STAPHYLOCOCCUS AUREUS] [DE:PCRB PROTEIN] [SP:Q53726] [DB:swissprot] >pir:[LN:S39922] [AC:S39922:S27666 ] [PN:pcrB protein] [CL:pcrB protein] [OR:Staphylococcus aureus] [DB:pir2] >gp:[GI:g153061] [LN:STAPCRA] [AC:M63176] [GN:pcrA] [OR:Staphylococcus aureus] [SR:Staphylococcus aureus (strain SA20) DNA] [DB:genpept-bct1] [DE:Staphylococcus aureus helicase required for T181 replication (pcrA)gene, complete cds.] [LE:256] [RE:939] [DI:direct]

| ORF Name | NTID | AAID | NT Length | AA Length | score | probability |
|---|---|---|---|---|---|---|
| AI7503000994_1410277_f1_15 | 2366 | 6138 | 153 | 50 | | |

Description
NO-HIT

| ORF Name | NTID | AAID | NT Length | AA Length | score | probability |
|---|---|---|---|---|---|---|
| AI7503000994_1414005_c1_477 | 2367 | 6139 | 579 | 192 | 324 | 3.4e-29 |

Description
pir:[LN:F69815] [AC:F69815 ] [PN:hypothetical protein ygaC] [GN:ygaC ] [OR:Bacillus subtilis] [DB:pir2] >gp:[GI:e1182857:g2633191] [LN:BSUB0005] [AC:Z99108:AL009126] [GN:ygaC] [FN:unknown] [OR:Bacillus subtilis] [DB:genpept-bct1] [DE:Bacillus subtilis complete genome (section 5 of 21): from 802821 to1011250.] [LE:135417] [RE:135734] [DI:direct] >gp:[GI:e281578:g1673391] [LN:BSZ82044] [AC:Z82044] [PN:hypothetical 12.2 kd protein] [GN:ygaC] [OR:Bacillus subtilis] [DB:genpept-bct1] [DE:B.subtilis 25 kb genomic DNA segment (from sspE to katA).] [LE:2267] [RE:2584] [DI:direct]

| ORF Name | NTID | AAID | NT Length | AA Length | score | probability |
|---|---|---|---|---|---|---|
| AI7503000994_14460882_c3_694 | 2368 | 6140 | 240 | 79 | 365 | 1.6e-33 |

Description
gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF Name | NTID | AAID | NT Length | AA Length | score | probability |
|---|---|---|---|---|---|---|
| AI7503000994_14460882_f2_232 | 2369 | 6141 | 126 | 41 | 99 | 9.9e-05 |

Description
gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF Name | NTID | AAID | NT Length | AA Length | score | probability |
|---|---|---|---|---|---|---|
| AI7503000994_14581306_f3_377 | 2370 | 6142 | 303 | 100 | 160 | 8.2e-12 |

Description
gp:[GI:g3676415] [LN:AF051917] [AC:AF051917:L19570] [PN:unknown] [OR:Staphylococcus aureus] [DB:genpept-bct2] [DE:Staphylococcus aureus plasmid pSK41, complete sequence.] [NT:Orf149] [LE:2068] [RE:2484] [DI:complement]

| ORF Name | NTID | AAID | NT Length | AA Length | score | probability |
|---|---|---|---|---|---|---|
| AI7503000994_14642137_f3_381 | 2371 | 6143 | 168 | 55 | | |

Description
NO-HIT

| ORF Name | NTID | AAID | NT Length | AA Length | score | probability |
|---|---|---|---|---|---|---|
| AI7503000994_14714077_c1_445 | 2372 | 6144 | 1209 | 402 | 715 | 1.3e-70 |

Description
pir:[LN:G69794] [AC:G69794 ] [PN:hypothetical protein yerH] [GN:yerH ] [OR:Bacillus subtilis] [DB:pir2] >gp:[GI:e1182643:g2632977] [LN:BSUB0004] [AC:Z99107:AL009126] [GN:yerH] [FN:unknown] [OR:Bacillus subtilis] [DB:genpept-bct1] [DE:Bacillus subtilis complete genome (section 4 of 21): from 600701 to813890.] [LE:122441] [RE:123631] [DI:direct] >gp:[GI:e1167977:g2577964] [LN:BSYERABCD] [AC:Y15254] [PN:YerH protein] [GN:yerH] [OR:Bacillus subtilis] [DB:genpept-bct1] [DE:Bacillus subtilis 13kB DNA fragment, from yerA to sapB gene.] [LE:10086] [RE:11276] [DI:direct]

| ORF Name | NTID | AAID | NT Length | AA Length | score | probability |
|---|---|---|---|---|---|---|
| AI7503000994_14845336_f1_44 | 2373 | 6145 | 147 | 48 | | |

Description
NO-HIT

| ORF Name | NTID | AAID | NT Length | AA Length | score | probability |
|---|---|---|---|---|---|---|
| AI7503000994_14849093_c3_686 | 2374 | 6146 | 294 | 97 | 133 | 6.0e-09 |

Description
pir:[LN:F71245] [AC:F71245 ] [PN:hypothetical protein PHS004] [GN:PHS004 ] [OR:Pyrococcus horikoshii] [DB:pir2] >gp:[GI:d1030236:g3256610] [LN:AP000001] [AC:AP000001:AB009465:AB009464:AB009466:AB009467:AB009468:AB009469] [PN:58aa long hypothetical protein] [GN:PHS004] [OR:Pyrococcus horikoshii] [SR:Pyrococcus horikoshii (strain:OT3) DNA] [DB:genpept-bct1] [DE:Pyrococcus horikoshii OT3 genomic DNA, 1-287000 nt. position (1/7).] [NT:similar to GENPEPT:Z47547 percent identity:50.000] [LE:195255] [RE:195431] [DI:direct]

| ORF Name | NTID | AAID | NT Length | AA Length | score | probability |
|---|---|---|---|---|---|---|
| AI7503000994_14883592_c1_429 | 2375 | 6147 | 2076 | 691 | 600 | 2.0e-58 |

Description
pir:[LN:S40098] [AC:S40098 ] [PN:hypothetical protein] [OR:Clostridium butyricum] [DB:pir2] >gp:[GI:g436133] [LN:CBPYFOLY] [AC:Z29084] [OR:Clostridium butyricum] [DB:genpept-bct1] [DE:C.butyricum transposon containing tbcC gene.] [NT:product is similar to TnpB of transposon Tn554 from] [LE:1088] [RE:3070] [DI:direct]

| ORF Name | NTID | AAID | NT Length | AA Length | score | probability |
|---|---|---|---|---|---|---|
| AI7503000994_14900826_c2_587 | 2376 | 6148 | 351 | 116 | 188 | 8.9e-15 |

Description
gp:[GI:g208931] [LN:SYNORFLAC] [AC:M15619] [OR:synthetic construct] [SR:E.coli (strain SE5000) synthetic DNA, clone pKB1] [DB:genpept-syn] [DE:Synthetic E.coli ORF16/lacZ fusion protein, partial cds.] [NT:ORF16-lacZ fusion protein] [LE:29] [RE:>232] [DI:direct]

| ORF Name | NTID | AAID | NT Length | AA Length | score | probability |
|---|---|---|---|---|---|---|
| AI7503000994_15033167_c3_671 | 2377 | 6149 | 126 | 41 | | |

Description
NO-HIT

| ORF Name | NTID | AAID | NT Length | AA Length | score | probability |
|---|---|---|---|---|---|---|
| AI7503000994_15041430_c2_563 | 2378 | 6150 | 249 | 82 | | |

Description
NO-HIT

| ORF Name | NTID | AAID | NT Length | AA Length | score | probability |
|---|---|---|---|---|---|---|
| AI7503000994_15121077_c1_448 | 2379 | 6151 | 1476 | 491 | 1626 | 3.7e-167 |

Description
pir:[LN:B69795] [AC:B69795 ] [PN:amidase homolog yerM] [GN:yerM ] [CL:indoleacetamide hydrolase] [OR:Bacillus subtilis] [DB:pir2] >gp:[GI:e1182648:g2632982] [LN:BSUB0004] [AC:Z99107:AL009126] [GN:yerM] [FN:unknown] [OR:Bacillus subtilis] [DB:genpept-bct1] [DE:Bacillus subtilis complete genome (section 4 of 21): from 600701 to813890.] [NT:alternate gene name: yedB; similar to amidase] [LE:127844] [RE:129301] [DI:direct]

| ORF Name | NTID | AAID | NT Length | AA Length | score | probability |
|---|---|---|---|---|---|---|
| AI7503000994_16110257_f3_287 | 2380 | 6152 | 126 | 41 | | |

Description
NO-HIT

| ORF Name | NTID | AAID | NT Length | AA Length | score | probability |
|---|---|---|---|---|---|---|
| AI7503000994_16209675_c3_674 | 2381 | 6153 | 159 | 52 | | |

Description
NO-HIT

| ORF Name | NTID | AAID | NT Length | AA Length | score | probability |
|---|---|---|---|---|---|---|
| AI7503000994_16219007_f3_366 | 2382 | 6154 | 921 | 306 | 1319 | 1.3e-134 |

Description sp:[LN:BLAC_STAAU] [AC:P00807] [GN:BLAZ] [OR:STAPHYLOCOCCUS AUREUS] [EC:3.5.2.6]
[DE:BETA-LACTAMASE PRECURSOR, (PENICILLINASE)] [SP:P00807] [DB:swissprot]
>pir:[LN:PNSAP] [AC:A01002:A23600:A90289:S06757:A45789:B45789:D45789::S11784:A60992 ]
[PN:beta-lactamase, precursor:cephalosporinase:penicillinase] [GN:blaZ ]
[CL:beta-lactamase I] [OR:Staphylococcus aureus] [EC:3.5.2.6] [DB:pir1]
>gp:[GI:g551850] [LN:ENEBELAA] [AC:M60253] [PN:beta-lactamase] [GN:blaZ]
[OR:Enterococcus faecalis] [SR:Enterococcus faecalis (strain HH22) cDNA to mRNA]
[DB:genpept-bct1] [EC:3.5.2.6] [DE:E.faecalis beta-lactamase mRNA, complete cds.]
[LE:142] [RE:987] [DI:direct] >gp:[GI:g150717] [LN:PI25BLAZA] [AC:M15526]
[PN:beta-lactamase] [GN:blaZ] [OR:Plasmid pI258] [SR:Plasmid pI258 (clone: pWN101) DNA]
[DB:genpept-bct1] [EC:3.5.2.6] [DE:Plasmid pI258 (from S.aureus) beta-lactamase (blaZ),
complete cds.] [LE:140] [RE:985] [DI:direct] >gp:[GI:g581568] [LN:SAPBLAZ] [AC:X04121]
[OR:Staphylococcus aureus] [DB:genpept-bct1] [DE:S. aureus PC1 beta-lactamase gene blaZ
from plasmid pI258.] [NT:beta-lactamase (aa 1-281)] [SP:P00807] [LE:140] [RE:985]
[DI:direct] >gp:[GI:g581590] [LN:SATN552] [AC:X52734] [OR:Staphylococcus aureus]
[DB:genpept-bct1] [DE:S.aureus Tn552 transposable element.] [NT:blaZ protein (AA
1-281)] [SP:P00807] [LE:5399] [RE:6244] [DI:direct] >gp:[GI:g581591] [LN:SATNBLAZ]
[AC:X16471] [OR:Staphylococcus aureus] [DB:genpept-bct1] [DE:Staphylococcus aureus
transposon Tn4002 blaZ gene forbeta-lactamase.] [NT:beta-lactamase (AA 1-281)]
[SP:P00807] [LE:142] [RE:987] [DI:direct] >gp:[GI:g1575125] [LN:SAU58139] [AC:U58139]
[PN:beta-lactamase] [GN:blaZ] [OR:Staphylococcus aureus] [SR:Staphylococcus aureus
strain=a53] [DB:genpept-bct1] [DE:Staphylococcus aureus beta-lactamase (blaz) gene,
complete cds.] [LE:142] [RE:987] [DI:direct] >gp:[GI:g537336] [LN:STALACBAA]
[AC:M25252] [PN:beta-lactamase] [OR:Staphylococcus aureus] [SR:Staphylococcus aureus
DNA] [DB:genpept-bct1] [DE:Staphylococcus aureus (clone pPC1) beta-lactamase gene,
completecds.] [LE:123] [RE:968] [DI:direct] >gp:[GI:g537337] [LN:STALACBAB] [AC:M25253]
[PN:beta-lactamase] [OR:Staphylococcus aureus] [SR:Staphylococcus aureus DNA]
[DB:genpept-bct1] [DE:Staphylococcus aureus (clone pS1) beta-lactamase gene,
completecds.] [LE:29] [RE:874] [DI:direct]

| ORF Name | NTID | AAID | NT Length | AA Length | score | probability |
|---|---|---|---|---|---|---|
| AI7503000994_16677343_c1_412 | 2383 | 6155 | 447 | 148 | 111 | 1.3e-06 |

Description sp:[LN:Y357_METJA] [AC:Q57803] [GN:MJ0357] [OR:METHANOCOCCUS JANNASCHII]
[DE:HYPOTHETICAL PROTEIN MJ0357] [SP:Q57803] [DB:swissprot] >pir:[LN:E64344] [AC:E64344
] [PN:hypothetical protein MJ0357] [OR:Methanococcus jannaschii] [DB:pir2]
[MP:REV326407-325940 ] >gp:[GI:g1591066] [LN:U67489] [AC:U67489:L77117] [PN:M.
jannaschii predicted coding region MJ0357] [GN:MJ0357] [OR:Methanococcus jannaschii]
[DB:genpept-bct2] [DE:Methanococcus jannaschii section 31 of 150 of the complete
genome.] [NT:hypothetical protein; identified by GeneMark;] [LE:1632] [RE:2099]
[DI:complement]

| ORF Name | NTID | AAID | NT Length | AA Length | score | probability |
|---|---|---|---|---|---|---|
| AI7503000994_16695300_f3_307 | 2384 | 6156 | 1113 | 370 | 586 | 5.9e-57 |

Description pir:[LN:H69815] [AC:H69815 ] [PN:hypothetical protein ygaE] [GN:ygaE ] [OR:Bacillus
subtilis] [DB:pir2] >gp:[GI:e1182859:g2633193] [LN:BSUB0005] [AC:Z99108:AL009126]
[GN:ygaE] [FN:unknown] [OR:Bacillus subtilis] [DB:genpept-bct1] [DE:Bacillus subtilis
complete genome (section 5 of 21): from 802821 to1011250.] [LE:137853] [RE:138914]
[DI:complement] >gp:[GI:e281580:g1673393] [LN:BSZ82044] [AC:Z82044] [PN:hypothetical
40.7 kd protein] [GN:ygaE] [OR:Bacillus subtilis] [DB:genpept-bct1] [DE:B.subtilis 25
kb genomic DNA segment (from sspE to katA).] [LE:4703] [RE:5764] [DI:complement]

| ORF Name | NTID | AAID | NT Length | AA Length | score | probability |
|---|---|---|---|---|---|---|
| AI7503000994_19536693_c3_645 | 2385 | 6157 | 318 | 105 | 232 | 1.9e-19 |

Description pir:[LN:A69795] [AC:A69795 ] [PN:conserved hypothetical protein yerL] [GN:yerL ] [CL:probable glu-tRNA amidotransferase C chain] [OR:Bacillus subtilis] [DB:pir2] >gp:[GI:g2589194] [LN:AF008553] [AC:AF008553] [PN:Glu-tRNAGln amidotransferase subunit C] [GN:gatC] [OR:Bacillus subtilis] [DB:genpept-bct1] [DE:Bacillus subtilis Glu-tRNAGln amidotransferase subunits C (gatC), A(gatA) and B (gatB) genes, complete cds.] [LE:412] [RE:702] [DI:direct] >gp:[GI:g2114425] [LN:BSU92466] [AC:U92466] [OR:Bacillus subtilis] [DB:genpept-bct1] [DE:Bacillus subtilis strain JH642 amidase-like protein, partial cds,osmoregulated proline transporter (opuE) gene, complete cds andSapB (sapB) gene, partial cds.] [NT:similar to Synechocystis sp. hypothetical protein,] [LE:278] [RE:568] [DI:complement] >gp:[GI:e1182647:g2632981] [LN:BSUB0004] [AC:Z99107:AL009126] [GN:yerL] [FN:unknown] [OR:Bacillus subtilis] [DB:genpept-bct1] [DE:Bacillus subtilis complete genome (section 4 of 21): from 600701 to813890.] [NT:alternate gene name: yedA; similar to hypothetical] [LE:127538] [RE:127828] [DI:direct]

| ORF Name | NTID | AAID | NT Length | AA Length | score | probability |
|---|---|---|---|---|---|---|
| AI7503000994_19570253_f2_152 | 2386 | 6158 | 213 | 70 | | |

Description

NO-HIT

| ORF Name | NTID | AAID | NT Length | AA Length | score | probability |
|---|---|---|---|---|---|---|
| AI7503000994_1958183_f1_121 | 2387 | 6159 | 648 | 215 | 976 | 2.8e-98 |

Description gp:[GI:e1311096:g3320008] [LN:SEHLDGN] [AC:Z49220] [GN:agrB] [OR:Staphylococcus epidermidis] [DB:genpept-bct1] [DE:Staphylococcus epidermidis hld and agr[A,B,C,D] genes.] [LE:759] [RE:1343] [DI:direct]

| ORF Name | NTID | AAID | NT Length | AA Length | score | probability |
|---|---|---|---|---|---|---|
| AI7503000994_1972278_f3_306 | 2388 | 6160 | 300 | 99 | 316 | 2.4e-28 |

Description sp:[LN:GSAB_BACSU] [AC:P71084] [GN:GSAB] [OR:BACILLUS SUBTILIS] [EC:5.4.3.8] [DE:(GLUTAMATE-1-SEMIALDEHYDE AMINOTRANSFERASE) (GSA-AT)] [SP:P71084] [DB:swissprot] >gp:[GI:e281581:g1673394] [LN:BSZ82044] [AC:Z82044] [PN:glutamate-1-semialdehyde aminotransferase] [GN:gsaB] [OR:Bacillus subtilis] [DB:genpept-bct1] [DE:B.subtilis 25 kb genomic DNA segment (from sspE to katA).] [SP:P71084] [LE:5984] [RE:7273] [DI:complement]

| ORF Name | NTID | AAID | NT Length | AA Length | score | probability |
|---|---|---|---|---|---|---|
| AI7503000994_1988811_c3_672 | 2389 | 6161 | 1083 | 360 | 779 | 2.1e-77 |

Description pir:[LN:A69802] [AC:A69802 ] [PN:A/G-specific adenine glycosylase homolog yfhQ] [GN:yfhQ ] [OR:Bacillus subtilis] [DB:pir2] >gp:[GI:e1182852:g2633186] [LN:BSUB0005] [AC:Z99108:AL009126] [GN:yfhQ] [FN:unknown] [OR:Bacillus subtilis] [DB:genpept-bct1] [DE:Bacillus subtilis complete genome (section 5 of 21): from 802821 to1011250.] [NT:similar to A/G-specific adenine glycosylase] [LE:132342] [RE:133451] [DI:direct] >gp:[GI:d1025399:g2804547] [LN:D85082] [AC:D85082] [PN:YfhQ] [OR:Bacillus subtilis] [SR:Bacillus subtilis DNA] [DB:genpept-bct1] [DE:Bacillus subtilis DNA, genome sequence, 79 to 81 degree region.] [LE:25233] [RE:26342] [DI:direct]

| ORF_Name | NTID | AAID | NT Length | AA Length | score | probability |
|---|---|---|---|---|---|---|
| AI7503000994_20100206_f2_137 | 2390 | 6162 | 165 | 54 | | |

Description
NO-HIT

| ORF_Name | NTID | AAID | NT Length | AA Length | score | probability |
|---|---|---|---|---|---|---|
| AI7503000994_20344411_c2_508 | 2391 | 6163 | 336 | 111 | 440 | 1.8e-41 |

Description
sp:[LN:CH10_STAEP] [AC:P48227] [GN:GROES:HSP10] [OR:STAPHYLOCOCCUS EPIDERMIDIS]
[DE:10)] [SP:P48227] [DB:swissprot] >gp:[GI:g535341] [LN:SEU13618] [AC:U13618] [PN:heat
shock protein 10] [GN:hsp10] [OR:Staphylococcus epidermidis] [DB:genpept-bct1]
[DE:Staphylococcus epidermidis 9759 heat shock protein 10 (hsp10) andheat shock protein
60 (hsp60) genes, complete cds.] [LE:105] [RE:389] [DI:direct]

| ORF_Name | NTID | AAID | NT Length | AA Length | score | probability |
|---|---|---|---|---|---|---|
| AI7503000994_20348427_c2_578 | 2392 | 6164 | 126 | 41 | | |

Description
NO-HIT

| ORF_Name | NTID | AAID | NT Length | AA Length | score | probability |
|---|---|---|---|---|---|---|
| AI7503000994_2037838_f2_223 | 2393 | 6165 | 249 | 82 | 122 | 8.8e-08 |

Description
pir:[LN:A71136] [AC:A71136 ] [PN:hypothetical protein PH0853] [GN:PH0853 ]
[CL:isoleucine--tRNA ligase] [OR:Pyrococcus horikoshii] [DB:pir2]
>gp:[GI:d1030890:g3257264] [LN:AP000003]
[AC:AP000003:AB009484:AB009485:AB009486:AB009487:AB009488:AB009489] [PN:134aa long
hypothetical protein] [GN:PH0853] [OR:Pyrococcus horikoshii] [SR:Pyrococcus horikoshii
(strain:OT3) DNA] [DB:genpept-bct1] [DE:Pyrococcus horikoshii OT3 genomic DNA,
544001-777000 nt. position(3/7).] [LE:216446] [RE:216850] [DI:direct]

| ORF_Name | NTID | AAID | NT Length | AA Length | score | probability |
|---|---|---|---|---|---|---|
| AI7503000994_20414052_f1_49 | 2394 | 6166 | 129 | 42 | | |

Description
NO-HIT

| ORF_Name | NTID | AAID | NT Length | AA Length | score | probability |
|---|---|---|---|---|---|---|
| AI7503000994_20735686_f1_87 | 2395 | 6167 | 957 | 318 | 853 | 3.0e-85 |

Description
sp:[LN:YYBQ_BACSU] [AC:P37487] [GN:YYBQ] [OR:BACILLUS SUBTILIS] [DE:HYPOTHETICAL 34.0
KD PROTEIN IN COTF-TETB INTERGENIC REGION] [SP:P37487] [DB:swissprot] >pir:[LN:S65980]
[AC:S65980:D70088 ] [PN:conserved hypothetical protein yybQ] [GN:yybQ ] [CL:conserved
hypothetical protein MJ0608] [OR:Bacillus subtilis] [DB:pir2] >gp:[GI:d1005728:g467340]
[LN:BAC180K] [AC:D26185] [PN:unknown] [OR:Bacillus subtilis] [SR:Bacillus subtilis
(sub_species:Marburg, strain:168) DNA] [DB:genpept-bct1] [DE:B. subtilis DNA, 180
kilobase region of replication origin.] [LE:16200] [RE:17129] [DI:direct]
>gp:[GI:e1184781:g2636602] [LN:BSUB0021] [AC:Z99124:AL009126] [GN:yybQ] [FN:unknown]
[OR:Bacillus subtilis] [DB:genpept-bct1] [DE:Bacillus subtilis complete genome (section
21 of 21): from 3999281to 4214814.] [NT:similar to hypothetical proteins] [SP:P37487]
[LE:168132] [RE:169061] [DI:direct]

| ORF Name | NTID | AAID | NT Length | AA Length | score | probability |
|---|---|---|---|---|---|---|
| AI7503000994_20881510_c2_510 | 2396 | 6168 | 492 | 163 | 216 | 9.6e-18 |

Description gp:[GI:g3688823] [LN:AF084104] [AC:AF084104] [PN:hypothetical protein] [OR:Bacillus firmus] [DB:genpept-bct2] [DE:Bacillus firmus AcsA (acsA) gene, partial cds; SspA (sspA),hypothetical protein, maltose transportor ATP-binding protein(malK), leucine-rich protein transcriptional regulator (lrpR),hypothetical proteins, ABC transporter ATP-binding protein (natC),NatA (natA), NatB (natB), and hypothetical protein genes, completecds; and SpoIIIJ (spoIIIJ) gene, partial cds.] [NT:Orf15; similar to transcription regulator YtrA from] [LE:9870] [RE:10229] [DI:direct]

| ORF Name | NTID | AAID | NT Length | AA Length | score | probability |
|---|---|---|---|---|---|---|
| AI7503000994_2125637_f3_294 | 2397 | 6169 | 150 | 49 | | |

Description

NO-HIT

| ORF Name | NTID | AAID | NT Length | AA Length | score | probability |
|---|---|---|---|---|---|---|
| AI7503000994_21494536_c3_644 | 2398 | 6170 | 132 | 43 | | |

Description

NO-HIT

| ORF Name | NTID | AAID | NT Length | AA Length | score | probability |
|---|---|---|---|---|---|---|
| AI7503000994_21516287_f1_17 | 2399 | 6171 | 135 | 44 | 100 | 1.9e-05 |

Description pir:[LN:G64564] [AC:G64564 ] [PN:hypothetical protein HP0359] [OR:Helicobacter pylori] [DB:pir2] >gp:[GI:g2313473] [LN:AE000553] [AC:AE000553:AE000511] [PN:H. pylori predicted coding region HP0359] [GN:HP0359] [OR:Helicobacter pylori 26695] [DB:genpept-bct2] [DE:Helicobacter pylori 26695 section 31 of 134 of the complete genome.] [NT:hypothetical protein; identified by GeneMark;] [LE:250] [RE:315] [DI:direct]

| ORF Name | NTID | AAID | NT Length | AA Length | score | probability |
|---|---|---|---|---|---|---|
| AI7503000994_21616078_c1_440 | 2400 | 6172 | 192 | 63 | 135 | 3.7e-09 |

Description pir:[LN:C69792] [AC:C69792 ] [PN:hypothetical protein yebG] [GN:yebG ] [OR:Bacillus subtilis] [DB:pir2] >gp:[GI:g2239294] [LN:BSU51115] [AC:U51115] [PN:unknown] [OR:Bacillus subtilis] [DB:genpept-bct1] [DE:Bacillus subtilis CotA (cotA), GabP (gabP), YeaB (yeaB), YeaC(yeaC), YebA (yebA), GMP synthetase (guaA) genes, complete cds, andAIR carboxylase I (purE) gene, partial cds.] [NT:yebG] [LE:15312] [RE:15509] [DI:direct] >gp:[GI:e1182621:g2632955] [LN:BSUB0004] [AC:Z99107:AL009126] [GN:yebG] [FN:unknown] [OR:Bacillus subtilis] [DB:genpept-bct1] [DE:Bacillus subtilis complete genome (section 4 of 21): from 600701 to813890.] [LE:96901] [RE:97098] [DI:direct]

| ORF Name | NTID | AAID | NT Length | AA Length | score | probability |
|---|---|---|---|---|---|---|
| AI7503000994_21676433_c3_634 | 2401 | 6173 | 1137 | 378 | 192 | 3.3e-12 |

Description gp:[GI:e1292355:g3127839] [LN:SC1A6] [AC:AL023496] [PN:hypothetical protein] [GN:SC1A6.07c] [OR:Streptomyces coelicolor] [DB:genpept-bct1] [DE:Streptomyces coelicolor cosmid 1A6.] [NT:SC1A6.07c, unknown, len: 813] [LE:7442] [RE:9070] [DI:complement]

| ORF Name | NTID | AAID | NT Length | AA Length | score | probability |
|---|---|---|---|---|---|---|
| AI7503000994_22289077_c2_514 | 2402 | 6174 | 546 | 181 | | |

Description
NO-HIT

| ORF Name | NTID | AAID | NT Length | AA Length | score | probability |
|---|---|---|---|---|---|---|
| AI7503000994_22688428_c2_584 | 2403 | 6175 | 144 | 47 | | |

Description
NO-HIT

| ORF Name | NTID | AAID | NT Length | AA Length | score | probability |
|---|---|---|---|---|---|---|
| AI7503000994_23438461_c1_413 | 2404 | 6176 | 687 | 228 | 103 | 0.029 |

Description
gp:[GI:g5306158] [LN:AF160864] [AC:AF160864] [PN:orf1386] [GN:orf1386]
[OR:Mitochondrion Tetrahymena pyriformis] [SR:Tetrahymena pyriformis] [DB:genpept]
[DE:Tetrahymena pyriformis mitochondrial DNA, complete genome.] [NT:Open reading frame
ymf77 (CPGN); ATA initiation] [LE:22317] [RE:26477] [DI:complement]

| ORF Name | NTID | AAID | NT Length | AA Length | score | probability |
|---|---|---|---|---|---|---|
| AI7503000994_23495437_f2_262 | 2405 | 6177 | 1305 | 434 | 1004 | 3.0e-101 |

Description
pir:[LN:JC4864] [AC:JC4864 ] [PN:aspartate transaminase,] [GN:aspAT ] [OR:Bacillus
circulans] [EC:2.6.1.1] [DB:pir2] >gp:[GI:e216734:g1147557] [LN:BCASPAMIN] [AC:X94433]
[PN:Aspartate aminotransferase] [OR:Bacillus circulans subsp. alkalophilus]
[DB:genpept-bct1] [EC:2.6.1.1] [DE:B.circulans aspartate aminotransferase gene.]
[LE:367] [RE:1665] [DI:direct]

| ORF Name | NTID | AAID | NT Length | AA Length | score | probability |
|---|---|---|---|---|---|---|
| AI7503000994_23572125_c2_571 | 2406 | 6178 | 534 | 177 | 393 | 1.7e-36 |

Description
sp:[LN:YKHA_BACSU] [AC:P49851] [GN:YKHA] [OR:BACILLUS SUBTILIS] [DE:HYPOTHETICAL 20.1
KD PROTEIN IN HMP 5'REGION (ORF1)] [SP:P49851] [DB:swissprot]
>gp:[GI:d1011919:g1063246] [LN:BAC168TRP2] [AC:D78189] [OR:Bacillus subtilis]
[SR:Bacillus subtilis (strain:168trpC2) DNA] [DB:genpept-bct1] [DE:Bacillus subtilis
hmp DNA for 7 ORFs, complete cds.] [NT:low homology to P14 protein of Heamophilus]
[LE:241] [RE:780] [DI:direct]

| ORF Name | NTID | AAID | NT Length | AA Length | score | probability |
|---|---|---|---|---|---|---|
| AI7503000994_23595386_c1_484 | 2407 | 6179 | 627 | 208 | 271 | 1.4e-23 |

Description
pir:[LN:H70032] [AC:H70032 ] [PN:glycerate dehydrogenase homolog yvcT] [GN:yvcT ]
[OR:Bacillus subtilis] [DB:pir2] >gp:[GI:e1186156:g2635981] [LN:BSUB0018]
[AC:Z99121:AL009126] [GN:yvcT] [FN:unknown] [OR:Bacillus subtilis] [DB:genpept-bct1]
[DE:Bacillus subtilis complete genome (section 18 of 21): from 3399551to 3609060.]
[NT:similar to glycerate dehydrogenase] [LE:162076] [RE:163053] [DI:direct]

| ORF Name | NTID | AAID | NT Length | AA Length | score | probability |
|---|---|---|---|---|---|---|
| AI7503000994_23600175_f2_274 | 2408 | 6180 | 123 | 40 | | |

Description
NO-HIT

| ORF_Name | NTID | AAID | NT Length | AA Length | score | probability |
|---|---|---|---|---|---|---|
| AI7503000994_23629202_c1_433 | 2409 | 6181 | 381 | 126 | 598 | 3.2e-58 |

Description sp:[LN:BLAI_STAAU] [AC:P18415] [GN:BLAI:PENI] [OR:STAPHYLOCOCCUS AUREUS] [DE:REPRESSOR PROTEIN)] [SP:P18415] [DB:swissprot] >pir:[LN:S11782] [AC:S11782:S34446 ] [PN:regulatory protein blaI] [GN:blaI ] [CL:regulatory protein blaI] [OR:Staphylococcus aureus] [DB:pir2] >gp:[GI:g46758] [LN:SATN552] [AC:X52734] [OR:Staphylococcus aureus] [DB:genpept-bct1] [DE:S.aureus Tn552 transposable element.] [NT:blaI protein (AA 1-126)] [SP:P18415] [LE:3165] [RE:3545] [DI:complement] >gp:[GI:g152967] [LN:STABLA] [AC:M62650] [GN:blaI] [FN:putative blaZ repressor] [OR:Staphylococcus aureus] [SR:Staphylococcus aureus DNA] [DB:genpept-bct1] [DE:Staphylococcus aureus blaZ gene, 5' end; blaR1 gene, complete cds;blaI gene, complete cds; and binR gene, 5' end.] [LE:1903] [RE:2283] [DI:direct] >gp:[GI:g152970] [LN:STABLAIA] [AC:M92376] [PN:beta-lactamase repressor] [GN:BlaI] [FN:represses the production of the blaZ product] [OR:Staphylococcus aureus] [SR:Staphylococcus aureus (strain RN4) DNA] [DB:genpept-bct1] [DE:Staphylococcus aureus beta-lactamase repressor (BlaI) gene,complete cds.] [NT:no obvious promoters were found in the region] [LE:16] [RE:396] [DI:direct]

| ORF_Name | NTID | AAID | NT Length | AA Length | score | probability |
|---|---|---|---|---|---|---|
| AI7503000994_23672302_f3_302 | 2410 | 6182 | 156 | 51 | | |

Description
NO-HIT

| ORF_Name | NTID | AAID | NT Length | AA Length | score | probability |
|---|---|---|---|---|---|---|
| AI7503000994_23672562_c1_411 | 2411 | 6183 | 297 | 98 | 86 | 0.0034 |

Description gp:[GI:e8900:g1335718] [LN:PFRESAR1] [AC:X05182] [PN:ring-infected eryrthrocyte surface antigen] [GN:RESA] [OR:Plasmodium falciparum] [SR:malaria parasite P. falciparum] [DB:genpept-inv1] [DE:P.falciparum FC27 Ag46 RESA mRNA for ring-infected eryrthrocytesurface antigen.] [SP:P13830] [LE:<1] [RE:>955] [DI:direct]

| ORF_Name | NTID | AAID | NT Length | AA Length | score | probability |
|---|---|---|---|---|---|---|
| AI7503000994_23727212_f2_175 | 2412 | 6184 | 303 | 100 | 87 | 0.00045 |

Description pir:[LN:B69818] [AC:B69818 ] [PN:conserved hypothetical protein yhaH] [GN:yhaH ] [OR:Bacillus subtilis] [DB:pir2] >gp:[GI:e1183002:g2633336] [LN:BSUB0006] [AC:Z99109:AL009126] [GN:yhaH] [FN:unknown] [OR:Bacillus subtilis] [DB:genpept-bct1] [DE:Bacillus subtilis complete genome (section 6 of 21): from 999501 to1209940.] [NT:similar to hypothetical proteins from B. subtilis] [LE:73870] [RE:74226] [DI:complement] >gp:[GI:e325179:g2226119] [LN:BSY14077] [AC:Y14077] [PN:Hypothetical protein] [GN:yhaH] [OR:Bacillus subtilis] [DB:genpept-bct1] [DE:Bacillus subitilis 10.6 Kb chromosomal DNA: glyB-prsA region.] [LE:6687] [RE:7043] [DI:direct]

| ORF Name | NTID | AAID | NT Length | AA Length | score | probability |
|---|---|---|---|---|---|---|
| AI7503000994_23727250_f3_362 | 2413 | 6185 | 1395 | 464 | 1167 | 1.6e-118 |

Description sp:[LN:DHA2_BACSU] [AC:P39616] [GN:YWDH:IPA-58R] [OR:BACILLUS SUBTILIS] [EC:1.2.1.3]
[DE:PROBABLE ALDEHYDE DEHYDROGENASE YWDH,] [SP:P39616] [DB:swissprot] >pir:[LN:S39713]
[AC:S39713:C70054 ] [PN:aldehyde dehydrogenase homolog ywdH:protein ipa-58r] [GN:ywdH ]
[CL:aldehyde dehydrogenase (NAD+):aldehyde dehydrogenase homology] [OR:Bacillus
subtilis] [DB:pir2] >gp:[GI:g413982] [LN:BSGENR] [AC:X73124] [GN:ipa-58r] [OR:Bacillus
subtilis] [DB:genpept-bct1] [DE:B.subtilis genomic region (325 to 333).] [SP:P39616]
[LE:59908] [RE:61281] [DI:complement] >gp:[GI:e1186295:g2636331] [LN:BSUB0020]
[AC:Z99123:AL009126] [GN:ywdH] [FN:unknown] [OR:Bacillus subtilis] [DB:genpept-bct1]
[DE:Bacillus subtilis complete genome (section 20 of 21): from 3798401to 4010550.]
[NT:alternate gene name: ipa-58r; similar to aldehyde] [SP:P39616] [LE:96681]
[RE:98054] [DI:direct]

| ORF Name | NTID | AAID | NT Length | AA Length | score | probability |
|---|---|---|---|---|---|---|
| AI7503000994_2379658_f2_144 | 2414 | 6186 | 225 | 74 | | |

Description
NO-HIT

| ORF Name | NTID | AAID | NT Length | AA Length | score | probability |
|---|---|---|---|---|---|---|
| AI7503000994_23850907_f1_109 | 2415 | 6187 | 201 | 66 | | |

Description
NO-HIT

| ORF Name | NTID | AAID | NT Length | AA Length | score | probability |
|---|---|---|---|---|---|---|
| AI7503000994_24017175_f2_202 | 2416 | 6188 | 150 | 49 | | |

Description
NO-HIT

| ORF Name | NTID | AAID | NT Length | AA Length | score | probability |
|---|---|---|---|---|---|---|
| AI7503000994_24218791_f1_86 | 2417 | 6189 | 588 | 195 | 525 | 1.7e-50 |

Description pir:[LN:C70008] [AC:C70008 ] [PN:pyrazinamidase/nicotinamidase homolog yueJ] [GN:yueJ ]
[CL:hypothetical protein b1011] [OR:Bacillus subtilis] [DB:pir2]
>gp:[GI:e1184253:g2635671] [LN:BSUB0017] [AC:Z99120:AL009126] [GN:yueJ] [FN:unknown]
[OR:Bacillus subtilis] [DB:genpept-bct1] [DE:Bacillus subtilis complete genome (section
17 of 21): from 3197001to 3414420.] [NT:similar to pyrazinamidase/nicotinamidase]
[LE:62967] [RE:63518] [DI:complement]

| ORF Name | NTID | AAID | NT Length | AA Length | score | probability |
|---|---|---|---|---|---|---|
| AI7503000994_24225632_f2_253 | 2418 | 6190 | 171 | 56 | | |

Description
NO-HIT

| ORF Name | NTID | AAID | NT Length | AA Length | score | probability |
|---|---|---|---|---|---|---|
| AI7503000994_24257827_c2_511 | 2419 | 6191 | 387 | 128 | | |

Description
NO-HIT

| ORF Name | NTID | AAID | NT Length | AA Length | score | probability |
|---|---|---|---|---|---|---|
| AI7503000994_24265676_f1_120 | 2420 | 6192 | 144 | 47 | | |

Description
NO-HIT

| ORF Name | NTID | AAID | NT Length | AA Length | score | probability |
|---|---|---|---|---|---|---|
| AI7503000994_24350953_f2_151 | 2421 | 6193 | 132 | 43 | 72 | 0.017 |

Description
pir:[LN:G71244] [AC:G71244 ] [PN:hypothetical protein PH0217] [GN:PH0217 ]
[OR:Pyrococcus horikoshii] [DB:pir2] >gp:[GI:d1030229:g3256603] [LN:AP000001]
[AC:AP000001:AB009465:AB009464:AB009466:AB009467:AB009468:AB009469] [PN:106aa long
hypothetical protein] [GN:PH0217] [OR:Pyrococcus horikoshii] [SR:Pyrococcus horikoshii
(strain:OT3) DNA] [DB:genpept-bct1] [DE:Pyrococcus horikoshii OT3 genomic DNA, 1-287000
nt. position (1/7).] [LE:191072] [RE:191392] [DI:complement]

| ORF Name | NTID | AAID | NT Length | AA Length | score | probability |
|---|---|---|---|---|---|---|
| AI7503000994_24353382_c3_608 | 2422 | 6194 | 1623 | 540 | 2592 | 1.6e-269 |

Description
gp:[GI:g535342] [LN:SEU13618] [AC:U13618] [PN:heat shock protein 60] [GN:hsp60]
[OR:Staphylococcus epidermidis] [DB:genpept-bct1] [DE:Staphylococcus epidermidis 9759
heat shock protein 10 (hsp10) andheat shock protein 60 (hsp60) genes, complete cds.]
[LE:445] [RE:2064] [DI:direct]

| ORF Name | NTID | AAID | NT Length | AA Length | score | probability |
|---|---|---|---|---|---|---|
| AI7503000994_24407787_c1_483 | 2423 | 6195 | 354 | 117 | 84 | 0.029 |

Description
sp:[LN:SERX_YEAST] [AC:P40054] [GN:YER081W] [OR:SACCHAROMYCES CEREVISIAE] [SR:,BAKER'S
YEAST] [EC:1.1.1.95] [DE:(PGDH)] [SP:P40054] [DB:swissprot] >pir:[LN:S50584] [AC:S50584
] [PN:probable phosphoglycerate dehydrogenase, YER081w ] [OR:Saccharomyces cerevisiae]
[EC:1.1.1.95] [DB:pir2] [MP:5R ]

| ORF Name | NTID | AAID | NT Length | AA Length | score | probability |
|---|---|---|---|---|---|---|
| AI7503000994_24415942_c2_516 | 2424 | 6196 | 840 | 279 | | |

Description
NO-HIT

| ORF Name | NTID | AAID | NT Length | AA Length | score | probability |
|---|---|---|---|---|---|---|
| AI7503000994_24475252_c2_533 | 2425 | 6197 | 162 | 53 | | |

Description
NO-HIT

| ORF Name | NTID | AAID | NT Length | AA Length | score | probability |
|---|---|---|---|---|---|---|
| AI7503000994_24475252_f1_2 | 2426 | 6198 | 159 | 52 | | |

Description
NO-HIT

| ORF_Name | NTID | AAID | NT Length | AA Length | score | probability |
|---|---|---|---|---|---|---|
| AI7503000994_24885938_c3_639 | 2427 | 6199 | 642 | 213 | 302 | 7.4e-27 |

Description
pir:[LN:B69792] [AC:B69792 ] [PN:hypothetical protein yebF] [GN:yebF ] [OR:Bacillus subtilis] [DB:pir2] >gp:[GI:g2239293] [LN:BSU51115] [AC:U51115] [PN:unknown] [OR:Bacillus subtilis] [DB:genpept-bct1] [DE:Bacillus subtilis CotA (cotA), GabP (gabP), YeaB (yeaB), YeaC(yeaC), YebA (yebA), GMP synthetase (guaA) genes, complete cds, andAIR carboxylase I (purE) gene, partial cds.] [NT:yebF] [LE:15046] [RE:15312] [DI:direct] >gp:[GI:e1182620:g2632954] [LN:BSUB0004] [AC:Z99107:AL009126] [GN:yebF] [FN:unknown] [OR:Bacillus subtilis] [DB:genpept-bct1] [DE:Bacillus subtilis complete genome (section 4 of 21): from 600701 to813890.] [LE:96635] [RE:96901] [DI:direct]

| ORF_Name | NTID | AAID | NT Length | AA Length | score | probability |
|---|---|---|---|---|---|---|
| AI7503000994_25428507_c1_457 | 2428 | 6200 | 576 | 191 | 109 | 0.0063 |

Description
pir:[LN:G71609] [AC:G71609 ] [PN:hypothetical protein PFB0650w] [GN:PFB0650w ] [OR:Plasmodium falciparum] [DB:pir2] >gp:[GI:g3845240] [LN:AE001408] [AC:AE001408:AE001362] [PN:hypothetical protein] [GN:PFB0650w] [OR:Plasmodium falciparum] [SR:malaria parasite P. falciparum] [DB:genpept-inv2] [DE:Plasmodium falciparum chromosome 2, section 45 of 73 of thecomplete sequence.] [NT:predicted by GlimmerM] [LE:4458] [RE:11960] [DI:direct]

| ORF_Name | NTID | AAID | NT Length | AA Length | score | probability |
|---|---|---|---|---|---|---|
| AI7503000994_25595387_f1_93 | 2429 | 6201 | 432 | 143 | 326 | 2.1e-29 |

Description
gp:[GI:g3676415] [LN:AF051917] [AC:AF051917:L19570] [PN:unknown] [OR:Staphylococcus aureus] [DB:genpept-bct2] [DE:Staphylococcus aureus plasmid pSK41, complete sequence.] [NT:Orf149] [LE:2068] [RE:2484] [DI:complement]

| ORF_Name | NTID | AAID | NT Length | AA Length | score | probability |
|---|---|---|---|---|---|---|
| AI7503000994_25603388_f1_122 | 2430 | 6202 | 1293 | 430 | 2112 | 1.2e-218 |

Description
gp:[GI:g2981295] [LN:AF012132] [AC:AF012132] [PN:histidine kinase] [GN:agrC] [OR:Staphylococcus epidermidis] [DB:genpept-bct2] [DE:Staphylococcus epidermidis agr system including response regulator(agrA), histidine kinase (agrC), AgrD (agrD), AgrB (agrB) and deltatoxin (hld) genes, complete cds.] [NT:AgrC; similar to S. aureus and S. lugdunensis AgrC] [LE:975] [RE:2264] [DI:complement]

| ORF_Name | NTID | AAID | NT Length | AA Length | score | probability |
|---|---|---|---|---|---|---|
| AI7503000994_256265_c2_564 | 2431 | 6203 | 1092 | 363 | 538 | 7.3e-52 |

Description
pir:[LN:F70045] [AC:F70045 ] [PN:two-component sensor histidine kinase homolog yvqE] [GN:yvqE ] [OR:Bacillus subtilis] [DB:pir2] >gp:[GI:e1249816:g2832820] [LN:BS43KBDNA] [AC:AJ223978] [PN:YvqE protein] [GN:yvqE] [OR:Bacillus subtilis] [DB:genpept-bct1] [DE:Bacillus subtilis 42.7kB DNA fragment from yvsA to yvqA.] [LE:32111] [RE:33193] [DI:direct] >gp:[GI:e1184388:g2635806] [LN:BSUB0017] [AC:Z99120:AL009126] [GN:yvqE] [FN:unknown] [OR:Bacillus subtilis] [DB:genpept-bct1] [DE:Bacillus subtilis complete genome (section 17 of 21): from 3197001to 3414420.] [NT:similar to two-component sensor histidine kinase] [LE:197094] [RE:198176] [DI:complement]

| ORF_Name | NTID | AAID | NT Length | AA Length | score | probability |
|---|---|---|---|---|---|---|
| AI7503000994_25678438_c2_583 | 2432 | 6204 | 474 | 157 | 334 | 3.0e-30 |

Description
pir:[LN:E70344] [AC:E70344 ] [PN:conserved hypothetical protein aq_495] [GN:aq_495 ]
[CL:bacterioferritin comigratory protein:alkyl hydroperoxidase c22 protein homology]
[OR:Aquifex aeolicus] [DB:pir2] >gp:[GI:g2983147] [LN:AE000692] [AC:AE000692:AE000657]
[PN:hypothetical protein] [GN:aq_495] [OR:Aquifex aeolicus] [DB:genpept-bct2]
[DE:Aquifex aeolicus section 24 of 109 of the complete genome.] [LE:11182] [RE:11667]
[DI:direct]

| ORF_Name | NTID | AAID | NT Length | AA Length | score | probability |
|---|---|---|---|---|---|---|
| AI7503000994_25781392_f1_54 | 2433 | 6205 | 1029 | 342 | 225 | 5.7e-17 |

Description
pir:[LN:H69815] [AC:H69815 ] [PN:hypothetical protein ygaE] [GN:ygaE ] [OR:Bacillus
subtilis] [DB:pir2] >gp:[GI:e1182859:g2633193] [LN:BSUB0005] [AC:Z99108:AL009126]
[GN:ygaE] [FN:unknown] [OR:Bacillus subtilis] [DB:genpept-bct1] [DE:Bacillus subtilis
complete genome (section 5 of 21): from 802821 to1011250.] [LE:137853] [RE:138914]
[DI:complement] >gp:[GI:e281580:g1673393] [LN:BSZ82044] [AC:Z82044] [PN:hypothetical
40.7 kd protein] [GN:ygaE] [OR:Bacillus subtilis] [DB:genpept-bct1] [DE:B.subtilis 25
kb genomic DNA segment (from sspE to katA).] [LE:4703] [RE:5764] [DI:complement]

| ORF_Name | NTID | AAID | NT Length | AA Length | score | probability |
|---|---|---|---|---|---|---|
| AI7503000994_25790718_c2_541 | 2434 | 6206 | 315 | 104 | 349 | 7.7e-32 |

Description
pir:[LN:B69794] [AC:B69794 ] [PN:hypothetical protein yerC] [GN:yerC ] [OR:Bacillus
subtilis] [DB:pir2] >gp:[GI:g2465565] [LN:AF011544] [AC:AF011544] [PN:YecD] [GN:yecD]
[FN:unknown] [OR:Bacillus subtilis] [DB:genpept-bct1] [DE:Bacillus subtilis
phosphoribosylaminoimidazole-carboxamideformyltransferase (purH-J) gene, partial
cds,phosphoribosylglycinamide synthetase (purD), YecA (yecA), putativeadenine deaminase
(yecB), YecC (yecC), and YecD (yecD) genes,complete cds, and putative glutamate
synthase (yecE) gene, partialcds.] [NT:no apparent homology has been identified]
[LE:6547] [RE:6861] [DI:direct] >gp:[GI:e1182638:g2632972] [LN:BSUB0004]
[AC:Z99107:AL009126] [GN:yerC] [FN:unknown] [OR:Bacillus subtilis] [DB:genpept-bct1]
[DE:Bacillus subtilis complete genome (section 4 of 21): from 600701 to813890.]
[LE:115237] [RE:115551] [DI:direct] >gp:[GI:e1167973:g2577962] [LN:BSYERABCD]
[AC:Y15254] [PN:YerC protein] [GN:yerC] [OR:Bacillus subtilis] [DB:genpept-bct1]
[DE:Bacillus subtilis 13kB DNA fragment, from yerA to sapB gene.] [LE:2882] [RE:3196]
[DI:direct]

| ORF_Name | NTID | AAID | NT Length | AA Length | score | probability |
|---|---|---|---|---|---|---|
| AI7503000994_26177163_c1_466 | 2435 | 6207 | 1272 | 423 | 971 | 9.5e-98 |

Description
sp:[LN:AMPS_BACSU] [AC:P39762] [GN:AMPS] [OR:BACILLUS SUBTILIS] [EC:3.4.11.-]
[DE:AMINOPEPTIDASE AMPS,] [SP:P39762] [DB:swissprot] >pir:[LN:C69585] [AC:C69585 ]
[PN:aminopeptidase ampS] [GN:ampS ] [CL:Bacillus aminopeptidase] [OR:Bacillus subtilis]
[DB:pir2] >gp:[GI:e1185035:g2633816] [LN:BSUB0008] [AC:Z99111:AL009126]
[PN:aminopeptidase] [GN:ampS] [OR:Bacillus subtilis] [DB:genpept-bct1] [EC:3.4.11.-]
[DE:Bacillus subtilis complete genome (section 8 of 21): from 1394791to 1603020.]
[SP:P39762] [LE:119612] [RE:120844] [DI:complement] >gp:[GI:g3282130] [LN:AF012285]
[AC:AF012285:AF012284:U51911] [PN:aminopeptidase] [GN:ampS] [OR:Bacillus subtilis]
[DB:genpept-bct2] [DE:Bacillus subtilis mobA-nprE gene region.] [NT:similar to ampS
gene with GenBan Accession Number] [LE:20100] [RE:21332] [DI:complement]

| ORF Name | NTID | AAID | NT Length | AA Length | score | probability |
|---|---|---|---|---|---|---|
| AI7503000994_26205151_f2_147 | 2436 | 6208 | 156 | 51 | 117 | 3.0e-07 |

Description
pir:[LN:B71245] [AC:B71245 ] [PN:hypothetical protein PH0220] [GN:PH0220 ]
[OR:Pyrococcus horikoshii] [DB:pir2] >gp:[GI:d1030232:g3256606] [LN:AP000001]
[AC:AP000001:AB009465:AB009464:AB009466:AB009467:AB009468:AB009469] [PN:171aa long
hypothetical protein] [GN:PH0220] [OR:Pyrococcus horikoshii] [SR:Pyrococcus horikoshii
(strain:OT3) DNA] [DB:genpept-bct1] [DE:Pyrococcus horikoshii OT3 genomic DNA, 1-287000
nt. position (1/7).] [LE:192864] [RE:193379] [DI:complement]

| ORF Name | NTID | AAID | NT Length | AA Length | score | probability |
|---|---|---|---|---|---|---|
| AI7503000994_26209510_c1_478 | 2437 | 6209 | 165 | 54 | | |

Description
NO-HIT

| ORF Name | NTID | AAID | NT Length | AA Length | score | probability |
|---|---|---|---|---|---|---|
| AI7503000994_26209577_f3_358 | 2438 | 6210 | 1068 | 355 | 892 | 2.2e-89 |

Description
pir:[LN:C69811] [AC:C69811 ] [PN:nitric-oxide synthase homolog yflM] [GN:yflM ]
[OR:Bacillus subtilis] [DB:pir2] >gp:[GI:e1182753:g2633087] [LN:BSUB0005]
[AC:Z99108:AL009126] [GN:yflM] [FN:unknown] [OR:Bacillus subtilis] [DB:genpept-bct1]
[DE:Bacillus subtilis complete genome (section 5 of 21): from 802821 to1011250.]
[NT:similar to nitric-oxide synthase] [LE:33422] [RE:34432] [DI:direct]
>gp:[GI:d1023169:g2443235] [LN:D86417] [AC:D86417] [PN:YflM] [OR:Bacillus subtilis]
[SR:Bacillus subtilis (strain:AC327) DNA] [DB:genpept-bct1] [DE:Bacillus subtilis 35.7
kb genomic DNA, 70-73 degree region,complete cds.] [LE:14090] [RE:15100]
[DI:complement]

| ORF Name | NTID | AAID | NT Length | AA Length | score | probability |
|---|---|---|---|---|---|---|
| AI7503000994_26212875_c3_616 | 2439 | 6211 | 318 | 105 | | |

Description
NO-HIT

| ORF Name | NTID | AAID | NT Length | AA Length | score | probability |
|---|---|---|---|---|---|---|
| AI7503000994_26354787_c2_499 | 2440 | 6212 | 744 | 247 | 121 | 0.00043 |

Description
gp:[GI:g3549261] [LN:AF057019] [AC:AF057019] [PN:interaptin] [GN:abpD]
[OR:Dictyostelium discoideum] [DB:genpept-inv2] [DE:Dictyostelium discoideum interaptin
(abpD) gene, complete cds.] [LE:1861:2796:7392] [RE:2378:7315:7570] [DI:directJoin]

| ORF Name | NTID | AAID | NT Length | AA Length | score | probability |
|---|---|---|---|---|---|---|
| AI7503000994_26369052_f1_91 | 2441 | 6213 | 141 | 46 | 101 | 1.5e-05 |

Description
gp:[GI:g3676415] [LN:AF051917] [AC:AF051917:L19570] [PN:unknown] [OR:Staphylococcus
aureus] [DB:genpept-bct2] [DE:Staphylococcus aureus plasmid pSK41, complete sequence.]
[NT:Orf149] [LE:2068] [RE:2484] [DI:complement]

| ORF Name | NTID | AAID | NT Length | AA Length | score | probability |
|---|---|---|---|---|---|---|
| AI7503000994_26593808_f2_159 | 2442 | 6214 | 981 | 326 | 753 | 1.2e-74 |

Description pir:[LN:H69801] [AC:H69801 ] [PN:hypothetical protein yfhP] [GN:yfhP ] [OR:Bacillus subtilis] [DB:pir2] >gp:[GI:e1182851:g2633185] [LN:BSUB0005] [AC:Z99108:AL009126] [GN:yfhP] [FN:unknown] [OR:Bacillus subtilis] [DB:genpept-bct1] [DE:Bacillus subtilis complete genome (section 5 of 21): from 802821 to1011250.] [LE:131143] [RE:132126] [DI:complement] >gp:[GI:d1025398:g2804546] [LN:D85082] [AC:D85082] [PN:YfhP] [OR:Bacillus subtilis] [SR:Bacillus subtilis DNA] [DB:genpept-bct1] [DE:Bacillus subtilis DNA, genome sequence, 79 to 81 degree region.] [LE:24034] [RE:25017] [DI:complement]

| ORF Name | NTID | AAID | NT Length | AA Length | score | probability |
|---|---|---|---|---|---|---|
| AI7503000994_26689703_c3_679 | 2443 | 6215 | 453 | 150 | 562 | 2.1e-54 |

Description sp:[LN:FUR3_BACSU] [AC:P71086] [GN:YGAG] [OR:BACILLUS SUBTILIS] [DE:FERRIC UPTAKE REGULATION PROTEIN HOMOLOG 3] [SP:P71086] [DB:swissprot] >pir:[LN:B69816] [AC:B69816 ] [PN:transcription regulator Fur family homolog ygaG] [GN:ygaG ] [CL:ferric uptake regulator] [OR:Bacillus subtilis] [DB:pir2] >gp:[GI:e1182862:g2633196] [LN:BSUB0005] [AC:Z99108:AL009126] [GN:ygaG] [FN:unknown] [OR:Bacillus subtilis] [DB:genpept-bct1] [DE:Bacillus subtilis complete genome (section 5 of 21): from 802821 to1011250.] [NT:similar to transcriptional regulator (Fur family)] [SP:P71086] [LE:141173] [RE:141610] [DI:direct] >gp:[GI:e281583:g1673396] [LN:BSZ82044] [AC:Z82044] [PN:hypothetical 16.4 kd protein] [GN:ygaG] [OR:Bacillus subtilis] [DB:genpept-bct1] [DE:B.subtilis 25 kb genomic DNA segment (from sspE to katA).] [NT:homology to ferric uptake regulation protein] [SP:P71086] [LE:8023] [RE:8460] [DI:direct]

| ORF Name | NTID | AAID | NT Length | AA Length | score | probability |
|---|---|---|---|---|---|---|
| AI7503000994_26756500_c3_654 | 2444 | 6216 | 777 | 258 | 721 | 2.9e-71 |

Description pir:[LN:E69810] [AC:E69810 ] [PN:methionine aminopeptidase homolog yflG] [GN:yflG ] [CL:Escherichia coli methionyl aminopeptidase] [OR:Bacillus subtilis] [DB:pir2] >gp:[GI:e1182759:g2633093] [LN:BSUB0005] [AC:Z99108:AL009126] [GN:yflG] [FN:unknown] [OR:Bacillus subtilis] [DB:genpept-bct1] [DE:Bacillus subtilis complete genome (section 5 of 21): from 802821 to1011250.] [NT:similar to methionine aminopeptidase] [LE:36423] [RE:37172] [DI:complement] >gp:[GI:d1023163:g2443229] [LN:D86417] [AC:D86417] [PN:YflG] [OR:Bacillus subtilis] [SR:Bacillus subtilis (strain:AC327) DNA] [DB:genpept-bct1] [DE:Bacillus subtilis 35.7 kb genomic DNA, 70-73 degree region,complete cds.] [LE:11350] [RE:12099] [DI:direct]

| ORF Name | NTID | AAID | NT Length | AA Length | score | probability |
|---|---|---|---|---|---|---|
| AI7503000994_26757312_f3_321 | 2445 | 6217 | 1197 | 398 | 577 | 5.3e-56 |

Description gp:[GI:e1423916:g4584097] [LN:BAJ10131] [AC:AJ010131] [GN:yfkH] [OR:Bacillus cereus] [DB:genpept-bct1] [DE:Bacillus cereus yfkH gene and partial ykvW, bc333c genes.] [LE:863] [RE:1732] [DI:complement]

| ORF Name | NTID | AAID | NT Length | AA Length | score | probability |
|---|---|---|---|---|---|---|
| AI7503000994_285808_f2_146 | 2446 | 6218 | 225 | 74 | | |

Description

NO-HIT

| ORF Name | NTID | AAID | NT Length | AA Length | score | probability |
|---|---|---|---|---|---|---|
| AI7503000994_29307187_c3_687 | 2447 | 6219 | 165 | 54 | | |

Description
NO-HIT

| ORF Name | NTID | AAID | NT Length | AA Length | score | probability |
|---|---|---|---|---|---|---|
| AI7503000994_29500277_f3_392 | 2448 | 6220 | 171 | 56 | 169 | 9.2e-13 |

Description
gp:[GI:g1196510] [LN:MSGTCWPA] [AC:M15467] [PN:unknown protein] [OR:Mycobacterium tuberculosis] [SR:Mycobacterium tuberculosis (strain Erdman) DNA] [DB:genpept-bct1] [DE:M.tuberculosis 65 kDa antigen (cell wall protein a) gene.] [NT:ORF F175; putative] [LE:242] [RE:769] [DI:complement]

| ORF Name | NTID | AAID | NT Length | AA Length | score | probability |
|---|---|---|---|---|---|---|
| AI7503000994_2992943_c1_425 | 2449 | 6221 | 624 | 207 | 382 | 2.5e-35 |

Description
gp:[GI:g4981569] [LN:AE001764] [AC:AE001764:AE000512] [PN:ABC transporter, ATP-binding protein] [GN:TM1028] [OR:Thermotoga maritima] [DB:genpept-bct2] [DE:Thermotoga maritima section 76 of 136 of the complete genome.] [NT:similar to GB:AE000782 percent identity: 60.48;] [LE:5922] [RE:6803] [DI:direct]

| ORF Name | NTID | AAID | NT Length | AA Length | score | probability |
|---|---|---|---|---|---|---|
| AI7503000994_30265640_c3_693 | 2450 | 6222 | 1080 | 359 | 684 | 2.4e-67 |

Description
pir:[LN:E71373] [AC:E71373 ] [PN:probable regulatory protein (pfoS/R)] [GN:TP0038 ] [OR:Treponema pallidum subsp. pallidum] [SR:, syphilis spirochete] [DB:pir2]
>gp:[GI:g3322295] [LN:AE001189] [AC:AE001189:AE000520] [PN:regulatory protein (pfoS/R)] [GN:TP0038] [OR:Treponema pallidum] [DB:genpept-bct2] [DE:Treponema pallidum section 5 of 87 of the complete genome.] [NT:similar to GP:1354775 percent identity: 100.00;] [LE:1177] [RE:2229] [DI:complement]

| ORF Name | NTID | AAID | NT Length | AA Length | score | probability |
|---|---|---|---|---|---|---|
| AI7503000994_30506437_c2_517 | 2451 | 6223 | 177 | 58 | | |

Description
NO-HIT

| ORF Name | NTID | AAID | NT Length | AA Length | score | probability |
|---|---|---|---|---|---|---|
| AI7503000994_30677268_c1_419 | 2452 | 6224 | 171 | 56 | | |

Description
NO-HIT

| ORF Name | NTID | AAID | NT Length | AA Length | score | probability |
|---|---|---|---|---|---|---|
| AI7503000994_31273377_f1_113 | 2453 | 6225 | 171 | 56 | | |

Description
NO-HIT

| ORF Name | NTID | AAID | NT Length | AA Length | score | probability |
|---|---|---|---|---|---|---|
| AI7503000994_3128452_c1_438 | 2454 | 6226 | 132 | 43 | | |

Description
NO-HIT

| ORF Name | NTID | AAID | NT Length | AA Length | score | probability |
|---|---|---|---|---|---|---|
| AI7503000994_31289637_c2_545 | 2455 | 6227 | 123 | 40 | | |

Description
NO-HIT

| ORF Name | NTID | AAID | NT Length | AA Length | score | probability |
|---|---|---|---|---|---|---|
| AI7503000994_31534456_c3_689 | 2456 | 6228 | 156 | 51 | | |

Description
NO-HIT

| ORF Name | NTID | AAID | NT Length | AA Length | score | probability |
|---|---|---|---|---|---|---|
| AI7503000994_32037826_c1_451 | 2457 | 6229 | 1476 | 491 | 1119 | 2.0e-113 |

Description
pir:[LN:E69793] [AC:E69793 ] [PN:RNA methyltransferase homolog yefA] [GN:yefA ]
[OR:Bacillus subtilis] [DB:pir2] >gp:[GI:e1182653:g2632987] [LN:BSUB0004]
[AC:Z99107:AL009126] [GN:yefA] [FN:unknown] [OR:Bacillus subtilis] [DB:genpept-bct1]
[DE:Bacillus subtilis complete genome (section 4 of 21): from 600701 to813890.]
[NT:alternate gene name: yerS; similar to RNA] [LE:136409] [RE:137788] [DI:direct]

| ORF Name | NTID | AAID | NT Length | AA Length | score | probability |
|---|---|---|---|---|---|---|
| AI7503000994_3251577_c3_642 | 2458 | 6230 | 2190 | 729 | 3095 | 0.0 |

Description
sp:[LN:PCRA_STAAU] [AC:Q53727] [GN:PCRA] [OR:STAPHYLOCOCCUS AUREUS] [EC:3.6.1.-]
[DE:ATP-DEPENDENT HELICASE PCRA,] [SP:Q53727] [DB:swissprot] >pir:[LN:S39923]
[AC:S39923:S27667 ] [PN:DNA helicase pcrA] [GN:pcrA ] [CL:helicase II]
[OR:Staphylococcus aureus] [DB:pir2] >gp:[GI:g153062] [LN:STAPCRA] [AC:M63176]
[PN:helicase] [GN:pcrA] [OR:Staphylococcus aureus] [SR:Staphylococcus aureus (strain
SA20) DNA] [DB:genpept-bct1] [DE:Staphylococcus aureus helicase required for T181
replication (pcrA)gene, complete cds.] [LE:943] [RE:2970] [DI:direct]

| ORF Name | NTID | AAID | NT Length | AA Length | score | probability |
|---|---|---|---|---|---|---|
| AI7503000994_32634387_f2_133 | 2459 | 6231 | 198 | 65 | | |

Description
NO-HIT

| ORF Name | NTID | AAID | NT Length | AA Length | score | probability |
|---|---|---|---|---|---|---|
| AI7503000994_32680_c3_692 | 2460 | 6232 | 936 | 311 | 776 | 4.4e-77 |

Description sp:[LN:STSP_STAAU] [AC:P04188] [OR:STAPHYLOCOCCUS AUREUS] [EC:3.4.21.19]
[DE:PROTEINASE) (V8 PROTEINASE) (ENDOPROTEINASE GLU-C)] [SP:P04188] [DB:swissprot]
>pir:[LN:PRSASK] [AC:A26812:A00966 ] [PN:glutamyl endopeptidase,
precursor:staphylococcal serine proteinase] [CL:staphylococcal serine proteinase]
[OR:Staphylococcus aureus] [EC:3.4.21.19] [DB:pir1] >gp:[GI:g46687] [LN:SASP]
[AC:Y00356] [OR:Staphylococcus aureus] [DB:genpept-bct1] [DE:Staphylococcus aureus V8
serine protease gene.] [NT:preproenzyme (AA -68 to 268)] [SP:P04188] [LE:354] [RE:1364]
[DI:direct]

| ORF Name | NTID | AAID | NT Length | AA Length | score | probability |
|---|---|---|---|---|---|---|
| AI7503000994_32689162_f3_397 | 2461 | 6233 | 807 | 268 | 1384 | 1.6e-141 |

Description gp:[GI:g2981299] [LN:AF012132] [AC:AF012132] [PN:unknown] [GN:orf5] [OR:Staphylococcus
epidermidis] [DB:genpept-bct2] [DE:Staphylococcus epidermidis agr system including
response regulator(agrA), histidine kinase (agrC), AgrD (agrD), AgrB (agrB) and
deltatoxin (hld) genes, complete cds.] [NT:similar to S. aureus and S. lugdunensis
orf5] [LE:3778] [RE:4572] [DI:complement]

| ORF Name | NTID | AAID | NT Length | AA Length | score | probability |
|---|---|---|---|---|---|---|
| AI7503000994_32696088_c2_580 | 2462 | 6234 | 1749 | 582 | 1899 | 4.3e-196 |

Description pir:[LN:G69815] [AC:G69815 ] [PN:ABC transporter (ATP-binding protein) homolog ygaD]
[GN:ygaD ] [CL:ATP-binding cassette homology] [OR:Bacillus subtilis] [DB:pir2]
>gp:[GI:e1182858:g2633192] [LN:BSUB0005] [AC:Z99108:AL009126] [GN:ygaD] [FN:unknown]
[OR:Bacillus subtilis] [DB:genpept-bct1] [DE:Bacillus subtilis complete genome (section
5 of 21): from 802821 to1011250.] [NT:similar to ABC transporter (ATP-binding protein)]
[LE:136007] [RE:137776] [DI:direct] >gp:[GI:e281579:g1673392] [LN:BSZ82044] [AC:Z82044]
[PN:unidentified transporter-ATP binding] [GN:ygaD] [OR:Bacillus subtilis]
[DB:genpept-bct1] [DE:B.subtilis 25 kb genomic DNA segment (from sspE to katA).]
[LE:2857] [RE:4626] [DI:direct]

| ORF Name | NTID | AAID | NT Length | AA Length | score | probability |
|---|---|---|---|---|---|---|
| AI7503000994_33237786_f3_316 | 2463 | 6235 | 132 | 43 | | |

Description

NO-HIT

| ORF Name | NTID | AAID | NT Length | AA Length | score | probability |
|---|---|---|---|---|---|---|
| AI7503000994_3330167_f3_398 | 2464 | 6236 | 132 | 43 | | |

Description

NO-HIT

| ORF Name | NTID | AAID | NT Length | AA Length | score | probability |
|---|---|---|---|---|---|---|
| AI7503000994_33456965_c2_592 | 2465 | 6237 | 138 | 45 | | |

Description

NO-HIT

| ORF Name | NTID | AAID | NT Length | AA Length | score | probability |
|---|---|---|---|---|---|---|
| AI7503000994_33463542_c1_487 | 2466 | 6238 | 180 | 59 | | |

Description
NO-HIT

| ORF Name | NTID | AAID | NT Length | AA Length | score | probability |
|---|---|---|---|---|---|---|
| AI7503000994_3361326_c2_588 | 2467 | 6239 | 207 | 68 | | |

Description
NO-HIT

| ORF Name | NTID | AAID | NT Length | AA Length | score | probability |
|---|---|---|---|---|---|---|
| AI7503000994_33631292_c1_461 | 2468 | 6240 | 414 | 137 | 84 | 0.048 |

Description
gp:[GI:g2182758] [LN:BBU42599] [AC:U42599] [OR:Borrelia burgdorferi] [SR:Lyme disease spirochete] [DB:genpept-bct1] [DE:Borrelia burgdorferi plasmid cp18, OspE (ospE) gene, partial cds.] [NT:OrfE] [LE:1395] [RE:1967] [DI:direct]

| ORF Name | NTID | AAID | NT Length | AA Length | score | probability |
|---|---|---|---|---|---|---|
| AI7503000994_33631626_c1_489 | 2469 | 6241 | 132 | 43 | | |

Description
NO-HIT

| ORF Name | NTID | AAID | NT Length | AA Length | score | probability |
|---|---|---|---|---|---|---|
| AI7503000994_3392952_c1_410 | 2470 | 6242 | 591 | 196 | 195 | 1.6e-15 |

Description
gp:[GI:e247149:g1926347] [LN:LBPHIG1E] [AC:X98106] [GN:Rorf172] [OR:Bacteriophage phig1e] [DB:genpept-phg] [DE:Lactobacillus bacteriophage phig1e complete genomic DNA.] [LE:29618] [RE:30136] [DI:complement]

| ORF Name | NTID | AAID | NT Length | AA Length | score | probability |
|---|---|---|---|---|---|---|
| AI7503000994_34023427_c3_651 | 2471 | 6243 | 123 | 40 | | |

Description
NO-HIT

| ORF Name | NTID | AAID | NT Length | AA Length | score | probability |
|---|---|---|---|---|---|---|
| AI7503000994_34164192_c3_640 | 2472 | 6244 | 138 | 45 | | |

Description
NO-HIT

| ORF Name | NTID | AAID | NT Length | AA Length | score | probability |
|---|---|---|---|---|---|---|
| AI7503000994_34275325_c2_576 | 2473 | 6245 | 1521 | 506 | 238 | 5.0e-17 |

Description
sp:[LN:TAGH_BACSU] [AC:P42954] [GN:TAGH] [OR:BACILLUS SUBTILIS] [DE:TEICHOIC ACID TRANSLOCATION ATP-BINDING PROTEIN TAGH] [SP:P42954] [DB:swissprot] >pir:[LN:S69203] [AC:S69203:A69721 ] [PN:teichoic acid translocation ATP-binding protein tagH] [GN:tagH ] [CL:ATP-binding cassette homology] [OR:Bacillus subtilis] [DB:pir2] >gp:[GI:g755153] [LN:BSU13832] [AC:U13832] [PN:ATP-binding protein] [GN:tagH] [FN:teichoic acid translocation] [OR:Bacillus subtilis] [DB:genpept-bct1] [DE:Bacillus subtilis 168 highly hydrophobic integral membrane protein(tagG) gene and ATP-binding protein (tagH) gene, complete cds.] [LE:1134] [RE:2717] [DI:direct] >gp:[GI:e1184476:g2636096] [LN:BSUB0019] [AC:Z99122:AL009126] [PN:ATP-binding protein] [GN:tagH] [FN:teichoic acid translocation] [OR:Bacillus subtilis] [DB:genpept-bct1] [DE:Bacillus subtilis complete genome (section 19 of 21): from 3597091to 3809700.] [SP:P42954] [LE:75534] [RE:77117] [DI:complement] >gp:[GI:e1184476:g2636096] [LN:BSUB0019] [AC:Z99122:AL009126] [PN:ATP-binding protein] [GN:tagH] [FN:teichoic acid translocation] [OR:Bacillus subtilis] [DB:genpept] [DE:Bacillus subtilis complete genome (section 19 of 21): from 3597091to 3809700.] [SP:P42954] [LE:75534] [RE:77117] [DI:complement]

| ORF Name | NTID | AAID | NT Length | AA Length | score | probability |
|---|---|---|---|---|---|---|
| AI7503000994_34383400_c3_618 | 2474 | 6246 | 582 | 193 | 78 | 0.010 |

Description
gp:[GI:g4726117] [LN:ATAC006436] [AC:AC006436] [GN:F13J11.13] [OR:Arabidopsis thaliana] [SR:thale cress] [DB:genpept-pln2] [DE:Arabidopsis thaliana chromosome II BAC F13J11 genomic sequence,complete sequence.] [NT:unknown protein] [LE:50474] [RE:50725] [DI:direct]

| ORF Name | NTID | AAID | NT Length | AA Length | score | probability |
|---|---|---|---|---|---|---|
| AI7503000994_34557262_c2_585 | 2475 | 6247 | 135 | 44 | | |

Description
NO-HIT

| ORF Name | NTID | AAID | NT Length | AA Length | score | probability |
|---|---|---|---|---|---|---|
| AI7503000994_34572177_c2_513 | 2476 | 6248 | 735 | 244 | 147 | 1.5e-08 |

Description
pir:[LN:S42928] [AC:S42928 ] [PN:probable membrane-spanning protein] [OR:Staphylococcus epidermidis] [DB:pir2] >gp:[GI:g459263] [LN:SESTPSMP] [AC:Z30586] [PN:membrane spanning protein (putative)] [OR:Staphylococcus epidermidis] [DB:genpept-bct1] [DE:S.epidermidis (968) genes for potential ABC transporter andpotential membrane spanning protein.] [LE:896] [RE:1666] [DI:direct]

| ORF Name | NTID | AAID | NT Length | AA Length | score | probability |
|---|---|---|---|---|---|---|
| AI7503000994_34652177_c3_656 | 2477 | 6249 | 648 | 215 | 546 | 1.0e-52 |

Description
pir:[LN:E70045] [AC:E70045 ] [PN:two-component response regulator [YvqE] homolog yvqC] [GN:yvqC ] [CL:regulatory protein comA:response regulator homology] [OR:Bacillus subtilis] [DB:pir2] >gp:[GI:e1249817:g2832821] [LN:BS43KBDNA] [AC:AJ223978] [PN:YvqC protein] [GN:yvqC] [OR:Bacillus subtilis] [DB:genpept-bct1] [DE:Bacillus subtilis 42.7kB DNA fragment from yvsA to yvqA.] [LE:33171] [RE:33806] [DI:direct] >gp:[GI:e1184387:g2635805] [LN:BSUB0017] [AC:Z99120:AL009126] [GN:yvqC] [FN:unknown] [OR:Bacillus subtilis] [DB:genpept-bct1] [DE:Bacillus subtilis complete genome (section 17 of 21): from 3197001to 3414420.] [NT:similar to two-component response regulator [YvqE]] [LE:196481] [RE:197116] [DI:complement]

| ORF_Name | NTID | AAID | NT Length | AA Length | score | probability |
|---|---|---|---|---|---|---|
| AI7503000994_35428128_c3_635 | 2478 | 6250 | 141 | 46 | | |

Description
NO-HIT

| ORF_Name | NTID | AAID | NT Length | AA Length | score | probability |
|---|---|---|---|---|---|---|
| AI7503000994_35443785_c2_562 | 2479 | 6251 | 207 | 68 | | |

Description
NO-HIT

| ORF_Name | NTID | AAID | NT Length | AA Length | score | probability |
|---|---|---|---|---|---|---|
| AI7503000994_35885_f3_383 | 2480 | 6252 | 504 | 167 | | |

Description
NO-HIT

| ORF_Name | NTID | AAID | NT Length | AA Length | score | probability |
|---|---|---|---|---|---|---|
| AI7503000994_36119093_c3_643 | 2481 | 6253 | 2001 | 666 | 2102 | 1.3e-217 |

Description
pir:[LN:F69794] [AC:F69794 ] [PN:DNA ligase (NAD+),] [GN:yerG ]
[CL:polydeoxyribonucleotide synthase (NAD+)] [OR:Bacillus subtilis] [EC:6.5.1.2]
[DB:pir1] >gp:[GI:e1182642:g2632976] [LN:BSUB0004] [AC:Z99107:AL009126] [GN:yerG]
[FN:unknown] [OR:Bacillus subtilis] [DB:genpept-bct1] [DE:Bacillus subtilis complete
genome (section 4 of 21): from 600701 to813890.] [NT:similar to DNA ligase] [LE:120419]
[RE:122425] [DI:direct]

| ORF_Name | NTID | AAID | NT Length | AA Length | score | probability |
|---|---|---|---|---|---|---|
| AI7503000994_36195250_f3_359 | 2482 | 6254 | 822 | 273 | 375 | 1.4e-34 |

Description
sp:[LN:PHEA_METJA] [AC:Q58054] [GN:PHEA:MJ0637] [OR:METHANOCOCCUS JANNASCHII]
[EC:4.2.1.51] [DE:PROBABLE PREPHENATE DEHYDRATASE, (PDT)] [SP:Q58054] [DB:swissprot]
>pir:[LN:E64379] [AC:E64379 ] [PN:prephenate dehydratase,] [CL:prephenate
dehydratase:prephenate dehydratase homology] [OR:Methanococcus jannaschii]
[EC:4.2.1.51] [DB:pir2] [MP:REV567914-567096 ] >gp:[GI:g1591349] [LN:U67511]
[AC:U67511:L77117] [PN:chorismate mutase/prephenate dehydratase (pheA)] [GN:MJ0637]
[OR:Methanococcus jannaschii] [DB:genpept-bct2] [DE:Methanococcus jannaschii section 53
of 150 of the complete genome.] [NT:similar to SP:P43909 PID:683585 percent identity:]
[LE:7667] [RE:8485] [DI:complement]

| ORF_Name | NTID | AAID | NT Length | AA Length | score | probability |
|---|---|---|---|---|---|---|
| AI7503000994_36219692_c3_648 | 2483 | 6255 | 561 | 186 | 133 | 2.0e-08 |

Description
pir:[LN:A36886] [AC:A36886 ] [PN:surface protein PAg negative regulator par] [GN:par ]
[OR:Streptococcus sobrinus] [DB:pir2] >gp:[GI:d1003084:g425488] [LN:STRREPRESP]
[AC:D13323] [PN:repressor protein] [GN:par] [OR:Streptococcus sobrinus]
[SR:Streptococcus sobrinus (strain MT3791) DNA, clone pPG11] [DB:genpept-bct1]
[DE:Streptococcus sobrinus gene for repressor protein of surfaceprotein antigen gene
(pag), complete cds.] [NT:This ORF2 starts at the GTG codon (position 1162)] [LE:1162]
[RE:1773] [DI:direct]

| ORF_Name | NTID | AAID | NT Length | AA Length | score | probability |
|---|---|---|---|---|---|---|
| AI7503000994_36220000_c2_525 | 2484 | 6256 | 1047 | 348 | 557 | 7.0e-54 |

Description
pir:[LN:D69856] [AC:D69856 ] [PN:conserved hypothetical protein ykgB] [GN:ykgB ]
[OR:Bacillus subtilis] [DB:pir2] >gp:[GI:e1181502:g2632022] [LN:BSAJ2571] [AC:AJ002571]
[PN:YkgB] [GN:ykgB] [FN:unknown] [OR:Bacillus subtilis] [DB:genpept-bct1] [DE:Bacillus
subtilis 168 56 kb DNA fragment between xlyA and ykoR.] [LE:22000] [RE:23049]
[DI:complement] >gp:[GI:e1183321:g2633655] [LN:BSUB0007] [AC:Z99110:AL009126] [GN:ykgB]
[FN:unknown] [OR:Bacillus subtilis] [DB:genpept-bct1] [DE:Bacillus subtilis complete
genome (section 7 of 21): from 1194391to 1411140.] [NT:similar to hypothetical
proteins] [LE:174949] [RE:175998] [DI:complement]

| ORF_Name | NTID | AAID | NT Length | AA Length | score | probability |
|---|---|---|---|---|---|---|
| AI7503000994_36221013_t2_135 | 2485 | 6257 | 171 | 56 | | |

Description
NO-HIT

| ORF_Name | NTID | AAID | NT Length | AA Length | score | probability |
|---|---|---|---|---|---|---|
| AI7503000994_36336012_c3_664 | 2486 | 6258 | 165 | 54 | | |

Description
NO-HIT

| ORF_Name | NTID | AAID | NT Length | AA Length | score | probability |
|---|---|---|---|---|---|---|
| AI7503000994_36367302_c3_600 | 2487 | 6259 | 564 | 187 | 122 | 2.7e-06 |

Description
sp:[LN:Y359_METJA] [AC:Q57805] [GN:MJ0359] [OR:METHANOCOCCUS JANNASCHII]
[DE:HYPOTHETICAL PROTEIN MJ0359] [SP:Q57805] [DB:swissprot] >pir:[LN:G64344] [AC:G64344
] [PN:hypothetical protein MJ0359] [OR:Methanococcus jannaschii] [DB:pir2]
[MP:REV327449-326805 ] >gp:[GI:g1591068] [LN:U67489] [AC:U67489:L77117] [PN:M.
jannaschii predicted coding region MJ0359] [GN:MJ0359] [OR:Methanococcus jannaschii]
[DB:genpept-bct2] [DE:Methanococcus jannaschii section 31 of 150 of the complete
genome.] [NT:hypothetical protein; identified by GeneMark;] [LE:2497] [RE:3141]
[DI:complement]

| ORF_Name | NTID | AAID | NT Length | AA Length | score | probability |
|---|---|---|---|---|---|---|
| AI7503000994_36457341_c2_593 | 2488 | 6260 | 135 | 44 | 81 | 0.019 |

Description
pir:[LN:S75730] [AC:S75730:S50064 ] [PN:8-amino-7-oxononanoate
synthase,:7-keto-8-aminopelargonic acid synthetase:protein
slr0917:7-keto-8-aminopelargonic acid synthetase:protein slr0917] [GN:bioF ]
[CL:5-aminolevulinate synthase] [OR:Synechocystis sp.] [SR:PCC 6803, , PCC 6803]
[SR:PCC 6803, ] [EC:2.3.1.47] [DB:pir2] >gp:[GI:d1011116:g1673311] [LN:SYCSLLE]
[AC:D64003:AB001339] [PN:7-keto-8-aminopelargonic acid synthetase] [GN:bioF]
[OR:Synechocystis sp.] [SR:Synechocystis sp. (strain:PCC6803) DNA] [DB:genpept-bct1]
[DE:Synechocystis sp. PCC6803 complete genome, 22/27, 2755703-2868766.]
[NT:ORF_ID:slr0917] [LE:35986] [RE:37299] [DI:direct]

| ORF Name | NTID | AAID | NT Length | AA Length | score | probability |
|---|---|---|---|---|---|---|
| AI7503000994_36522175_f1_69 | 2489 | 6261 | 1557 | 518 | 2240 | 3.2e-232 |

Description
gp:[GI:g2565311] [LN:AF024571] [AC:AF024571] [PN:high affinity proline permease]
[GN:putP] [OR:Staphylococcus aureus] [DB:genpept-bct2] [DE:Staphylococcus aureus high
affinity proline permease (putP) gene,complete cds.] [LE:339] [RE:1832] [DI:direct]

| ORF Name | NTID | AAID | NT Length | AA Length | score | probability |
|---|---|---|---|---|---|---|
| AI7503000994_39077_f2_270 | 2490 | 6262 | 717 | 238 | 1223 | 1.9e-124 |

Description
gp:[GI:g2981294] [LN:AF012132] [AC:AF012132] [PN:response regulator] [GN:agrA]
[OR:Staphylococcus epidermidis] [DB:genpept-bct2] [DE:Staphylococcus epidermidis agr
system including response regulator(agrA), histidine kinase (agrC), AgrD (agrD), AgrB
(agrB) and deltatoxin (hld) genes, complete cds.] [NT:AgrA; similar to S. aureus and S.
lugdunensis AgrA] [LE:242] [RE:958] [DI:complement]

| ORF Name | NTID | AAID | NT Length | AA Length | score | probability |
|---|---|---|---|---|---|---|
| AI7503000994_3939013_c2_573 | 2491 | 6263 | 210 | 69 | 109 | 2.1e-06 |

Description
pir:[LN:C69807] [AC:C69807 ] [PN:hypothetical protein yfjT] [GN:yfjT ] [OR:Bacillus
subtilis] [DB:pir2] >gp:[GI:e1182787:g2633121] [LN:BSUB0005] [AC:Z99108:AL009126]
[GN:yfjT] [FN:unknown] [OR:Bacillus subtilis] [DB:genpept-bct1] [DE:Bacillus subtilis
complete genome (section 5 of 21): from 802821 to1011250.] [LE:65959] [RE:66144]
[DI:direct] >gp:[GI:d1024269:g2626812] [LN:D83967] [AC:D83967] [PN:YfjT] [OR:Bacillus
subtilis] [SR:Bacillus subtilis (strain:AC327) DNA] [DB:genpept-bct1] [DE:Bacillus
subtilis genomic DNA, 74 degree region.] [LE:1777] [RE:1962] [DI:complement]

| ORF Name | NTID | AAID | NT Length | AA Length | score | probability |
|---|---|---|---|---|---|---|
| AI7503000994_3942015_c1_471 | 2492 | 6264 | 528 | 175 | 790 | 1.4e-78 |

Description
sp:[LN:YLY1_STAAU] [AC:Q53719] [OR:STAPHYLOCOCCUS AUREUS] [DE:HYPOTHETICAL 18.6 KD
PROTEIN IN LYTA 3'REGION (ORF1)] [SP:Q53719] [DB:swissprot] >gp:[GI:g310602]
[LN:STAORFPHI] [AC:L19300] [OR:Staphylococcus aureus] [SR:Staphylococcus aureus
(library: NCTC 8325) DNA] [DB:genpept-bct1] [DE:Staphylococcus aureus DNA sequence
encoding three ORFs, completecds; prophage phi-11 sequence homology, 5' flank.]
[LE:1798] [RE:2313] [DI:direct]

| ORF Name | NTID | AAID | NT Length | AA Length | score | probability |
|---|---|---|---|---|---|---|
| AI7503000994_4021888_c3_615 | 2493 | 6265 | 669 | 222 | 83 | 0.0039 |

Description
pir:[LN:D71114] [AC:D71114 ] [PN:hypothetical protein PH0683] [GN:PH0683 ]
[OR:Pyrococcus horikoshii] [DB:pir2] >gp:[GI:d1030717:g3257091] [LN:AP000003]
[AC:AP000003:AB009484:AB009485:AB009486:AB009487:AB009488:AB009489] [PN:107aa long
hypothetical protein] [GN:PH0683] [OR:Pyrococcus horikoshii] [SR:Pyrococcus horikoshii
(strain:OT3) DNA] [DB:genpept-bct1] [DE:Pyrococcus horikoshii OT3 genomic DNA,
544001-777000 nt. position(3/7).] [LE:63024] [RE:63347] [DI:complement]

| ORF Name | NTID | AAID | NT Length | AA Length | score | probability |
|---|---|---|---|---|---|---|
| AI7503000994_4062500_c2_507 | 2494 | 6266 | 1401 | 466 | 502 | 3.3e-47 |

Description
gp:[GI:e1314011:g3393011] [LN:SAA224764] [AC:AJ224764] [PN:Clumping factor B] [GN:clfB] [FN:binds fibrinogen] [OR:Staphylococcus aureus] [DB:genpept-bct1] [DE:Staphylococcus aureus strain Newman clumping factor B (clfB) gene.] [LE:28] [RE:2769] [DI:direct]

| ORF Name | NTID | AAID | NT Length | AA Length | score | probability |
|---|---|---|---|---|---|---|
| AI7503000994_4072936_c1_453 | 2495 | 6267 | 153 | 50 | | |

Description
NO-HIT

| ORF Name | NTID | AAID | NT Length | AA Length | score | probability |
|---|---|---|---|---|---|---|
| AI7503000994_4093753_f3_387 | 2496 | 6268 | 126 | 41 | | |

Description
NO-HIT

| ORF Name | NTID | AAID | NT Length | AA Length | score | probability |
|---|---|---|---|---|---|---|
| AI7503000994_4095277_c3_627 | 2497 | 6269 | 1827 | 608 | 2760 | 2.5e-287 |

Description
pir:[LN:S11783] [AC:S11783:S27371:S34445 ] [PN:bla regulator protein blaR1:probable beta-lactam receptor signal transducer protein] [GN:blaR1 ] [CL:mecR1 protein:beta-lactamase OXA2 homology] [OR:Staphylococcus aureus] [DB:pir2] >gp:[GI:g152966] [LN:STABLA] [AC:M62650] [GN:blaR1] [FN:putative beta-lactam receptor-signal] [OR:Staphylococcus aureus] [SR:Staphylococcus aureus DNA] [DB:genpept-bct1] [DE:Staphylococcus aureus blaZ gene, 5' end; blaR1 gene, complete cds;blaI gene, complete cds; and binR gene, 5' end.] [LE:156] [RE:1913] [DI:direct]

| ORF Name | NTID | AAID | NT Length | AA Length | score | probability |
|---|---|---|---|---|---|---|
| AI7503000994_409556_f1_10 | 2498 | 6270 | 135 | 44 | 112 | 2.5e-06 |

Description
pir:[LN:D71245] [AC:D71245 ] [PN:hypothetical protein PH0221] [GN:PH0221 ] [OR:Pyrococcus horikoshii] [DB:pir2] >gp:[GI:d1030234:g3256608] [LN:AP000001] [AC:AP000001:AB009465:AB009464:AB009466:AB009467:AB009468:AB009469] [PN:235aa long hypothetical protein] [GN:PH0221] [OR:Pyrococcus horikoshii] [SR:Pyrococcus horikoshii (strain:OT3) DNA] [DB:genpept-bct1] [DE:Pyrococcus horikoshii OT3 genomic DNA, 1-287000 nt. position (1/7).] [LE:194212] [RE:194919] [DI:complement]

| ORF Name | NTID | AAID | NT Length | AA Length | score | probability |
|---|---|---|---|---|---|---|
| AI7503000994_4101517_f1_100 | 2499 | 6271 | 1068 | 355 | | |

Description
NO-HIT

| ORF_Name | NTID | AAID | NT Length | AA Length | score | probability |
|---|---|---|---|---|---|---|
| AI7503000994_4179637_c3_622 | 2500 | 6272 | 387 | 128 | 207 | 8.6e-17 |

Description
sp:[LN:TRAC_STAAU] [AC:P06698] [GN:TNPC] [OR:STAPHYLOCOCCUS AUREUS] [DE:TRANSPOSASE FOR TRANSPOSON TN554] [SP:P06698] [DB:swissprot] >pir:[LN:C24584] [AC:C24584 ] [PN:transposition regulatory protein tnpC] [GN:tnpC ] [CL:transposition regulatory protein tnpC] [OR:Staphylococcus aureus] [DB:pir2] >gp:[GI:g43729] [LN:ISTN554] [AC:X03216:K02987] [PN:pot. tnpC protein] [OR:Staphylococcus aureus] [DB:genpept-bct1] [DE:Staphylococcus aureus transposon Tn554.] [NT:(aa 1-125)] [SP:P06698] [LE:3115] [RE:3492] [DI:direct] >gp:[GI:d1046009:g5360833] [LN:D86934] [AC:D86934] [PN:transposaseC] [GN:tnpC] [OR:Staphylococcus aureus] [SR:Staphylococcus aureus (strain:N315) DNA, clone_lib:library of N31] [DB:genpept] [DE:Staphylococcus aureus genes, mec region, partial and complete cds.] [NT:ORF N047] [LE:32364] [RE:32741] [DI:direct]

| ORF_Name | NTID | AAID | NT Length | AA Length | score | probability |
|---|---|---|---|---|---|---|
| AI7503000994_430325_c1_456 | 2501 | 6273 | 1383 | 460 | 649 | 1.3e-63 |

Description
gp:[GI:g3820539] [LN:AF080002] [AC:AF080002] [PN:UDP-N-acetylmuramyl tripeptide synthetase MurC] [GN:murC] [OR:Heliobacillus mobilis] [DB:genpept-bct2] [DE:Heliobacillus mobilis exopolyphosphatase Ppx (ppx) gene, partialcds; cobyric acid synthase CobQ (cobQ), UDP-N-acetylmuramyltripeptide synthetase MurC (murC), glutamyl tRNA reductase HemA(hemA), photosynthesis gene cluster, complete sequence, stage IIsporulation protein E Sp2E (sp2E), cell cycle protein MesJ (mesJ),and ATP-dependent zinc metallopeptidase FtsH (ftsH) genes, completecds; and nucleoside diphosphate kinase B NdkB (ndkB) gene, partialcds.] [LE:2000] [RE:3367] [DI:complement]

| ORF_Name | NTID | AAID | NT Length | AA Length | score | probability |
|---|---|---|---|---|---|---|
| AI7503000994_4329635_f2_164 | 2502 | 6274 | 126 | 41 | | |

Description
NO-HIT

| ORF_Name | NTID | AAID | NT Length | AA Length | score | probability |
|---|---|---|---|---|---|---|
| AI7503000994_4689130_f2_272 | 2503 | 6275 | 306 | 101 | 81 | 0.029 |

Description
pir:[LN:A58932] [AC:A58932 ] [PN:cytochrome C-type biogenesis protein CCMF] [GN:yejR:ccmF ] [OR:mitochondrion Cyanidioschyzon merolae] [DB:pir2] >gp:[GI:d1037513:g4115789] [LN:D89861] [AC:D89861] [PN:cytochrome C-type biogenesis protein CCMF] [GN:yejR or ccmF] [OR:Mitochondrion Cyanidioschyzon merolae] [SR:Cyanidioschyzon merolae (strain:10D) mitochondrion DNA] [DB:genpept-pln1] [DE:Cyanidioschyzon merolae mitochondrial DNA, complete sequence.] [LE:16296] [RE:18158] [DI:complement]

| ORF_Name | NTID | AAID | NT Length | AA Length | score | probability |
|---|---|---|---|---|---|---|
| AI7503000994_4722265_c1_472 | 2504 | 6276 | 858 | 285 | 416 | 6.1e-39 |

Description
pir:[LN:H69800] [AC:H69800 ] [PN:hypothetical protein yfhG] [GN:yfhG ] [OR:Bacillus subtilis] [DB:pir2] >gp:[GI:e1182842:g2633176] [LN:BSUB0005] [AC:Z99108:AL009126] [GN:yfhG] [FN:unknown] [OR:Bacillus subtilis] [DB:genpept-bct1] [DE:Bacillus subtilis complete genome (section 5 of 21): from 802821 to1011250.] [LE:122320] [RE:123114] [DI:direct] >gp:[GI:d1025389:g2804537] [LN:D85082] [AC:D85082] [PN:YfhG] [OR:Bacillus subtilis] [SR:Bacillus subtilis DNA] [DB:genpept-bct1] [DE:Bacillus subtilis DNA, genome sequence, 79 to 81 degree region.] [LE:15211] [RE:16005] [DI:direct]

| ORF Name | NTID | AAID | NT Length | AA Length | score | probability |
|---|---|---|---|---|---|---|
| AI7503000994_4726566_f2_189 | 2505 | 6277 | 582 | 193 | 187 | 3.8e-13 |

Description
gp:[GI:g4981093] [LN:AE001732] [AC:AE001732:AE000512] [PN:DNA polymerase III, alpha subunit] [GN:TM0576] [OR:Thermotoga maritima] [DB:genpept-bct2] [DE:Thermotoga maritima section 44 of 136 of the complete genome.] [NT:similar to GB:M22996 SP:P13267 GB:M33543 GB:S55653] [LE:5720] [RE:9823] [DI:direct] >gp:[GI:g3930535] [LN:AF065313] [AC:AF065313] [PN:DNA polymerase III] [GN:polC] [OR:Thermotoga maritima] [DB:genpept-bct2] [DE:Thermotoga maritima DNA polymerase III (polC) gene, complete cds.] [NT:family C DNA polymerase] [LE:235] [RE:4338] [DI:direct]

| ORF Name | NTID | AAID | NT Length | AA Length | score | probability |
|---|---|---|---|---|---|---|
| AI7503000994_4728377_f2_171 | 2506 | 6278 | 1146 | 381 | 544 | 1.7e-52 |

Description
pir:[LN:F69807] [AC:F69807 ] [PN:hypothetical protein yfkB] [GN:yfkB ] [OR:Bacillus subtilis] [DB:pir2] >gp:[GI:e1182785:g2633119] [LN:BSUB0005] [AC:Z99108:AL009126] [GN:yfkB] [FN:unknown] [OR:Bacillus subtilis] [DB:genpept-bct1] [DE:Bacillus subtilis complete genome (section 5 of 21): from 802821 to1011250.] [LE:64694] [RE:65155] [DI:complement] >gp:[GI:d1024271:g2626814] [LN:D83967] [AC:D83967] [PN:YfkB] [OR:Bacillus subtilis] [SR:Bacillus subtilis (strain:AC327) DNA] [DB:genpept-bct1] [DE:Bacillus subtilis genomic DNA, 74 degree region.] [LE:2766] [RE:3227] [DI:direct]

| ORF Name | NTID | AAID | NT Length | AA Length | score | probability |
|---|---|---|---|---|---|---|
| AI7503000994_4876387_f3_376 | 2507 | 6279 | 180 | 59 | | |

Description
NO-HIT

| ORF Name | NTID | AAID | NT Length | AA Length | score | probability |
|---|---|---|---|---|---|---|
| AI7503000994_4881313_c1_475 | 2508 | 6280 | 159 | 52 | | |

Description
NO-HIT

| ORF Name | NTID | AAID | NT Length | AA Length | score | probability |
|---|---|---|---|---|---|---|
| AI7503000994_4900443_c1_449 | 2509 | 6281 | 1440 | 479 | 2460 | 1.5e-255 |

Description
sp:[LN:YZDD_BACSU] [AC:Q45486] [GN:YZDD] [OR:BACILLUS SUBTILIS] [DE:PET112-LIKE PROTEIN] [SP:Q45486] [DB:swissprot] >gp:[GI:g1354211] [LN:BSU49790] [AC:U49790] [PN:PET112-like protein] [OR:Bacillus subtilis] [DB:genpept-bct1] [DE:Bacilus subtilis PET112-like protein gene, complete cds.] [LE:433] [RE:1860] [DI:direct]

| ORF Name | NTID | AAID | NT Length | AA Length | score | probability |
|---|---|---|---|---|---|---|
| AI7503000994_5133500_f1_48 | 2510 | 6282 | 480 | 159 | 358 | 8.6e-33 |

Description
pir:[LN:E69808] [AC:E69808 ] [PN:protein-tyrosine phosphatase homolog yfkJ] [GN:yfkJ ] [CL:protein-tyrosine-phosphatase, low molecular weight] [OR:Bacillus subtilis] [DB:pir2] >gp:[GI:e1182778:g2633112] [LN:BSUB0005] [AC:Z99108:AL009126] [GN:yfkJ] [FN:unknown] [OR:Bacillus subtilis] [DB:genpept-bct1] [DE:Bacillus subtilis complete genome (section 5 of 21): from 802821 to1011250.] [NT:similar to protein-tyrosine phosphatase] [LE:58691] [RE:59161] [DI:direct] >gp:[GI:d1024279:g2626822] [LN:D83967] [AC:D83967] [PN:YfkJ] [OR:Bacillus subtilis] [SR:Bacillus subtilis (strain:AC327) DNA] [DB:genpept-bct1] [DE:Bacillus subtilis genomic DNA, 74 degree region.] [LE:8760] [RE:9230] [DI:complement]

| ORF_Name | NTID | AAID | NT Length | AA Length | score | probability |
|---|---|---|---|---|---|---|
| AI7503000994_5167268_c3_649 | 2511 | 6283 | 1080 | 359 | 613 | 8.2e-60 |

Description sp:[LN:DINP_ECOLI] [AC:Q47155:Q47683] [GN:DINP] [OR:ESCHERICHIA COLI]
[DE:DNA-DAMAGE-INDUCIBLE PROTEIN P] [SP:Q47155:Q47683] [DB:swissprot] >pir:[LN:H64747]
[AC:H64747 ] [PN:DNA-damage-inducibile protein dinP] [GN:dinP ] [CL:umuC protein]
[OR:Escherichia coli] [DB:pir2] >gp:[GI:d1008174:g984587] [LN:ECODINJ] [AC:D38582]
[PN:DinP] [OR:Escherichia coli] [SR:Escherichia coli (sub_strain W3110, strain K-12)
(library: Kohara'] [DB:genpept-bct1] [DE:Escherichia coli genes for 'YafH, YafI, YafJ,
YafK, YafQ, DinJ,YafL, YafM, FhiA, MbhA, DinP, YafN, YafO and YafP.] [NT:hypothetical;
similarity to YLW6_CAEEL (P34409),'] [LE:8540] [RE:9595] [DI:direct]
>gp:[GI:d1041669:g4902967] [LN:ECOTSF] [AC:D83536] [PN:DNA-damage-inducible protein p.]
[GN:dinP] [OR:Escherichia coli] [SR:Escherichia coli (strain:K12) DNA]
[DB:genpept-bct1] [DE:Escherichia coli genomic DNA. (4.1 - 6.1 min).]
[NT:ORF_ID:o127#9; similar to PIR Accession Number] [LE:60446] [RE:61501] [DI:direct]
>gp:[GI:g1552799] [LN:ECU70214] [AC:U70214] [PN:DinP] [GN:dinP] [OR:Escherichia coli]
[DB:genpept-bct1] [DE:Escherichia coli chromosome minutes 4-6.] [LE:81973] [RE:83028]
[DI:direct] >gp:[GI:g1786425] [LN:AE000131] [AC:AE000131:U00096] [PN:damage-inducible
protein P; putative tRNA] [GN:dinP] [FN:putative enzyme; Not classified]
[OR:Escherichia coli] [DB:genpept-bct2] [DE:Escherichia coli K-12 MG1655 section 21 of
400 of the completegenome.] [NT:o351; 100 pct identical to GB:ECODINJ_11] [LE:7487]
[RE:8542] [DI:direct]

| ORF_Name | NTID | AAID | NT Length | AA Length | score | probability |
|---|---|---|---|---|---|---|
| AI7503000994_5269400_f3_291 | 2512 | 6284 | 138 | 45 | | |

Description

NO-HIT

| ORF_Name | NTID | AAID | NT Length | AA Length | score | probability |
|---|---|---|---|---|---|---|
| AI7503000994_570327_c1_424 | 2513 | 6285 | 171 | 56 | 52 | 0.026 |

Description pir:[LN:S68156] [AC:S68156 ] [PN:NADH dehydrogenase (ubiquinone), chain 3] [GN:ND3 ]
[CL:NADH dehydrogenase (ubiquinone) chain 3] [OR:mitochondrion Dictyostelium
discoideum] [EC:1.6.5.3] [DB:pir2] >gp:[GI:d1041830:g4958885] [LN:AB000109]
[AC:AB000109] [PN:NADH dehydrogenase subunit 3] [GN:nad3] [OR:Mitochondrion
Dictyostelium discoideum] [SR:Dictyostelium discoideum (strain:AX3, partially X22
(48172-5151] [DB:genpept-invl] [EC:1.6.5.3] [DE:Dictyostelium discoideum mitochondrial
DNA, complete sequence.] [LE:24783] [RE:25145] [DI:direct] >gp:[GI:d1004450:g699592]
[LN:DDID16466] [AC:D16466] [PN:NADH dehydrogenase subunit 3] [GN:nad3]
[OR:Mitochondrion Dictyostelium discoideum] [SR:Dictyostelium discoideum (strain:AX3)
mitochondrion DNA] [DB:genpept-invl] [EC:1.6.5.3] [DE:Dictyostelium discoideum
mitochondrial DNA.] [LE:7866] [RE:8228] [DI:direct] >gp:[GI:d1004450:g699592]
[LN:DDID16466] [AC:D16466] [PN:NADH dehydrogenase subunit 3] [GN:nad3]
[OR:Mitochondrion Dictyostelium discoideum] [SR:Dictyostelium discoideum (strain:AX3)
mitochondrion DNA] [DB:genpept] [EC:1.6.5.3] [DE:Dictyostelium discoideum mitochondrial
DNA.] [LE:7866] [RE:8228] [DI:direct]

| ORF Name | NTID | AAID | NT Length | AA Length | score | probability |
|---|---|---|---|---|---|---|
| AI7503000994_5860052_f3_388 | 2514 | 6286 | 435 | 144 | 107 | 3.4e-06 |

Description
pir:[LN:H71190] [AC:H71190 ] [PN:hypothetical protein PH1800] [GN:PH1800 ]
[OR:Pyrococcus horikoshii] [DB:pir2] >gp:[GI:d1031862:g3258236] [LN:AP000007]
[AC:AP000007:AB009464:AB009465:AB009521:AB009522:AB009523:AB009524] [PN:133aa long
hypothetical protein] [GN:PH1800] [OR:Pyrococcus horikoshii] [SR:Pyrococcus horikoshii
(strain:OT3) DNA] [DB:genpept-bct1] [DE:Pyrococcus horikoshii OT3 genomic DNA,
1485001-1738505 nt. position(7/7).] [LE:80658] [RE:81059] [DI:direct]

| ORF Name | NTID | AAID | NT Length | AA Length | score | probability |
|---|---|---|---|---|---|---|
| AI7503000994_5913882_f2_167 | 2515 | 6287 | 123 | 40 | | |

Description
NO-HIT

| ORF Name | NTID | AAID | NT Length | AA Length | score | probability |
|---|---|---|---|---|---|---|
| AI7503000994_6053308_c2_538 | 2516 | 6288 | 903 | 300 | 815 | 3.2e-81 |

Description
sp:[LN:NADE_ECOLI] [AC:P18843:P78235] [GN:NADE:EFG:NTRL] [OR:ESCHERICHIA COLI]
[EC:6.3.5.1] [DE:PROTEIN)] [SP:P18843:P78235] [DB:swissprot] >pir:[LN:D64933]
[AC:D64933:A26928 ] [PN:NAD+ synthase (glutamine-hydrolyzing),:nitrogen-regulatory
protein] [GN:nadE ] [CL:spore outgrowth factor B] [OR:Escherichia coli] [EC:6.3.5.1]
[DB:pir2] [MP:34-39 min ] >gp:[GI:d1016252:g1742846] [LN:D90817] [AC:D90817:AB001340]
[PN:NH(3)-dependent NAD(+) synthetase (EC 6.3.5.1)] [GN:nadE, efg, ntrL__]
[OR:Escherichia coli] [SR:Escherichia coli (strain:K12) DNA, clone_lib:Kohara lambda
minise] [DB:genpept-bct1] [DE:E.coli genomic DNA, Kohara clone #326(39.1-39.4 min.).]
[NT:ORF_ID:o326#9; similar to [SwissProt Accession] [LE:7818] [RE:8645] [DI:direct]
>gp:[GI:d1016258:g1742853] [LN:D90818] [AC:D90818:AB001340] [PN:NH(3)-dependent NAD(+)
synthetase (EC 6.3.5.1)] [GN:nadE, efg, ntrL__] [OR:Escherichia coli] [SR:Escherichia
coli (strain:K12) DNA, clone_lib:Kohara lambda minise] [DB:genpept-bct1] [DE:E.coli
genomic DNA, Kohara clone #327(39.2-39.5 min.).] [NT:ORF_ID:o326#9; similar to
[SwissProt Accession] [LE:2186] [RE:3013] [DI:direct] >gp:[GI:g1788036] [LN:AE000269]
[AC:AE000269:U00096] [PN:NAD synthetase, prefers NH3 over glutamine] [GN:nadE]
[FN:enzyme; Biosynthesis of cofactors, carriers:] [OR:Escherichia coli]
[DB:genpept-bct2] [EC:6.3.5.1] [DE:Escherichia coli K-12 MG1655 section 159 of 400 of
the completegenome.] [NT:o275; residues 32-274 are 100 pct identical to] [LE:1232]
[RE:2059] [DI:direct]

| ORF_Name | NTID | AAID | NT Length | AA Length | score | probability |
|---|---|---|---|---|---|---|
| AI7503000994_6147252_c1_473 | 2517 | 6289 | 846 | 281 | 150 | 1.6e-08 |

Description sp:[LN:TAGG_BACSU] [AC:P42953] [GN:TAGG] [OR:BACILLUS SUBTILIS] [DE:TEICHOIC ACID TRANSLOCATION PERMEASE PROTEIN TAGG] [SP:P42953] [DB:swissprot] >pir:[LN:S69202] [AC:S69202:H69720 ] [PN:teichoic acid permease tagG:integral membrane protein tagG] [GN:tagG ] [OR:Bacillus subtilis] [DB:pir2] >gp:[GI:g755152] [LN:BSU13832] [AC:U13832] [PN:highly hydrophobic integral membrane protein] [GN:tagG] [FN:teichoic acid translocation] [OR:Bacillus subtilis] [DB:genpept-bct1] [DE:Bacillus subtilis 168 highly hydrophobic integral membrane protein(tagG) gene and ATP-binding protein (tagH) gene, complete cds.] [LE:287] [RE:1114] [DI:direct] >gp:[GI:e1184477:g2636097] [LN:BSUB0019] [AC:Z99122:AL009126] [PN:permease] [GN:tagG] [FN:teichoic acid translocation] [OR:Bacillus subtilis] [DB:genpept-bct1] [DE:Bacillus subtilis complete genome (section 19 of 21): from 3597091to 3809700.] [SP:P42953] [LE:77137] [RE:77964] [DI:complement] >gp:[GI:e1184477:g2636097] [LN:BSUB0019] [AC:Z99122:AL009126] [PN:permease] [GN:tagG] [FN:teichoic acid translocation] [OR:Bacillus subtilis] [DB:genpept] [DE:Bacillus subtilis complete genome (section 19 of 21): from 3597091to 3809700.] [SP:P42953] [LE:77137] [RE:77964] [DI:complement]

| ORF_Name | NTID | AAID | NT Length | AA Length | score | probability |
|---|---|---|---|---|---|---|
| AI7503000994_632661_c2_560 | 2518 | 6290 | 777 | 258 | 490 | 8.8e-47 |

Description gp:[GI:g3820538] [LN:AF080002] [AC:AF080002] [PN:cobyric acid synthase CobQ] [GN:cobQ] [OR:Heliobacillus mobilis] [DB:genpept-bct2] [DE:Heliobacillus mobilis exopolyphosphatase Ppx (ppx) gene, partialcds; cobyric acid synthase CobQ (cobQ), UDP-N-acetylmuramyltripeptide synthetase MurC (murC), glutamyl tRNA reductase HemA(hemA), photosynthesis gene cluster, complete sequence, stage IIsporulation protein E Sp2E (sp2E), cell cycle protein MesJ (mesJ),and ATP-dependent zinc metallopeptidase FtsH (ftsH) genes, completecds; and nucleoside diphosphate kinase B NdkB (ndkB) gene, partialcds.] [LE:1238] [RE:1996] [DI:complement]

| ORF_Name | NTID | AAID | NT Length | AA Length | score | probability |
|---|---|---|---|---|---|---|
| AI7503000994_6682627_c3_604 | 2519 | 6291 | 357 | 118 | 123 | 6.9e-08 |

Description gp:[GI:g624123] [LN:PBU42580] [AC:U42580:U17055:U32570] [GN:a58L] [OR:Paramecium bursaria Chlorella virus 1] [DB:genpept-vrl] [DE:Paramecium bursaria Chlorella virus 1, complete genome.] [NT:contains Glu-, Gln-rich regions: QVQVV (11X), KEVWE] [LE:31140] [RE:31628] [DI:complement]

| ORF_Name | NTID | AAID | NT Length | AA Length | score | probability |
|---|---|---|---|---|---|---|
| AI7503000994_6829687_c2_512 | 2520 | 6292 | 618 | 205 | 355 | 1.8e-32 |

Description pir:[LN:S42925] [AC:S42925 ] [PN:probable transport protein] [CL:ATP-binding cassette homology] [OR:Staphylococcus aureus] [DB:pir2] >gp:[GI:g459256] [LN:SASTPSMP] [AC:Z30588] [PN:Potential ABC transporter] [GN:stpC] [OR:Staphylococcus aureus] [DB:genpept-bct1] [DE:S.aureus (RN4220) genes for potential ABC transporter and potentialmembrane spanning protein.] [LE:199] [RE:894] [DI:direct]

| ORF Name | NTID | AAID | NT Length | AA Length | score | probability |
|---|---|---|---|---|---|---|
| AI7503000994_6931261_c1_409 | 2521 | 6293 | 537 | 178 | 128 | 2.0e-08 |

Description
gp:[GI:g2689551] [LN:U93688] [AC:U93688] [OR:Staphylococcus aureus] [DB:genpept-bct2] [DE:Staphylococcus aureus toxic shock syndrome toxin-1 (tst),enterotoxin (ent), and integrase (int) genes, complete cds.] [NT:orf4] [LE:3868] [RE:4395] [DI:complement]

| ORF Name | NTID | AAID | NT Length | AA Length | score | probability |
|---|---|---|---|---|---|---|
| AI7503000994_7164087_c2_575 | 2522 | 6294 | 333 | 110 | 217 | 7.5e-18 |

Description
pir:[LN:A69801] [AC:A69801 ] [PN:hypothetical protein yfhH] [GN:yfhH ] [OR:Bacillus subtilis] [DB:pir2] >gp:[GI:e1182843:g2633177] [LN:BSUB0005] [AC:Z99108:AL009126] [GN:yfhH] [FN:unknown] [OR:Bacillus subtilis] [DB:genpept-bct1] [DE:Bacillus subtilis complete genome (section 5 of 21): from 802821 to1011250.] [LE:123116] [RE:123430] [DI:direct] >gp:[GI:d1025390:g2804538] [LN:D85082] [AC:D85082] [PN:YfhH] [OR:Bacillus subtilis] [SR:Bacillus subtilis DNA] [DB:genpept-bct1] [DE:Bacillus subtilis DNA, genome sequence, 79 to 81 degree region.] [LE:16007] [RE:16321] [DI:direct]

| ORF Name | NTID | AAID | NT Length | AA Length | score | probability |
|---|---|---|---|---|---|---|
| AI7503000994_7207518_f2_267 | 2523 | 6295 | 375 | 124 | 151 | 7.4e-11 |

Description
pir:[LN:B27059] [AC:B27059 ] [PN:hypothetical protein 2] [OR:Glycine max] [SR:, soybean] [DB:pir2]

| ORF Name | NTID | AAID | NT Length | AA Length | score | probability |
|---|---|---|---|---|---|---|
| AI7503000994_789010_c3_620 | 2524 | 6296 | 132 | 43 | | |

Description
NO-HIT

| ORF Name | NTID | AAID | NT Length | AA Length | score | probability |
|---|---|---|---|---|---|---|
| AI7503000994_799188_f1_118 | 2525 | 6297 | 468 | 155 | 252 | 9.8e-20 |

Description
gp:[GI:g3929312] [LN:AF100426] [AC:AF100426] [PN:fimbriae-associated protein Fap1] [GN:fap1] [OR:Streptococcus parasanguinis] [DB:genpept-bct2] [DE:Streptococcus parasanguis fimbriae-associated protein Fap1 (fap1)gene, complete cds.] [NT:invovled in fimbriae assembly and fimbriae-mediated] [LE:284] [RE:7996] [DI:direct]

| ORF Name | NTID | AAID | NT Length | AA Length | score | probability |
|---|---|---|---|---|---|---|
| AI7503000994_815903_c1_423 | 2526 | 6298 | 141 | 46 | | |

Description
NO-HIT

| ORF Name | NTID | AAID | NT Length | AA Length | score | probability |
|---|---|---|---|---|---|---|
| AI7503000994_820325_f2_156 | 2527 | 6299 | 948 | 315 | 1131 | 1.1e-114 |

Description
sp:[LN:GSAB_BACSU] [AC:P71084] [GN:GSAB] [OR:BACILLUS SUBTILIS] [EC:5.4.3.8]
[DE:(GLUTAMATE-1-SEMIALDEHYDE AMINOTRANSFERASE) (GSA-AT)] [SP:P71084] [DB:swissprot]
>gp:[GI:e281581:g1673394] [LN:BSZ82044] [AC:Z82044] [PN:glutamate-1-semialdehyde
aminotransferase] [GN:gsaB] [OR:Bacillus subtilis] [DB:genpept-bct1] [DE:B.subtilis 25
kb genomic DNA segment (from sspE to katA).] [SP:P71084] [LE:5984] [RE:7273]
[DI:complement]

| ORF Name | NTID | AAID | NT Length | AA Length | score | probability |
|---|---|---|---|---|---|---|
| AI7503000994_860677_f1_3 | 2528 | 6300 | 177 | 58 | 72 | 0.017 |

Description
gp:[GI:g3845668] [LN:AF021254] [AC:AF021254] [PN:unknown] [GN:RTL5] [OR:avian
adenovirus type 8] [DB:genpept-vrl] [DE:Avian adenovirus type 8 strain ATCC A-2A 100 K
protein homologgene, partial cds; RTL10, RTR1, late 33 K protein homolog, pVIIIhomolog,
RTL9, RTR2, fibre homolog, RTL8, RTL7, RTL6, RTL5, andRTR3 genes, complete cds; and
RTL4 gene, partial cds.] [LE:8905] [RE:9216] [DI:complement]

| ORF Name | NTID | AAID | NT Length | AA Length | score | probability |
|---|---|---|---|---|---|---|
| AI7503000994_885756_c3_662 | 2529 | 6301 | 180 | 59 | | |

Description
NO-HIT

| ORF Name | NTID | AAID | NT Length | AA Length | score | probability |
|---|---|---|---|---|---|---|
| AI7503000994_979712_c1_430 | 2530 | 6302 | 1422 | 473 | 111 | 0.023 |

Description
pir:[LN:C71610] [AC:C71610 ] [PN:probable membrane associated protein PFB0615c]
[GN:PFB0615c ] [OR:Plasmodium falciparum] [DB:pir2] >gp:[GI:g3845231] [LN:AE001406]
[AC:AE001406:AE001362] [PN:predicted membrane associated protein] [GN:PFB0615c]
[OR:Plasmodium falciparum] [SR:malaria parasite P. falciparum] [DB:genpept-inv2]
[DE:Plasmodium falciparum chromosome 2, section 43 of 73 of thecomplete sequence.]
[NT:predicted by GlimmerM] [LE:1921:2496:6961] [RE:2310:6749:8358] [DI:complementJoin]

| ORF Name | NTID | AAID | NT Length | AA Length | score | probability |
|---|---|---|---|---|---|---|
| AI7503000994_985678_c3_646 | 2531 | 6303 | 975 | 324 | 889 | 4.6e-89 |

Description
pir:[LN:F69795] [AC:F69795 ] [PN:conserved hypothetical protein yerQ] [GN:yerQ ]
[OR:Bacillus subtilis] [DB:pir2] >gp:[GI:e1182652:g2632986] [LN:BSUB0004]
[AC:Z99107:AL009126] [GN:yerQ] [FN:unknown] [OR:Bacillus subtilis] [DB:genpept-bct1]
[DE:Bacillus subtilis complete genome (section 4 of 21): from 600701 to813890.]
[NT:similar to hypothetical proteins] [LE:135242] [RE:136153] [DI:direct]

| ORF Name | NTID | AAID | NT Length | AA Length | score | probability |
|---|---|---|---|---|---|---|
| AI7503000994_9859433_c2_561 | 2532 | 6304 | 126 | 41 | | |

Description
NO-HIT

| ORF Name | NTID | AAID | NT Length | AA Length | score | probability |
|---|---|---|---|---|---|---|
| AI7503000995_10580443_cl_140 | 2533 | 6305 | 237 | 78 | 246 | 6.4e-21 |

Description
sp:[LN:YEED_ECOLI] [AC:P33014] [GN:YEED] [OR:ESCHERICHIA COLI] [DE:HYPOTHETICAL 8.1 KD PROTEIN IN SBCB-HISL INTERGENIC REGION] [SP:P33014] [DB:swissprot] >pir:[LN:C64966] [AC:C64966 ] [PN:yeeD protein] [GN:yeeD ] [CL:conserved hypothetical protein HI0721] [OR:Escherichia coli] [DB:pir2] >gp:[GI:d1016564:g1736686] [LN:D90839] [AC:D90839:AB001340] [GN:yeeD] [OR:Escherichia coli] [SR:Escherichia coli (strain:K12) DNA, clone_lib:Kohara lambda minise] [DB:genpept-bct1] [DE:E.coli genomic DNA, Kohara clone #349(44.6-45.0 min.).] [NT:ORF_ID:o349#3; similar to [SwissProt Accession] [LE:12878] [RE:13105] [DI:complement] >gp:[GI:d1016569:g1736692] [LN:D90840] [AC:D90840:AB001340] [GN:yeeD] [OR:Escherichia coli] [SR:Escherichia coli (strain:K12) DNA, clone_lib:Kohara lambda minise] [DB:genpept-bct1] [DE:E.coli genomic DNA, Kohara clone #350(44.9-45.2 min.).] [NT:ORF_ID:o350#3; similar to [SwissProt Accession] [LE:1569] [RE:1796] [DI:complement] >gp:[GI:g405955] [LN:ECOHU43] [AC:U00009] [PN:yeeD] [OR:Escherichia coli] [SR:Escherichia coli K12 BHB2600] [DB:genpept-bct1] [DE:sbcB region of E.coli K12 BHB2600.] [NT:similar to ORF in fliE-amyA intergenic region] [LE:4083] [RE:4310] [DI:complement] >gp:[GI:g1788322] [LN:AE000292] [AC:AE000292:U00096] [PN:orf, hypothetical protein] [GN:yeeD] [FN:orf; Unknown] [OR:Escherichia coli] [DB:genpept-bct2] [DE:Escherichia coli K-12 MG1655 section 182 of 400 of the completegenome.] [NT:f75; 100 pct identical to YEED_ECOLI SW: P33014] [LE:9541] [RE:9768] [DI:complement]

| ORF Name | NTID | AAID | NT Length | AA Length | score | probability |
|---|---|---|---|---|---|---|
| AI7503000995_12142768_f1_32 | 2534 | 6306 | 300 | 99 | 110 | 4.2e-06 |

Description
pir:[LN:D71245] [AC:D71245 ] [PN:hypothetical protein PH0221] [GN:PH0221 ] [OR:Pyrococcus horikoshii] [DB:pir2] >gp:[GI:d1030234:g3256608] [LN:AP000001] [AC:AP000001:AB009465:AB009464:AB009466:AB009467:AB009468:AB009469] [PN:235aa long hypothetical protein] [GN:PH0221] [OR:Pyrococcus horikoshii] [SR:Pyrococcus horikoshii (strain:OT3) DNA] [DB:genpept-bct1] [DE:Pyrococcus horikoshii OT3 genomic DNA, 1-287000 nt. position (1/7).] [LE:194212] [RE:194919] [DI:complement]

| ORF Name | NTID | AAID | NT Length | AA Length | score | probability |
|---|---|---|---|---|---|---|
| AI7503000995_13907566_cl_148 | 2535 | 6307 | 144 | 47 | | |

Description
NO-HIT

| ORF Name | NTID | AAID | NT Length | AA Length | score | probability |
|---|---|---|---|---|---|---|
| AI7503000995_14493812_cl_131 | 2536 | 6308 | 465 | 154 | 289 | 1.8e-25 |

Description
pir:[LN:C69786] [AC:C69786 ] [PN:conserved hypothetical protein ydiB] [GN:ydiB ] [CL:hypothetical protein HI0065] [OR:Bacillus subtilis] [DB:pir2]
>gp:[GI:e1182570:g2632904] [LN:BSUB0004] [AC:Z99107:AL009126] [GN:ydiB] [FN:unknown] [OR:Bacillus subtilis] [DB:genpept-bct1] [DE:Bacillus subtilis complete genome (section 4 of 21): from 600701 to813890.] [NT:similar to hypothetical proteins] [LE:40670] [RE:41146] [DI:direct] >gp:[GI:d1020494:g1945107] [LN:D88802] [AC:D88802] [GN:ydiB] [OR:Bacillus subtilis] [SR:Bacillus subtilis (sub_species:Marburg, strain:168, isolate:JH642] [DB:genpept-bct1] [DE:Bacillus subtilis DNA for phoB-rrnE-groESL region, complete cds.] [NT:E. coli hypothetical protein; P31805 (267)] [LE:27672] [RE:28148] [DI:direct]

| ORF Name | NTID | AAID | NT Length | AA Length | score | probability |
|---|---|---|---|---|---|---|
| AI7503000995_1461637_f2_60 | 2537 | 6309 | 249 | 82 | 123 | 6.9e-08 |

Description sp:[LN:ILVN_BACSU] [AC:P37252] [GN:ILVN] [OR:BACILLUS SUBTILIS] [EC:4.1.3.18]
[DE:(ACETOHYDROXY-ACID SYNTHASE SMALL SUBUNIT) (ALS)] [SP:P37252] [DB:swissprot]
>pir:[LN:E69644] [AC:E69644 ] [PN:acetolactate synthase (small subunit) ilvN] [GN:ilvN
] [CL:acetolactate synthase small chain] [OR:Bacillus subtilis] [DB:pir2]
>gp:[GI:g143092] [LN:BACILNB] [AC:L03181] [PN:acetolactate synthase small subunit]
[GN:ilvN] [OR:Bacillus subtilis] [SR:Bacillus subtilis DNA] [DB:genpept-bct1]
[DE:Bacillus subtilis ilvB, ilvN and ilvC genes, complete ilv-leuoperon.] [LE:2438]
[RE:2962] [DI:direct] >gp:[GI:e1184079:g2635295] [LN:BSUB0015] [AC:Z99118:AL009126]
[PN:acetolactate synthase (acetohydroxy-acid] [GN:ilvN] [FN:valine/isoleucine
biosynthesis] [OR:Bacillus subtilis] [DB:genpept-bct1] [EC:4.1.3.18] [DE:Bacillus
subtilis complete genome (section 15 of 21): from 2795131to 3013540.] [SP:P37252]
[LE:98696] [RE:99220] [DI:complement] >gp:[GI:e1165365:g1770067] [LN:BSZ75208]
[AC:Z75208] [PN:acetolactate synthase small subunit] [GN:ilvN] [OR:Bacillus subtilis]
[DB:genpept-bct1] [EC:4.1.3.18] [DE:B.subtilis genomic sequence 89009bp.]
[NT:acetolactate synthase (acetohydroxy-acid synthase)] [SP:P37252] [LE:70687]
[RE:71211] [DI:direct]

| ORF Name | NTID | AAID | NT Length | AA Length | score | probability |
|---|---|---|---|---|---|---|
| AI7503000995_14849093_c3_180 | 2538 | 6310 | 294 | 97 | 133 | 6.0e-09 |

Description pir:[LN:F71245] [AC:F71245 ] [PN:hypothetical protein PHS004] [GN:PHS004 ]
[OR:Pyrococcus horikoshii] [DB:pir2] >gp:[GI:d1030236:g3256610] [LN:AP000001]
[AC:AP000001:AB009465:AB009464:AB009466:AB009467:AB009468:AB009469] [PN:58aa long
hypothetical protein] [GN:PHS004] [OR:Pyrococcus horikoshii] [SR:Pyrococcus horikoshii
(strain:OT3) DNA] [DB:genpept-bct1] [DE:Pyrococcus horikoshii OT3 genomic DNA, 1-287000
nt. position (1/7).] [NT:similar to GENPEPT:Z47547 percent identity:50.000] [LE:195255]
[RE:195431] [DI:direct]

| ORF Name | NTID | AAID | NT Length | AA Length | score | probability |
|---|---|---|---|---|---|---|
| AI7503000995_14897837_f1_29 | 2539 | 6311 | 1275 | 424 | 1161 | 4.3e-128 |

Description sp:[LN:THD1_LACLA] [AC:Q02145] [GN:ILVA] [OR:LACTOCOCCUS LACTIS]
[SR:,SUBSPLACTIS:STREPTOCOCCUS LACTIS] [EC:4.2.1.16] [DE:DEAMINASE)] [SP:Q02145]
[DB:swissprot] >pir:[LN:S35141] [AC:S35141 ] [PN:probable threonine dehydratase,]
[GN:ilvA ] [CL:threonine dehydratase] [OR:Lactococcus lactis subsp. lactis]
[EC:4.2.1.16] [DB:pir2]

| ORF Name | NTID | AAID | NT Length | AA Length | score | probability |
|---|---|---|---|---|---|---|
| AI7503000995_157802_c1_135 | 2540 | 6312 | 141 | 46 | | |

Description
NO-HIT

| ORF Name | NTID | AAID | NT Length | AA Length | score | probability |
|---|---|---|---|---|---|---|
| AI7503000995_1702_f2_36 | 2541 | 6313 | 522 | 173 | 88 | 0.0089 |

Description pir:[LN:T00168] [AC:T00168 ] [PN:hypothetical protein 33] [OR:Staphylococcus aureus
phage phi PVL] [DB:pir3] >gp:[GI:d1032869:g3341942] [LN:AB009866] [AC:AB009866]
[OR:bacteriophage phi PVL] [SR:bacteriophage phi PVL (specific_host:Staphylococcus
aureus ATC] [DB:genpept-phg] [DE:Bacteriophage phi PVL proviral DNA, complete
sequence.] [NT:orf 33] [LE:28172] [RE:28582] [DI:complement]

| ORF_Name | NTID | AAID | NT Length | AA Length | score | probability |
|---|---|---|---|---|---|---|
| AI7503000995_19564128_c2_172 | 2542 | 6314 | 315 | 104 | | |

Description
NO-HIT

| ORF_Name | NTID | AAID | NT Length | AA Length | score | probability |
|---|---|---|---|---|---|---|
| AI7503000995_20422318_f3_73 | 2543 | 6315 | 417 | 138 | 105 | 2.2e-05 |

Description
pir:[LN:D69633] [AC:D69633 ] [PN:glutamine ABC transporter (glutamine-binding protein) glnH] [GN:glnH ] [CL:lysine-arginine-ornithine-binding protein] [OR:Bacillus subtilis] [DB:pir2] >gp:[GI:e1183973:g2635189] [LN:BSUB0014] [AC:Z99117:AL009126] [PN:glutamine ABC transporter (glutamine-binding)] [GN:glnH] [OR:Bacillus subtilis] [DB:genpept-bctl] [DE:Bacillus subtilis complete genome (section 14 of 21): from 2599451to 2812870.] [LE:202928] [RE:203749] [DI:direct] >gp:[GI:e1183991:g2635207] [LN:BSUB0015] [AC:Z99118:AL009126] [PN:glutamine ABC transporter (glutamine-binding)] [GN:glnH] [OR:Bacillus subtilis] [DB:genpept-bctl] [DE:Bacillus subtilis complete genome (section 15 of 21): from 2795131to 3013540.] [LE:7248] [RE:8069] [DI:direct]

| ORF_Name | NTID | AAID | NT Length | AA Length | score | probability |
|---|---|---|---|---|---|---|
| AI7503000995_2114077_c2_166 | 2544 | 6316 | 156 | 51 | 115 | 1.1e-06 |

Description
pir:[LN:D69786] [AC:D69786 ] [PN:glycoprotein endopeptidase homolog ydiC] [GN:ydiC ] [OR:Bacillus subtilis] [DB:pir2] >gp:[GI:e1182571:g2632905] [LN:BSUB0004] [AC:Z99107:AL009126] [GN:ydiC] [FN:unknown] [OR:Bacillus subtilis] [DB:genpept-bctl] [DE:Bacillus subtilis complete genome (section 4 of 21): from 600701 to813890.] [NT:similar to glycoprotein endopeptidase] [LE:41127] [RE:41816] [DI:direct] >gp:[GI:d1020495:g1945108] [LN:D88802] [AC:D88802] [GN:ydiC] [OR:Bacillus subtilis] [SR:Bacillus subtilis (sub_species:Marburg, strain:168, isolate:JH642] [DB:genpept-bctl] [DE:Bacillus subtilis DNA for phoB-rrnE-groESL region, complete cds.] [NT:H. influenzae hypothetical protein; P43990 (182)] [LE:28129] [RE:28818] [DI:direct]

| ORF_Name | NTID | AAID | NT Length | AA Length | score | probability |
|---|---|---|---|---|---|---|
| AI7503000995_2125637_f3_111 | 2545 | 6317 | 150 | 49 | | |

Description
NO-HIT

| ORF_Name | NTID | AAID | NT Length | AA Length | score | probability |
|---|---|---|---|---|---|---|
| AI7503000995_22441907_f2_58 | 2546 | 6318 | 1869 | 622 | 1924 | 9.7e-199 |

Description
sp:[LN:ILVD_BACSU] [AC:P51785] [GN:ILVD] [OR:BACILLUS SUBTILIS] [EC:4.2.1.9] [DE:110) (VEG110)] [SP:P51785] [DB:swissprot]

| ORF_Name | NTID | AAID | NT Length | AA Length | score | probability |
|---|---|---|---|---|---|---|
| AI7503000995_22766502_f1_18 | 2547 | 6319 | 135 | 44 | | |

Description
NO-HIT

| ORF Name | NTID | AAID | NT Length | AA Length | score | probability |
|---|---|---|---|---|---|---|
| AI7503000995_23478463_f3_99 | 2548 | 6320 | 1755 | 584 | 1667 | 1.7e-171 |

Description pir:[LN:B69644] [AC:B69644:I39865 ] [PN:acetolactate synthase, large chain] [GN:ilvB ] [CL:acetolactate synthase large chain:thiamine pyrophosphate-binding domain homology] [OR:Bacillus subtilis] [EC:4.1.3.18] [DB:pir2] >gp:[GI:e1184080:g2635296] [LN:BSUB0015] [AC:Z99118:AL009126] [PN:acetolactate synthase (acetohydroxy-acid] [GN:ilvB] [FN:valine/isoleucine biosynthesis] [OR:Bacillus subtilis] [DB:genpept-bct1] [EC:4.1.3.18] [DE:Bacillus subtilis complete genome (section 15 of 21): from 2795131to 3013540.] [LE:99217] [RE:100941] [DI:complement] >gp:[GI:e1165364:g1770066] [LN:BSZ75208] [AC:Z75208] [PN:acetolactate synthase large subunit] [GN:ilvB] [OR:Bacillus subtilis] [DB:genpept-bct1] [EC:4.1.3.18] [DE:B.subtilis genomic sequence 89009bp.] [NT:acetolactate synthase (acetohydroxy-acid synthase)] [LE:68966] [RE:70690] [DI:direct]

| ORF Name | NTID | AAID | NT Length | AA Length | score | probability |
|---|---|---|---|---|---|---|
| AI7503000995_23867325_f2_64 | 2549 | 6321 | 570 | 189 | 561 | 2.6e-54 |

Description sp:[LN:LEUD_LACLA] [AC:Q02144] [GN:LEUD] [OR:LACTOCOCCUS LACTIS] [SR:,SUBSPLACTIS:STREPTOCOCCUS LACTIS] [EC:4.2.1.33] [DE:(ISOPROPYLMALATE ISOMERASE) (ALPHA-IPM ISOMERASE)] [SP:Q02144] [DB:swissprot] >pir:[LN:E36889] [AC:E36889:S35135 ] [PN:probable 3-isopropylmalate dehydratase, chain leuD] [GN:leuD ] [CL:3-isopropylmalate dehydratase small chain] [OR:Lactococcus lactis subsp. lactis] [EC:4.2.1.33] [DB:pir2] >gp:[GI:g2565154] [LN:LLU92974] [AC:U92974:M90760:M90761] [PN:LeuD] [GN:leuD] [OR:Lactococcus lactis] [DB:genpept-bct1] [DE:Lactococcus lactis unknown gene, partial cds, and HisC (hisC),unknown, HisG (hisG), unknown, HisB (hisB), unknown, HisH (hish),HisA (hisA), HisF (hisF), HisIE (hisIE), unknown, unknown, LeuA(leuA), LeuB (leuB), LeuC (leuC), LeuD (leuD), unknown, IlvD(ilvD), IlvB (ilvB), IlvN, IlvC (ilvC), IlvA (ilvA), AldB (aldB)and aldR (aldR) genes, complete cds.] [NT:isopropylmalate dehydratase subunit] [LE:16590] [RE:17165] [DI:direct]

| ORF Name | NTID | AAID | NT Length | AA Length | score | probability |
|---|---|---|---|---|---|---|
| AI7503000995_24343813_c1_139 | 2550 | 6322 | 1119 | 372 | 1075 | 9.0e-109 |

Description sp:[LN:YEEE_ECOLI] [AC:P33015] [GN:YEEE] [OR:ESCHERICHIA COLI] [DE:HYPOTHETICAL 38.1 KD PROTEIN IN SBCB-HISL INTERGENIC REGION] [SP:P33015] [DB:swissprot] >pir:[LN:D64966] [AC:D64966 ] [PN:membrane protein yeeE] [GN:yeeE ] [OR:Escherichia coli] [DB:pir2] >gp:[GI:d1016565:g1736687] [LN:D90839] [AC:D90839:AB001340] [GN:yeeE] [OR:Escherichia coli] [SR:Escherichia coli (strain:K12) DNA, clone_lib:Kohara lambda minise] [DB:genpept-bct1] [DE:E.coli genomic DNA, Kohara clone #349(44.6-45.0 min.).] [NT:ORF_ID:o349#4; similar to [SwissProt Accession] [LE:13119] [RE:14177] [DI:complement] >gp:[GI:d1016570:g1736693] [LN:D90840] [AC:D90840:AB001340] [GN:yeeE] [OR:Escherichia coli] [SR:Escherichia coli (strain:K12) DNA, clone_lib:Kohara lambda minise] [DB:genpept-bct1] [DE:E.coli genomic DNA, Kohara clone #350(44.9-45.2 min.).] [NT:ORF_ID:o349#4; similar to [SwissProt Accession] [LE:1810] [RE:2868] [DI:complement] >gp:[GI:g405956] [LN:ECOHU43] [AC:U00009] [PN:yeeE] [OR:Escherichia coli] [SR:Escherichia coli K12 BHB2600] [DB:genpept-bct1] [DE:sbcB region of E.coli K12 BHB2600.] [NT:similar to ORF in fliE-amyA intergenic region] [LE:4324] [RE:5382] [DI:complement] >gp:[GI:g1788323] [LN:AE000292] [AC:AE000292:U00096] [PN:putative transport system permease protein] [GN:yeeE] [FN:putative transport; Not classified] [OR:Escherichia coli] [DB:genpept-bct2] [DE:Escherichia coli K-12 MG1655 section 182 of 400 of the completegenome.] [NT:f352; 100 pct identical to YEEE_ECOLI SW: P33015] [LE:9782] [RE:10840] [DI:complement]

| ORF Name | NTID | AAID | NT Length | AA Length | score | probability |
|---|---|---|---|---|---|---|
| AI7503000995_24640625_c2_175 | 2551 | 6323 | 960 | 319 | 954 | 6.0e-96 |

Description sp:[LN:SCRR_STAXY] [AC:P74892] [GN:SCRR] [OR:STAPHYLOCOCCUS XYLOSUS] [DE:SUCROSE OPERON REPRESSOR (SCR OPERON REGULATORY PROTEIN)] [SP:P74892] [DB:swissprot] >gp:[GI:e264641:g949974] [LN:SXSCRBA] [AC:X67744] [PN:sucrose repressor] [GN:scrR] [OR:Staphylococcus xylosus] [DB:genpept-bct1] [DE:S.xylosus scrB and scrR genes.] [SP:P74892] [LE:495] [RE:1457] [DI:direct]

| ORF Name | NTID | AAID | NT Length | AA Length | score | probability |
|---|---|---|---|---|---|---|
| AI7503000995_24646962_c1_150 | 2552 | 6324 | 210 | 69 | 79 | 0.0032 |

Description gp:[GI:g2564351] [LN:VCU83795] [AC:U83795] [PN:RstR] [GN:rstR] [FN:repressor of rstA transcription] [OR:Vibrio cholerae] [DB:genpept-bct1] [DE:Vibrio cholerae RstR (rstR), RstA1 (rstA1), RstB1 (rstB1) and RstC(rstC) genes, complete cds.] [LE:496] [RE:834] [DI:complement] >gp:[GI:g2564356] [LN:VCU83796] [AC:U83796] [PN:RstR] [GN:rstR] [FN:repressor of rstA transcription] [OR:Vibrio cholerae] [DB:genpept-bct1] [DE:Vibrio cholerae RstR (rstR), RstA2 (rstA2), and RstB2 (rstB2)genes, complete cds.] [LE:496] [RE:834] [DI:complement]

| ORF Name | NTID | AAID | NT Length | AA Length | score | probability |
|---|---|---|---|---|---|---|
| AI7503000995_24814812_f3_90 | 2553 | 6325 | 1950 | 649 | 1516 | 1.7e-155 |

Description sp:[LN:YDIF_BACSU] [AC:O05519] [GN:YDIF] [OR:BACILLUS SUBTILIS] [DE:HYPOTHETICAL ABC TRANSPORTER ATP-BINDING PROTEIN YDIF] [SP:O05519] [DB:swissprot] >pir:[LN:G69786] [AC:G69786 ] [PN:ABC transporter (ATP-binding protein) homolog ydiF] [GN:ydiF ] [CL:ATP-binding cassette homology] [OR:Bacillus subtilis] [DB:pir2] >gp:[GI:e1182574:g2632908] [LN:BSUB0004] [AC:Z99107:AL009126] [GN:ydiF] [FN:unknown] [OR:Bacillus subtilis] [DB:genpept-bct1] [DE:Bacillus subtilis complete genome (section 4 of 21): from 600701 to813890.] [NT:similar to ABC transporter (ATP-binding protein)] [SP:O05519] [LE:43544] [RE:45472] [DI:complement] >gp:[GI:d1020498:g1945111] [LN:D88802] [AC:D88802] [GN:ydiF] [OR:Bacillus subtilis] [SR:Bacillus subtilis (sub_species:Marburg, strain:168, isolate:JH642] [DB:genpept-bct1] [DE:Bacillus subtilis DNA for phoB-rrnE-groESL region, complete cds.] [NT:H. influenzae hypothetical ABC transporter; P44808] [LE:30546] [RE:32474] [DI:complement]

| ORF Name | NTID | AAID | NT Length | AA Length | score | probability |
|---|---|---|---|---|---|---|
| AI7503000995_24823588_f2_63 | 2554 | 6326 | 1386 | 461 | 1633 | 6.7e-168 |

Description sp:[LN:LEU2_LACLA] [AC:Q02142] [GN:LEUC] [OR:LACTOCOCCUS LACTIS] [SR:,SUBSPLACTIS:STREPTOCOCCUS LACTIS] [EC:4.2.1.33] [DE:(ISOPROPYLMALATE ISOMERASE) (ALPHA-IPM ISOMERASE) (IPMI)] [SP:Q02142] [DB:swissprot] >pir:[LN:S35134] [AC:S35134 ] [PN:probable 3-isopropylmalate dehydratase, chain leuC] [GN:leuC ] [OR:Lactococcus lactis subsp. lactis] [SR:strain NCDO2118, , strain NCDO2118] [SR:strain NCDO2118, ] [EC:4.2.1.33] [DB:pir2] >gp:[GI:g2565153] [LN:LLU92974] [AC:U92974:M90760:M90761] [PN:LeuC] [GN:leuC] [OR:Lactococcus lactis] [DB:genpept-bct1] [DE:Lactococcus lactis unknown gene, partial cds, and HisC (hisC),unknown, HisG (hisG), unknown, HisB (hisB), unknown, HisH (hish),HisA (hisA), HisF (hisF), HisIE (hisIE), unknown, unknown, LeuA(leuA), LeuB (leuB), LeuC (leuC), LeuD (leuD), unknown, IlvD(ilvD), IlvB (ilvB), IlvN, IlvC (ilvC), IlvA (ilvA), AldB (aldB)and aldR (aldR) genes, complete cds.] [NT:isopropylmalate dehydratase subunit] [LE:15188] [RE:16570] [DI:direct]

| ORF Name | NTID | AAID | NT Length | AA Length | score | probability |
|---|---|---|---|---|---|---|
| AI7503000995_25900300_c3_212 | 2555 | 6327 | 330 | 110 | 297 | 2.5e-26 |

Description
gp:[GI:g2689561] [LN:U93688] [AC:U93688] [OR:Staphylococcus aureus] [DB:genpept-bct2] [DE:Staphylococcus aureus toxic shock syndrome toxin-1 (tst),enterotoxin (ent), and integrase (int) genes, complete cds.] [NT:orf14] [LE:10769] [RE:11029] [DI:complement]

| ORF Name | NTID | AAID | NT Length | AA Length | score | probability |
|---|---|---|---|---|---|---|
| AI7503000995_26615912_c3_206 | 2556 | 6328 | 1479 | 492 | 1943 | 9.5e-201 |

Description
sp:[LN:SCRB_STAXY] [AC:Q05936] [GN:SCRB] [OR:STAPHYLOCOCCUS XYLOSUS] [EC:3.2.1.26] [DE:SUCROSE-6-PHOSPHATE HYDROLASE, (SUCRASE) (INVERTASE)] [SP:Q05936] [DB:swissprot] >pir:[LN:A47059] [AC:A47059 ] [PN:sucrase ScrB] [OR:Staphylococcus xylosus] [DB:pir2] >gp:[GI:e264653:g288269] [LN:SXSCRBA] [AC:X67744] [PN:beta-fructofuranosidase] [GN:scrB] [OR:Staphylococcus xylosus] [DB:genpept-bct1] [EC:3.2.1.26] [DE:S.xylosus scrB and scrR genes.] [SP:Q05936] [LE:1541] [RE:3025] [DI:direct]

| ORF Name | NTID | AAID | NT Length | AA Length | score | probability |
|---|---|---|---|---|---|---|
| AI7503000995_2866090_f2_35 | 2557 | 6329 | 1254 | 417 | 1250 | 2.6e-127 |

Description
gp:[GI:g2689564] [LN:U93688] [AC:U93688] [PN:integrase] [GN:int] [OR:Staphylococcus aureus] [DB:genpept-bct2] [DE:Staphylococcus aureus toxic shock syndrome toxin-1 (tst),enterotoxin (ent), and integrase (int) genes, complete cds.] [NT:similar to staphylococcal phage integrase] [LE:13871] [RE:15091] [DI:direct]

| ORF Name | NTID | AAID | NT Length | AA Length | score | probability |
|---|---|---|---|---|---|---|
| AI7503000995_29307312_c3_181 | 2558 | 6330 | 165 | 54 | | |

Description
NO-HIT

| ORF Name | NTID | AAID | NT Length | AA Length | score | probability |
|---|---|---|---|---|---|---|
| AI7503000995_31436_f1_15 | 2559 | 6331 | 177 | 58 | | |

Description
NO-HIT

| ORF Name | NTID | AAID | NT Length | AA Length | score | probability |
|---|---|---|---|---|---|---|
| AI7503000995_31680342_f3_74 | 2560 | 6332 | 546 | 181 | 176 | 4.6e-12 |

Description
gp:[GI:g1633572] [LN:KSU52064] [AC:U52064] [OR:Kaposi's sarcoma-associated herpesvirus] [SR:Kaposi's sarcoma-associated herpesvirus - Human herpesvirus 8] [DB:genpept-vrl] [DE:Kaposi's sarcoma-associated herpes-like virus ORF73 homolog gene,complete cds.] [NT:Herpesvirus saimiri ORF73 homolog] [LE:1] [RE:3489] [DI:direct] >gp:[GI:g1718329] [LN:KSU75698] [AC:U75698] [OR:Kaposi's sarcoma-associated herpesvirus] [SR:Kaposi's sarcoma-associated herpesvirus - Human herpesvirus 8] [DB:genpept-vrl] [DE:Kaposi's sarcoma-associated herpesvirus long unique region, 80putative ORF's and kaposin gene, complete cds.] [NT:ORF 73; extensive acidic domains, potential leucine] [LE:123809] [RE:127297] [DI:complement]

| ORF Name | NTID | AAID | NT Length | AA Length | score | probability |
|---|---|---|---|---|---|---|
| AI7503000995_33203138_c1_133 | 2561 | 6333 | 159 | 52 | | |

Description
NO-HIT

| ORF Name | NTID | AAID | NT Length | AA Length | score | probability |
|---|---|---|---|---|---|---|
| AI7503000995_3361326_c2_151 | 2562 | 6334 | 207 | 68 | | |

Description
NO-HIT

| ORF Name | NTID | AAID | NT Length | AA Length | score | probability |
|---|---|---|---|---|---|---|
| AI7503000995_34257878_f2_62 | 2563 | 6335 | 1065 | 354 | 894 | 1.4e-89 |

Description
sp:[LN:LEU3_LACLA] [AC:Q02143] [GN:LEUB] [OR:LACTOCOCCUS LACTIS]
[SR:,SUBSPLACTIS:STREPTOCOCCUS LACTIS] [EC:1.1.1.85] [DE:(IMDH) (3-IPM-DH)] [SP:Q02143]
[DB:swissprot] >pir:[LN:S35133] [AC:S35133:C36889 ] [PN:3-isopropylmalate
dehydrogenase,] [GN:leuB ] [CL:3-isopropylmalate dehydrogenase] [OR:Lactococcus lactis
subsp. lactis] [SR:strain NCDO2118, , strain NCDO2118] [SR:strain NCDO2118, ]
[EC:1.1.1.85] [DB:pir2] >gp:[GI:g2565152] [LN:LLU92974] [AC:U92974:M90760:M90761]
[PN:LeuB] [GN:leuB] [OR:Lactococcus lactis] [DB:genpept-bct1] [DE:Lactococcus lactis
unknown gene, partial cds, and HisC (hisC),unknown, HisG (hisG), unknown, HisB (hisB),
unknown, HisH (hish),HisA (hisA), HisF (hisF), HisIE (hisIE), unknown, unknown,
LeuA(leuA), LeuB (leuB), LeuC (leuC), LeuD (leuD), unknown, IlvD(ilvD), IlvB (ilvB),
IlvN, IlvC (ilvC), IlvA (ilvA), AldB (aldB)and aldR (aldR) genes, complete cds.]
[NT:isopropylmalate dehydrogenase] [LE:13788] [RE:14825] [DI:direct]

| ORF Name | NTID | AAID | NT Length | AA Length | score | probability |
|---|---|---|---|---|---|---|
| AI7503000995_34412750_c3_207 | 2564 | 6336 | 966 | 321 | 1031 | 4.2e-104 |

Description
pir:[LN:S20799] [AC:S58482:S20799 ] [PN:hypothetical protein 7] [CL:ribokinase]
[OR:Staphylococcus aureus] [DB:pir2] >gp:[GI:g46512] [LN:SAAGRAB] [AC:X52543:M32737]
[OR:Staphylococcus aureus] [DB:genpept-bct1] [DE:S.aureus agrA, agrB and hld genes.]
[NT:orf 7] [LE:4896] [RE:5855] [DI:complement]

| ORF Name | NTID | AAID | NT Length | AA Length | score | probability |
|---|---|---|---|---|---|---|
| AI7503000995_35598750_f3_72 | 2565 | 6337 | 849 | 282 | 112 | 3.9e-06 |

Description
gp:[GI:g2897106] [LN:AF020798] [AC:AF020798] [PN:repressor] [OR:Streptococcus
thermophilus bacteriophage TP-J34] [DB:genpept-phg] [DE:Streptococcus thermophilus
bacteriophage lysogeny module, integrasehomolog (int), putative host cell
surface-exposed lipoprotein,putative metallo-proteinase, repressor, Cro-like
regulatoryprotein, and P1-antirepressor homolog genes, complete cds.] [NT:CI-like
regulatory protein; orf121] [LE:4825] [RE:5190] [DI:complement]

| ORF Name | NTID | AAID | NT Length | AA Length | score | probability |
|---|---|---|---|---|---|---|
| AI7503000995_36132937_f2_53 | 2566 | 6338 | 1641 | 546 | 273 | 9.6e-20 |

Description
sp:[LN:HEXA_STRPN] [AC:P10564] [GN:HEXA] [OR:STREPTOCOCCUS PNEUMONIAE] [DE:DNA MISMATCH REPAIR PROTEIN HEXA] [SP:P10564] [DB:swissprot] >pir:[LN:C28667] [AC:C28667 ] [PN:DNA mismatch repair protein hexA] [GN:hexA ] [CL:DNA mismatch repair protein mutS] [OR:Streptococcus pneumoniae] [DB:pir2] >gp:[GI:g153655] [LN:STRHEXA] [AC:M18729] [PN:mismatch repair protein] [GN:hexA] [OR:Streptococcus pneumoniae] [SR:Streptococcus pneumoniae (strain 175) (clone: pLS141.) DNA] [DB:genpept-bct1] [DE:S.pneumoniae mismatch repair protein (hexA) gene, complete cds.] [LE:971] [RE:3505] [DI:direct]

| ORF Name | NTID | AAID | NT Length | AA Length | score | probability |
|---|---|---|---|---|---|---|
| AI7503000995_36206502_c3_197 | 2567 | 6339 | 483 | 160 | 340 | 7.0e-31 |

Description
pir:[LN:E69786] [AC:E69786 ] [PN:ribosomal-protein-alanine N-acetyltransfer homolog ydiD] [GN:ydiD] [CL:Escherichia coli peptide N-acetyltransferase rimI] [OR:Bacillus subtilis] [DB:pir2] >gp:[GI:e1182572:g2632906] [LN:BSUB0004] [AC:Z99107:AL009126] [GN:ydiD] [FN:unknown] [OR:Bacillus subtilis] [DB:genpept-bct1] [DE:Bacillus subtilis complete genome (section 4 of 21): from 600701 to813890.] [NT:similar to ribosomal-protein-alanine] [LE:41826] [RE:42281] [DI:direct] >gp:[GI:d1020496:g1945109] [LN:D88802] [AC:D88802] [GN:ydiD] [OR:Bacillus subtilis] [SR:Bacillus subtilis (sub_species:Marburg, strain:168, isolate:JH642] [DB:genpept-bct1] [DE:Bacillus subtilis DNA for phoB-rrnE-groESL region, complete cds.] [NT:H. influenzae, ribosomal protein alanine] [LE:28828] [RE:29283] [DI:direct]

| ORF Name | NTID | AAID | NT Length | AA Length | score | probability |
|---|---|---|---|---|---|---|
| AI7503000995_409556_f1_33 | 2568 | 6340 | 135 | 44 | 112 | 2.5e-06 |

Description
pir:[LN:D71245] [AC:D71245 ] [PN:hypothetical protein PH0221] [GN:PH0221 ] [OR:Pyrococcus horikoshii] [DB:pir2] >gp:[GI:d1030234:g3256608] [LN:AP000001] [AC:AP000001:AB009465:AB009464:AB009466:AB009467:AB009468:AB009469] [PN:235aa long hypothetical protein] [GN:PH0221] [OR:Pyrococcus horikoshii] [SR:Pyrococcus horikoshii (strain:OT3) DNA] [DB:genpept-bct1] [DE:Pyrococcus horikoshii OT3 genomic DNA, 1-287000 nt. position (1/7).] [LE:194212] [RE:194919] [DI:complement]

| ORF Name | NTID | AAID | NT Length | AA Length | score | probability |
|---|---|---|---|---|---|---|
| AI7503000995_4707506_c2_174 | 2569 | 6341 | 1314 | 437 | 1156 | 2.4e-117 |

Description
sp:[LN:NRGA_BACSU] [AC:Q07429] [GN:NRGA] [OR:BACILLUS SUBTILIS] [DE:PROBABLE AMMONIUM TRANSPORTER (MEMBRANE PROTEIN NRGA)] [SP:Q07429] [DB:swissprot] >pir:[LN:A36865] [AC:A36865:D69667 ] [PN:ammonium transporter nrgA] [GN:nrgA ] [CL:ammonium transporter nrgA] [OR:Bacillus subtilis] [DB:pir2] >gp:[GI:g143264] [LN:BACNRGABO] [AC:L03216] [PN:membrane-associated protein] [GN:nrgA] [OR:Bacillus subtilis] [SR:Bacillus subtilis (strain 168) DNA] [DB:genpept-bct1] [DE:Bacillus subtilis operon membrane-associated protein (nrgA), andPII-like protein (nrgB) genes, complete cds.] [NT:putative] [LE:126] [RE:1340] [DI:direct] >gp:[GI:e1184557:g2636176] [LN:BSUB0019] [AC:Z99122:AL009126] [PN:ammonium transporter] [GN:nrgA] [OR:Bacillus subtilis] [DB:genpept-bct1] [DE:Bacillus subtilis complete genome (section 19 of 21): from 3597091to 3809700.] [SP:Q07429] [LE:158754] [RE:159968] [DI:direct] >gp:[GI:e283112:g1684645] [LN:BSZ82987] [AC:Z82987] [PN:unknown] [GN:nrgA] [OR:Bacillus subtilis] [DB:genpept-bct1] [DE:B.subtilis ywo[A,B,C,D,E,F,G,H], nrg[A,B], spoIIID and mbl genes.] [SP:Q07429] [LE:1335] [RE:2549] [DI:complement] >gp:[GI:e1184557:g2636176] [LN:BSUB0019] [AC:Z99122:AL009126] [PN:ammonium transporter] [GN:nrgA] [OR:Bacillus subtilis] [DB:genpept] [DE:Bacillus subtilis complete genome (section 19 of 21): from 3597091to 3809700.] [SP:Q07429] [LE:158754] [RE:159968] [DI:direct]

| ORF Name | NTID | AAID | NT Length | AA Length | score | probability |
|---|---|---|---|---|---|---|
| AI7503000995_4958387_c1_132 | 2570 | 6342 | 537 | 178 | 305 | 3.6e-27 |

Description
pir:[LN:D69786] [AC:D69786 ] [PN:glycoprotein endopeptidase homolog ydiC] [GN:ydiC ] [OR:Bacillus subtilis] [DB:pir2] >gp:[GI:e1182571:g2632905] [LN:BSUB0004] [AC:Z99107:AL009126] [GN:ydiC] [FN:unknown] [OR:Bacillus subtilis] [DB:genpept-bct1] [DE:Bacillus subtilis complete genome (section 4 of 21): from 600701 to813890.] [NT:similar to glycoprotein endopeptidase] [LE:41127] [RE:41816] [DI:direct] >gp:[GI:d1020495:g1945108] [LN:D88802] [AC:D88802] [GN:ydiC] [OR:Bacillus subtilis] [SR:Bacillus subtilis (sub_species:Marburg, strain:168, isolate:JH642] [DB:genpept-bct1] [DE:Bacillus subtilis DNA for phoB-rrnE-groESL region, complete cds.] [NT:H. influenzae hypothetical protein; P43990 (182)] [LE:28129] [RE:28818] [DI:direct]

| ORF Name | NTID | AAID | NT Length | AA Length | score | probability |
|---|---|---|---|---|---|---|
| AI7503000995_5359438_c2_167 | 2571 | 6343 | 1107 | 368 | 1096 | 5.4e-111 |

Description
sp:[LN:YDIE_BACSU] [AC:O05518] [GN:YDIE] [OR:BACILLUS SUBTILIS] [DE:HYPOTHETICAL 36.8 KD PROTEIN IN PHOB-GROES INTERGENIC REGION] [SP:O05518] [DB:swissprot] >pir:[LN:F69786] [AC:F69786 ] [PN:glycoprotein endopeptidase homolog ydiE] [GN:ydiE ] [CL:O-sialoglycoprotein endopeptidase] [OR:Bacillus subtilis] [DB:pir2] >gp:[GI:e1182573:g2632907] [LN:BSUB0004] [AC:Z99107:AL009126] [GN:ydiE] [FN:unknown] [OR:Bacillus subtilis] [DB:genpept-bct1] [DE:Bacillus subtilis complete genome (section 4 of 21): from 600701 to813890.] [NT:similar to glycoprotein endopeptidase] [SP:O05518] [LE:42274] [RE:43314] [DI:direct] >gp:[GI:d1020497:g1945110] [LN:D88802] [AC:D88802] [GN:ydiE] [OR:Bacillus subtilis] [SR:Bacillus subtilis (sub_species:Marburg, strain:168, isolate:JH642] [DB:genpept-bct1] [DE:Bacillus subtilis DNA for phoB-rrnE-groESL region, complete cds.] [NT:P. haemolytica o-sialoglycoprotein endopeptidase;] [LE:29276] [RE:30316] [DI:direct]

| ORF Name | NTID | AAID | NT Length | AA Length | score | probability |
|---|---|---|---|---|---|---|
| AI7503000995_5909428_c3_203 | 2572 | 6344 | 750 | 249 | 582 | 1.6e-56 |

Description gp:[GI:d1039124:g4514349] [LN:AB013375] [AC:AB013375] [PN:YdiH] [GN:ydiH] [OR:Bacillus halodurans] [SR:Bacillus halodurans (strain:C-125) DNA] [DB:genpept-bct1] [DE:Bacillus halodurans C-125 ydiH, ydiI, ydij, yhcA and yxaA genes,complete and partial cds.] [LE:235] [RE:870] [DI:direct]

| ORF Name | NTID | AAID | NT Length | AA Length | score | probability |
|---|---|---|---|---|---|---|
| AI7503000995_6836010_c2_153 | 2573 | 6345 | 171 | 56 | | |

Description

NO-HIT

| ORF Name | NTID | AAID | NT Length | AA Length | score | probability |
|---|---|---|---|---|---|---|
| AI7503000995_860790_f3_101 | 2574 | 6346 | 1593 | 530 | 1391 | 3.0e-142 |

Description sp:[LN:LEU1_LACLA] [AC:Q02141] [GN:LEUA] [OR:LACTOCOCCUS LACTIS]
[SR:,SUBSPLACTIS:STREPTOCOCCUS LACTIS] [EC:4.1.3.12] [DE:SYNTHASE] (ALPHA-IPM SYNTHETASE)] [SP:Q02141] [DB:swissprot] >pir:[LN:S35132] [AC:S35132:B36889 ]
[PN:2-isopropylmalate synthase,:alpha-isopropylmalate synthase] [GN:leuA ]
[CL:2-isopropylmalate synthase leuA] [OR:Lactococcus lactis subsp. lactis]
[EC:4.1.3.12] [DB:pir2]

| ORF Name | NTID | AAID | NT Length | AA Length | score | probability |
|---|---|---|---|---|---|---|
| AI7503000995_9843800_f1_8 | 2575 | 6347 | 192 | 63 | 47 | 0.020 |

Description gp:[GI:e236301:g1263146] [LN:MTMCECYTB] [AC:Z70776] [PN:cytochrome b] [OR:Mitochondrion Mugil cephalus] [SR:Mugil cephalus] [DB:genpept-vrt] [DE:M.cephalus mitochondrial cytochrome b gene.] [LE:<1] [RE:>292] [DI:direct]

| ORF Name | NTID | AAID | NT Length | AA Length | score | probability |
|---|---|---|---|---|---|---|
| AI7503000995_995451_f2_61 | 2576 | 6348 | 1020 | 339 | 1139 | 1.5e-115 |

Description sp:[LN:ILVC_BACSU] [AC:P37253] [GN:ILVC] [OR:BACILLUS SUBTILIS] [EC:1.1.1.86]
[DE:ISOMEROREDUCTASE] (ALPHA-KETO-BETA-HYDROXYLACIL REDUCTOISOMERASE)] [SP:P37253]
[DB:swissprot] >pir:[LN:C69644] [AC:C69644 ] [PN:ketol-acid reductoisomerase ilvC]
[GN:ilvC ] [CL:Methanococcus ketol-acid reductoisomerase: ketol-acid reductoisomerase homology] [OR:Bacillus subtilis] [DB:pir2] >gp:[GI:g143093] [LN:BACILNB] [AC:L03181]
[PN:ketol-acid reductoisomerase] [GN:ilvC] [OR:Bacillus subtilis] [SR:Bacillus subtilis DNA] [DB:genpept-bct1] [DE:Bacillus subtilis ilvB, ilvN and ilvC genes, complete ilv-leuoperon.] [LE:2979] [RE:4007] [DI:direct] >gp:[GI:e1184078:g2635294]
[LN:BSUB0015] [AC:Z99118:AL009126] [PN:ketol-acid reductoisomerase (acetohydroxy-acid]
[GN:ilvC] [FN:valine/isoleucine biosynthesis] [OR:Bacillus subtilis] [DB:genpept-bct1]
[EC:1.1.1.86] [DE:Bacillus subtilis complete genome (section 15 of 21): from 2795131to 3013540.] [SP:P37253] [LE:97651] [RE:98679] [DI:complement] >gp:[GI:e1165366:g1770068]
[LN:BSZ75208] [AC:Z75208] [PN:ketol-acid reductoisomerase] [GN:ilvC] [OR:Bacillus subtilis] [DB:genpept-bct1] [EC:1.1.1.86] [DE:B.subtilis genomic sequence 89009bp.]
[NT:ketol-acid reductoisomerase (acetohydroxy-acid] [SP:P37253] [LE:71228] [RE:72256]
[DI:direct]

| ORF_Name | NTID | AAID | NT Length | AA Length | score | probability |
|---|---|---|---|---|---|---|
| AI7503000996_10719452_c3_376 | 2577 | 6349 | 684 | 227 | 371 | 3.6e-34 |

Description sp:[LN:HLY3_BACSU] [AC:P54175] [GN:YPLQ] [OR:BACILLUS SUBTILIS] [DE:HEMOLYSIN III HOMOLOG] [SP:P54175] [DB:swissprot] >pir:[LN:D69938] [AC:D69938 ] [PN:hemolysin III homolog homolog yplQ] [GN:yplQ ] [CL:hemolysin III yplQ] [OR:Bacillus subtilis] [DB:pir2] >gp:[GI:g1256643] [LN:BACYACA] [AC:L77246] [GN:yplQ] [OR:Bacillus subtilis] [DB:genpept-bct1] [DE:Bacillus subtilis (YAC10-9 clone) DNA region between the serA andkdg loci.] [NT:20.2% identity with NADH dehydrogenase of the] [LE:25508] [RE:26149] [DI:complement] >gp:[GI:e1183626:g2634599] [LN:BSUB0012] [AC:Z99115:AL009126] [GN:yplQ] [FN:unknown] [OR:Bacillus subtilis] [DB:genpept-bct1] [DE:Bacillus subtilis complete genome (section 12 of 21): from 2195541to 2409220.] [NT:similar to hemolysin III homolog] [SP:P54175] [LE:99003] [RE:99644] [DI:direct]

| ORF_Name | NTID | AAID | NT Length | AA Length | score | probability |
|---|---|---|---|---|---|---|
| AI7503000996_10734567_f3_197 | 2578 | 6350 | 249 | 82 | | |

Description

NO-HIT

| ORF_Name | NTID | AAID | NT Length | AA Length | score | probability |
|---|---|---|---|---|---|---|
| AI7503000996_10752342_c2_327 | 2579 | 6351 | 981 | 326 | 773 | 9.1e-77 |

Description pir:[LN:D69812] [AC:D69812 ] [PN:ferrichrome ABC transporter (permease) homolog yfmE] [GN:yfmE ] [CL:vitamin B12 transport protein btuC] [OR:Bacillus subtilis] [DB:pir2] >gp:[GI:e1182740:g2633074] [LN:BSUB0005] [AC:Z99108:AL009126] [GN:yfmE] [FN:unknown] [OR:Bacillus subtilis] [DB:genpept-bct1] [DE:Bacillus subtilis complete genome (section 5 of 21): from 802821 to1011250.] [NT:similar to ferrichrome ABC transporter (permease)] [LE:20404] [RE:21405] [DI:complement] >gp:[GI:d1023182:g2443248] [LN:D86417] [AC:D86417] [PN:YfmE] [OR:Bacillus subtilis] [SR:Bacillus subtilis (strain:AC327) DNA] [DB:genpept-bct1] [DE:Bacillus subtilis 35.7 kb genomic DNA, 70-73 degree region,complete cds.] [LE:27116] [RE:28117] [DI:direct]

| ORF_Name | NTID | AAID | NT Length | AA Length | score | probability |
|---|---|---|---|---|---|---|
| AI7503000996_10759818_c1_271 | 2580 | 6352 | 1008 | 335 | 669 | 9.5e-66 |

Description pir:[LN:B69812] [AC:B69812 ] [PN:ferrichrome ABC transporter (binding prote) homolog yfmC] [GN:yfmC ] [CL:iron(III) dicitrate transport protein] [OR:Bacillus subtilis] [DB:pir2] >gp:[GI:e1182742:g2633076] [LN:BSUB0005] [AC:Z99108:AL009126] [GN:yfmC] [FN:unknown] [OR:Bacillus subtilis] [DB:genpept-bct1] [DE:Bacillus subtilis complete genome (section 5 of 21): from 802821 to1011250.] [NT:similar to ferrichrome ABC transporter (binding] [LE:22475] [RE:23422] [DI:complement] >gp:[GI:d1023180:g2443246] [LN:D86417] [AC:D86417] [PN:YfmC] [OR:Bacillus subtilis] [SR:Bacillus subtilis (strain:AC327) DNA] [DB:genpept-bct1] [DE:Bacillus subtilis 35.7 kb genomic DNA, 70-73 degree region,complete cds.] [LE:25099] [RE:26046] [DI:direct]

| ORF_Name | NTID | AAID | NT Length | AA Length | score | probability |
|---|---|---|---|---|---|---|
| AI7503000996_11913877_f1_49 | 2581 | 6353 | 123 | 40 | | |

Description

NO-HIT

| ORF_Name | NTID | AAID | NT Length | AA Length | score | probability |
|---|---|---|---|---|---|---|
| AI7503000996_11961568_c2_311 | 2582 | 6354 | 945 | 314 | 1007 | 1.5e-101 |

Description
sp:[LN:LACC_STAAU] [AC:P11099] [GN:LACC] [OR:STAPHYLOCOCCUS AUREUS] [EC:2.7.1.144]
[DE:TAGATOSE-6-PHOSPHATE KINASE, (PHOSPHOTAGATOKINASE)] [SP:P11099] [DB:swissprot]
>pir:[LN:S04358] [AC:S04358 ] [PN:lacC protein] [GN:lacC ] [CL:6-phosphofructokinase 2]
[OR:Staphylococcus aureus] [DB:pir2] >gp:[GI:g46605] [LN:SALACCD] [AC:X14827]
[OR:Staphylococcus aureus] [DB:genpept-bct1] [DE:Staphylococcus aureus lacC and lacD
genes.] [NT:lacC polypeptide (AA 1-310)] [SP:P11099] [LE:55] [RE:987] [DI:direct]

| ORF_Name | NTID | AAID | NT Length | AA Length | score | probability |
|---|---|---|---|---|---|---|
| AI7503000996_12578885_f2_109 | 2583 | 6355 | 366 | 121 | | |

Description
NO-HIT

| ORF_Name | NTID | AAID | NT Length | AA Length | score | probability |
|---|---|---|---|---|---|---|
| AI7503000996_12603166_f2_89 | 2584 | 6356 | 303 | 100 | 110 | 1.6e-06 |

Description
pir:[LN:G71244] [AC:G71244 ] [PN:hypothetical protein PH0217] [GN:PH0217 ]
[OR:Pyrococcus horikoshii] [DB:pir2] >gp:[GI:d1030229:g3256603] [LN:AP000001]
[AC:AP000001:AB009465:AB009464:AB009466:AB009467:AB009468:AB009469] [PN:106aa long
hypothetical protein] [GN:PH0217] [OR:Pyrococcus horikoshii] [SR:Pyrococcus horikoshii
(strain:OT3) DNA] [DB:genpept-bct1] [DE:Pyrococcus horikoshii OT3 genomic DNA, 1-287000
nt. position (1/7).] [LE:191072] [RE:191392] [DI:complement]

| ORF_Name | NTID | AAID | NT Length | AA Length | score | probability |
|---|---|---|---|---|---|---|
| AI7503000996_1287875_f3_173 | 2585 | 6357 | 123 | 40 | | |

Description
NO-HIT

| ORF_Name | NTID | AAID | NT Length | AA Length | score | probability |
|---|---|---|---|---|---|---|
| AI7503000996_13680468_c2_336 | 2586 | 6358 | 1080 | 359 | 1133 | 6.4e-115 |

Description
sp:[LN:YBAL_BACSU] [AC:P50863] [GN:YBAL:REC233] [OR:BACILLUS SUBTILIS] [DE:HYPOTHETICAL
38.6 KD PROTEIN IN CWLD-GERD INTERGENIC REGION] [SP:P50863] [DB:swissprot]
>pir:[LN:A69743] [AC:A69743 ] [PN:ATP-binding Mrp-like protein homolog ybaL] [GN:ybaL ]
[CL:conserved probable membrane protein YIL003w] [OR:Bacillus subtilis] [DB:pir2]
>gp:[GI:e95614:g1177249] [LN:BSCWLD] [AC:X74737] [GN:rec233] [OR:Bacillus subtilis]
[DB:genpept-bct1] [DE:B.subtilis cwlD, rec223 and gerD genes.] [SP:P50863] [LE:1376]
[RE:2434] [DI:direct] >gp:[GI:e1182087:g2632421] [LN:BSUB0001] [AC:Z99104:AL009126]
[GN:ybaL] [FN:unknown] [OR:Bacillus subtilis] [DB:genpept-bct1] [DE:Bacillus subtilis
complete genome (section 1 of 21): from 1 to213080.] [NT:alternate gene name: ybxI;
similar to ATP-binding] [LE:157420] [RE:158478] [DI:direct] >gp:[GI:d1011652:g1644213]
[LN:D64126] [AC:D64126] [PN:unknown] [GN:orf14] [OR:Bacillus subtilis] [SR:Bacillus
subtilis (strain:168) DNA] [DB:genpept-bct1] [DE:Bacillus subtilis genes for ribosomal
proteins L13 and S9, putativecell wall hydrolase CwlD, gerD protein, 16S ribosomal RNA
and 23Sribosomal RNA.] [LE:6981] [RE:8039] [DI:direct]

| ORF Name | NTID | AAID | NT Length | AA Length | score | probability |
|---|---|---|---|---|---|---|
| AI7503000996_13871068_c1_247 | 2587 | 6359 | 666 | 221 | 893 | 1.7e-89 |

Description
gp:[GI:d1039013:g4512410] [LN:AB017508] [AC:AB017508] [GN:rpsC] [OR:Bacillus halodurans] [SR:Bacillus halodurans (strain:C-125) DNA] [DB:genpept-bct1] [DE:Bacillus halodurans C-125 genomic DNA, 32 kb fragment, completecds.] [NT:rpsC homologue (identity of 87% to B. subtilis )] [LE:16781] [RE:17440] [DI:direct]

| ORF Name | NTID | AAID | NT Length | AA Length | score | probability |
|---|---|---|---|---|---|---|
| AI7503000996_13886593_c2_318 | 2588 | 6360 | 252 | 83 | 96 | 5.0e-05 |

Description
gp:[GI:g727435] [LN:LLU23376] [AC:U23376] [OR:Lactococcus lactis] [DB:genpept-bct1] [DE:Lactococcus lactis N5-(1-carboxyethyl)-L-ornithine synthase (ceo)gene, complete cds.] [NT:putative 6-kDa protein] [LE:165] [RE:353] [DI:direct]

| ORF Name | NTID | AAID | NT Length | AA Length | score | probability |
|---|---|---|---|---|---|---|
| AI7503000996_1408450_f2_158 | 2589 | 6361 | 564 | 187 | 104 | 9.8e-06 |

Description
pir:[LN:E71186] [AC:E71186 ] [PN:hypothetical protein PH1769] [GN:PH1769 ] [OR:Pyrococcus horikoshii] [DB:pir2] >gp:[GI:d1031827:g3258201] [LN:AP000007] [AC:AP000007:AB009464:AB009465:AB009521:AB009522:AB009523:AB009524] [PN:100aa long hypothetical protein] [GN:PH1769] [OR:Pyrococcus horikoshii] [SR:Pyrococcus horikoshii (strain:OT3) DNA] [DB:genpept-bct1] [DE:Pyrococcus horikoshii OT3 genomic DNA, 1485001-1738505 nt. position(7/7).] [LE:59186] [RE:59488] [DI:direct]

| ORF Name | NTID | AAID | NT Length | AA Length | score | probability |
|---|---|---|---|---|---|---|
| AI7503000996_1410277_f1_4 | 2590 | 6362 | 153 | 50 | | |

Description
NO-HIT

| ORF Name | NTID | AAID | NT Length | AA Length | score | probability |
|---|---|---|---|---|---|---|
| AI7503000996_14277217_c2_297 | 2591 | 6363 | 516 | 171 | 626 | 3.4e-61 |

Description
sp:[LN:RS5_BACSU] [AC:P21467] [GN:RPSE:SPCA] [OR:BACILLUS SUBTILIS] [DE:30S RIBOSOMAL PROTEIN S5 (BS5)] [SP:P21467] [DB:swissprot] >pir:[LN:R3BS5S] [AC:D69699:S12680:S11355 ] [PN:ribosomal protein S5] [GN:rpsE ] [CL:Escherichia coli ribosomal protein S5] [OR:Bacillus subtilis] [DB:pir1] >gp:[GI:g1044981] [LN:BACRPLP] [AC:L47971] [PN:ribosomal protein S5] [GN:rpsE] [OR:Bacillus subtilis] [DB:genpept-bct1] [DE:Bacillus subtilis ribosomal protein (rplPNXEFROQ, rpmCDJ,rpsQNHEMK) genes, integral membrane protein (secY) gene, adenylatekinase (adk) gene, methionine aminopeptidase (map) gene,inititation factor 1 (infA) gene, RNA polymerase alpha (rpoA) gene.] [LE:3585] [RE:4085] [DI:direct] >gp:[GI:e1182066:g2632400] [LN:BSUB0001] [AC:Z99104:AL009126] [PN:ribosomal protein S5] [GN:rpsE] [OR:Bacillus subtilis] [DB:genpept-bct1] [DE:Bacillus subtilis complete genome (section 1 of 21): from 1 to213080.] [SP:P21467] [LE:143359] [RE:143859] [DI:direct]

| ORF Name | NTID | AAID | NT Length | AA Length | score | probability |
|---|---|---|---|---|---|---|
| AI7503000996_14312750_c3_354 | 2592 | 6364 | 492 | 163 | 665 | 2.5e-65 |

Description
sp:[LN:RL13_STACA] [AC:Q00990] [GN:RPLM] [OR:STAPHYLOCOCCUS CARNOSUS] [DE:50S RIBOSOMAL PROTEIN L13] [SP:Q00990] [DB:swissprot] >pir:[LN:S23063] [AC:S23063 ] [PN:ribosomal protein L13] [GN:rplM ] [CL:Escherichia coli ribosomal protein L13] [OR:Staphylococcus carnosus] [DB:pir2] >gp:[GI:g46912] [LN:SCRPLM] [AC:X63912:S79454] [PN:ribosomal protein L13] [GN:rplM] [OR:Staphylococcus carnosus] [DB:genpept-bct1] [DE:S.carnosus rplM gene for ribosomal protein L13.] [SP:Q00990] [LE:309] [RE:746] [DI:direct]

| ORF Name | NTID | AAID | NT Length | AA Length | score | probability |
|---|---|---|---|---|---|---|
| AI7503000996_14346067_c2_316 | 2593 | 6365 | 1023 | 340 | 561 | 2.6e-54 |

Description
gp:[GI:g4321580] [LN:AF050114] [AC:AF050114] [PN:alginate lyase] [OR:Pseudomonas sp. W7] [DB:genpept-bct2] [DE:Pseudomonas sp. W7 alginate lyase gene, complete cds.] [LE:1] [RE:1038] [DI:direct]

| ORF Name | NTID | AAID | NT Length | AA Length | score | probability |
|---|---|---|---|---|---|---|
| AI7503000996_14531558_f1_53 | 2594 | 6366 | 126 | 41 | | |

Description
NO-HIT

| ORF Name | NTID | AAID | NT Length | AA Length | score | probability |
|---|---|---|---|---|---|---|
| AI7503000996_14900826_c3_386 | 2595 | 6367 | 351 | 116 | 188 | 8.9e-15 |

Description
gp:[GI:g208931] [LN:SYNORFLAC] [AC:M15619] [OR:synthetic construct] [SR:E.coli (strain SE5000) synthetic DNA, clone pKB1] [DB:genpept-syn] [DE:Synthetic E.coli ORF16/lacZ fusion protein, partial cds.] [NT:ORF16-lacZ fusion protein] [LE:29] [RE:>232] [DI:direct]

| ORF Name | NTID | AAID | NT Length | AA Length | score | probability |
|---|---|---|---|---|---|---|
| AI7503000996_157750_c3_379 | 2596 | 6368 | 195 | 64 | | |

Description
NO-HIT

| ORF Name | NTID | AAID | NT Length | AA Length | score | probability |
|---|---|---|---|---|---|---|
| AI7503000996_15879002_f2_96 | 2597 | 6369 | 123 | 40 | | |

Description
NO-HIT

| ORF Name | NTID | AAID | NT Length | AA Length | score | probability |
|---|---|---|---|---|---|---|
| AI7503000996_16829627_c2_300 | 2598 | 6370 | 372 | 123 | 484 | 3.8e-46 |

Description
gp:[GI:g1044989] [LN:BACRPLP] [AC:L47971] [PN:ribosomal protein S13] [GN:rpsM] [OR:Bacillus subtilis] [DB:genpept-bct1] [DE:Bacillus subtilis ribosomal protein (rplPNXEFROQ, rpmCDJ,rpsQNHEMK) genes, integral membrane protein (secY) gene, adenylatekinase (adk) gene, methionine aminopeptidase (map) gene,inititation factor 1 (infA) gene, RNA polymerase alpha (rpoA) gene.] [LE:8197] [RE:8562] [DI:direct]

| ORF Name | NTID | AAID | NT Length | AA Length | score | probability |
|---|---|---|---|---|---|---|
| AI7503000996_16835333_c2_288 | 2599 | 6371 | 840 | 279 | 1198 | 8.3e-122 |

Description
gp:[GI:g1165306] [LN:BSU43929] [AC:U43929] [PN:L2] [GN:rplB] [OR:Bacillus subtilis] [DB:genpept-bct2] [DE:Bacillus subtilis ribosomal protein gene cluster, rpsJ, rplC, rplD,rplW, rplB, rpsS, rplV and rpsC genes, complete cds, and rplP gene,partial cds.] [NT:ribosomal protein] [LE:2266] [RE:3099] [DI:direct]

| ORF Name | NTID | AAID | NT Length | AA Length | score | probability |
|---|---|---|---|---|---|---|
| AI7503000996_197127_f2_121 | 2600 | 6372 | 1965 | 654 | 285 | 9.0e-22 |

Description
sp:[LN:Y4XN_RHISN] [AC:P55706] [GN:Y4XN] [OR:RHIZOBIUM SP] [SR:NGR234,] [DE:HYPOTHETICAL 71.0 KD PROTEIN Y4XN] [SP:P55706] [DB:swissprot] >gp:[GI:g2182722] [LN:AE000106] [AC:AE000106:U00090] [PN:Y4xN] [GN:y4xN] [OR:Rhizobium sp. NGR234] [DB:genpept-bct2] [DE:Rhizobium sp. NGR234 plasmid pNGR234a, section 43 of 46 of thecomplete plasmid sequence.] [NT:hypothetical 71 kd protein; similar to Escherichia] [LE:6573] [RE:8459] [DI:complement]

| ORF Name | NTID | AAID | NT Length | AA Length | score | probability |
|---|---|---|---|---|---|---|
| AI7503000996_19730052_c1_278 | 2601 | 6373 | 1479 | 492 | 990 | 9.2e-100 |

Description
pir:[LN:F69763] [AC:F69763 ] [PN:multidrug resistance protein homolog ycnB] [GN:ycnB ] [CL:lincomycin-resistance protein lmrB] [OR:Bacillus subtilis] [DB:pir2] >gp:[GI:e1182351:g2632685] [LN:BSUB0003] [AC:Z99106:AL009126] [GN:ycnB] [FN:unknown] [OR:Bacillus subtilis] [DB:genpept-bct1] [DE:Bacillus subtilis complete genome (section 3 of 21): from 402751 to611850.] [NT:similar to multidrug resistance protein] [LE:32866] [RE:34284] [DI:complement] >gp:[GI:d1009651:g1805454] [LN:D50453] [AC:D50453] [PN:homologue of multidrug resistance protein B,] [GN:ycnB] [OR:Bacillus subtilis] [SR:Bacillus subtilis (strain:168 trpC2) DNA] [DB:genpept-bct1] [DE:Bacillus subtilis DNA for 25-36 degree region containing theamyE-srfA region, complete cds.] [LE:115269] [RE:116687] [DI:complement]

| ORF Name | NTID | AAID | NT Length | AA Length | score | probability |
|---|---|---|---|---|---|---|
| AI7503000996_19822151_c2_302 | 2602 | 6374 | 372 | 123 | 433 | 9.7e-41 |

Description
pir:[LN:F32307] [AC:F32307:C69696 ] [PN:ribosomal protein L17:ribosomal protein BL15 (rplQ)] [GN:rplQ ] [CL:Escherichia coli ribosomal protein L17] [OR:Bacillus subtilis] [DB:pir2] >gp:[GI:g142464] [LN:BACALPHA] [AC:M26414] [PN:ribosomal protein L17] [GN:rplQ] [OR:Bacillus subtilis] [SR:Bacillus subtilis DNA] [DB:genpept-bct1] [DE:B.subtilis initiation factor 1, ribosomal proteins B, S13, S11, L17and RNA polymerase alpha core protein genes, complete cds.] [LE:2603] [RE:2965] [DI:direct] >gp:[GI:g1044992] [LN:BACRPLP] [AC:L47971] [PN:ribosomal protein L17] [GN:rplQ] [OR:Bacillus subtilis] [DB:genpept-bct1] [DE:Bacillus subtilis ribosomal protein (rplPNXEFROQ, rpmCDJ,rpsQNHEMK) genes, integral membrane protein (secY) gene, adenylatekinase (adk) gene, methionine aminopeptidase (map) gene,inititation factor 1 (infA) gene, RNA polymerase alpha (rpoA) gene.] [LE:10177] [RE:10539] [DI:direct] >gp:[GI:e1182077:g2632411] [LN:BSUB0001] [AC:Z99104:AL009126] [PN:ribosomal protein L17 (BL15)] [GN:rplQ] [OR:Bacillus subtilis] [DB:genpept-bct1] [DE:Bacillus subtilis complete genome (section 1 of 21): from 1 to213080.] [SP:P20277] [LE:149951] [RE:150313] [DI:direct]

| ORF Name | NTID | AAID | NT Length | AA Length | score | probability |
|---|---|---|---|---|---|---|
| AI7503000996_20363762_c3_375 | 2603 | 6375 | 1215 | 404 | 587 | 4.7e-57 |

Description gp:[GI:g5052662] [LN:AF145686] [AC:AF145686] [PN:BcDNA.LD24639] [GN:BcDNA.LD24639] [OR:Drosophila melanogaster] [SR:fruit fly] [DB:genpept-inv2] [DE:Drosophila melanogaster clone LD24639 BcDNA.LD24639 (BcDNA.LD24639)mRNA, complete cds.] [LE:199] [RE:1761] [DI:direct]

| ORF Name | NTID | AAID | NT Length | AA Length | score | probability |
|---|---|---|---|---|---|---|
| AI7503000996_2125637_f3_165 | 2604 | 6376 | 150 | 49 | | |

Description

NO-HIT

| ORF Name | NTID | AAID | NT Length | AA Length | score | probability |
|---|---|---|---|---|---|---|
| AI7503000996_21516287_f1_6 | 2605 | 6377 | 126 | 41 | | |

Description

NO-HIT

| ORF Name | NTID | AAID | NT Length | AA Length | score | probability |
|---|---|---|---|---|---|---|
| AI7503000996_21751063_c1_245 | 2606 | 6378 | 579 | 192 | 621 | 1.2e-60 |

Description sp:[LN:RL3_BACST] [AC:P28600] [GN:RPLC] [OR:BACILLUS STEAROTHERMOPHILUS] [DE:50S RIBOSOMAL PROTEIN L3] [SP:P28600] [DB:swissprot] >pir:[LN:S24363] [AC:S24363:S36085 ] [PN:ribosomal protein L3] [GN:rpl3 ] [CL:Escherichia coli ribosomal protein L3] [OR:Bacillus stearothermophilus] [DB:pir2] >gp:[GI:g40102] [LN:BSRPLCLD] [AC:X67014:S42397] [PN:ribosomal protein L3] [GN:rplC] [OR:Bacillus stearothermophilus] [DB:genpept-bct1] [DE:B.stearothermophilus genes rplC and rplD for ribosomal proteins L3and L4, respectively.] [SP:P28600] [LE:52] [RE:693] [DI:direct]

| ORF Name | NTID | AAID | NT Length | AA Length | score | probability |
|---|---|---|---|---|---|---|
| AI7503000996_21915941_c1_250 | 2607 | 6379 | 372 | 123 | 571 | 2.3e-55 |

Description sp:[LN:RL14_BACSU] [AC:P12875] [GN:RPLN] [OR:BACILLUS SUBTILIS] [DE:50S RIBOSOMAL PROTEIN L14] [SP:P12875] [DB:swissprot] >pir:[LN:R5BS4B] [AC:S05992:H69695 ] [PN:ribosomal protein L14] [GN:rplN ] [CL:Escherichia coli ribosomal protein L14] [OR:Bacillus subtilis] [DB:pir1] >gp:[GI:g1044974] [LN:BACRPLP] [AC:L47971] [PN:ribosomal protein L14] [GN:rplN] [OR:Bacillus subtilis] [DB:genpept-bct1] [DE:Bacillus subtilis ribosomal protein (rplPNXEFROQ, rpmCDJ,rpsQNHEMK) genes, integral membrane protein (secY) gene, adenylatekinase (adk) gene, methionine aminopeptidase (map) gene,inititation factor 1 (infA) gene, RNA polymerase alpha (rpoA) gene.] [LE:675] [RE:1043] [DI:direct] >gp:[GI:g40150] [LN:BSSPC] [AC:X15664] [OR:Bacillus subtilis] [DB:genpept-bct1] [DE:B.subtilis S10/spc operon rpmC, rpsQ, rplN, rplX, rplE, rpsN genes.] [NT:L14 protein (AA 1-122)] [SP:P12875] [LE:840] [RE:1208] [DI:direct] >gp:[GI:e1182059:g2632393] [LN:BSUB0001] [AC:Z99104:AL009126] [PN:ribosomal protein L14] [GN:rplN] [OR:Bacillus subtilis] [DB:genpept-bct1] [DE:Bacillus subtilis complete genome (section 1 of 21): from 1 to213080.] [SP:P12875] [LE:140449] [RE:140817] [DI:direct]

| ORF Name | NTID | AAID | NT Length | AA Length | score | probability |
|---|---|---|---|---|---|---|
| AI7503000996_22002318_c3_342 | 2608 | 6380 | 330 | 109 | 390 | 3.5e-36 |

Description
sp:[LN:RL24_BACST] [AC:P04455] [GN:RPLX] [OR:BACILLUS STEAROTHERMOPHILUS] [DE:50S RIBOSOMAL PROTEIN L24] [SP:P04455] [DB:swissprot] >pir:[LN:R5BS24] [AC:A02819 ] [PN:ribosomal protein L24] [CL:Escherichia coli ribosomal protein L24] [OR:Bacillus stearothermophilus] [DB:pir1]

| ORF Name | NTID | AAID | NT Length | AA Length | score | probability |
|---|---|---|---|---|---|---|
| AI7503000996_22455303_f3_190 | 2609 | 6381 | 165 | 54 | | |

Description
NO-HIT

| ORF Name | NTID | AAID | NT Length | AA Length | score | probability |
|---|---|---|---|---|---|---|
| AI7503000996_22688428_c3_383 | 2610 | 6382 | 144 | 47 | | |

Description
NO-HIT

| ORF Name | NTID | AAID | NT Length | AA Length | score | probability |
|---|---|---|---|---|---|---|
| AI7503000996_22900877_c1_252 | 2611 | 6383 | 132 | 43 | | |

Description
NO-HIT

| ORF Name | NTID | AAID | NT Length | AA Length | score | probability |
|---|---|---|---|---|---|---|
| AI7503000996_23460931_f2_100 | 2612 | 6384 | 429 | 142 | | |

Description
NO-HIT

| ORF Name | NTID | AAID | NT Length | AA Length | score | probability |
|---|---|---|---|---|---|---|
| AI7503000996_23572128_c3_346 | 2613 | 6385 | 183 | 60 | 282 | 9.7e-25 |

Description
sp:[LN:RL30_STAAU] [AC:O06444] [GN:RPMD] [OR:STAPHYLOCOCCUS AUREUS] [DE:50S RIBOSOMAL PROTEIN L30] [SP:O06444] [DB:swissprot] >gp:[GI:g2078380] [LN:SAU96620] [AC:U96620] [PN:ribosomal protein L30] [GN:L30] [OR:Staphylococcus aureus] [DB:genpept-bct1] [DE:Staphylococcus aureus NCTC 8325 ribosomal protein L30 (L30),ribosomal protein L15 (L15) and SecY (secY) genes, complete cds.] [LE:65] [RE:244] [DI:direct]

| ORF Name | NTID | AAID | NT Length | AA Length | score | probability |
|---|---|---|---|---|---|---|
| AI7503000996_23572180_c3_349 | 2614 | 6386 | 222 | 73 | 326 | 2.1e-29 |

Description
pir:[LN:F69644] [AC:F69644 ] [PN:translation initiation factor IF-1] [GN:infA ] [CL:translation initiation factor IF-1] [OR:Bacillus subtilis] [DB:pir2] >gp:[GI:g142459] [LN:BACALPHA] [AC:M26414] [PN:initiation factor 1] [GN:infA] [OR:Bacillus subtilis] [SR:Bacillus subtilis DNA] [DB:genpept-bct1] [DE:B.subtilis initiation factor 1, ribosomal proteins B, S13, S11, L17and RNA polymerase alpha core protein genes, complete cds.] [LE:235] [RE:453] [DI:direct] >gp:[GI:g1044987] [LN:BACRPLP] [AC:L47971] [PN:initiation factor IF-1] [GN:infA] [OR:Bacillus subtilis] [DB:genpept-bct1] [DE:Bacillus subtilis ribosomal protein (rplPNXEFROQ, rpmCDJ,rpsQNHEMK) genes, integral membrane protein (secY) gene, adenylatekinase (adk) gene, methionine aminopeptidase (map) gene,inititation factor 1 (infA) gene, RNA polymerase alpha (rpoA) gene.] [LE:7809] [RE:8027] [DI:direct] >gp:[GI:e1182072:g2632406] [LN:BSUB0001] [AC:Z99104:AL009126] [PN:initiation factor IF-I] [GN:infA] [FN:protein synthesis] [OR:Bacillus subtilis] [DB:genpept-bct1] [DE:Bacillus subtilis complete genome (section 1 of 21): from 1 to213080.] [SP:P20458] [LE:147583] [RE:147801] [DI:direct]

| ORF Name | NTID | AAID | NT Length | AA Length | score | probability |
|---|---|---|---|---|---|---|
| AI7503000996_23573587_c2_294 | 2615 | 6387 | 201 | 66 | 287 | 2.9e-25 |

Description
gp:[GI:d1039020:g4512417] [LN:AB017508] [AC:AB017508] [GN:rpsN] [OR:Bacillus halodurans] [SR:Bacillus halodurans (strain:C-125) DNA] [DB:genpept-bct1] [DE:Bacillus halodurans C-125 genomic DNA, 32 kb fragment, completecds.] [NT:rpsN homologue (identity of 92% to B. subtilis )] [LE:19712] [RE:19897] [DI:direct]

| ORF Name | NTID | AAID | NT Length | AA Length | score | probability |
|---|---|---|---|---|---|---|
| AI7503000996_23603450_c2_317 | 2616 | 6388 | 585 | 194 | 85 | 0.0017 |

Description
pir:[LN:S77761] [AC:S77761 ] [PN:probable phosphotransferase system enzyme II, :protein MC456:protein-Npi-phosphohistidine--sugar phosphotransferase] [OR:Mycoplasma capricolum] [EC:2.7.1.69] [DB:pir2]

| ORF Name | NTID | AAID | NT Length | AA Length | score | probability |
|---|---|---|---|---|---|---|
| AI7503000996_23632750_c3_365 | 2617 | 6389 | 525 | 174 | 726 | 8.7e-72 |

Description
pir:[LN:JC2527] [AC:JC2527:PC2381 ] [PN:alkaline shock protein] [GN:asp23 ] [OR:Staphylococcus aureus] [DB:pir2] >gp:[GI:g894289] [LN:S76213] [AC:S76213] [PN:alkaline shock protein 23] [GN:asp23] [OR:Staphylococcus aureus] [SR:Staphylococcus aureus 912] [DB:genpept-bct1] [DE:asp23=alkaline shock protein 23 {methicillin resistant}[Staphylococcus aureus, 912, Genomic, 1360 nt].] [NT:Method: conceptual translation with partial peptide] [LE:343] [RE:852] [DI:direct]

| ORF_Name | NTID | AAID | NT Length | AA Length | score | probability |
|---|---|---|---|---|---|---|
| AI7503000996_23634813_c3_355 | 2618 | 6390 | 771 | 256 | 970 | 1.2e-97 |

Description
sp:[LN:LACR_STAAU] [AC:P16644] [GN:LACR] [OR:STAPHYLOCOCCUS AUREUS] [DE:LACTOSE PHOSPHOTRANSFERASE SYSTEM REPRESSOR] [SP:P16644] [DB:swissprot] >pir:[LN:A44506] [AC:A44506 ] [PN:lactose operon repressor lacR] [OR:Staphylococcus aureus] [DB:pir2] >gp:[GI:g153035] [LN:STALACR] [AC:M32103] [PN:lacR repressor] [OR:Staphylococcus aureus] [SR:Staphylococcus aureus (strain 8325-4) DNA] [DB:genpept-bct1] [DE:Staphylococcus aureus lac repressor (lacR) gene, complete cds andlacA repressor (lacA), partial cds.] [LE:1058] [RE:1813] [DI:direct]

| ORF_Name | NTID | AAID | NT Length | AA Length | score | probability |
|---|---|---|---|---|---|---|
| AI7503000996_23642761_f1_22 | 2619 | 6391 | 228 | 75 | 80 | 0.0064 |

Description
gp:[GI:d1000903:g220579] [LN:MUSPRIMP] [AC:D00570:J00614] [OR:Mus musculus] [SR:Mus musculus male cDNA to mRNA] [DB:genpept-rod] [DE:Mus musculus mRNA for ORFs (putative primordial protein), completecds.] [NT:open reading frame (196 AA)] [LE:584] [RE:1174] [DI:direct] >gp:[GI:d1000903:g220579] [LN:MUSPRIMP] [AC:D00570:J00614] [OR:Mus musculus] [SR:Mus musculus male cDNA to mRNA] [DB:genpept] [DE:Mus musculus mRNA for ORFs (putative primordial protein), completecds.] [NT:open reading frame (196 AA)] [LE:584] [RE:1174] [DI:direct]

| ORF_Name | NTID | AAID | NT Length | AA Length | score | probability |
|---|---|---|---|---|---|---|
| AI7503000996_23683375_c3_356 | 2620 | 6392 | 507 | 168 | 583 | 1.2e-56 |

Description
sp:[LN:LACA_STRMU] [AC:P26423] [GN:LACA] [OR:STREPTOCOCCUS MUTANS] [EC:5.3.1.26] [DE:GALACTOSE-6-PHOSPHATE ISOMERASE LACA SUBUNIT,] [SP:P26423] [DB:swissprot] >pir:[LN:C43258] [AC:C43258:S27701 ] [PN:galactoside O-acetyltransferase,] [GN:lacA ] [OR:Streptococcus mutans] [EC:2.3.1.18] [DB:pir2] >gp:[GI:g153673] [LN:STRLACOP] [AC:M80797] [PN:galactosidase acetyltransferase] [GN:lacA] [OR:Streptococcus mutans] [SR:Streptococcus mutans (strain PS14) DNA] [DB:genpept-bct1] [EC:2.3.1.18] [DE:Streptococcus mutans lac operon.] [LE:1534] [RE:1962] [DI:direct]

| ORF_Name | NTID | AAID | NT Length | AA Length | score | probability |
|---|---|---|---|---|---|---|
| AI7503000996_2379658_f2_82 | 2621 | 6393 | 225 | 74 | | |

Description
NO-HIT

| ORF_Name | NTID | AAID | NT Length | AA Length | score | probability |
|---|---|---|---|---|---|---|
| AI7503000996_23882135_c2_303 | 2622 | 6394 | 873 | 290 | 665 | 2.5e-65 |

Description
sp:[LN:YBXA_BACSU] [AC:P40735] [GN:YBXA] [OR:BACILLUS SUBTILIS] [DE:HYPOTHETICAL ABC TRANSPORTER ATP-BINDING PROTEIN YBXA] [SP:P40735] [DB:swissprot] >pir:[LN:E69751] [AC:E69751:G32307 ] [PN:ABC transporter (ATP-binding protein) homolog ybxA] [GN:ybxA ] [CL:ATP-binding cassette homology] [OR:Bacillus subtilis] [DB:pir2] >gp:[GI:e1182078:g2632412] [LN:BSUB0001] [AC:Z99104:AL009126] [GN:ybxA] [FN:unknown] [OR:Bacillus subtilis] [DB:genpept-bct1] [DE:Bacillus subtilis complete genome (section 1 of 21): from 1 to213080.] [NT:alternate gene name: ybaD; similar to ABC] [SP:P40735] [LE:150441] [RE:151286] [DI:direct] >gp:[GI:d1011641:g1644202] [LN:D64126] [AC:D64126] [PN:unknown] [GN:orf4] [OR:Bacillus subtilis] [SR:Bacillus subtilis (strain:168) DNA] [DB:genpept-bct1] [DE:Bacillus subtilis genes for ribosomal proteins L13 and S9, putativecell wall hydrolase CwlD, gerD protein, 16S ribosomal RNA and 23Sribosomal RNA.] [LE:1] [RE:846] [DI:direct]

| ORF Name | NTID | AAID | NT Length | AA Length | score | probability |
|---|---|---|---|---|---|---|
| AI7503000996_23944052_f1_36 | 2623 | 6395 | 150 | 49 | | |

Description
NO-HIT

| ORF Name | NTID | AAID | NT Length | AA Length | score | probability |
|---|---|---|---|---|---|---|
| AI7503000996_24223787_c1_258 | 2624 | 6396 | 156 | 51 | 221 | 2.8e-18 |

Description
sp:[LN:RPOA_BACSU] [AC:P20429] [GN:RPOA] [OR:BACILLUS SUBTILIS] [EC:2.7.7.6] [DE:ALPHA CHAIN) (RNA POLYMERASE ALPHA SUBUNIT)] [SP:P20429] [DB:swissprot] >pir:[LN:E32307] [AC:E32307:C24972:E69698 ] [PN:DNA-directed RNA polymerase, alpha chain rpoA:transcriptase alpha chain] [GN:rpoA ] [CL:DNA-directed RNA polymerase alpha chain] [OR:Bacillus subtilis] [EC:2.7.7.6] [DB:pir2] >gp:[GI:g142463] [LN:BACALPHA] [AC:M26414] [PN:RNA polymerase alpha-core-subunit] [GN:rpoA] [OR:Bacillus subtilis] [SR:Bacillus subtilis DNA] [DB:genpept-bct1] [DE:B.subtilis initiation factor 1, ribosomal proteins B, S13, S11, L17and RNA polymerase alpha core protein genes, complete cds.] [LE:1581] [RE:2525] [DI:direct] >gp:[GI:g1044991] [LN:BACRPLP] [AC:L47971] [PN:RNA polymerase alpha-core-subunit] [GN:rpoA] [OR:Bacillus subtilis] [DB:genpept-bct1] [DE:Bacillus subtilis ribosomal protein (rplPNXEFROQ, rpmCDJ,rpsQNHEMK) genes, integral membrane protein (secY) gene, adenylatekinase (adk) gene, methionine aminopeptidase (map) gene,inititation factor 1 (infA) gene, RNA polymerase alpha (rpoA) gene.] [LE:9155] [RE:10099] [DI:direct] >gp:[GI:e1182076:g2632410] [LN:BSUB0001] [AC:Z99104:AL009126] [PN:RNA polymerase (alpha subunit)] [GN:rpoA] [OR:Bacillus subtilis] [DB:genpept-bct1] [EC:2.7.7.6] [DE:Bacillus subtilis complete genome (section 1 of 21): from 1 to213080.] [SP:P20429] [LE:148929] [RE:149873] [DI:direct]

| ORF Name | NTID | AAID | NT Length | AA Length | score | probability |
|---|---|---|---|---|---|---|
| AI7503000996_24244012_c3_374 | 2625 | 6397 | 546 | 181 | 280 | 1.6e-24 |

Description
pir:[LN:C70048] [AC:C70048 ] [PN:conserved hypothetical protein yvsG] [GN:yvsG ] [OR:Bacillus subtilis] [DB:pir2] >gp:[GI:e1249789:g2832793] [LN:BS43KBDNA] [AC:AJ223978] [PN:YvsG protein] [GN:yvsG] [OR:Bacillus subtilis] [DB:genpept-bct1] [DE:Bacillus subtilis 42.7kB DNA fragment from yvsA to yvqA.] [LE:5971] [RE:6453] [DI:complement] >gp:[GI:e1186023:g2635848] [LN:BSUB0018] [AC:Z99121:AL009126] [GN:yvsG] [FN:unknown] [OR:Bacillus subtilis] [DB:genpept-bct1] [DE:Bacillus subtilis complete genome (section 18 of 21): from 3399551to 3609060.] [NT:similar to hypothetical proteins] [LE:21284] [RE:21766] [DI:direct]

| ORF Name | NTID | AAID | NT Length | AA Length | score | probability |
|---|---|---|---|---|---|---|
| AI7503000996_24252318_c1_256 | 2626 | 6398 | 126 | 41 | 191 | 4.3e-15 |

Description
sp:[LN:RL36_BACST] [AC:P07841] [GN:RPMJ] [OR:BACILLUS STEAROTHERMOPHILUS] [DE:(BL38)] [SP:P07841] [DB:swissprot] >pir:[LN:R5BS36] [AC:S08566:S59066 ] [PN:ribosomal protein L36:ribosomal protein BL38:ribosomal protein II] [CL:Escherichia coli ribosomal protein L36] [OR:Bacillus stearothermophilus] [DB:pir1]

| ORF Name | NTID | AAID | NT Length | AA Length | score | probability |
|---|---|---|---|---|---|---|
| AI7503000996_24328927_f1_39 | 2627 | 6399 | 201 | 66 | | |

Description
NO-HIT

| ORF Name | NTID | AAID | NT Length | AA Length | score | probability |
|---|---|---|---|---|---|---|
| AI7503000996_24337750_c2_312 | 2628 | 6400 | 981 | 326 | 1524 | 2.4e-156 |

Description
sp:[LN:LACD_STAAU] [AC:P11100] [GN:LACD] [OR:STAPHYLOCOCCUS AUREUS] [EC:4.1.2.40]
[DE:ALDOLASE) (D-TAGATOSE-1,6-BISPHOSPHATE ALDOLASE)] [SP:P11100] [DB:swissprot]
>pir:[LN:S04359] [AC:S04359 ] [PN:lacD protein] [GN:lacD ] [OR:Staphylococcus aureus]
[DB:pir2] >gp:[GI:g46606] [LN:SALACCD] [AC:X14827] [OR:Staphylococcus aureus]
[DB:genpept-bct1] [DE:Staphylococcus aureus lacC and lacD genes.] [NT:lacD polypeptide
(AA 1-326)] [SP:P11100] [LE:991] [RE:1971] [DI:direct]

| ORF Name | NTID | AAID | NT Length | AA Length | score | probability |
|---|---|---|---|---|---|---|
| AI7503000996_24339718_c2_335 | 2629 | 6401 | 483 | 160 | 93 | 0.033 |

Description
gp:[GI:e246715:g1617437] [LN:SGCOM7865] [AC:X98110] [PN:pheromone receptor] [GN:comD2]
[OR:Streptococcus gordonii] [DB:genpept-bct1] [DE:S.gordonii tRNA-Arg, comC2, comD2 &
comE2 genes.] [NT:histidine kinase] [LE:656] [RE:2014] [DI:direct]

| ORF Name | NTID | AAID | NT Length | AA Length | score | probability |
|---|---|---|---|---|---|---|
| AI7503000996_24350953_f1_10 | 2630 | 6402 | 132 | 43 | 72 | 0.017 |

Description
pir:[LN:G71244] [AC:G71244 ] [PN:hypothetical protein PH0217] [GN:PH0217 ]
[OR:Pyrococcus horikoshii] [DB:pir2] >gp:[GI:d1030229:g3256603] [LN:AP000001]
[AC:AP000001:AB009464:AB009465:AB009466:AB009467:AB009468:AB009469] [PN:106aa long
hypothetical protein] [GN:PH0217] [OR:Pyrococcus horikoshii] [SR:Pyrococcus horikoshii
(strain:OT3) DNA] [DB:genpept-bct1] [DE:Pyrococcus horikoshii OT3 genomic DNA, 1-287000
nt. position (1/7).] [LE:191072] [RE:191392] [DI:complement]

| ORF Name | NTID | AAID | NT Length | AA Length | score | probability |
|---|---|---|---|---|---|---|
| AI7503000996_24397127_c2_313 | 2631 | 6403 | 1776 | 591 | 2460 | 1.5e-255 |

Description
sp:[LN:PTLB_STAAU] [AC:P11162] [GN:LACE] [OR:STAPHYLOCOCCUS AUREUS] [EC:2.7.1.69]
[DE:(EC 2.7.1.69) (EII-LAC)] [SP:P11162] [DB:swissprot] >pir:[LN:B28474] [AC:B28474 ]
[PN:phosphotransferase system enzyme II,, lactose-specific, factor II]
[OR:Staphylococcus aureus] [EC:2.7.1.69] [DB:pir2] >gp:[GI:g153038] [LN:STALACS]
[AC:J03479:M17729] [OR:Staphylococcus aureus] [SR:S.aureus (strain 8325-4) DNA, clone
pFB34] [DB:genpept-bct1] [DE:S.aureus enzyme III-lac (lacF), enzyme II-lac (lacE),
andphospho-beta-galactosidase (lacG) genes, complete cds.] [NT:enzyme II-lac (lacE)]
[LE:413] [RE:2131] [DI:direct]

| ORF Name | NTID | AAID | NT Length | AA Length | score | probability |
|---|---|---|---|---|---|---|
| AI7503000996_24402217_c3_350 | 2632 | 6404 | 405 | 134 | 560 | 3.4e-54 |

Description
sp:[LN:RS11_BACSU] [AC:P04969] [GN:RPSK] [OR:BACILLUS SUBTILIS] [DE:30S RIBOSOMAL PROTEIN S11 (BS11)] [SP:P04969] [DB:swissprot] >pir:[LN:R3BSS1] [AC:D32307:B24972:S11361:B69700 ] [PN:ribosomal protein S11:ribosomal protein BS11] [GN:rpsK ] [CL:Escherichia coli ribosomal protein S11] [OR:Bacillus subtilis] [DB:pir1] >gp:[GI:g142462] [LN:BACALPHA] [AC:M26414] [PN:ribosomal protein S11] [GN:rpsK] [OR:Bacillus subtilis] [SR:Bacillus subtilis DNA] [DB:genpept-bct1] [DE:B.subtilis initiation factor 1, ribosomal proteins B, S13, S11, L17and RNA polymerase alpha core protein genes, complete cds.] [LE:1009] [RE:1404] [DI:direct] >gp:[GI:g1044990] [LN:BACRPLP] [AC:L47971] [PN:ribosomal protein S11] [GN:rpsK] [OR:Bacillus subtilis] [DB:genpept-bct1] [DE:Bacillus subtilis ribosomal protein (rplPNXEFROQ, rpmCDJ,rpsQNHEMK) genes, integral membrane protein (secY) gene, adenylatekinase (adk) gene, methionine aminopeptidase (map) gene,inititation factor 1 (infA) gene, RNA polymerase alpha (rpoA) gene.] [LE:8583] [RE:8978] [DI:direct] >gp:[GI:g143451] [LN:BACRPOA] [AC:M13957] [OR:Bacillus subtilis] [SR:B.subtilis (strain 168 Marburg) DNA clone lambda-gt11-11-1] [DB:genpept-bct1] [DE:B.subtilis DNA sequence of the rpsM-rpoA interval.] [NT:ribosomal protein S11] [LE:133] [RE:528] [DI:direct] >gp:[GI:e1182075:g2632409] [LN:BSUB0001] [AC:Z99104:AL009126] [PN:ribosomal protein S11 (BS11)] [GN:rpsK] [OR:Bacillus subtilis] [DB:genpept-bct1] [DE:Bacillus subtilis complete genome (section 1 of 21): from 1 to213080.] [SP:P04969] [LE:148357] [RE:148752] [DI:direct]

| ORF Name | NTID | AAID | NT Length | AA Length | score | probability |
|---|---|---|---|---|---|---|
| AI7503000996_24641927_c1_273 | 2633 | 6405 | 1380 | 459 | 978 | 1.7e-98 |

Description
sp:[LN:YKAA_BACFI] [AC:P30267] [OR:BACILLUS FIRMUS] [DE:HYPOTHETICAL 50.9 KD PROTEIN IN KATA 3'REGION (ORF A)] [SP:P30267] [DB:swissprot] >pir:[LN:S27491] [AC:S27491 ] [PN:hypothetical protein A] [OR:Bacillus firmus] [DB:pir2] >gp:[GI:g143121] [LN:BACKATA2] [AC:L02548:M74194] [OR:Bacillus firmus] [SR:Bacillus firmus DNA] [DB:genpept-bct1] [DE:B.firmus ORF A and ORF B, complete cds.] [NT:ORF A; putative] [LE:225] [RE:1616] [DI:direct]

| ORF Name | NTID | AAID | NT Length | AA Length | score | probability |
|---|---|---|---|---|---|---|
| AI7503000996_24648312_f1_48 | 2634 | 6406 | 747 | 248 | 905 | 9.3e-91 |

Description
gp:[GI:g845686] [LN:STALACR] [AC:M32103] [OR:Staphylococcus aureus] [SR:Staphylococcus aureus (strain 8325-4) DNA] [DB:genpept-bct1] [DE:Staphylococcus aureus lac repressor (lacR) gene, complete cds andlacA repressor (lacA), partial cds.] [NT:ORF-27] [LE:76] [RE:807] [DI:complement]

| ORF Name | NTID | AAID | NT Length | AA Length | score | probability |
|---|---|---|---|---|---|---|
| AI7503000996_24744040_c1_270 | 2635 | 6407 | 1065 | 354 | 361 | 4.1e-33 |

Description
gp:[GI:g4982168] [LN:AE001804] [AC:AE001804:AE000512] [PN:hypothetical protein] [GN:TM1597] [OR:Thermotoga maritima] [DB:genpept-bct2] [DE:Thermotoga maritima section 116 of 136 of the complete genome.] [NT:similar to percent identity: 0.00; identified by] [LE:7299] [RE:8363] [DI:direct]

| ORF Name | NTID | AAID | NT Length | AA Length | score | probability |
|---|---|---|---|---|---|---|
| AI7503000996_24806662_c1_248 | 2636 | 6408 | 237 | 78 | 252 | 1.5e-21 |

Description
sp:[LN:RL29_BACSU] [AC:P12873] [GN:RPMC] [OR:BACILLUS SUBTILIS] [DE:50S RIBOSOMAL PROTEIN L29] [SP:P12873] [DB:swissprot] >pir:[LN:R5BS2L] [AC:S05990:E69697 ] [PN:ribosomal protein L29] [GN:rpmC ] [CL:Escherichia coli ribosomal protein L29] [OR:Bacillus subtilis] [DB:pir1] >gp:[GI:g1044972] [LN:BACRPLP] [AC:L47971] [PN:ribosomal protein L29] [GN:rpmC] [OR:Bacillus subtilis] [DB:genpept-bct1] [DE:Bacillus subtilis ribosomal protein (rplPNXEFROQ, rpmCDJ,rpsQNHEMK) genes, integral membrane protein (secY) gene, adenylatekinase (adk) gene, methionine aminopeptidase (map) gene,inititation factor 1 (infA) gene, RNA polymerase alpha (rpoA) gene.] [LE:142] [RE:342] [DI:direct] >gp:[GI:g40148] [LN:BSSPC] [AC:X15664] [OR:Bacillus subtilis] [DB:genpept-bct1] [DE:B.subtilis S10/spc operon rpmC, rpsQ, rplN, rplX, rplE, rpsN genes.] [NT:L29 protein (AA 1-66)] [SP:P12873] [LE:313] [RE:513] [DI:direct] >gp:[GI:e1182057:g2632391] [LN:BSUB0001] [AC:Z99104:AL009126] [PN:ribosomal protein L29] [GN:rpmC] [OR:Bacillus subtilis] [DB:genpept-bct1] [DE:Bacillus subtilis complete genome (section 1 of 21): from 1 to213080.] [SP:P12873] [LE:139922] [RE:140122] [DI:direct]

| ORF Name | NTID | AAID | NT Length | AA Length | score | probability |
|---|---|---|---|---|---|---|
| AI7503000996_24855303_c3_368 | 2637 | 6409 | 1047 | 348 | 784 | 6.2e-78 |

Description
pir:[LN:C69812] [AC:C69812 ] [PN:ferrichrome ABC transporter (permease) homolog yfmD] [GN:yfmD ] [CL:ferrichrome ABC transporter] [OR:Bacillus subtilis] [DB:pir2] >gp:[GI:e1182741:g2633075] [LN:BSUB0005] [AC:Z99108:AL009126] [GN:yfmD] [FN:unknown] [OR:Bacillus subtilis] [DB:genpept-bct1] [DE:Bacillus subtilis complete genome (section 5 of 21): from 802821 to1011250.] [NT:similar to ferrichrome ABC transporter (permease)] [LE:21402] [RE:22403] [DI:complement] >gp:[GI:d1023181:g2443247] [LN:D86417] [AC:D86417] [PN:YfmD] [OR:Bacillus subtilis] [SR:Bacillus subtilis (strain:AC327) DNA] [DB:genpept-bct1] [DE:Bacillus subtilis 35.7 kb genomic DNA, 70-73 degree region,complete cds.] [LE:26118] [RE:27119] [DI:direct]

| ORF Name | NTID | AAID | NT Length | AA Length | score | probability |
|---|---|---|---|---|---|---|
| AI7503000996_25908568_c1_253 | 2638 | 6410 | 453 | 150 | 706 | 1.1e-69 |

Description
sp:[LN:RL15_STAAU] [AC:O06445] [GN:RPLO] [OR:STAPHYLOCOCCUS AUREUS] [DE:50S RIBOSOMAL PROTEIN L15] [SP:O06445] [DB:swissprot] >gp:[GI:g2078381] [LN:SAU96620] [AC:U96620] [PN:ribosomal protein L15] [GN:L15] [OR:Staphylococcus aureus] [DB:genpept-bct1] [DE:Staphylococcus aureus NCTC 8325 ribosomal protein L30 (L30),ribosomal protein L15 (L15) and SecY (secY) genes, complete cds.] [LE:261] [RE:701] [DI:direct]

| ORF Name | NTID | AAID | NT Length | AA Length | score | probability |
|---|---|---|---|---|---|---|
| AI7503000996_26205151_f2_85 | 2639 | 6411 | 156 | 51 | 123 | 6.9e-08 |

Description
pir:[LN:B71245] [AC:B71245 ] [PN:hypothetical protein PH0220] [GN:PH0220 ] [OR:Pyrococcus horikoshii] [DB:pir2] >gp:[GI:d1030232:g3256606] [LN:AP000001] [AC:AP000001:AB009465:AB009464:AB009466:AB009467:AB009468:AB009469] [PN:171aa long hypothetical protein] [GN:PH0220] [OR:Pyrococcus horikoshii] [SR:Pyrococcus horikoshii (strain:OT3) DNA] [DB:genpept-bct1] [DE:Pyrococcus horikoshii OT3 genomic DNA, 1-287000 nt. position (1/7).] [LE:192864] [RE:193379] [DI:complement]

| ORF Name | NTID | AAID | NT Length | AA Length | score | probability |
|---|---|---|---|---|---|---|
| AI7503000996_26360036_c3_345 | 2640 | 6412 | 387 | 128 | 429 | 2.6e-40 |

Description
sp:[LN:RL18_BACSU] [AC:P46899:P70969] [GN:RPLR] [OR:BACILLUS SUBTILIS] [DE:50S RIBOSOMAL PROTEIN L18] [SP:P46899:P70969] [DB:swissprot] >gp:[GI:g1044980] [LN:BACRPLP] [AC:L47971] [PN:ribosomal protein L18] [GN:rplR] [OR:Bacillus subtilis] [DB:genpept-bct1] [DE:Bacillus subtilis ribosomal protein (rplPNXEFROQ, rpmCDJ,rpsQNHEMK) genes, integral membrane protein (secY) gene, adenylatekinase (adk) gene, methionine aminopeptidase (map) gene,inititation factor 1 (infA) gene, RNA polymerase alpha (rpoA) gene.] [LE:3198] [RE:3560] [DI:direct]

| ORF Name | NTID | AAID | NT Length | AA Length | score | probability |
|---|---|---|---|---|---|---|
| AI7503000996_26773450_c1_249 | 2641 | 6413 | 285 | 94 | 380 | 4.0e-35 |

Description
sp:[LN:RS17_BACST] [AC:P23828] [GN:RPSQ] [OR:BACILLUS STEAROTHERMOPHILUS] [DE:30S RIBOSOMAL PROTEIN S17] [SP:P23828] [DB:swissprot] >pir:[LN:S17865] [AC:S17865:S59056 ] [PN:ribosomal protein S17] [GN:rps17 ] [CL:Escherichia coli ribosomal protein S17] [OR:Bacillus stearothermophilus] [DB:pir2]

| ORF Name | NTID | AAID | NT Length | AA Length | score | probability |
|---|---|---|---|---|---|---|
| AI7503000996_26776678_c2_290 | 2642 | 6414 | 372 | 123 | 431 | 1.6e-40 |

Description
sp:[LN:RL22_BACST] [AC:P23311] [GN:RPLV] [OR:BACILLUS STEAROTHERMOPHILUS] [DE:50S RIBOSOMAL PROTEIN L22] [SP:P23311] [DB:swissprot] >pir:[LN:S10612] [AC:S10612 ] [PN:ribosomal protein L22] [CL:Escherichia coli ribosomal protein L22] [OR:Bacillus stearothermophilus] [DB:pir2] >gp:[GI:g40107] [LN:BSRPLS] [AC:X54994] [PN:ribosomal protein L22] [OR:Bacillus stearothermophilus] [DB:genpept-bct1] [DE:B.stearothermophilus gene for ribosomal proteins L2, S19, L22, S3,and L16.] [SP:P23311] [LE:923] [RE:1264] [DI:direct]

| ORF Name | NTID | AAID | NT Length | AA Length | score | probability |
|---|---|---|---|---|---|---|
| AI7503000996_2735801_c1_269 | 2643 | 6415 | 1848 | 615 | 274 | 1.3e-20 |

Description
sp:[LN:Y4XN_RHISN] [AC:P55706] [GN:Y4XN] [OR:RHIZOBIUM SP] [SR:NGR234,] [DE:HYPOTHETICAL 71.0 KD PROTEIN Y4XN] [SP:P55706] [DB:swissprot] >gp:[GI:g2182722] [LN:AE000106] [AC:AE000106:U00090] [PN:Y4xN] [GN:y4xN] [OR:Rhizobium sp. NGR234] [DB:genpept-bct2] [DE:Rhizobium sp. NGR234 plasmid pNGR234a, section 43 of 46 of thecomplete plasmid sequence.] [NT:hypothetical 71 kd protein; similar to Escherichia] [LE:6573] [RE:8459] [DI:complement]

| ORF Name | NTID | AAID | NT Length | AA Length | score | probability |
|---|---|---|---|---|---|---|
| AI7503000996_277312_c1_276 | 2644 | 6416 | 1353 | 450 | 452 | 9.4e-43 |

Description
gp:[GI:e1391039:g4467970] [LN:MXEGLBG] [AC:X76640] [PN:hypothetical protein] [FN:transmembrane protein, putative] [OR:Myxococcus xanthus] [DB:genpept-bct1] [DE:Myxococcus xanthus celA gene and ORFX.] [NT:ORFX] [LE:669] [RE:2192] [DI:direct]

| ORF Name | NTID | AAID | NT Length | AA Length | score | probability |
|---|---|---|---|---|---|---|
| AI7503000996_285808_f2_84 | 2645 | 6417 | 225 | 74 | | |

Description
NO-HIT

| ORF Name | NTID | AAID | NT Length | AA Length | score | probability |
|---|---|---|---|---|---|---|
| AI7503000996_29314381_f2_151 | 2646 | 6418 | 138 | 45 | 79 | 0.0032 |

Description
pir:[LN:QQECR3] [AC:A04439 ] [PN:hypothetical protein E-116] [OR:Escherichia coli] [DB:pir1] [MP:72 min ]

| ORF Name | NTID | AAID | NT Length | AA Length | score | probability |
|---|---|---|---|---|---|---|
| AI7503000996_29328312_c2_289 | 2647 | 6419 | 339 | 112 | 431 | 1.6e-40 |

Description
gp:[GI:g4927744] [LN:AF126059] [AC:AF126059] [PN:RpS19] [GN:rpsS] [OR:Streptococcus pneumoniae] [DB:genpept-bct2] [DE:Streptococcus pneumoniae isolate R6 ribosomal protein operon,partial sequence.] [NT:30S ribosomal protein S19] [LE:934] [RE:1215] [DI:direct] >gp:[GI:g4927753] [LN:AF126060] [AC:AF126060] [PN:RpS19] [GN:rpsS] [OR:Streptococcus pneumoniae] [DB:genpept-bct2] [DE:Streptococcus pneumoniae isolate ZR1 ribosomal protein operon,partial sequence.] [NT:30S ribosomal protein S19] [LE:934] [RE:1215] [DI:direct] >gp:[GI:g4927762] [LN:AF126061] [AC:AF126061] [PN:RpS19] [GN:rpsS] [OR:Streptococcus pneumoniae] [DB:genpept-bct2] [DE:Streptococcus pneumoniae isolate SP#5 ribosomal protein operon,partial sequence.] [NT:30S ribosomal protein S19] [LE:934] [RE:1215] [DI:direct]

| ORF Name | NTID | AAID | NT Length | AA Length | score | probability |
|---|---|---|---|---|---|---|
| AI7503000996_29562550_f3_218 | 2648 | 6420 | 156 | 51 | | |

Description
NO-HIT

| ORF Name | NTID | AAID | NT Length | AA Length | score | probability |
|---|---|---|---|---|---|---|
| AI7503000996_30742165_c3_347 | 2649 | 6421 | 1323 | 440 | 1919 | 3.3e-198 |

Description
sp:[LN:SECY_STACA] [AC:Q05217] [GN:SECY] [OR:STAPHYLOCOCCUS CARNOSUS] [DE:PREPROTEIN TRANSLOCASE SECY SUBUNIT] [SP:Q05217] [DB:swissprot] >pir:[LN:S30115] [AC:S30115 ] [PN:preprotein translocase secY] [GN:secY ] [CL:preprotein translocase secY] [OR:Staphylococcus carnosus] [DB:pir2] >gp:[GI:g49189] [LN:SCSECY] [AC:X70086:S47913:X68981] [GN:secY] [OR:Staphylococcus carnosus] [DB:genpept-bct1] [DE:S.carnosus secY gene.] [SP:Q05217] [LE:223] [RE:1515] [DI:direct]

| ORF Name | NTID | AAID | NT Length | AA Length | score | probability |
|---|---|---|---|---|---|---|
| AI7503000996_3131677_f2_99 | 2650 | 6422 | 123 | 40 | | |

Description
NO-HIT

| ORF_Name | NTID | AAID | NT Length | AA Length | score | probability |
|---|---|---|---|---|---|---|
| AI7503000996_31377318_c1_246 | 2651 | 6423 | 291 | 96 | 297 | 2.5e-26 |

Description
sp:[LN:RL23_BACSU] [AC:P42924] [GN:RPLW] [OR:BACILLUS SUBTILIS] [DE:50S RIBOSOMAL
PROTEIN L23] [SP:P42924] [DB:swissprot] >pir:[LN:A69697] [AC:A69697 ] [PN:ribosomal
protein L23] [GN:rplW ] [CL:Escherichia coli ribosomal protein L23] [OR:Bacillus
subtilis] [DB:pir1] >gp:[GI:d1009466:g786155] [LN:BACRPL1] [AC:D50302] [PN:Ribosomal
Protein L23] [GN:rplW] [OR:Bacillus subtilis] [SR:Bacillus subtilis (strain:168) DNA]
[DB:genpept-bct1] [DE:Bacillus subtilis genes for ribosomal proteins L13, L4, L23,
L2,S19, L22, S3 and L16, partial and complete cds.] [LE:1140] [RE:1427] [DI:direct]
>gp:[GI:e1182051:g2632385] [LN:BSUB0001] [AC:Z99104:AL009126] [PN:ribosomal protein
L23] [GN:rplW] [OR:Bacillus subtilis] [DB:genpept-bct1] [DE:Bacillus subtilis complete
genome (section 1 of 21): from 1 to213080.] [SP:P42924] [LE:136990] [RE:137277]
[DI:direct] >gp:[GI:g1165305] [LN:BSU43929] [AC:U43929] [PN:L23] [GN:rplW] [OR:Bacillus
subtilis] [DB:genpept-bct2] [DE:Bacillus subtilis ribosomal protein gene cluster, rpsJ,
rplC, rplD,rplW, rplB, rpsS, rplV and rpsC genes, complete cds, and rplP gene,partial
cds.] [NT:ribosomal protein] [LE:1947] [RE:2234] [DI:direct]

| ORF_Name | NTID | AAID | NT Length | AA Length | score | probability |
|---|---|---|---|---|---|---|
| AI7503000996_3304562_c3_359 | 2652 | 6424 | 366 | 121 | 411 | 2.1e-38 |

Description
sp:[LN:PTLA_STAAU] [AC:P02909] [GN:LACF] [OR:STAPHYLOCOCCUS AUREUS] [EC:2.7.1.69]
[DE:(EC 2.7.1.69) (EIII-LAC)] [SP:P02909] [DB:swissprot] >gp:[GI:g153037] [LN:STALACS]
[AC:J03479:M17729] [OR:Staphylococcus aureus] [SR:S.aureus (strain 8325-4) DNA, clone
pFB34] [DB:genpept-bct1] [DE:S.aureus enzyme III-lac (lacF), enzyme II-lac (lacE),
andphospho-beta-galactosidase (lacG) genes, complete cds.] [NT:enzyme III-lac (lacF)]
[LE:102] [RE:413] [DI:direct]

| ORF_Name | NTID | AAID | NT Length | AA Length | score | probability |
|---|---|---|---|---|---|---|
| AI7503000996_33437802_c2_299 | 2653 | 6425 | 669 | 222 | 772 | 1.2e-76 |

Description
sp:[LN:KAD_BACSU] [AC:P16304] [GN:ADK] [OR:BACILLUS SUBTILIS] [EC:2.7.4.3]
[DE:(SUPEROXIDE-INDUCIBLE PROTEIN 16) (SOI16)] [SP:P16304] [DB:swissprot]
>pir:[LN:JS0492] [AC:JS0492:S12684:S08630:E69583 ] [PN:adenylate kinase,:ATP-AMP
transphosphorylase] [GN:adk ] [CL:adenylate kinase] [OR:Bacillus subtilis] [EC:2.7.4.3]
[DB:pir2] >gp:[GI:g1044985] [LN:BACRPLP] [AC:L47971] [PN:adenylate kinase] [GN:adk]
[OR:Bacillus subtilis] [DB:genpept-bct1] [DE:Bacillus subtilis ribosomal protein
(rplPNXEFROQ, rpmCDJ,rpsQNHEMK) genes, integral membrane protein (secY) gene,
adenylatekinase (adk) gene, methionine aminopeptidase (map) gene,inititation factor 1
(infA) gene, RNA polymerase alpha (rpoA) gene.] [LE:6101] [RE:6754] [DI:direct]
>gp:[GI:d1000951:g216340] [LN:BACSECY] [AC:D00619] [PN:adenylate kinase] [OR:Bacillus
subtilis] [SR:Bacillus subtilis (strain:207-21) DNA] [DB:genpept-bct1] [DE:Bacillus
subtilis genes for ribosomal proteins, SecY, adenylatekinase and methionine amino
peptidase, complete cds.] [LE:2055] [RE:2708] [DI:direct] >gp:[GI:e1182070:g2632404]
[LN:BSUB0001] [AC:Z99104:AL009126] [PN:adenylate kinase] [GN:adk] [OR:Bacillus
subtilis] [DB:genpept-bct1] [EC:2.7.4.3] [DE:Bacillus subtilis complete genome (section
1 of 21): from 1 to213080.] [SP:P16304] [LE:145875] [RE:146528] [DI:direct]

| ORF_Name | NTID | AAID | NT Length | AA Length | score | probability |
|---|---|---|---|---|---|---|
| AI7503000996_33463542_c2_337 | 2654 | 6426 | 180 | 59 | | |

Description
NO-HIT

| ORF Name | NTID | AAID | NT Length | AA Length | score | probability |
|---|---|---|---|---|---|---|
| AI7503000996_34017517_c2_304 | 2655 | 6427 | 828 | 275 | 714 | 1.6e-70 |

Description
pir:[LN:F69742] [AC:F69742 ] [PN:hypothetical protein ybaF] [GN:ybaF ] [OR:Bacillus subtilis] [DB:pir2] >gp:[GI:e1182080:g2632414] [LN:BSUB0001] [AC:Z99104:AL009126] [GN:ybaF] [FN:unknown] [OR:Bacillus subtilis] [DB:genpept-bct1] [DE:Bacillus subtilis complete genome (section 1 of 21): from 1 to213080.] [LE:152128] [RE:152925] [DI:direct]

| ORF Name | NTID | AAID | NT Length | AA Length | score | probability |
|---|---|---|---|---|---|---|
| AI7503000996_34188213_c2_295 | 2656 | 6428 | 423 | 140 | 579 | 3.3e-56 |

Description
gp:[GI:g1044978] [LN:BACRPLP] [AC:L47971] [PN:ribosomal protein S8] [GN:rpsH] [OR:Bacillus subtilis] [DB:genpept-bct1] [DE:Bacillus subtilis ribosomal protein (rplPNXEFROQ, rpmCDJ,rpsQNHEMK) genes, integral membrane protein (secY) gene, adenylatekinase (adk) gene, methionine aminopeptidase (map) gene,inititation factor 1 (infA) gene, RNA polymerase alpha (rpoA) gene.] [LE:2198] [RE:2596] [DI:direct]

| ORF Name | NTID | AAID | NT Length | AA Length | score | probability |
|---|---|---|---|---|---|---|
| AI7503000996_34406562_c1_259 | 2657 | 6429 | 867 | 288 | 644 | 4.2e-63 |

Description
pir:[LN:E69742] [AC:E69742 ] [PN:ABC transporter (ATP-binding protein) homolog ybaE] [GN:ybaE ] [CL:ATP-binding cassette homology] [OR:Bacillus subtilis] [DB:pir2] >gp:[GI:e1182079:g2632413] [LN:BSUB0001] [AC:Z99104:AL009126] [GN:ybaE] [FN:unknown] [OR:Bacillus subtilis] [DB:genpept-bct1] [DE:Bacillus subtilis complete genome (section 1 of 21): from 1 to213080.] [NT:similar to ABC transporter (ATP-binding protein)] [LE:151301] [RE:152131] [DI:direct] >gp:[GI:d1011642:g1644203] [LN:D64126] [AC:D64126] [PN:unknown] [GN:orf5] [OR:Bacillus subtilis] [SR:Bacillus subtilis (strain:168) DNA] [DB:genpept-bct1] [DE:Bacillus subtilis genes for ribosomal proteins L13 and S9, putativecell wall hydrolase CwlD, gerD protein, 16S ribosomal RNA and 23Sribosomal RNA.] [LE:861] [RE:1691] [DI:direct]

| ORF Name | NTID | AAID | NT Length | AA Length | score | probability |
|---|---|---|---|---|---|---|
| AI7503000996_34557262_c3_384 | 2658 | 6430 | 135 | 44 | | |

Description
NO-HIT

| ORF Name | NTID | AAID | NT Length | AA Length | score | probability |
|---|---|---|---|---|---|---|
| AI7503000996_34647177_c2_296 | 2659 | 6431 | 558 | 185 | 638 | 1.8e-62 |

Description
gp:[GI:d1039022:g4512419] [LN:AB017508] [AC:AB017508] [GN:rplF] [OR:Bacillus halodurans] [SR:Bacillus halodurans (strain:C-125) DNA] [DB:genpept-bct1] [DE:Bacillus halodurans C-125 genomic DNA, 32 kb fragment, completecds.] [NT:rplF homologue (identity of 78% to B. subtilis )] [LE:20357] [RE:20893] [DI:direct]

| ORF_Name | NTID | AAID | NT Length | AA Length | score | probability |
|---|---|---|---|---|---|---|
| AI7503000996_34651577_f2_127 | 2660 | 6432 | 1047 | 348 | 502 | 4.7e-48 |

Description
pir:[LN:D69756] [AC:D69756 ] [PN:conserved hypothetical protein yceB] [GN:yceB ]
[CL:ynbW protein] [OR:Bacillus subtilis] [DB:pir2] >gp:[GI:d1023111:g2415739]
[LN:AB000617] [AC:AB000617] [PN:YceB] [GN:yceB] [OR:Bacillus subtilis] [SR:Bacillus
subtilis (strain:168 trpC2) DNA] [DB:genpept-bct1] [DE:Bacillus subtilis genomic DNA,
22 to 25 degree region, completecds.] [NT:homologue of a hypothetical 36.6 kDa protein
in] [LE:23969] [RE:24910] [DI:complement] >gp:[GI:e1182240:g2632574] [LN:BSUB0002]
[AC:Z99105:AL009126] [GN:yceB] [FN:unknown] [OR:Bacillus subtilis] [DB:genpept-bct1]
[DE:Bacillus subtilis complete genome (section 2 of 21): from 194651 to415810.]
[NT:similar to hypothetical proteins] [LE:115784] [RE:116725] [DI:complement]

| ORF_Name | NTID | AAID | NT Length | AA Length | score | probability |
|---|---|---|---|---|---|---|
| AI7503000996_35348182_f2_94 | 2661 | 6433 | 231 | 76 | | |

Description
NO-HIT

| ORF_Name | NTID | AAID | NT Length | AA Length | score | probability |
|---|---|---|---|---|---|---|
| AI7503000996_36135437_c2_287 | 2662 | 6434 | 648 | 215 | 676 | 1.7e-66 |

Description
sp:[LN:RL4_BACST] [AC:P28601] [GN:RPLD] [OR:BACILLUS STEAROTHERMOPHILUS] [DE:50S
RIBOSOMAL PROTEIN L4] [SP:P28601] [DB:swissprot] >pir:[LN:S24364] [AC:S24364:S36086 ]
[PN:ribosomal protein L4] [GN:rpl4 ] [CL:Escherichia coli ribosomal protein L4]
[OR:Bacillus stearothermophilus] [DB:pir2] >gp:[GI:g40103] [LN:BSRPLCLD]
[AC:X67014:S42397] [PN:ribosomal protein L4] [GN:rplD] [OR:Bacillus stearothermophilus]
[DB:genpept-bct1] [DE:B.stearothermophilus genes rplC and rplD for ribosomal proteins
L3and L4, respectively.] [SP:P28601] [LE:724] [RE:1347] [DI:direct]

| ORF_Name | NTID | AAID | NT Length | AA Length | score | probability |
|---|---|---|---|---|---|---|
| AI7503000996_36226575_c1_251 | 2663 | 6435 | 558 | 185 | 766 | 5.0e-76 |

Description
sp:[LN:RL5_BACSU] [AC:P12877] [GN:RPLE] [OR:BACILLUS SUBTILIS] [DE:50S RIBOSOMAL
PROTEIN L5 (BL6)] [SP:P12877] [DB:swissprot] >pir:[LN:R5BS5] [AC:S05994:A69695 ]
[PN:ribosomal protein L5:BL6] [GN:rplE ] [CL:Escherichia coli ribosomal protein L5]
[OR:Bacillus subtilis] [DB:pir1] >gp:[GI:g1044976] [LN:BACRPLP] [AC:L47971]
[PN:ribosomal protein L5] [GN:rplE] [OR:Bacillus subtilis] [DB:genpept-bct1]
[DE:Bacillus subtilis ribosomal protein (rplPNXEFROQ, rpmCDJ,rpsQNHEMK) genes, integral
membrane protein (secY) gene, adenylatekinase (adk) gene, methionine aminopeptidase
(map) gene,inititation factor 1 (infA) gene, RNA polymerase alpha (rpoA) gene.]
[LE:1419] [RE:1958] [DI:direct] >gp:[GI:g40152] [LN:BSSPC] [AC:X15664] [OR:Bacillus
subtilis] [DB:genpept-bct1] [DE:B.subtilis S10/spc operon rpmC, rpsQ, rplN, rplX, rplE,
rpsN genes.] [NT:L5 protein (AA 1-179)] [SP:P12877] [LE:1584] [RE:2123] [DI:direct]
>gp:[GI:e1182061:g2632395] [LN:BSUB0001] [AC:Z99104:AL009126] [PN:ribosomal protein L5
(BL6)] [GN:rplE] [OR:Bacillus subtilis] [DB:genpept-bct1] [DE:Bacillus subtilis
complete genome (section 1 of 21): from 1 to213080.] [SP:P12877] [LE:141193]
[RE:141732] [DI:direct]

| ORF_Name | NTID | AAID | NT Length | AA Length | score | probability |
|---|---|---|---|---|---|---|
| AI7503000996_4062510_f3_217 | 2664 | 6436 | 168 | 55 | | |

Description
NO-HIT

| ORF_Name | NTID | AAID | NT Length | AA Length | score | probability |
|---|---|---|---|---|---|---|
| AI7503000996_4100327_f3_181 | 2665 | 6437 | 360 | 119 | 133 | 6.0e-09 |

Description
pir:[LN:D69798] [AC:D69798 ] [PN:hypothetical protein yetG] [GN:yetG ] [OR:Bacillus subtilis] [DB:pir2] >gp:[GI:e1182694:g2633028] [LN:BSUB0004] [AC:Z99107:AL009126] [GN:yetG] [FN:unknown] [OR:Bacillus subtilis] [DB:genpept-bct1] [DE:Bacillus subtilis complete genome (section 4 of 21): from 600701 to813890.] [LE:183921] [RE:184298] [DI:complement]

| ORF_Name | NTID | AAID | NT Length | AA Length | score | probability |
|---|---|---|---|---|---|---|
| AI7503000996_4165677_c2_305 | 2666 | 6438 | 807 | 268 | 544 | 1.7e-52 |

Description
sp:[LN:TRUA_BACSU] [AC:P70973] [GN:TRUA] [OR:BACILLUS SUBTILIS] [EC:4.2.1.70] [DE:I) (PSEUDOURIDINE SYNTHASE I) (URACIL HYDROLYASE)] [SP:P70973] [DB:swissprot]
>pir:[LN:F69726] [AC:F69726 ] [PN:pseudouridylate synthase I truA] [GN:truA ] [CL:tRNA-pseudouridine synthase I] [OR:Bacillus subtilis] [DB:pir2]
>gp:[GI:e1182081:g2632415] [LN:BSUB0001] [AC:Z99104:AL009126] [PN:pseudouridylate synthase I] [GN:truA] [OR:Bacillus subtilis] [DB:genpept-bct1] [EC:4.2.1.70] [DE:Bacillus subtilis complete genome (section 1 of 21): from 1 to213080.] [NT:alternate gene name: ybaH] [SP:P70973] [LE:152935] [RE:153678] [DI:direct] >gp:[GI:d1011645:g1644206] [LN:D64126] [AC:D64126] [PN:unknown] [GN:orf8] [OR:Bacillus subtilis] [SR:Bacillus subtilis (strain:168) DNA] [DB:genpept-bct1] [DE:Bacillus subtilis genes for ribosomal proteins L13 and S9, putativecell wall hydrolase CwlD, gerD protein, 16S ribosomal RNA and 23Sribosomal RNA.] [LE:2496] [RE:3239] [DI:direct]

| ORF_Name | NTID | AAID | NT Length | AA Length | score | probability |
|---|---|---|---|---|---|---|
| AI7503000996_4305287_f3_211 | 2667 | 6439 | 123 | 40 | | |

Description
NO-HIT

| ORF_Name | NTID | AAID | NT Length | AA Length | score | probability |
|---|---|---|---|---|---|---|
| AI7503000996_4564036_c3_363 | 2668 | 6440 | 1044 | 347 | 898 | 5.2e-90 |

Description
pir:[LN:A69813] [AC:A69813 ] [PN:quinone oxidoreductase homolog yfmJ] [GN:yfmJ ] [OR:Bacillus subtilis] [DB:pir2] >gp:[GI:e1182735:g2633069] [LN:BSUB0005] [AC:Z99108:AL009126] [GN:yfmJ] [FN:unknown] [OR:Bacillus subtilis] [DB:genpept-bct1] [DE:Bacillus subtilis complete genome (section 5 of 21): from 802821 to1011250.] [NT:similar to quinone oxidoreductase] [LE:14498] [RE:15517] [DI:complement] >gp:[GI:d1023187:g2443253] [LN:D86417] [AC:D86417] [PN:YfmJ] [OR:Bacillus subtilis] [SR:Bacillus subtilis (strain:AC327) DNA] [DB:genpept-bct1] [DE:Bacillus subtilis 35.7 kb genomic DNA, 70-73 degree region,complete cds.] [LE:33004] [RE:34023] [DI:direct]

| ORF_Name | NTID | AAID | NT Length | AA Length | score | probability |
|---|---|---|---|---|---|---|
| AI7503000996_4694030_c3_367 | 2669 | 6441 | 1236 | 411 | 362 | 3.2e-33 |

Description
gp:[GI:g5354197] [LN:AF157493] [AC:AF157493] [PN:putative transporter] [GN:ditE] [OR:Zymomonas mobilis] [DB:genpept] [DE:Zymomonas mobilis ZM4 fosmid clone 42D7, complete sequence.] [LE:17549] [RE:18844] [DI:direct]

| ORF Name | NTID | AAID | NT Length | AA Length | score | probability |
|---|---|---|---|---|---|---|
| AI7503000996_4697262_c2_310 | 2670 | 6442 | 540 | 179 | 806 | 2.9e-80 |

Description
pir:[LN:D43258] [AC:D43258 ] [PN:galactose-6-phosphate isomerase subunit LacB]
[OR:Streptococcus mutans] [DB:pir2]

| ORF Name | NTID | AAID | NT Length | AA Length | score | probability |
|---|---|---|---|---|---|---|
| AI7503000996_4714817_c2_315 | 2671 | 6443 | 879 | 292 | 200 | 1.0e-14 |

Description
gp:[GI:g4206189] [LN:LLU60828] [AC:U60828] [PN:unknown] [OR:Lactococcus lactis]
[DB:genpept-bct2] [DE:Lactococcus lactis galactose-lactose operon, complete sequence.]
[NT:orfx] [LE:12631] [RE:13554] [DI:direct]

| ORF Name | NTID | AAID | NT Length | AA Length | score | probability |
|---|---|---|---|---|---|---|
| AI7503000996_4886592_c3_341 | 2672 | 6444 | 450 | 149 | 614 | 6.4e-60 |

Description
sp:[LN:RL16_BACSU] [AC:P14577] [GN:RPLP] [OR:BACILLUS SUBTILIS] [DE:50S RIBOSOMAL
PROTEIN L16] [SP:P14577] [DB:swissprot] >pir:[LN:B69696] [AC:B69696:S05989 ]
[PN:ribosomal protein L16 (rplP)] [GN:rplP ] [CL:Escherichia coli ribosomal protein
L16] [OR:Bacillus subtilis] [DB:pir2] >gp:[GI:e1182056:g2632390] [LN:BSUB0001]
[AC:Z99104:AL009126] [PN:ribosomal protein L16] [GN:rplP] [OR:Bacillus subtilis]
[DB:genpept-bct1] [DE:Bacillus subtilis complete genome (section 1 of 21): from 1
to213080.] [LE:139498] [RE:139932] [DI:direct]

| ORF Name | NTID | AAID | NT Length | AA Length | score | probability |
|---|---|---|---|---|---|---|
| AI7503000996_4897202_c1_257 | 2673 | 6445 | 768 | 255 | 996 | 2.1e-100 |

Description
sp:[LN:RPOA_BACS5] [AC:O50634] [GN:RPOA] [OR:BACILLUS SP] [SR:C-125,] [EC:2.7.7.6]
[DE:ALPHA CHAIN) (RNA POLYMERASE ALPHA SUBUNIT)] [SP:O50634] [DB:swissprot]
>gp:[GI:d1025104:g2760185] [LN:AB010082] [AC:AB010082] [PN:RNA polymerase alpha
subunit] [GN:rpoA] [OR:Bacillus halodurans] [SR:Bacillus halodurans (strain:C-125) DNA]
[DB:genpept-bct1] [DE:Bacillus halodurans C-125 gene for initiation factor IF-I,
RNApolymerase alpha subunit and ribosomal proteins, partial andcomplete cds.] [LE:1701]
[RE:2645] [DI:direct] >gp:[GI:d1039034:g4512431] [LN:AB017508] [AC:AB017508] [GN:rpoA]
[OR:Bacillus halodurans] [SR:Bacillus halodurans (strain:C-125) DNA] [DB:genpept-bct1]
[DE:Bacillus halodurans C-125 genomic DNA, 32 kb fragment, completecds.] [NT:rpoA
homologue (identity of 85% to B. subtilis )] [LE:26934] [RE:27878] [DI:direct]

| ORF Name | NTID | AAID | NT Length | AA Length | score | probability |
|---|---|---|---|---|---|---|
| AI7503000996_4897253_f3_189 | 2674 | 6446 | 129 | 42 | | |

Description
NO-HIT

| ORF Name | NTID | AAID | NT Length | AA Length | score | probability |
|---|---|---|---|---|---|---|
| AI7503000996_4901712_c1_261 | 2675 | 6447 | 408 | 135 | 496 | 2.0e-47 |

Description
pir:[LN:H69699] [AC:H69699:S11359 ] [PN:ribosomal protein S9 (rpsI):ribosomal protein BS10] [GN:rpsI ] [CL:Escherichia coli ribosomal protein S9] [OR:Bacillus subtilis] [DB:pir2] >gp:[GI:e1182083:g2632417] [LN:BSUB0001] [AC:Z99104:AL009126] [PN:ribosomal protein S9] [GN:rpsI] [OR:Bacillus subtilis] [DB:genpept-bct1] [DE:Bacillus subtilis complete genome (section 1 of 21): from 1 to213080.] [SP:P21470] [LE:154299] [RE:154691] [DI:direct] >gp:[GI:d1011647:g1644208] [LN:D64126] [AC:D64126] [PN:ribosomal protein S9] [GN:rpsI] [OR:Bacillus subtilis] [SR:Bacillus subtilis (strain:168) DNA] [DB:genpept-bct1] [DE:Bacillus subtilis genes for ribosomal proteins L13 and S9, putativecell wall hydrolase CwlD, gerD protein, 16S ribosomal RNA and 23Sribosomal RNA.] [LE:3860] [RE:4252] [DI:direct]

| ORF Name | NTID | AAID | NT Length | AA Length | score | probability |
|---|---|---|---|---|---|---|
| AI7503000996_5110637_c2_306 | 2676 | 6448 | 129 | 42 | | |

Description
NO-HIT

| ORF Name | NTID | AAID | NT Length | AA Length | score | probability |
|---|---|---|---|---|---|---|
| AI7503000996_5189012_f1_55 | 2677 | 6449 | 168 | 55 | | |

Description
NO-HIT

| ORF Name | NTID | AAID | NT Length | AA Length | score | probability |
|---|---|---|---|---|---|---|
| AI7503000996_55437_c2_314 | 2678 | 6450 | 1428 | 475 | 2439 | 2.6e-253 |

Description
sp:[LN:LACG_STAAU] [AC:P11175] [GN:LACG] [OR:STAPHYLOCOCCUS AUREUS] [EC:3.2.1.85] [DE:GALACTOHYDROLASE) (PGALASE) (P-BETA-GAL) (PBG)] [SP:P11175] [DB:swissprot] >pir:[LN:A27233] [AC:A27233 ] [PN:beta-galactosidase,:lactase] [CL:Agrobacterium beta-glucosidase] [OR:Staphylococcus aureus] [EC:3.2.1.23] [DB:pir2] >gp:[GI:g153039] [LN:STALACS] [AC:J03479:M17729] [OR:Staphylococcus aureus] [SR:S.aureus (strain 8325-4) DNA, clone pFB34] [DB:genpept-bct1] [DE:S.aureus enzyme III-lac (lacF), enzyme II-lac (lacE), andphospho-beta-galactosidase (lacG) genes, complete cds.] [NT:phospho-beta-galactosidase (lacG)] [LE:2149] [RE:3561] [DI:direct]

| ORF Name | NTID | AAID | NT Length | AA Length | score | probability |
|---|---|---|---|---|---|---|
| AI7503000996_6854675_f1_20 | 2679 | 6451 | 279 | 92 | 119 | 1.8e-07 |

Description
pir:[LN:A69895] [AC:A69895 ] [PN:hypothetical protein ynzG] [GN:ynzG ] [CL:hypothetical protein yolF] [OR:Bacillus subtilis] [DB:pir2] >gp:[GI:e1183408:g2634133] [LN:BSUB0010] [AC:Z99113:AL009126] [GN:ynzG] [FN:unknown] [OR:Bacillus subtilis] [DB:genpept-bct1] [DE:Bacillus subtilis complete genome (section 10 of 21): from 1781201to 2014980.] [LE:99142] [RE:99393] [DI:direct]

| ORF Name | NTID | AAID | NT Length | AA Length | score | probability |
|---|---|---|---|---|---|---|
| AI7503000996_797308_f2_112 | 2680 | 6452 | 189 | 62 | | |

Description
NO-HIT

| ORF Name | NTID | AAID | NT Length | AA Length | score | probability |
|---|---|---|---|---|---|---|
| AI7503000996_812840_c1_260 | 2681 | 6453 | 144 | 47 | | |

Description
NO-HIT

| ORF Name | NTID | AAID | NT Length | AA Length | score | probability |
|---|---|---|---|---|---|---|
| AI7503000996_9771907_c2_334 | 2682 | 6454 | 165 | 54 | | |

Description
NO-HIT

| ORF Name | NTID | AAID | NT Length | AA Length | score | probability |
|---|---|---|---|---|---|---|
| AI7503000997_10406642_f1_38 | 2683 | 6455 | 342 | 113 | 165 | 2.8e-12 |

Description
sp:[LN:NARQ_BACSU] [AC:P39756] [GN:NARQ:NARAA] [OR:BACILLUS SUBTILIS] [DE:NARQ PROTEIN]
[SP:P39756] [DB:swissprot] >pir:[LN:B69665] [AC:B69665 ] [PN:required for formate
dehydrogenase activity narQ] [GN:narQ ] [OR:Bacillus subtilis] [DB:pir2]
>gp:[GI:e276834:g1648855] [LN:BSATPC] [AC:Z81356] [PN:unknown] [GN:narQ] [OR:Bacillus
subtilis] [DB:genpept-bct1] [DE:B.subtilis atpC gene.] [SP:P39756] [LE:7048] [RE:7836]
[DI:direct] >gp:[GI:g580895] [LN:BSNARAAB] [AC:Z35277] [PN:unknown] [GN:narAA]
[OR:Bacillus subtilis] [DB:genpept-bct1] [DE:B.subtilis (168) narA gene.] [SP:P39756]
[LE:490] [RE:1278] [DI:direct] >gp:[GI:e1184577:g2636196] [LN:BSUB0019]
[AC:Z99122:AL009126] [GN:narQ] [FN:required for formate dehydrogenase activity]
[OR:Bacillus subtilis] [DB:genpept-bct1] [DE:Bacillus subtilis complete genome (section
19 of 21): from 3597091to 3809700.] [NT:alternate gene name: narAA] [SP:P39756]
[LE:175331] [RE:176119] [DI:complement] >gp:[GI:e1184577:g2636196] [LN:BSUB0019]
[AC:Z99122:AL009126] [GN:narQ] [FN:required for formate dehydrogenase activity]
[OR:Bacillus subtilis] [DB:genpept] [DE:Bacillus subtilis complete genome (section 19
of 21): from 3597091to 3809700.] [NT:alternate gene name: narAA] [SP:P39756]
[LE:175331] [RE:176119] [DI:complement]

| ORF Name | NTID | AAID | NT Length | AA Length | score | probability |
|---|---|---|---|---|---|---|
| AI7503000997_1054640_f3_189 | 2684 | 6456 | 213 | 70 | 170 | 7.2e-13 |

Description
sp:[LN:NARQ_BACSU] [AC:P39756] [GN:NARQ:NARAA] [OR:BACILLUS SUBTILIS] [DE:NARQ PROTEIN]
[SP:P39756] [DB:swissprot] >pir:[LN:B69665] [AC:B69665 ] [PN:required for formate
dehydrogenase activity narQ] [GN:narQ ] [OR:Bacillus subtilis] [DB:pir2]
>gp:[GI:e276834:g1648855] [LN:BSATPC] [AC:Z81356] [PN:unknown] [GN:narQ] [OR:Bacillus
subtilis] [DB:genpept-bct1] [DE:B.subtilis atpC gene.] [SP:P39756] [LE:7048] [RE:7836]
[DI:direct] >gp:[GI:g580895] [LN:BSNARAAB] [AC:Z35277] [PN:unknown] [GN:narAA]
[OR:Bacillus subtilis] [DB:genpept-bct1] [DE:B.subtilis (168) narA gene.] [SP:P39756]
[LE:490] [RE:1278] [DI:direct] >gp:[GI:e1184577:g2636196] [LN:BSUB0019]
[AC:Z99122:AL009126] [GN:narQ] [FN:required for formate dehydrogenase activity]
[OR:Bacillus subtilis] [DB:genpept-bct1] [DE:Bacillus subtilis complete genome (section
19 of 21): from 3597091to 3809700.] [NT:alternate gene name: narAA] [SP:P39756]
[LE:175331] [RE:176119] [DI:complement] >gp:[GI:e1184577:g2636196] [LN:BSUB0019]
[AC:Z99122:AL009126] [GN:narQ] [FN:required for formate dehydrogenase activity]
[OR:Bacillus subtilis] [DB:genpept] [DE:Bacillus subtilis complete genome (section 19
of 21): from 3597091to 3809700.] [NT:alternate gene name: narAA] [SP:P39756]
[LE:175331] [RE:176119] [DI:complement]

| ORF_Name | NTID | AAID | NT Length | AA Length | score | probability |
|---|---|---|---|---|---|---|
| AI7503000997_10580182_f1_9 | 2685 | 6457 | 123 | 40 | | |

Description
NO-HIT

| ORF_Name | NTID | AAID | NT Length | AA Length | score | probability |
|---|---|---|---|---|---|---|
| AI7503000997_10646887_f1_25 | 2686 | 6458 | 126 | 41 | | |

Description
NO-HIT

| ORF_Name | NTID | AAID | NT Length | AA Length | score | probability |
|---|---|---|---|---|---|---|
| AI7503000997_11756250_f3_197 | 2687 | 6459 | 144 | 47 | | |

Description
NO-HIT

| ORF_Name | NTID | AAID | NT Length | AA Length | score | probability |
|---|---|---|---|---|---|---|
| AI7503000997_11767205_f3_213 | 2688 | 6460 | 126 | 41 | | |

Description
NO-HIT

| ORF_Name | NTID | AAID | NT Length | AA Length | score | probability |
|---|---|---|---|---|---|---|
| AI7503000997_1209800_c2_304 | 2689 | 6461 | 282 | 93 | 72 | 0.0011 |

Description
sp:[LN:LACF_AGRRD] [AC:P29823] [GN:LACF] [OR:AGROBACTERIUM RADIOBACTER] [DE:LACTOSE TRANSPORT SYSTEM PERMEASE PROTEIN LACF] [SP:P29823] [DB:swissprot] >pir:[LN:MMAGCF] [AC:S25248:S22740 ] [PN:membrane protein lacF] [GN:lacF ] [CL:inner membrane protein ugpA] [OR:Agrobacterium radiobacter] [DB:pirl] >gp:[GI:g38969] [LN:ARLACOP] [AC:X66596:S40378:S40757] [GN:lacF] [OR:Agrobacterium radiobacter] [DB:genpept-bct1] [DE:A.radiobacter lac operon.] [SP:P29823] [LE:1897] [RE:2793] [DI:direct]

| ORF_Name | NTID | AAID | NT Length | AA Length | score | probability |
|---|---|---|---|---|---|---|
| AI7503000997_12270176_c2_349 | 2690 | 6462 | 180 | 59 | | |

Description
NO-HIT

| ORF Name | NTID | AAID | NT Length | AA Length | score | probability |
|---|---|---|---|---|---|---|
| AI7503000997_12595175_f2_140 | 2691 | 6463 | 498 | 165 | 261 | 1.6e-22 |

Description
sp:[LN:YKKC_BACSU] [AC:P49856] [GN:YKKC] [OR:BACILLUS SUBTILIS] [DE:HYPOTHETICAL 11.9
KD PROTEIN IN HMP 3'REGION] [SP:P49856] [DB:swissprot] >pir:[LN:A69857] [AC:A69857 ]
[PN:chaperonin homolog ykkC] [GN:ykkC ] [CL:sugE protein] [OR:Bacillus subtilis]
[DB:pir2] >gp:[GI:d1011924:g1063251] [LN:BAC168TRP2] [AC:D78189] [OR:Bacillus subtilis]
[SR:Bacillus subtilis (strain:168trpC2) DNA] [DB:genpept-bct1] [DE:Bacillus subtilis
hmp DNA for 7 ORFs, complete cds.] [NT:unnamed protein product] [LE:4724] [RE:5062]
[DI:direct] >gp:[GI:e1181509:g2632029] [LN:BSAJ2571] [AC:AJ002571] [PN:YkkC] [GN:ykkC]
[FN:unknown] [OR:Bacillus subtilis] [DB:genpept-bct1] [DE:Bacillus subtilis 168 56 kb
DNA fragment between xlyA and ykoR.] [SP:P49856] [LE:28642] [RE:28980] [DI:direct]
>gp:[GI:e1183329:g2633663] [LN:BSUB0007] [AC:Z99110:AL009126] [GN:ykkC] [FN:unknown]
[OR:Bacillus subtilis] [DB:genpept-bct1] [DE:Bacillus subtilis complete genome (section
7 of 21): from 1194391to 1411140.] [NT:similar to chaperonin] [SP:P49856] [LE:181591]
[RE:181929] [DI:direct]

| ORF Name | NTID | AAID | NT Length | AA Length | score | probability |
|---|---|---|---|---|---|---|
| AI7503000997_1375308_c2_341 | 2692 | 6464 | 411 | 136 | 103 | 9.0e-06 |

Description
gp:[GI:g3283053] [LN:AF054173] [AC:AF054173] [PN:staphylococcal accessory regulator A
homolog] [GN:sarA] [OR:Staphylococcus epidermidis] [DB:genpept-bct2] [DE:Staphylococcus
epidermidis staphylococcal accessory regulator Ahomolog (sarA) gene, complete cds.]
[LE:887] [RE:1261] [DI:direct]

| ORF Name | NTID | AAID | NT Length | AA Length | score | probability |
|---|---|---|---|---|---|---|
| AI7503000997_13849056_c1_251 | 2693 | 6465 | 279 | 92 | 79 | 0.041 |

Description
gp:[GI:e1313955:g3392923] [LN:LLNISG] [AC:AJ000993] [PN:hypothetical protein] [GN:orfD]
[OR:Lactococcus lactis] [DB:genpept-bct1] [DE:Lactococcus lactis nisG gene, orfA, orfB,
orfC, and orfD.] [LE:3153] [RE:4799] [DI:direct]

| ORF Name | NTID | AAID | NT Length | AA Length | score | probability |
|---|---|---|---|---|---|---|
| AI7503000997_1406552_c1_252 | 2694 | 6466 | 123 | 40 | | |

Description
NO-HIT

| ORF Name | NTID | AAID | NT Length | AA Length | score | probability |
|---|---|---|---|---|---|---|
| AI7503000997_14094002_c2_303 | 2695 | 6467 | 138 | 45 | | |

Description
NO-HIT

| ORF Name | NTID | AAID | NT Length | AA Length | score | probability |
|---|---|---|---|---|---|---|
| AI7503000997_14097586_f3_201 | 2696 | 6468 | 438 | 145 | 470 | 1.2e-44 |

Description
sp:[LN:URE2_STAXY] [AC:P42874] [GN:UREB] [OR:STAPHYLOCOCCUS XYLOSUS] [EC:3.5.1.5]
[DE:UREASE BETA SUBUNIT, (UREA AMIDOHYDROLASE)] [SP:P42874] [DB:swissprot]
>pir:[LN:S38484] [AC:S38484 ] [PN:urease, beta chain] [CL:urease 12K chain:urease 12K
chain homology] [OR:Staphylococcus xylosus] [EC:3.5.1.5] [DB:pir1] >gp:[GI:g410515]
[LN:SXUREABC] [AC:X74600] [PN:urease beta subunit] [GN:ureB] [OR:Staphylococcus
xylosus] [DB:genpept-bct1] [DE:S.xylosus gene for ureA, ureB, and ureC genes for urease
gamma,beta and alpha subunits.] [SP:P42874] [LE:886] [RE:1299] [DI:direct]

| ORF Name | NTID | AAID | NT Length | AA Length | score | probability |
|---|---|---|---|---|---|---|
| AI7503000997_14220635_c3_380 | 2697 | 6469 | 150 | 49 | | |

Description
NO-HIT

| ORF Name | NTID | AAID | NT Length | AA Length | score | probability |
|---|---|---|---|---|---|---|
| AI7503000997_14454632_c2_289 | 2698 | 6470 | 177 | 58 | 226 | 8.4e-19 |

Description
gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF Name | NTID | AAID | NT Length | AA Length | score | probability |
|---|---|---|---|---|---|---|
| AI7503000997_14460882_f1_23 | 2699 | 6471 | 189 | 62 | 221 | 2.8e-18 |

Description
gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF Name | NTID | AAID | NT Length | AA Length | score | probability |
|---|---|---|---|---|---|---|
| AI7503000997_14501888_f2_129 | 2700 | 6472 | 126 | 41 | | |

Description
NO-HIT

| ORF Name | NTID | AAID | NT Length | AA Length | score | probability |
|---|---|---|---|---|---|---|
| AI7503000997_14549010_c2_339 | 2701 | 6473 | 666 | 221 | 531 | 4.0e-51 |

Description
gp:[GI:e1429630:g4756162] [LN:A67171] [AC:A67171] [FN:MOBA GENE] [OR:Staphylococcus carnosus] [DB:genpept-pat] [DE:Sequence 11 from Patent EP0805205.] [NT:unnamed protein product] [LE:4821] [RE:5411] [DI:direct] >gp:[GI:g3955208] [LN:AF022796] [AC:AF022796] [PN:MobA] [GN:mobA] [OR:Staphylococcus carnosus] [DB:genpept-bct2] [DE:Staphylococcus carnosus molybdenum cofactor biosynthetic genecluster, complete sequence.] [NT:protein similar to MobA of Escherichia coli] [LE:7042] [RE:7632] [DI:direct]

| ORF Name | NTID | AAID | NT Length | AA Length | score | probability |
|---|---|---|---|---|---|---|
| AI7503000997_14550133_f1_14 | 2702 | 6474 | 543 | 180 | | |

Description
NO-HIT

| ORF Name | NTID | AAID | NT Length | AA Length | score | probability |
|---|---|---|---|---|---|---|
| AI7503000997_15820176_f3_207 | 2703 | 6475 | 126 | 41 | | |

Description
NO-HIT

| ORF_Name | NTID | AAID | NT Length | AA Length | score | probability |
|---|---|---|---|---|---|---|
| AI7503000997_16129817_f1_68 | 2704 | 6476 | 156 | 51 | | |

Description
NO-HIT

| ORF_Name | NTID | AAID | NT Length | AA Length | score | probability |
|---|---|---|---|---|---|---|
| AI7503000997_19533567_f2_100 | 2705 | 6477 | 264 | 87 | 80 | 0.0025 |

Description
gp:[GI:g5306165] [LN:AF160864] [AC:AF160864] [PN:orf98] [GN:orf98] [OR:Mitochondrion Tetrahymena pyriformis] [SR:Tetrahymena pyriformis] [DB:genpept] [DE:Tetrahymena pyriformis mitochondrial DNA, complete genome.] [NT:Open reading frame ymf71 (CPGN); ATT initiation] [LE:37598] [RE:37894] [DI:direct]

| ORF_Name | NTID | AAID | NT Length | AA Length | score | probability |
|---|---|---|---|---|---|---|
| AI7503000997_20112790_c3_399 | 2706 | 6478 | 126 | 41 | | |

Description
NO-HIT

| ORF_Name | NTID | AAID | NT Length | AA Length | score | probability |
|---|---|---|---|---|---|---|
| AI7503000997_20345067_c3_365 | 2707 | 6479 | 126 | 41 | | |

Description
NO-HIT

| ORF_Name | NTID | AAID | NT Length | AA Length | score | probability |
|---|---|---|---|---|---|---|
| AI7503000997_2126925_f3_211 | 2708 | 6480 | 153 | 50 | | |

Description
NO-HIT

| ORF_Name | NTID | AAID | NT Length | AA Length | score | probability |
|---|---|---|---|---|---|---|
| AI7503000997_21611592_f3_236 | 2709 | 6481 | 369 | 122 | 89 | 0.0017 |

Description
pir:[LN:E71805] [AC:E71805 ] [PN:protein-export membrane protein] [GN:secF ]
[CL:Escherichia coli preprotein translocase chain secF] [OR:Helicobacter pylori]
[SR:strain J99, , strain J99] [SR:strain J99, ] [DB:pir2] >gp:[GI:g4156068]
[LN:AE001567] [AC:AE001567:AE001439] [PN:PROTEIN-EXPORT MEMBRANE PROTEIN] [GN:secF]
[OR:Helicobacter pylori J99] [DB:genpept-bct2] [DE:Helicobacter pylori, strain J99
section 128 of 132 of the completegenome.] [NT:similar to H. pylori 26695 gene HP1549]
[LE:9115] [RE:10086] [DI:direct]

| ORF_Name | NTID | AAID | NT Length | AA Length | score | probability |
|---|---|---|---|---|---|---|
| AI7503000997_21646015_f2_104 | 2710 | 6482 | 210 | 69 | 158 | 1.3e-11 |

Description
gp:[GI:g1022725] [LN:SHU35635] [AC:U35635] [PN:unknown] [OR:Staphylococcus
haemolyticus] [SR:Staphylococcus haemolyticus strain=Y176] [DB:genpept-bct1]
[DE:Staphylococcus haemolyticus IS1272 ORF1 and ORF2 genes, completecds.] [NT:ORF2]
[LE:394] [RE:1083] [DI:complement] >gp:[GI:g295162] [LN:STAMECRA] [AC:L14017]
[OR:Staphylococcus aureus] [SR:Staphylococcus aureus (strain COL) DNA]
[DB:genpept-bct1] [DE:Staphylococcus aureus methicillin-resistance protein (mecR)
geneand unknown ORF, complete cds.] [NT:unknown ORF1; putative] [LE:1492] [RE:2181]
[DI:complement]

| ORF_Name | NTID | AAID | NT Length | AA Length | score | probability |
|---|---|---|---|---|---|---|
| AI7503000997_21675050_f3_230 | 2711 | 6483 | 360 | 119 | | |

Description
NO-HIT

| ORF_Name | NTID | AAID | NT Length | AA Length | score | probability |
|---|---|---|---|---|---|---|
| AI7503000997_21681561_f1_74 | 2712 | 6484 | 891 | 296 | 776 | 4.4e-77 |

Description
pir:[LN:D69744] [AC:D69744 ] [PN:conserved hypothetical protein ybbI] [GN:ybbI ] [CL:conserved hypothetical protein b2428] [OR:Bacillus subtilis] [DB:pir2] >gp:[GI:e1182103:g2632437] [LN:BSUB0001] [AC:Z99104:AL009126] [GN:ybbI] [FN:unknown] [OR:Bacillus subtilis] [DB:genpept-bct1] [DE:Bacillus subtilis complete genome (section 1 of 21): from 1 to213080.] [NT:similar to hypothetical proteins] [LE:192050] [RE:192964] [DI:complement]

| ORF_Name | NTID | AAID | NT Length | AA Length | score | probability |
|---|---|---|---|---|---|---|
| AI7503000997_21776942_c1_244 | 2713 | 6485 | 642 | 213 | 855 | 1.9e-85 |

Description
sp:[LN:YBXG_BACSU] [AC:P54425:O31438] [GN:YBXG:YBDP] [OR:BACILLUS SUBTILIS] [DE:HYPOTHETICAL TRANSPORT PROTEIN IN NDHF-CSGA INTERGENIC REGION (ORF1)] [SP:P54425:O31438] [DB:swissprot] >pir:[LN:H69751] [AC:H69751:PC6045 ] [PN:amino acid permease homolog ybxG] [GN:ybxG ] [CL:arginine permease] [OR:Bacillus subtilis] [DB:pir2] >gp:[GI:d1034070:g3599629] [LN:AB006424] [AC:AB006424] [GN:ybdP] [OR:Bacillus subtilis] [SR:Bacillus subtilis (strain:168) DNA] [DB:genpept-bct1] [DE:Bacillus subtilis genomic DNA, 70 kb region between 17 and 23degree.] [LE:29556] [RE:30944] [DI:direct] >gp:[GI:e1182158:g2632492] [LN:BSUB0002] [AC:Z99105:AL009126] [GN:ybxG] [FN:unknown] [OR:Bacillus subtilis] [DB:genpept-bct1] [DE:Bacillus subtilis complete genome (section 2 of 21): from 194651 to415810.] [NT:alternate gene name: ybdP; similar to amino acid] [SP:P54425] [LE:31905] [RE:33293] [DI:direct]

| ORF_Name | NTID | AAID | NT Length | AA Length | score | probability |
|---|---|---|---|---|---|---|
| AI7503000997_2211433_f3_205 | 2714 | 6486 | 867 | 288 | 534 | 1.9e-51 |

Description
sp:[LN:URED_BACSB] [AC:Q07400] [GN:URED] [OR:BACILLUS SP] [SR:TB-90,] [DE:UREASE ACCESSORY PROTEIN URED] [SP:Q07400] [DB:swissprot] >pir:[LN:G36950] [AC:G36950 ] [PN:ureD protein] [OR:Bacillus sp.] [DB:pir2] >gp:[GI:d1003839:g216366] [LN:BACUREA] [AC:D14439] [PN:urease accessory protein] [GN:UreD] [OR:Bacillus sp.] [SR:Bacillus sp. (strain:TB-90) DNA] [DB:genpept-bct1] [DE:Thermophilic Bacillus genes for urease subunits and ureaseaccessory proteins, complete cds.] [LE:4281] [RE:5096] [DI:direct]

| ORF_Name | NTID | AAID | NT Length | AA Length | score | probability |
|---|---|---|---|---|---|---|
| AI7503000997_22290657_c3_382 | 2715 | 6487 | 387 | 128 | 164 | 3.1e-12 |

Description
gp:[GI:g3283053] [LN:AF054173] [AC:AF054173] [PN:staphylococcal accessory regulator A homolog] [GN:sarA] [OR:Staphylococcus epidermidis] [DB:genpept-bct2] [DE:Staphylococcus epidermidis staphylococcal accessory regulator Ahomolog (sarA) gene, complete cds.] [LE:887] [RE:1261] [DI:direct]

| ORF_Name | NTID | AAID | NT Length | AA Length | score | probability |
|---|---|---|---|---|---|---|
| AI7503000997_22455337_f3_217 | 2716 | 6488 | 168 | 55 | | |

Description
NO-HIT

| ORF Name | NTID | AAID | NT Length | AA Length | score | probability |
|---|---|---|---|---|---|---|
| AI7503000997_22692177_c1_271 | 2717 | 6489 | 537 | 178 | 556 | 9.0e-54 |

Description
gp:[GI:e1429621:g4756159] [LN:A67171] [AC:A67171] [FN:MOAB GENE] [OR:Staphylococcus carnosus] [DB:genpept-pat] [DE:Sequence 11 from Patent EP0805205.] [NT:unnamed protein product] [LE:1150] [RE:1662] [DI:direct] >gp:[GI:g3955202] [LN:AF022796] [AC:AF022796] [PN:MoaB] [GN:moaB] [OR:Staphylococcus carnosus] [DB:genpept-bct2] [DE:Staphylococcus carnosus molybdenum cofactor biosynthetic genecluster, complete sequence.] [NT:protein similar to MoaB of Escherichia coli] [LE:3371] [RE:3883] [DI:direct]

| ORF Name | NTID | AAID | NT Length | AA Length | score | probability |
|---|---|---|---|---|---|---|
| AI7503000997_22734582_c2_293 | 2718 | 6490 | 141 | 46 | | |

Description
NO-HIT

| ORF Name | NTID | AAID | NT Length | AA Length | score | probability |
|---|---|---|---|---|---|---|
| AI7503000997_23538332_f1_18 | 2719 | 6491 | 150 | 49 | | |

Description
NO-HIT

| ORF Name | NTID | AAID | NT Length | AA Length | score | probability |
|---|---|---|---|---|---|---|
| AI7503000997_23609628_c2_330 | 2720 | 6492 | 975 | 324 | 385 | 1.2e-35 |

Description
gp:[GI:g2645495] [LN:AF017231] [AC:AF017231] [PN:inosine-adenosine-guanosine-nucleoside] [FN:catalyzes the hydrolysis of the N-ribosidic] [OR:Trypanosoma brucei brucei] [DB:genpept-inv1] [DE:Trypanosoma brucei brucei inosine-adenosine-guanosine-nucleosidehydrolase mRNA, complete cds.] [NT:N-ribohydrolase; IAG-nucleoside hydrolase] [LE:187] [RE:1170] [DI:direct]

| ORF Name | NTID | AAID | NT Length | AA Length | score | probability |
|---|---|---|---|---|---|---|
| AI7503000997_23620260_c2_311 | 2721 | 6493 | 1107 | 368 | 334 | 3.0e-30 |

Description
sp:[LN:ODH_ARTSP] [AC:Q44297] [GN:ODH] [OR:ARTHROBACTER SP] [SR:1C,] [EC:1.5.1.28] [DE:OPINE DEHYDROGENASE,] [SP:Q44297] [DB:swissprot] >pir:[LN:I39664] [AC:I39664 ] [PN:probable D-octopine dehydrogenase,] [OR:Arthrobacter sp.] [EC:1.5.1.11] [DB:pir2] >gp:[GI:d1008736:g1060848] [LN:ARGOD] [AC:D45211] [PN:opine dehydrogenase] [OR:Arthrobacter sp.] [SR:Arthrobacter sp. DNA, clone pODH1] [DB:genpept-bct1] [DE:Arthrobacter sp. gene for opine dehydrogenase, complete cds.] [LE:254] [RE:1333] [DI:direct]

| ORF Name | NTID | AAID | NT Length | AA Length | score | probability |
|---|---|---|---|---|---|---|
| AI7503000997_23631551_c3_395 | 2722 | 6494 | 792 | 263 | | |

Description
NO-HIT

| ORF_Name | NTID | AAID | NT Length | AA Length | score | probability |
|---|---|---|---|---|---|---|
| AI7503000997_23642167_f3_175 | 2723 | 6495 | 1218 | 405 | 611 | 1.3e-59 |

Description
pir:[LN:B70065] [AC:B70065 ] [PN:antibiotic resistance protein homolog ywoG] [GN:ywoG ]
[OR:Bacillus subtilis] [DB:pir2] >gp:[GI:e1184551:g2636170] [LN:BSUB0019]
[AC:Z99122:AL009126] [GN:ywoG] [FN:unknown] [OR:Bacillus subtilis] [DB:genpept-bct1]
[DE:Bacillus subtilis complete genome (section 19 of 21): from 3597091to 3809700.]
[NT:similar to antibiotic resistance protein] [LE:151451] [RE:152641] [DI:direct]
>gp:[GI:e283116:g1684651] [LN:BSZ82987] [AC:Z82987] [PN:unknown similar to quinolon
resistance protein] [GN:ywoG] [OR:Bacillus subtilis] [DB:genpept-bct1] [DE:B.subtilis
ywo[A,B,C,D,E,F,G,H], nrg[A,B], spoIIID and mbl genes.] [LE:8662] [RE:9852]
[DI:complement] >gp:[GI:e1184551:g2636170] [LN:BSUB0019] [AC:Z99122:AL009126] [GN:ywoG]
[FN:unknown] [OR:Bacillus subtilis] [DB:genpept] [DE:Bacillus subtilis complete genome
(section 19 of 21): from 3597091to 3809700.] [NT:similar to antibiotic resistance
protein] [LE:151451] [RE:152641] [DI:direct]

| ORF_Name | NTID | AAID | NT Length | AA Length | score | probability |
|---|---|---|---|---|---|---|
| AI7503000997_23678262_c3_394 | 2724 | 6496 | 573 | 190 | 370 | 4.6e-34 |

Description
pir:[LN:B69832] [AC:B69832 ] [PN:biotin biosynthesis homolog yhfU] [GN:yhfU ]
[OR:Bacillus subtilis] [DB:pir2] >gp:[GI:e1183039:g2633373] [LN:BSUB0006]
[AC:Z99109:AL009126] [GN:yhfU] [FN:unknown] [OR:Bacillus subtilis] [DB:genpept-bct1]
[DE:Bacillus subtilis complete genome (section 6 of 21): from 999501 to1209940.]
[NT:similar to biotin biosynthesis] [LE:111897] [RE:112457] [DI:complement]
>gp:[GI:e325000:g2226257] [LN:BSY14084] [AC:Y14084] [PN:hypothetical protein] [GN:yhfU]
[OR:Bacillus subtilis] [DB:genpept-bct1] [DE:B.subtilis chromosomal DNA, region 78-80
degrees: aprE to comK.] [NT:similarity to BioY from Bacillus sphaericus (Swiss]
[LE:6325] [RE:6885] [DI:complement]

| ORF_Name | NTID | AAID | NT Length | AA Length | score | probability |
|---|---|---|---|---|---|---|
| AI7503000997_24104677_c2_291 | 2725 | 6497 | 1656 | 551 | 1619 | 2.0e-166 |

Description
sp:[LN:PTIB_BACSU] [AC:P54715] [GN:GLVC:GLVCB:GLV-2] [OR:BACILLUS SUBTILIS]
[EC:2.7.1.69] [DE:II, BC COMPONENT),] [SP:P54715] [DB:swissprot] >pir:[LN:G69635]
[AC:G69635 ] [PN:PTS arbutin-like enzyme IIBC component glvC] [GN:glvC ] [OR:Bacillus
subtilis] [DB:pir2] >gp:[GI:e1182810:g2633144] [LN:BSUB0005] [AC:Z99108:AL009126]
[PN:phosphotransferase system (PTS) arbutin-like] [GN:glvC] [OR:Bacillus subtilis]
[DB:genpept-bct1] [DE:Bacillus subtilis complete genome (section 5 of 21): from 802821
to1011250.] [NT:alternate gene name: yfiB] [SP:P54715] [LE:88901] [RE:90484]
[DI:direct] >gp:[GI:d1009740:g1486243] [LN:D50543] [AC:D50543] [PN:unknown] [GN:glv-2]
[FN:unknown] [OR:Bacillus subtilis] [SR:Bacillus subtilis (strain:168,
haplotype:haploid) DNA] [DB:genpept-bct1] [DE:Bacillus subtilis DNA for 76-degree
region, complete cds.] [LE:2577] [RE:4160] [DI:direct]

| ORF_Name | NTID | AAID | NT Length | AA Length | score | probability |
|---|---|---|---|---|---|---|
| AI7503000997_24257012_c1_268 | 2726 | 6498 | 735 | 244 | 927 | 4.4e-93 |

Description
gp:[GI:g3955199] [LN:AF022796] [AC:AF022796] [PN:ModB] [GN:modB] [OR:Staphylococcus
carnosus] [DB:genpept-bct2] [DE:Staphylococcus carnosus molybdenum cofactor
biosynthetic genecluster, complete sequence.] [NT:integral membrane-spanning protein of
the] [LE:906] [RE:1577] [DI:direct]

| ORF Name | NTID | AAID | NT Length | AA Length | score | probability |
|---|---|---|---|---|---|---|
| AI7503000997_24303812_c3_352 | 2727 | 6499 | 123 | 40 | | |

Description
NO-HIT

| ORF Name | NTID | AAID | NT Length | AA Length | score | probability |
|---|---|---|---|---|---|---|
| AI7503000997_24314818_c2_340 | 2728 | 6500 | 1035 | 344 | 1410 | 2.9e-144 |

Description
gp:[GI:e1429633:g4756163] [LN:A67171] [AC:A67171] [PN:MOAA GENE] [OR:Staphylococcus carnosus] [DB:genpept-pat] [DE:Sequence 11 from Patent EP0805205.] [LE:5470] [RE:6492] [DI:direct] >gp:[GI:g3955209] [LN:AF022796] [AC:AF022796] [PN:MoaA] [GN:moaA] [OR:Staphylococcus carnosus] [DB:genpept-bct2] [DE:Staphylococcus carnosus molybdenum cofactor biosynthetic genecluster, complete sequence.] [NT:protein similar to MoaA of Escherichia coli] [LE:7691] [RE:8713] [DI:direct]

| ORF Name | NTID | AAID | NT Length | AA Length | score | probability |
|---|---|---|---|---|---|---|
| AI7503000997_24406502_f2_127 | 2729 | 6501 | 171 | 56 | | |

Description
NO-HIT

| ORF Name | NTID | AAID | NT Length | AA Length | score | probability |
|---|---|---|---|---|---|---|
| AI7503000997_24406577_c2_346 | 2730 | 6502 | 3156 | 1051 | 2317 | 2.2e-240 |

Description
pir:[LN:E69795] [AC:E69795 ] [PN:acriflavin resistance protein homolog yerP] [GN:yerP ] [OR:Bacillus subtilis] [DB:pir2] >gp:[GI:e1182651:g2632985] [LN:BSUB0004] [AC:Z99107:AL009126] [GN:yerP] [FN:unknown] [OR:Bacillus subtilis] [DB:genpept-bct1] [DE:Bacillus subtilis complete genome (section 4 of 21): from 600701 to813890.] [NT:similar to acriflavin resistance protein] [LE:131722] [RE:134919] [DI:direct]

| ORF Name | NTID | AAID | NT Length | AA Length | score | probability |
|---|---|---|---|---|---|---|
| AI7503000997_24431532_c1_277 | 2731 | 6503 | 1254 | 417 | 1796 | 3.6e-185 |

Description
gp:[GI:g4574235] [LN:AF106850] [AC:AF106850] [PN:FmhB] [GN:fmhB] [OR:Staphylococcus aureus] [DB:genpept-bct2] [DE:Staphylococcus aureus FmhB (fmhB) gene, complete cds.] [NT:similar to Staphylococcus aureus FemA and FemB] [LE:204] [RE:1469] [DI:direct]

| ORF Name | NTID | AAID | NT Length | AA Length | score | probability |
|---|---|---|---|---|---|---|
| AI7503000997_24616251_f2_148 | 2732 | 6504 | 696 | 231 | 139 | 2.6e-07 |

Description
gp:[GI:g567887] [LN:STMDNRN] [AC:L37338] [PN:putative repressor] [GN:dnrO] [OR:Streptomyces peucetius] [SR:Streptomyces peucetius ATCC 29050 DNA] [DB:genpept-bct2] [DE:Streptomyces peucetius TDP-D-glucose-4,6-dehydratase (dnrM) gene,3' end, regulatory protein (dnrN) gene, complete cds, and repressorprotein (dnrO) gene, complete cds.] [NT:putative] [LE:1085] [RE:2107] [DI:direct]

| ORF_Name | NTID | AAID | NT Length | AA Length | score | probability |
|---|---|---|---|---|---|---|
| AI7503000997_24644008_c3_396 | 2733 | 6505 | 792 | 263 | 911 | 2.2e-91 |

Description
gp:[GI:g3955198] [LN:AF022796] [AC:AF022796] [PN:ModA] [GN:modA] [OR:Staphylococcus carnosus] [DB:genpept-bct2] [DE:Staphylococcus carnosus molybdenum cofactor biosynthetic genecluster, complete sequence.] [NT:molybdate-binding lipoprotein of the] [LE:109] [RE:894] [DI:direct]

| ORF_Name | NTID | AAID | NT Length | AA Length | score | probability |
|---|---|---|---|---|---|---|
| AI7503000997_24650452_f1_64 | 2734 | 6506 | 153 | 50 | | |

Description
NO-HIT

| ORF_Name | NTID | AAID | NT Length | AA Length | score | probability |
|---|---|---|---|---|---|---|
| AI7503000997_24804077_c3_358 | 2735 | 6507 | 153 | 50 | | |

Description
NO-HIT

| ORF_Name | NTID | AAID | NT Length | AA Length | score | probability |
|---|---|---|---|---|---|---|
| AI7503000997_25430317_c1_274 | 2736 | 6508 | 492 | 163 | 446 | 4.1e-42 |

Description
gp:[GI:g3955205] [LN:AF022796] [AC:AF022796] [PN:MobB] [GN:mobB] [OR:Staphylococcus carnosus] [DB:genpept-bct2] [DE:Staphylococcus carnosus molybdenum cofactor biosynthetic genecluster, complete sequence.] [NT:protein similar to MobB of Escherichia coli] [LE:5873] [RE:6355] [DI:direct]

| ORF_Name | NTID | AAID | NT Length | AA Length | score | probability |
|---|---|---|---|---|---|---|
| AI7503000997_25443838_c2_305 | 2737 | 6509 | 789 | 262 | 448 | 2.5e-42 |

Description
gp:[GI:d1023468:g2506027] [LN:D42078] [AC:D42078] [GN:NAG] [OR:Staphylococcus aureus] [SR:Staphylococcus aureus DNA] [DB:genpept-bct1] [DE:Staphylococcus aureus DNA for N-acetyl-glucosaminidase, partialcds.] [LE:<1] [RE:1448] [DI:direct]
>gp:[GI:d1023468:g2506027] [LN:D42078] [AC:D42078] [GN:NAG] [OR:Staphylococcus aureus] [SR:Staphylococcus aureus DNA] [DB:genpept] [DE:Staphylococcus aureus DNA for N-acetyl-glucosaminidase, partialcds.] [LE:<1] [RE:1448] [DI:direct]

| ORF_Name | NTID | AAID | NT Length | AA Length | score | probability |
|---|---|---|---|---|---|---|
| AI7503000997_25548385_f1_7 | 2738 | 6510 | 144 | 47 | | |

Description
NO-HIT

| ORF_Name | NTID | AAID | NT Length | AA Length | score | probability |
|---|---|---|---|---|---|---|
| AI7503000997_25554213_f1_49 | 2739 | 6511 | 627 | 208 | 943 | 8.8e-95 |

Description
sp:[LN:UREG_STAXY] [AC:P42877] [GN:UREG] [OR:STAPHYLOCOCCUS XYLOSUS] [DE:UREASE ACCESSORY PROTEIN UREG] [SP:P42877] [DB:swissprot] >gp:[GI:g511070] [LN:SXUREFG] [AC:Z35136] [PN:UreG] [OR:Staphylococcus xylosus] [DB:genpept-bct1] [DE:S.xylosus (C2a) UreF and UreG genes.] [SP:P42877] [LE:781] [RE:1395] [DI:direct]

| ORF Name | NTID | AAID | NT Length | AA Length | score | probability |
|---|---|---|---|---|---|---|
| AI7503000997_25582885_f1_22 | 2740 | 6512 | 453 | 150 | 153 | 4.6e-11 |

Description
pir:[LN:C70065] [AC:C70065 ] [PN:transcription regulator MarR family homolog ywoH]
[GN:ywoH ] [OR:Bacillus subtilis] [DB:pir2] >gp:[GI:e1184550:g2636169] [LN:BSUB0019]
[AC:Z99122:AL009126] [GN:ywoH] [FN:unknown] [OR:Bacillus subtilis] [DB:genpept-bct1]
[DE:Bacillus subtilis complete genome (section 19 of 21): from 3597091to 3809700.]
[NT:similar to transcriptional regulator (MarR family)] [LE:151016] [RE:151429]
[DI:direct] >gp:[GI:e283130:g1684652] [LN:BSZ82987] [AC:Z82987] [PN:unknown, similar to
cytolysin SlyA from] [GN:ywoH] [OR:Bacillus subtilis] [DB:genpept-bct1] [DE:B.subtilis
ywo[A,B,C,D,E,F,G,H], nrg[A,B], spoIIID and mbl genes.] [LE:9874] [RE:10287]
[DI:complement] >gp:[GI:e1184550:g2636169] [LN:BSUB0019] [AC:Z99122:AL009126] [GN:ywoH]
[FN:unknown] [OR:Bacillus subtilis] [DB:genpept] [DE:Bacillus subtilis complete genome
(section 19 of 21): from 3597091to 3809700.] [NT:similar to transcriptional regulator
(MarR family)] [LE:151016] [RE:151429] [DI:direct]

| ORF Name | NTID | AAID | NT Length | AA Length | score | probability |
|---|---|---|---|---|---|---|
| AI7503000997_25679762_c1_248 | 2741 | 6513 | 831 | 276 | 374 | 1.7e-34 |

Description
sp:[LN:SUHB_BACSU] [AC:Q45499] [GN:SUHB] [OR:BACILLUS SUBTILIS] [DE:EXTRAGENIC
SUPPRESSOR PROTEIN SUHB HOMOLOG] [SP:Q45499] [DB:swissprot] >pir:[LN:E69864] [AC:E69864
] [PN:myo-inositol-1(or 4)-monophosphatase homolog yktC] [GN:yktC ] [CL:suppressor
protein suhB] [OR:Bacillus subtilis] [DB:pir2] >gp:[GI:e1185057:g2633838] [LN:BSUB0008]
[AC:Z99111:AL009126] [GN:yktC] [FN:unknown] [OR:Bacillus subtilis] [DB:genpept-bct1]
[DE:Bacillus subtilis complete genome (section 8 of 21): from 1394791to 1603020.]
[NT:similar to myo-inositol-1(or 4)-monophosphatase] [SP:Q45499] [LE:142056]
[RE:142853] [DI:direct] >gp:[GI:g3282150] [LN:AF012285] [AC:AF012285:AF012284:U51911]
[PN:unknown] [GN:yktC] [FN:unknown] [OR:Bacillus subtilis] [DB:genpept-bct2]
[DE:Bacillus subtilis mobA-nprE gene region.] [NT:similar to E. coli extragenic
suppressor protein] [LE:42544] [RE:43341] [DI:direct]

| ORF Name | NTID | AAID | NT Length | AA Length | score | probability |
|---|---|---|---|---|---|---|
| AI7503000997_26182800_c1_276 | 2742 | 6514 | 813 | 270 | 90 | 0.045 |

Description
sp:[LN:YCX3_ASTLO] [AC:P34778] [OR:ASTASIA LONGA] [SR:,EUGLENOPHYCEAN ALGA]
[DE:HYPOTHETICAL 20.1 KD PROTEIN IN TRNS-RPL20 INTERGENIC REGION (ORF170)] [SP:P34778]
[DB:swissprot] >pir:[LN:S38600] [AC:S38600 ] [PN:hypothetical protein 170 (rpl20 5'
region)] [OR:plastid Astasia longa] [DB:pir2] >gp:[GI:g414866] [LN:ALRIBPTR]
[AC:X75653] [GN:orf170] [OR:Chloroplast Astasia longa] [SR:euglenophycean alga]
[DB:genpept-pln1] [DE:A.longa plastid genes for ribosomal proteins and tRNAs.]
[SP:P34778] [LE:1985] [RE:2497] [DI:complement]

| ORF Name | NTID | AAID | NT Length | AA Length | score | probability |
|---|---|---|---|---|---|---|
| AI7503000997_26367127_f1_44 | 2743 | 6515 | 168 | 55 | | |

Description
NO-HIT

| ORF Name | NTID | AAID | NT Length | AA Length | score | probability |
|---|---|---|---|---|---|---|
| AI7503000997_26375031_f1_8 | 2744 | 6516 | 195 | 64 | 86 | 0.015 |

Description pir:[LN:A70387] [AC:A70387 ] [PN:conserved hypothetical protein aq_1006] [GN:aq_1006 ] [OR:Aquifex aeolicus] [DB:pir2] >gp:[GI:g2983515] [LN:AE000718] [AC:AE000718:AE000657] [PN:hypothetical protein] [GN:aq_1006] [OR:Aquifex aeolicus] [DB:genpept-bct2] [DE:Aquifex aeolicus section 50 of 109 of the complete genome.] [LE:2797] [RE:5733] [DI:direct]

| ORF Name | NTID | AAID | NT Length | AA Length | score | probability |
|---|---|---|---|---|---|---|
| AI7503000997_26758426_c2_316 | 2745 | 6517 | 750 | 249 | 121 | 2.8e-07 |

Description gp:[GI:g3283053] [LN:AF054173] [AC:AF054173] [PN:staphylococcal accessory regulator A homolog] [GN:sarA] [OR:Staphylococcus epidermidis] [DB:genpept-bct2] [DE:Staphylococcus epidermidis staphylococcal accessory regulator Ahomolog (sarA) gene, complete cds.] [LE:887] [RE:1261] [DI:direct]

| ORF Name | NTID | AAID | NT Length | AA Length | score | probability |
|---|---|---|---|---|---|---|
| AI7503000997_29494067_c3_356 | 2746 | 6518 | 213 | 70 | 50 | 0.031 |

Description pir:[LN:PC1133] [AC:PC1133:S18087 ] [PN:hypothetical protein 119 (rmpG 5' region)] [OR:Lactococcus lactis] [DB:pir2]

| ORF Name | NTID | AAID | NT Length | AA Length | score | probability |
|---|---|---|---|---|---|---|
| AI7503000997_29697752_c2_302 | 2747 | 6519 | 786 | 261 | 499 | 9.8e-48 |

Description sp:[LN:LYTR_BACSU] [AC:Q02115] [GN:LYTR] [OR:BACILLUS SUBTILIS] [DE:MEMBRANE-BOUND PROTEIN LYTR] [SP:Q02115] [DB:swissprot] >pir:[LN:A47679] [AC:A47679:H69654 ] [PN:lyt divergon expression attenuator LytR] [GN:lytR ] [CL:Bacillus subtilis probable transcription regulator yvhJ] [OR:Bacillus subtilis] [DB:pir2] >gp:[GI:g143156] [LN:BACLYTABCD] [AC:M87645] [PN:membrane bound protein] [GN:lytR] [OR:Bacillus subtilis] [SR:Bacillus subtilis (strain W168) DNA] [DB:genpept-bct1] [DE:Bacillus subtilis membrane bound protein (lytA and lytR); amidaseenhancer (lytB); and amidase (lytC) genes, complete cds's.] [LE:92] [RE:1012] [DI:complement]
>gp:[GI:e1184471:g2636091] [LN:BSUB0019] [AC:Z99122:AL009126] [PN:membrane-bound protein] [GN:lytR] [FN:attenuator role for lytABC and lytR expression] [OR:Bacillus subtilis] [DB:genpept-bct1] [DE:Bacillus subtilis complete genome (section 19 of 21): from 3597091to 3809700.] [SP:Q02115] [LE:65251] [RE:66171] [DI:direct]
>gp:[GI:e1184471:g2636091] [LN:BSUB0019] [AC:Z99122:AL009126] [PN:membrane-bound protein] [GN:lytR] [FN:attenuator role for lytABC and lytR expression] [OR:Bacillus subtilis] [DB:genpept] [DE:Bacillus subtilis complete genome (section 19 of 21): from 3597091to 3809700.] [SP:Q02115] [LE:65251] [RE:66171] [DI:direct]

| ORF Name | NTID | AAID | NT Length | AA Length | score | probability |
|---|---|---|---|---|---|---|
| AI7503000997_31284550_f3_237 | 2748 | 6520 | 174 | 57 | | |

Description

NO-HIT

| ORF Name | NTID | AAID | NT Length | AA Length | score | probability |
|---|---|---|---|---|---|---|
| AI7503000997_3250075_f3_220 | 2749 | 6521 | 1008 | 335 | 705 | 1.5e-69 |

Description
pir:[LN:A71175] [AC:A71175 ] [PN:probable dehydrogenase] [GN:PH0597 ] [OR:Pyrococcus horikoshii] [DB:pir2] >gp:[GI:d1030629:g3257003] [LN:AP000002] [AC:AP000002:AB009475:AB009476:AB009477:AB009478:AB009479:AB009480] [PN:376aa long hypothetical dehydrogenase] [GN:PH0597] [OR:Pyrococcus horikoshii] [SR:Pyrococcus horikoshii (strain:OT3) DNA] [DB:genpept-bct1] [DE:Pyrococcus horikoshii OT3 genomic DNA, 287001-544000 nt. position(2/7).] [NT:similar to owl:BSZ9404317 percent identity: 49.821] [LE:248539] [RE:249669] [DI:complement]

| ORF Name | NTID | AAID | NT Length | AA Length | score | probability |
|---|---|---|---|---|---|---|
| AI7503000997_33360910_f3_216 | 2750 | 6522 | 549 | 182 | 120 | 1.4e-07 |

Description
pir:[LN:S74932] [AC:S74932 ] [PN:hypothetical protein slr0686] [OR:Synechocystis sp.] [SR:PCC 6803, , PCC 6803] [SR:PCC 6803, ] [DB:pir2] >gp:[GI:d1017705:g1652047] [LN:D90902] [AC:D90902:AB001339] [PN:hypothetical protein] [OR:Synechocystis sp.] [SR:Synechocystis sp. (strain:PCC6803) DNA] [DB:genpept-bct1] [DE:Synechocystis sp. PCC6803 complete genome, 4/27, 402290-524345.] [NT:ORF_ID:slr0686] [LE:27521] [RE:27880] [DI:direct]

| ORF Name | NTID | AAID | NT Length | AA Length | score | probability |
|---|---|---|---|---|---|---|
| AI7503000997_33694505_f3_198 | 2751 | 6523 | 162 | 53 | 47 | 0.0063 |

Description
gp:[GI:d1042768:g5103471] [LN:AP000058] [AC:AP000058] [PN:102aa long hypothetical protein] [GN:APE0083] [OR:Aeropyrum pernix] [SR:Aeropyrum pernix (strain:K1) DNA] [DB:genpept] [DE:Aeropyrum pernix genomic DNA, section 1/7.] [LE:56764] [RE:57072] [DI:direct]

| ORF Name | NTID | AAID | NT Length | AA Length | score | probability |
|---|---|---|---|---|---|---|
| AI7503000997_3371062_f1_10 | 2752 | 6524 | 333 | 110 | 90 | 0.00034 |

Description
gp:[GI:g1040951] [LN:AOU35271] [AC:U35271] [PN:NADH dehydrogenase subunit 6] [OR:Mitochondrion Anopheles oswaldoi] [SR:Anopheles oswaldoi] [DB:genpept-inv1] [DE:Anopheles oswaldoi NADH dehydrogenase subunit 6 gene, mitochondrialgene encoding mitochondrial product, partial cds.] [LE:<1] [RE:525] [DI:direct]

| ORF Name | NTID | AAID | NT Length | AA Length | score | probability |
|---|---|---|---|---|---|---|
| AI7503000997_34192165_f1_63 | 2753 | 6525 | 345 | 114 | 264 | 7.9e-23 |

Description
pir:[LN:B69857] [AC:B69857 ] [PN:chaperonin homolog ykkD] [GN:ykkD ] [CL:sugE protein] [OR:Bacillus subtilis] [DB:pir2] >gp:[GI:e1181510:g2632030] [LN:BSAJ2571] [AC:AJ002571] [PN:YkkD] [GN:ykkD] [FN:unknown] [OR:Bacillus subtilis] [DB:genpept-bct1] [DE:Bacillus subtilis 168 56 kb DNA fragment between xlyA and ykoR.] [LE:28980] [RE:29297] [DI:direct] >gp:[GI:e1183330:g2633664] [LN:BSUB0007] [AC:Z99110:AL009126] [GN:ykkD] [FN:unknown] [OR:Bacillus subtilis] [DB:genpept-bct1] [DE:Bacillus subtilis complete genome (section 7 of 21): from 1194391to 1411140.] [NT:similar to chaperonin] [LE:181929] [RE:182246] [DI:direct]

| ORF Name | NTID | AAID | NT Length | AA Length | score | probability |
|---|---|---|---|---|---|---|
| AI7503000997_34411552_f2_123 | 2754 | 6526 | 1722 | 573 | 2703 | 2.8e-281 |

Description sp:[LN:URE1_STAXY] [AC:P42873] [GN:UREC] [OR:STAPHYLOCOCCUS XYLOSUS] [EC:3.5.1.5] [DE:UREASE ALPHA SUBUNIT, (UREA AMIDOHYDROLASE)] [SP:P42873] [DB:swissprot] >pir:[LN:S38485] [AC:S38485 ] [PN:urease, 62K chain:urease alpha chain] [GN:ureC ] [CL:urease 62K chain:urease 62K chain homology] [OR:Staphylococcus xylosus] [EC:3.5.1.5] [DB:pir2] >gp:[GI:g410516] [LN:SXUREABC] [AC:X74600] [PN:urease alpha subunit] [GN:ureC] [OR:Staphylococcus xylosus] [DB:genpept-bct1] [DE:S.xylosus gene for ureA, ureB, and ureC genes for urease gamma,beta and alpha subunits.] [SP:P42873] [LE:1296] [RE:3011] [DI:direct]

| ORF Name | NTID | AAID | NT Length | AA Length | score | probability |
|---|---|---|---|---|---|---|
| AI7503000997_34430_f2_96 | 2755 | 6527 | 156 | 51 | | |

Description

NO-HIT

| ORF Name | NTID | AAID | NT Length | AA Length | score | probability |
|---|---|---|---|---|---|---|
| AI7503000997_34431300_c2_300 | 2756 | 6528 | 774 | 257 | 139 | 2.8e-09 |

Description gp:[GI:d1011987:g1402529] [LN:D78257] [AC:D78257] [PN:ORF8] [GN:orf8] [OR:Enterococcus faecalis] [SR:Enterococcus faecalis plasmid:pYI17 DNA] [DB:genpept-bct1] [DE:Enterococcus faecalis plasmid pYI17 genes for BacA, BacB, ORF3,ORF4, ORF5, ORF6, ORF7, ORF8, ORF9, ORF10, ORF11,partial cds.] [LE:1899] [RE:2261] [DI:complement]

| ORF Name | NTID | AAID | NT Length | AA Length | score | probability |
|---|---|---|---|---|---|---|
| AI7503000997_34617187_f2_156 | 2757 | 6529 | 207 | 68 | 74 | 0.00010 |

Description gp:[GI:g4164553] [LN:AF081828] [AC:AF081828] [PN:NADH dehydrogenase 6] [OR:Mitochondrion Ixodes hexagonus] [SR:Ixodes hexagonus] [DB:genpept-inv2] [DE:Ixodes hexagonus mitochondrial DNA, complete genome.] [LE:9406] [RE:9831] [DI:direct]

| ORF Name | NTID | AAID | NT Length | AA Length | score | probability |
|---|---|---|---|---|---|---|
| AI7503000997_35191527_f1_19 | 2758 | 6530 | 156 | 51 | | |

Description

NO-HIT

| ORF Name | NTID | AAID | NT Length | AA Length | score | probability |
|---|---|---|---|---|---|---|
| AI7503000997_35319025_f3_200 | 2759 | 6531 | 132 | 43 | | |

Description

NO-HIT

| ORF_Name | NTID | AAID | NT Length | AA Length | score | probability |
|---|---|---|---|---|---|---|
| AI7503000997_35547892_f3_218 | 2760 | 6532 | 156 | 51 | 161 | 8.5e-12 |

Description
gp:[GI:g2735506] [LN:SCU96107] [AC:U96107] [PN:SceB precursor] [GN:sceB] [OR:Staphylococcus carnosus] [DB:genpept-bct2] [DE:Staphylococcus carnosus N5,N10-methylenetetrahydromethanopterinreductase homolog, SceB precursor (sceB) and putative transmembraneprotein genes, complete cds, and putative Na+/H+ antiporter NhaC(nhaC) gene, partial cds.] [NT:major secreted protein] [LE:1894] [RE:2685] [DI:direct]

| ORF_Name | NTID | AAID | NT Length | AA Length | score | probability |
|---|---|---|---|---|---|---|
| AI7503000997_35572051_f1_72 | 2761 | 6533 | 129 | 42 | | |

Description
NO-HIT

| ORF_Name | NTID | AAID | NT Length | AA Length | score | probability |
|---|---|---|---|---|---|---|
| AI7503000997_36017151_f2_110 | 2762 | 6534 | 141 | 46 | | |

Description
NO-HIT

| ORF_Name | NTID | AAID | NT Length | AA Length | score | probability |
|---|---|---|---|---|---|---|
| AI7503000997_36113805_c1_245 | 2763 | 6535 | 750 | 249 | 775 | 5.6e-77 |

Description
sp:[LN:YBXG_BACSU] [AC:P54425:O31438] [GN:YBXG:YBDP] [OR:BACILLUS SUBTILIS] [DE:HYPOTHETICAL TRANSPORT PROTEIN IN NDHF-CSGA INTERGENIC REGION (ORF1)] [SP:P54425:O31438] [DB:swissprot] >pir:[LN:H69751] [AC:H69751:PC6045 ] [PN:amino acid permease homolog ybxG] [GN:ybxG ] [CL:arginine permease] [OR:Bacillus subtilis] [DB:pir2] >gp:[GI:d1034070:g3599629] [LN:AB006424] [AC:AB006424] [GN:ybdP] [OR:Bacillus subtilis] [SR:Bacillus subtilis (strain:168) DNA] [DB:genpept-bct1] [DE:Bacillus subtilis genomic DNA, 70 kb region between 17 and 23degree.] [LE:29556] [RE:30944] [DI:direct] >gp:[GI:e1182158:g2632492] [LN:BSUB0002] [AC:Z99105:AL009126] [GN:ybxG] [FN:unknown] [OR:Bacillus subtilis] [DB:genpept-bct1] [DE:Bacillus subtilis complete genome (section 2 of 21): from 194651 to415810.] [NT:alternate gene name: ybdP; similar to amino acid] [SP:P54425] [LE:31905] [RE:33293] [DI:direct]

| ORF_Name | NTID | AAID | NT Length | AA Length | score | probability |
|---|---|---|---|---|---|---|
| AI7503000997_36132792_c3_402 | 2764 | 6536 | 255 | 84 | 218 | 5.9e-18 |

Description
gp:[GI:e1429627:g4756161] [LN:A67171] [AC:A67171] [PN:MOAD GENE] [OR:Staphylococcus carnosus] [DB:genpept-pat] [DE:Sequence 11 from Patent EP0805205.] [LE:4583] [RE:4816] [DI:direct] >gp:[GI:g3955207] [LN:AF022796] [AC:AF022796] [PN:MoaD] [GN:moaD] [OR:Staphylococcus carnosus] [DB:genpept-bct2] [DE:Staphylococcus carnosus molybdenum cofactor biosynthetic genecluster, complete sequence.] [NT:protein similar to MoaD of Escherichia coli] [LE:6804] [RE:7037] [DI:direct]

| ORF Name | NTID | AAID | NT Length | AA Length | score | probability |
|---|---|---|---|---|---|---|
| AI7503000997_36134427_c1_241 | 2765 | 6537 | 657 | 218 | 251 | 1.9e-21 |

Description sp:[LN:YHCW_BACSU] [AC:P54607] [GN:YHCW] [OR:BACILLUS SUBTILIS] [DE:HYPOTHETICAL 24.7 KD PROTEIN IN CSPB-GLPP INTERGENIC REGION] [SP:P54607] [DB:swissprot] >pir:[LN:C69824] [AC:C69824 ] [PN:phosphoglycolate phosphatase homolog yhcW] [GN:yhcW ] [CL:hypothetical protein b2690] [OR:Bacillus subtilis] [DB:pir2] >gp:[GI:e233881:g1239999] [LN:BS75DGREG] [AC:X96983] [PN:hypothetical protein] [GN:yhcW] [OR:Bacillus subtilis] [DB:genpept-bct1] [DE:B.subtilis chromosomal DNA (region 75 degrees: cspB upstream ofglpPFKD operon).] [NT:similarity to phosphoglycolate phosphatase from] [SP:P54607] [LE:18604] [RE:19266] [DI:direct] >gp:[GI:e1182913:g2633247] [LN:BSUB0005] [AC:Z99108:AL009126] [GN:yhcW] [FN:unknown] [OR:Bacillus subtilis] [DB:genpept-bct1] [DE:Bacillus subtilis complete genome (section 5 of 21): from 802821 to1011250.] [NT:similar to phosphoglycolate phosphatase] [SP:P54607] [LE:194410] [RE:195072] [DI:direct]

| ORF Name | NTID | AAID | NT Length | AA Length | score | probability |
|---|---|---|---|---|---|---|
| AI7503000997_36209660_f2_116 | 2766 | 6538 | 378 | 125 | | |

Description

NO-HIT

| ORF Name | NTID | AAID | NT Length | AA Length | score | probability |
|---|---|---|---|---|---|---|
| AI7503000997_36225625_f1_56 | 2767 | 6539 | 795 | 264 | 1034 | 2.0e-104 |

Description gp:[GI:e244971:g1340128] [LN:SA1234] [AC:X97985] [OR:Staphylococcus aureus] [DB:genpept-bct1] [DE:S.aureus orfs 1,2,3 & 4.] [NT:ORF1] [LE:537] [RE:1304] [DI:direct]

| ORF Name | NTID | AAID | NT Length | AA Length | score | probability |
|---|---|---|---|---|---|---|
| AI7503000997_36615903_c2_329 | 2768 | 6540 | 1164 | 387 | 1007 | 1.5e-101 |

Description pir:[LN:H69771] [AC:H69771 ] [PN:butyryl-CoA dehydrogenase homolog ydbM] [GN:ydbM ] [OR:Bacillus subtilis] [DB:pir2] >gp:[GI:d1020042:g1881262] [LN:AB001488] [AC:AB001488] [GN:ydbM] [OR:Bacillus subtilis] [SR:Bacillus subtilis (strain:168) DNA] [DB:genpept-bct1] [DE:Bacillus subtilis genome sequence, 148 kb sequence of the regionbetween 35 and 47 degree.] [NT:SIMILAR TO ACYL-COA DEHYDROGENASE.] [LE:38215] [RE:39360] [DI:direct] >gp:[GI:e1182418:g2632752] [LN:BSUB0003] [AC:Z99106:AL009126] [GN:ydbM] [FN:unknown] [OR:Bacillus subtilis] [DB:genpept-bct1] [DE:Bacillus subtilis complete genome (section 3 of 21): from 402751 to611850.] [NT:similar to butyryl-CoA dehydrogenase] [LE:101959] [RE:103104] [DI:direct]

| ORF Name | NTID | AAID | NT Length | AA Length | score | probability |
|---|---|---|---|---|---|---|
| AI7503000997_3943752_f2_128 | 2769 | 6541 | 150 | 49 | | |

Description

NO-HIT

| ORF Name | NTID | AAID | NT Length | AA Length | score | probability |
|---|---|---|---|---|---|---|
| AI7503000997_3947153_f3_204 | 2770 | 6542 | 456 | 151 | 482 | 6.2e-46 |

Description
sp:[LN:UREE_BACSB] [AC:Q07401] [GN:UREE] [OR:BACILLUS SP] [SR:TB-90,] [DE:UREASE ACCESSORY PROTEIN UREE] [SP:Q07401] [DB:swissprot] >pir:[LN:D36950] [AC:D36950 ] [PN:ureE protein] [OR:Bacillus sp.] [DB:pir2] >gp:[GI:d1003836:g393297] [LN:BACUREA] [AC:D14439] [PN:urease accessory protein] [GN:UreE] [OR:Bacillus sp.] [SR:Bacillus sp. (strain:TB-90) DNA] [DB:genpept-bct1] [DE:Thermophilic Bacillus genes for urease subunits and ureaseaccessory proteins, complete cds.] [LE:2521] [RE:2967] [DI:direct]

| ORF Name | NTID | AAID | NT Length | AA Length | score | probability |
|---|---|---|---|---|---|---|
| AI7503000997_3991557_f1_55 | 2771 | 6543 | 141 | 46 | | |

Description
NO-HIT

| ORF Name | NTID | AAID | NT Length | AA Length | score | probability |
|---|---|---|---|---|---|---|
| AI7503000997_4042327_c3_390 | 2772 | 6544 | 918 | 305 | 309 | 1.3e-27 |

Description
gp:[GI:g1322222] [LN:HSU35735] [AC:U35735] [PN:RACH1] [GN:RACH1] [OR:Homo sapiens] [SR:human] [DB:genpept-pri2] [DE:Human RACH1 (RACH1) mRNA, complete cds.] [LE:169] [RE:1338] [DI:direct]

| ORF Name | NTID | AAID | NT Length | AA Length | score | probability |
|---|---|---|---|---|---|---|
| AI7503000997_4086568_c3_381 | 2773 | 6545 | 1983 | 660 | 130 | 1.8e-07 |

Description
sp:[LN:SOXS_ECOLI] [AC:P22539] [GN:SOXS] [OR:ESCHERICHIA COLI] [DE:REGULATORY PROTEIN SOXS] [SP:P22539] [DB:swissprot]

| ORF Name | NTID | AAID | NT Length | AA Length | score | probability |
|---|---|---|---|---|---|---|
| AI7503000997_42500_f1_24 | 2774 | 6546 | 159 | 52 | | |

Description
NO-HIT

| ORF Name | NTID | AAID | NT Length | AA Length | score | probability |
|---|---|---|---|---|---|---|
| AI7503000997_4459380_f1_84 | 2775 | 6547 | 207 | 68 | | |

Description
NO-HIT

| ORF Name | NTID | AAID | NT Length | AA Length | score | probability |
|---|---|---|---|---|---|---|
| AI7503000997_4459505_c2_343 | 2776 | 6548 | 129 | 42 | | |

Description
NO-HIT

| ORF Name | NTID | AAID | NT Length | AA Length | score | probability |
|---|---|---|---|---|---|---|
| AI7503000997_4486693_f2_92 | 2777 | 6549 | 804 | 267 | 976 | 2.8e-98 |

Description
gp:[GI:e324856:g2226002] [LN:SXY14043] [AC:Y14043] [PN:glucose-1-dehydrogenase] [GN:gdh] [OR:Staphylococcus xylosus] [DB:genpept-bct1] [DE:Staphylococcus xylosus glcU and gdh genes.] [LE:1222] [RE:2013] [DI:direct]

| ORF Name | NTID | AAID | NT Length | AA Length | score | probability |
|---|---|---|---|---|---|---|
| AI7503000997_4491450_f2_150 | 2778 | 6550 | 873 | 290 | 310 | 1.0e-27 |

Description
gp:[GI:g4980827] [LN:AE001714] [AC:AE001714:AE000512] [PN:transcriptional regulator, RpiR family] [GN:TM0326] [OR:Thermotoga maritima] [DB:genpept-bct2] [DE:Thermotoga maritima section 26 of 136 of the complete genome.] [NT:similar to SP:P46118 PID:881368 GB:U00096] [LE:3706] [RE:4548] [DI:direct]

| ORF Name | NTID | AAID | NT Length | AA Length | score | probability |
|---|---|---|---|---|---|---|
| AI7503000997_4547163_f1_48 | 2779 | 6551 | 699 | 232 | 741 | 2.2e-73 |

Description
sp:[LN:UREF_STAXY] [AC:P42876] [GN:UREF] [OR:STAPHYLOCOCCUS XYLOSUS] [DE:UREASE ACCESSORY PROTEIN UREF] [SP:P42876] [DB:swissprot] >gp:[GI:g511069] [LN:SXUREFG] [AC:Z35136] [PN:UreF] [OR:Staphylococcus xylosus] [DB:genpept-bct1] [DE:S.xylosus (C2a) UreF and UreG genes.] [SP:P42876] [LE:79] [RE:648] [DI:direct]

| ORF Name | NTID | AAID | NT Length | AA Length | score | probability |
|---|---|---|---|---|---|---|
| AI7503000997_4569012_f1_79 | 2780 | 6552 | 588 | 195 | | |

Description
NO-HIT

| ORF Name | NTID | AAID | NT Length | AA Length | score | probability |
|---|---|---|---|---|---|---|
| AI7503000997_4720290_f2_145 | 2781 | 6553 | 138 | 45 | | |

Description
NO-HIT

| ORF Name | NTID | AAID | NT Length | AA Length | score | probability |
|---|---|---|---|---|---|---|
| AI7503000997_4720928_f1_11 | 2782 | 6554 | 186 | 61 | | |

Description
NO-HIT

| ORF Name | NTID | AAID | NT Length | AA Length | score | probability |
|---|---|---|---|---|---|---|
| AI7503000997_4726550_f2_143 | 2783 | 6555 | 177 | 58 | | |

Description
NO-HIT

| ORF Name | NTID | AAID | NT Length | AA Length | score | probability |
|---|---|---|---|---|---|---|
| AI7503000997_4800202_c1_269 | 2784 | 6556 | 621 | 206 | 694 | 2.1e-68 |

Description
gp:[GI:g3955200] [LN:AF022796] [AC:AF022796] [PN:ModC] [GN:modC] [OR:Staphylococcus carnosus] [DB:genpept-bct2] [DE:Staphylococcus carnosus molybdenum cofactor biosynthetic genecluster, complete sequence.] [NT:ATP-binding protein of the molybdate-specific ABC] [LE:1578] [RE:2186] [DI:direct]

| ORF Name | NTID | AAID | NT Length | AA Length | score | probability |
|---|---|---|---|---|---|---|
| AI7503000997_4804153_f1_33 | 2785 | 6557 | 690 | 229 | 618 | 2.4e-60 |

Description
gp:[GI:e1429636:g4756164] [LN:A67171] [AC:A67171] [FN:MOAC GENE] [OR:Staphylococcus carnosus] [DB:genpept-pat] [DE:Sequence 11 from Patent EP0805205.] [NT:unnamed protein product] [LE:1846] [RE:2331] [DI:complement] >gp:[GI:g3955203] [LN:AF022796] [AC:AF022796] [PN:MoaC] [GN:moaC] [OR:Staphylococcus carnosus] [DB:genpept-bct2] [DE:Staphylococcus carnosus molybdenum cofactor biosynthetic genecluster, complete sequence.] [NT:protein similar to MoaC of Escherichia coli] [LE:4067] [RE:4552] [DI:complement]

| ORF Name | NTID | AAID | NT Length | AA Length | score | probability |
|---|---|---|---|---|---|---|
| AI7503000997_4876675_f2_122 | 2786 | 6558 | 399 | 132 | 430 | 2.0e-40 |

Description
sp:[LN:URE3_STAXY] [AC:P42875] [GN:UREA] [OR:STAPHYLOCOCCUS XYLOSUS] [EC:3.5.1.5] [DE:UREASE GAMMA SUBUNIT, (UREA AMIDOHYDROLASE)] [SP:P42875] [DB:swissprot] >pir:[LN:S38483] [AC:S38483 ] [PN:urease, 11K chain:urease gamma chain] [CL:urease 11K chain:urease 11K chain homology] [OR:Staphylococcus xylosus] [EC:3.5.1.5] [DB:pir2] >gp:[GI:g581787] [LN:SXUREABC] [AC:X74600] [PN:urease gamma subunit] [GN:ureA] [OR:Staphylococcus xylosus] [DB:genpept-bct1] [DE:S.xylosus gene for ureA, ureB, and ureC genes for urease gamma,beta and alpha subunits.] [SP:P42875] [LE:568] [RE:870] [DI:direct]

| ORF Name | NTID | AAID | NT Length | AA Length | score | probability |
|---|---|---|---|---|---|---|
| AI7503000997_4884662_c3_367 | 2787 | 6559 | 1128 | 375 | 333 | 1.0e-32 |

Description
gp:[GI:e1393931:g4490992] [LN:SCE29] [AC:AL035707] [PN:putative salicylate hydroxylase] [GN:SCE29.14c] [OR:Streptomyces coelicolor] [DB:genpept-bct1] [DE:Streptomyces coelicolor cosmid E29.] [NT:SCE29.14c, possible salicylate hydroxylase, len:] [LE:19076] [RE:20338] [DI:complement]

| ORF Name | NTID | AAID | NT Length | AA Length | score | probability |
|---|---|---|---|---|---|---|
| AI7503000997_4976687_c1_281 | 2788 | 6560 | 924 | 307 | 232 | 1.9e-19 |

Description
gp:[GI:g4980727] [LN:AE001707] [AC:AE001707:AE000512] [PN:conserved hypothetical protein] [GN:TM0229] [OR:Thermotoga maritima] [DB:genpept-bct2] [DE:Thermotoga maritima section 19 of 136 of the complete genome.] [NT:similar to GB:L77117 PID:1591686 percent identity:] [LE:5630] [RE:6487] [DI:direct]

| ORF Name | NTID | AAID | NT Length | AA Length | score | probability |
|---|---|---|---|---|---|---|
| AI7503000997_5082812_c2_310 | 2789 | 6561 | 135 | 44 | | |

Description
NO-HIT

| ORF Name | NTID | AAID | NT Length | AA Length | score | probability |
|---|---|---|---|---|---|---|
| AI7503000997_5087556_c2_335 | 2790 | 6562 | 849 | 282 | 990 | 9.2e-100 |

Description
gp:[GI:e1429618:g4756158] [LN:A67171] [AC:A67171] [FN:MOEB GENE] [OR:Staphylococcus carnosus] [DB:genpept-pat] [DE:Sequence 11 from Patent EP0805205.] [NT:unnamed protein product] [LE:117] [RE:1118] [DI:direct] >gp:[GI:g3955201] [LN:AF022796] [AC:AF022796] [PN:MoeB] [GN:moeB] [OR:Staphylococcus carnosus] [DB:genpept-bct2] [DE:Staphylococcus carnosus molybdenum cofactor biosynthetic genecluster, complete sequence.] [NT:protein similar to the molybdopterin synthase] [LE:2338] [RE:3339] [DI:direct]

| ORF Name | NTID | AAID | NT Length | AA Length | score | probability |
|---|---|---|---|---|---|---|
| AI7503000997_5113550_f2_149 | 2791 | 6563 | 1089 | 362 | 269 | 2.3e-23 |

Description
pir:[LN:C70217] [AC:C70217 ] [PN:outer surface protein homolog] [OR:Borrelia burgdorferi] [SR:, Lyme disease spirochete] [DB:pir2] >gp:[GI:g2689897] [LN:AE000792] [AC:AE000792] [PN:outer surface protein, putative] [GN:BBB07] [OR:Borrelia burgdorferi] [SR:Lyme disease spirochete] [DB:genpept-bct2] [DE:Borrelia burgdorferi plasmid cp26, complete plasmid sequence.] [NT:similar to GB:M88764 SP:Q09090 PID:469166] [LE:4769] [RE:5866] [DI:direct]

| ORF Name | NTID | AAID | NT Length | AA Length | score | probability |
|---|---|---|---|---|---|---|
| AI7503000997_5266018_f2_160 | 2792 | 6564 | 771 | 256 | 415 | 7.8e-39 |

Description
sp:[LN:YFIA_BACSU] [AC:P54717] [GN:YFIA] [OR:BACILLUS SUBTILIS] [DE:HYPOTHETICAL 29.3 KD PROTEIN IN GLVG-GLVBC INTERGENIC REGION] [SP:P54717] [DB:swissprot] >pir:[LN:D69802] [AC:D69802 ] [PN:conserved hypothetical protein yfiA] [GN:yfiA ] [OR:Bacillus subtilis] [DB:pir2] >gp:[GI:e1182809:g2633143] [LN:BSUB0005] [AC:Z99108:AL009126] [GN:yfiA] [FN:unknown] [OR:Bacillus subtilis] [DB:genpept-bct1] [DE:Bacillus subtilis complete genome (section 5 of 21): from 802821 to1011250.] [NT:similar to hypothetical proteins] [SP:P54717] [LE:88122] [RE:88886] [DI:direct] >gp:[GI:d1009739:g1486242] [LN:D50543] [AC:D50543] [PN:unknown] [GN:yfiA] [FN:unknown] [OR:Bacillus subtilis] [SR:Bacillus subtilis (strain:168, haplotype:haploid) DNA] [DB:genpept-bct1] [DE:Bacillus subtilis DNA for 76-degree region, complete cds.] [LE:1798] [RE:2562] [DI:direct]

| ORF Name | NTID | AAID | NT Length | AA Length | score | probability |
|---|---|---|---|---|---|---|
| AI7503000997_5898328_f2_91 | 2793 | 6565 | 864 | 287 | 1102 | 1.2e-111 |

Description
gp:[GI:e324855:g2226001] [LN:SXY14043] [AC:Y14043] [PN:glucose uptake protein] [GN:glcU] [OR:Staphylococcus xylosus] [DB:genpept-bct1] [DE:Staphylococcus xylosus glcU and gdh genes.] [LE:306] [RE:1172] [DI:direct]

| ORF Name | NTID | AAID | NT Length | AA Length | score | probability |
|---|---|---|---|---|---|---|
| AI7503000997_6050010_c3_404 | 2794 | 6566 | 129 | 42 | | |

Description
NO-HIT

| ORF Name | NTID | AAID | NT Length | AA Length | score | probability |
|---|---|---|---|---|---|---|
| AI7503000997_6757755_f2_121 | 2795 | 6567 | 171 | 56 | | |

Description
NO-HIT

| ORF Name | NTID | AAID | NT Length | AA Length | score | probability |
|---|---|---|---|---|---|---|
| AI7503000997_6929676_c1_255 | 2796 | 6568 | 342 | 113 | | |

Description
NO-HIT

| ORF Name | NTID | AAID | NT Length | AA Length | score | probability |
|---|---|---|---|---|---|---|
| AI7503000997_7031318_f2_153 | 2797 | 6569 | 339 | 112 | | |

Description
NO-HIT

| ORF Name | NTID | AAID | NT Length | AA Length | score | probability |
|---|---|---|---|---|---|---|
| AI7503000997_7086677_c3_364 | 2798 | 6570 | 243 | 80 | 78 | 0.019 |

Description
sp:[LN:LY4F_MOUSE] [AC:Q60653] [GN:LY49F:LY-49F:LY49-F] [OR:MUS MUSCULUS] [SR:,MOUSE]
[DE:T-CELL SURFACE GLYCOPROTEIN LY-49F (LY49-F ANTIGEN)] [SP:Q60653] [DB:swissprot]
>pir:[LN:I49051] [AC:I49051 ] [PN:Ly-49F-GE antigen] [OR:Mus musculus] [SR:, house
mouse] [DB:pir2] >gp:[GI:g533492] [LN:MMU10092] [AC:U10092] [PN:Ly-49F-GE antigen]
[OR:Mus musculus] [SR:house mouse] [DB:genpept-rod] [DE:Mus musculus C57BL/6 Ly-49F-GE
antigen mRNA, complete cds.] [LE:81] [RE:881] [DI:direct]

| ORF Name | NTID | AAID | NT Length | AA Length | score | probability |
|---|---|---|---|---|---|---|
| AI7503000997_818812_c2_337 | 2799 | 6571 | 1287 | 428 | 1560 | 3.6e-160 |

Description
gp:[GI:e1429624:g4756160] [LN:A67171] [AC:A67171] [FN:MOEA GENE] [OR:Staphylococcus
carnosus] [DB:genpept-pat] [DE:Sequence 11 from Patent EP0805205.] [NT:unnamed protein
product] [LE:2396] [RE:3655] [DI:direct] >gp:[GI:g3955204] [LN:AF022796] [AC:AF022796]
[PN:MoeA] [GN:moeA] [OR:Staphylococcus carnosus] [DB:genpept-bct2] [DE:Staphylococcus
carnosus molybdenum cofactor biosynthetic genecluster, complete sequence.] [NT:protein
similar to MoeA of Escherichia coli] [LE:4617] [RE:5876] [DI:direct]

| ORF Name | NTID | AAID | NT Length | AA Length | score | probability |
|---|---|---|---|---|---|---|
| AI7503000997_829761_c1_288 | 2800 | 6572 | 2172 | 723 | 1751 | 2.1e-180 |

Description
pir:[LN:H69724] [AC:H69724 ] [PN:DNA topoisomerase III topB] [GN:topB ] [OR:Bacillus
subtilis] [DB:pir2] >gp:[GI:d1020016:g1881236] [LN:AB001488] [AC:AB001488] [PN:PROBABLE
DNA TOPOISOMERASE III] [GN:topB] [OR:Bacillus subtilis] [SR:Bacillus subtilis
(strain:168) DNA] [DB:genpept-bct1] [EC:5.99.1.2] [DE:Bacillus subtilis genome
sequence, 148 kb sequence of the regionbetween 35 and 47 degree.] [LE:9617] [RE:11800]
[DI:direct] >gp:[GI:e1182392:g2632726] [LN:BSUB0003] [AC:Z99106:AL009126] [PN:DNA
topoisomerase III] [GN:topB] [OR:Bacillus subtilis] [DB:genpept-bct1] [EC:5.99.1.2]
[DE:Bacillus subtilis complete genome (section 3 of 21): from 402751 to611850.]
[LE:73361] [RE:75544] [DI:direct]

| ORF Name | NTID | AAID | NT Length | AA Length | score | probability |
|---|---|---|---|---|---|---|
| AI7503000997_834686_c2_290 | 2801 | 6573 | 132 | 43 | | |

Description
NO-HIT

| ORF Name | NTID | AAID | NT Length | AA Length | score | probability |
|---|---|---|---|---|---|---|
| AI7503000997_959427_f1_62 | 2802 | 6574 | 417 | 138 | 241 | 2.2e-20 |

Description
gp:[GI:g2735506] [LN:SCU96107] [AC:U96107] [PN:SceB precursor] [GN:sceB]
[OR:Staphylococcus carnosus] [DB:genpept-bct2] [DE:Staphylococcus carnosus
N5,N10-methylenetetrahydromethanopterinreductase homolog, SceB precursor (sceB) and
putative transmembraneprotein genes, complete cds, and putative Na+/H+ antiporter
NhaC(nhaC) gene, partial cds.] [NT:major secreted protein] [LE:1894] [RE:2685]
[DI:direct]

| ORF Name | NTID | AAID | NT Length | AA Length | score | probability |
|---|---|---|---|---|---|---|
| AI7503000997_964077_c1_275 | 2803 | 6575 | 453 | 150 | 659 | 1.1e-64 |

Description
gp:[GI:g3955206] [LN:AF022796] [AC:AF022796] [PN:MoaE] [GN:moaE] [OR:Staphylococcus
carnosus] [DB:genpept-bct2] [DE:Staphylococcus carnosus molybdenum cofactor
biosynthetic genecluster, complete sequence.] [NT:protein similar to MoaE of
Escherichia coli] [LE:6352] [RE:6804] [DI:direct]

| ORF Name | NTID | AAID | NT Length | AA Length | score | probability |
|---|---|---|---|---|---|---|
| AI7503000997_975061_c3_377 | 2804 | 6576 | 1455 | 484 | 916 | 6.4e-92 |

Description
sp:[LN:YB07_HAEIN] [AC:Q57007:P96339] [GN:HI1107] [OR:HAEMOPHILUS INFLUENZAE]
[DE:HYPOTHETICAL NA+/H+ ANTIPORTER HI1107] [SP:Q57007:P96339] [DB:swissprot]
>pir:[LN:I64182] [AC:I64182 ] [PN:Na+/H+-exchanging protein homolog:Na+/H+ antiporter]
[CL:Na+/H+-exchanging protein] [OR:Haemophilus influenzae] [DB:pir2] >gp:[GI:g1574661]
[LN:U32790] [AC:U32790:L42023] [PN:Na+/H+ antiporter (nhaC)] [GN:HI1107]
[OR:Haemophilus influenzae Rd] [DB:genpept-bct2] [DE:Haemophilus influenzae Rd section
105 of 163 of the completegenome.] [NT:similar to GB:M73530 SP:P27611 PID:143245]
[LE:7526] [RE:8932] [DI:complement]

| ORF Name | NTID | AAID | NT Length | AA Length | score | probability |
|---|---|---|---|---|---|---|
| AI7503000997_9845631_f3_222 | 2805 | 6577 | 156 | 51 | | |

Description
NO-HIT

| ORF Name | NTID | AAID | NT Length | AA Length | score | probability |
|---|---|---|---|---|---|---|
| AI7503000997_9928188_f1_39 | 2806 | 6578 | 132 | 43 | 95 | 0.00025 |

Description
sp:[LN:NARQ_BACSU] [AC:P39756] [GN:NARQ:NARAA] [OR:BACILLUS SUBTILIS] [DE:NARQ PROTEIN] [SP:P39756] [DB:swissprot] >pir:[LN:B69665] [AC:B69665 ] [PN:required for formate dehydrogenase activity narQ] [GN:narQ ] [OR:Bacillus subtilis] [DB:pir2] >gp:[GI:e276834:g1648855] [LN:BSATPC] [AC:Z81356] [PN:unknown] [GN:narQ] [OR:Bacillus subtilis] [DB:genpept-bct1] [DE:B.subtilis atpC gene.] [SP:P39756] [LE:7048] [RE:7836] [DI:direct] >gp:[GI:g580895] [LN:BSNARAAB] [AC:Z35277] [PN:unknown] [GN:narAA] [OR:Bacillus subtilis] [DB:genpept-bct1] [DE:B.subtilis (168) narA gene.] [SP:P39756] [LE:490] [RE:1278] [DI:direct] >gp:[GI:e1184577:g2636196] [LN:BSUB0019] [AC:Z99122:AL009126] [GN:narQ] [FN:required for formate dehydrogenase activity] [OR:Bacillus subtilis] [DB:genpept-bct1] [DE:Bacillus subtilis complete genome (section 19 of 21): from 3597091to 3809700.] [NT:alternate gene name: narAA] [SP:P39756] [LE:175331] [RE:176119] [DI:complement] >gp:[GI:e1184577:g2636196] [LN:BSUB0019] [AC:Z99122:AL009126] [GN:narQ] [FN:required for formate dehydrogenase activity] [OR:Bacillus subtilis] [DB:genpept] [DE:Bacillus subtilis complete genome (section 19 of 21): from 3597091to 3809700.] [NT:alternate gene name: narAA] [SP:P39756] [LE:175331] [RE:176119] [DI:complement]

| ORF Name | NTID | AAID | NT Length | AA Length | score | probability |
|---|---|---|---|---|---|---|
| AI7503000997_9928500_c1_270 | 2807 | 6579 | 261 | 86 | 286 | 3.7e-25 |

Description
gp:[GI:e1429618:g4756158] [LN:A67171] [AC:A67171] [FN:MOEB GENE] [OR:Staphylococcus carnosus] [DB:genpept-pat] [DE:Sequence 11 from Patent EP0805205.] [NT:unnamed protein product] [LE:117] [RE:1118] [DI:direct] >gp:[GI:g3955201] [LN:AF022796] [AC:AF022796] [PN:MoeB] [GN:moeB] [OR:Staphylococcus carnosus] [DB:genpept-bct2] [DE:Staphylococcus carnosus molybdenum cofactor biosynthetic genecluster, complete sequence.] [NT:protein similar to the molybdopterin synthase] [LE:2338] [RE:3339] [DI:direct]

| ORF Name | NTID | AAID | NT Length | AA Length | score | probability |
|---|---|---|---|---|---|---|
| AI7503000997_9977318_f1_75 | 2808 | 6580 | 1437 | 478 | 700 | 4.9e-69 |

Description
pir:[LN:D65017] [AC:D65017 ] [PN:hypothetical protein b2429] [CL:phosphotransferase system sucrose-specific enzyme II, factor II] [OR:Escherichia coli] [DB:pir2] >gp:[GI:d1017042:g1799859] [LN:D90872] [AC:D90872:AB001340] [PN:PTS SYSTEM, SUCROSE-SPECIFIC IIBC COMPONENT] [GN:IPA-49D] [OR:Escherichia coli] [SR:Escherichia coli (strain:K12) DNA, clone_lib:Kohara lambda minise] [DB:genpept-bct1] [DE:E.coli genomic DNA, Kohara clone #419(54.7-55.1 min.).] [NT:similar to [SwissProt Accession Number P05306]] [LE:9801] [RE:11225] [DI:direct] >gp:[GI:d1017045:g1799863] [LN:D90873] [AC:D90873:AB001340] [PN:PTS SYSTEM, SUCROSE-SPECIFIC IIBC COMPONENT] [GN:IPA-49D] [OR:Escherichia coli] [SR:Escherichia coli (strain:K12) DNA, clone_lib:Kohara lambda minise] [DB:genpept-bct1] [DE:E.coli genomic DNA, Kohara clone #420(54.9-55.2 min.).] [NT:similar to [SwissProt Accession Number P05306]] [LE:611] [RE:2035] [DI:direct] >gp:[GI:g1788769] [LN:AE000330] [AC:AE000330:U00096] [PN:putative PTS enzyme II] [GN:b2429] [FN:putative enzyme; Not classified] [OR:Escherichia coli] [DB:genpept-bct2] [DE:Escherichia coli K-12 MG1655 section 220 of 400 of the completegenome.] [NT:o474; 33 pct identical (29 gaps) to 436 residues] [LE:5237] [RE:6661] [DI:direct]

| ORF Name | NTID | AAID | NT Length | AA Length | score | probability |
|---|---|---|---|---|---|---|
| AI7503000998_10159760_f1_50 | 2809 | 6581 | 156 | 51 | | |

Description
NO-HIT

| ORF Name | NTID | AAID | NT Length | AA Length | score | probability |
|---|---|---|---|---|---|---|
| AI7503000998_10312805_f3_197 | 2810 | 6582 | 144 | 47 | | |

Description
NO-HIT

| ORF Name | NTID | AAID | NT Length | AA Length | score | probability |
|---|---|---|---|---|---|---|
| AI7503000998_10646950_c1_238 | 2811 | 6583 | 1221 | 406 | 1151 | 8.0e-117 |

Description
pir:[LN:A69974] [AC:A69974 ] [PN:cystathionine gamma-synthase homolog yrhB] [GN:yrhB ] [CL:O-succinylhomoserine (thiol)-lyase] [OR:Bacillus subtilis] [DB:pir2]
>gp:[GI:g1934606] [LN:BSU93874] [AC:U93874] [PN:cystathionine gamma-lyase] [GN:yrhB] [OR:Bacillus subtilis] [DB:genpept-bct1] [DE:Bacillus subtilis cysteine synthase (yrhA), cystathionine gamma-lyase (yrhB), YrhC (yrhC), YrhD (yrhD), formate dehydrogenase chain A (yrhE), YrhF (yrhF), formate dehydrogenase (yrhG), YrhH(yrhH), regulatory protein (yrhI), cytochrome P450 102 (yrhJ), YrhK(yrhK), hypothetical protein YrhL (yrhL), putative anti-SigV factor(yrhM), RNA polymerase sigma factor SigV (sigV) and YrhO (yrhO)genes, complete cds, and YrhP (yrhP) gene, partial cds.] [NT:similar to Rattus norvegicus cystathionine] [LE:986] [RE:2125] [DI:direct]
>gp:[GI:e1183955:g2635171] [LN:BSUB0014] [AC:Z99117:AL009126] [GN:yrhB] [FN:unknown] [OR:Bacillus subtilis] [DB:genpept-bct1] [DE:Bacillus subtilis complete genome (section 14 of 21): from 2599451to 2812870.] [NT:similar to cystathionine gamma-synthase] [LE:184821] [RE:185960] [DI:complement]

| ORF Name | NTID | AAID | NT Length | AA Length | score | probability |
|---|---|---|---|---|---|---|
| AI7503000998_10723177_f1_59 | 2812 | 6584 | 255 | 84 | | |

Description
NO-HIT

| ORF Name | NTID | AAID | NT Length | AA Length | score | probability |
|---|---|---|---|---|---|---|
| AI7503000998_11213532_c3_351 | 2813 | 6585 | 246 | 81 | 90 | 0.00022 |

Description
gp:[GI:g208931] [LN:SYNORFLAC] [AC:M15619] [OR:synthetic construct] [SR:E.coli (strain SE5000) synthetic DNA, clone pKB1] [DB:genpept-syn] [DE:Synthetic E.coli ORF16/lacZ fusion protein, partial cds.] [NT:ORF16-lacZ fusion protein] [LE:29] [RE:>232] [DI:direct]

| ORF Name | NTID | AAID | NT Length | AA Length | score | probability |
|---|---|---|---|---|---|---|
| AI7503000998_1178785_c3_323 | 2814 | 6586 | 939 | 312 | 731 | 2.6e-72 |

Description
pir:[LN:H69973] [AC:H69973 ] [PN:cysteine synthase homolog yrhA] [GN:yrhA ] [CL:threonine dehydratase] [OR:Bacillus subtilis] [DB:pir2] >gp:[GI:g1934605] [LN:BSU93874] [AC:U93874] [PN:cysteine synthase] [GN:yrhA] [OR:Bacillus subtilis] [DB:genpept-bct1] [DE:Bacillus subtilis cysteine synthase (yrhA), cystathioninegamma-lyase (yrhB), YrhC (yrhC), YrhD (yrhD), formate dehydrogenasechain A (yrhE), YrhF (yrhF), formate dehydrogenase (yrhG), YrhH(yrhH), regulatory protein (yrhI), cytochrome P450 102 (yrhJ), YrhK(yrhK), hypothetical protein YrhL (yrhL), putative anti-SigV factor(yrhM), RNA polymerase sigma factor SigV (sigV) and YrhO (yrhO)genes, complete cds, and YrhP (yrhP) gene, partial cds.] [NT:similar to cysteine synthase from Spinacia] [LE:61] [RE:984] [DI:direct] >gp:[GI:e1183956:g2635172] [LN:BSUB0014] [AC:Z99117:AL009126] [GN:yrhA] [FN:unknown] [OR:Bacillus subtilis] [DB:genpept-bct1] [DE:Bacillus subtilis complete genome (section 14 of 21): from 2599451to 2812870.] [NT:similar to cysteine synthase] [LE:185962] [RE:186885] [DI:complement]

| ORF Name | NTID | AAID | NT Length | AA Length | score | probability |
|---|---|---|---|---|---|---|
| AI7503000998_11931540_f2_96 | 2815 | 6587 | 825 | 274 | 786 | 3.8e-78 |

Description
sp:[LN:YLAC_STAXY] [AC:O33812] [OR:STAPHYLOCOCCUS XYLOSUS] [DE:HYPOTHETICAL TRANSCRIPTIONAL REGULATOR IN LACR 5'REGION (FRAGMENT)] [SP:O33812] [DB:swissprot] >gp:[GI:e352090:g2462703] [LN:SXLACRPH] [AC:Y14599] [PN:transcriptional regulator from the LysR-type] [OR:Staphylococcus xylosus] [DB:genpept-bct1] [DE:Staphylococcus xylosus lacR, lacP, lacH genes and 2 ORF's.] [NT:ORF1] [SP:O33812] [LE:<1] [RE:814] [DI:direct]

| ORF Name | NTID | AAID | NT Length | AA Length | score | probability |
|---|---|---|---|---|---|---|
| AI7503000998_1256387_c2_297 | 2816 | 6588 | 129 | 42 | | |

Description
NO-HIT

| ORF Name | NTID | AAID | NT Length | AA Length | score | probability |
|---|---|---|---|---|---|---|
| AI7503000998_12603166_f2_86 | 2817 | 6589 | 303 | 100 | 100 | 1.9e-05 |

Description
pir:[LN:G71244] [AC:G71244 ] [PN:hypothetical protein PH0217] [GN:PH0217 ] [OR:Pyrococcus horikoshii] [DB:pir2] >gp:[GI:d1030229:g3256603] [LN:AP000001] [AC:AP000001:AB009465:AB009464:AB009466:AB009467:AB009468:AB009469] [PN:106aa long hypothetical protein] [GN:PH0217] [OR:Pyrococcus horikoshii] [SR:Pyrococcus horikoshii (strain:OT3) DNA] [DB:genpept-bct1] [DE:Pyrococcus horikoshii OT3 genomic DNA, 1-287000 nt. position (1/7).] [LE:191072] [RE:191392] [DI:complement]

| ORF Name | NTID | AAID | NT Length | AA Length | score | probability |
|---|---|---|---|---|---|---|
| AI7503000998_126068_f1_46 | 2818 | 6590 | 555 | 184 | 164 | 3.4e-11 |

Description
pir:[LN:A71661] [AC:A71661 ] [PN:hypothetical protein RP563] [GN:RP563 ] [OR:Rickettsia prowazekii] [DB:pir2] >gp:[GI:e1342855:g3861111] [LN:RPXX03] [AC:AJ235272:AJ235269] [PN:unknown] [GN:RP563] [OR:Rickettsia prowazekii] [DB:genpept-bct1] [DE:Rickettsia prowazekii strain Madrid E, complete genome; segment3/4.] [LE:110476] [RE:112242] [DI:direct]

| ORF Name | NTID | AAID | NT Length | AA Length | score | probability |
|---|---|---|---|---|---|---|
| AI7503000998_13089052_f3_214 | 2819 | 6591 | 123 | 40 | | |

Description
NO-HIT

| ORF Name | NTID | AAID | NT Length | AA Length | score | probability |
|---|---|---|---|---|---|---|
| AI7503000998_13678300_c2_267 | 2820 | 6592 | 1233 | 410 | 1393 | 1.8e-142 |

Description
pir:[LN:B69760] [AC:B69760 ] [PN:conserved hypothetical protein yciC] [GN:yciC ] [CL:conserved hypothetical protein yciC] [OR:Bacillus subtilis] [DB:pir2] >gp:[GI:e1182288:g2632622] [LN:BSUB0002] [AC:Z99105:AL009126] [GN:yciC] [FN:unknown] [OR:Bacillus subtilis] [DB:genpept-bct1] [DE:Bacillus subtilis complete genome (section 2 of 21): from 194651 to415810.] [NT:similar to hypothetical proteins] [LE:170984] [RE:172177] [DI:direct] >gp:[GI:d1009605:g1805408] [LN:D50453] [AC:D50453] [PN:homologues to nitrile hydratase region] [GN:yciC] [OR:Bacillus subtilis] [SR:Bacillus subtilis (strain:168 trpC2) DNA] [DB:genpept-bct1] [DE:Bacillus subtilis DNA for 25-36 degree region containing theamyE-srfA region, complete cds.] [LE:45287] [RE:46480] [DI:direct]

| ORF Name | NTID | AAID | NT Length | AA Length | score | probability |
|---|---|---|---|---|---|---|
| AI7503000998_13912712_c3_312 | 2821 | 6593 | 150 | 49 | 52 | 0.015 |

Description
sp:[LN:IMM1_ECOLI] [AC:P02985] [GN:IMM] [OR:ESCHERICHIA COLI] [DE:COLICIN E1 IMMUNITY PROTEIN (IMME1) (MICROCIN E1 IMMUNITY PROTEIN)] [SP:P02985] [DB:swissprot] >gp:[GI:g455140] [LN:CE1CEA] [AC:M12543] [OR:Plasmid ColE1] [SR:Plasmid ColE1 (a colicin-producing derivative strain from E.col] [DB:genpept-bct1] [DE:Plasmid ColE1 cea (3' end), imm and lys genes (complete cds).] [NT:immunity protein] [LE:32] [RE:373] [DI:complement]

| ORF Name | NTID | AAID | NT Length | AA Length | score | probability |
|---|---|---|---|---|---|---|
| AI7503000998_13923427_f3_196 | 2822 | 6594 | 135 | 44 | | |

Description
NO-HIT

| ORF Name | NTID | AAID | NT Length | AA Length | score | probability |
|---|---|---|---|---|---|---|
| AI7503000998_14218805_c2_301 | 2823 | 6595 | 129 | 42 | 80 | 0.0095 |

Description
sp:[LN:TRER_BACSU] [AC:P39796] [GN:TRER] [OR:BACILLUS SUBTILIS] [DE:TREHALOSE OPERON TRANSCRIPTIONAL REPRESSOR] [SP:P39796] [DB:swissprot] >pir:[LN:JC5038] [AC:JC5038:S67931:D69725:I40499:S67866 ] [PN:transcription repressor of trehalose operon treR] [GN:treR ] [OR:Bacillus subtilis] [DB:pir2] >gp:[GI:g1000453] [LN:BSTREAPR] [AC:Z54245] [PN:TreR] [GN:treR] [FN:repressor of the trehalose operon] [OR:Bacillus subtilis] [DB:genpept-bct1] [DE:B.subtilis treA, treP and treR genes.] [NT:position 3684 corresponds to position 2543 of] [SP:P39796] [LE:3352] [RE:4068] [DI:direct] >gp:[GI:e1182772:g2633106] [LN:BSUB0005] [AC:Z99108:AL009126] [PN:transcriptional regulator (GntR family)] [GN:treR] [FN:negative regulation of the trehalose operon] [OR:Bacillus subtilis] [DB:genpept-bct1] [DE:Bacillus subtilis complete genome (section 5 of 21): from 802821 to1011250.] [NT:alternate gene name: yfxA] [SP:P39796] [LE:50243] [RE:50959] [DI:direct] >gp:[GI:d1024286:g2626829] [LN:D83967] [AC:D83967] [PN:TreR] [OR:Bacillus subtilis] [SR:Bacillus subtilis (strain:AC327) DNA] [DB:genpept-bct1] [DE:Bacillus subtilis genomic DNA, 74 degree region.] [LE:16962] [RE:17678] [DI:complement]

| ORF Name | NTID | AAID | NT Length | AA Length | score | probability |
|---|---|---|---|---|---|---|
| AI7503000998_14271068_f1_51 | 2824 | 6596 | 261 | 86 | 68 | 0.018 |

Description
sp:[LN:PROP_ECOLI] [AC:P30848] [GN:PROP] [OR:ESCHERICHIA COLI] [DE:PROLINE/BETAINE TRANSPORTER (PROLINE PORTER II) (PPII)] [SP:P30848] [DB:swissprot] >pir:[LN:S32331] [AC:S32331:S56339:F65220 ] [PN:proline/betaine transport protein:proline permease II:proline porter II] [GN:proP ] [CL:citrate utilization determinant] [OR:Escherichia coli] [DB:pir2] [MP:93 min ] >gp:[GI:g147357] [LN:ECOPROBETT] [AC:M83089] [PN:a proline/betaine transporter] [GN:proP] [FN:active uptake of proline or betaine] [OR:Escherichia coli] [DB:genpept-bct1] [DE:E. coli proline/betaine transporter (proP) gene, complete cds.] [NT:Evidence that this open reading frame encodes a] [LE:433] [RE:1935] [DI:direct] >gp:[GI:g536955] [LN:ECOUW93] [AC:U14003] [GN:proP] [FN:active uptake of proline or betaine] [OR:Escherichia coli] [DB:genpept-bct1] [DE:Escherichia coli K-12 chromosomal region from 92.8 to 00.1 minutes.] [NT:CG Site No. 361] [LE:21331] [RE:22833] [DI:direct] >gp:[GI:g1790550] [LN:AE000483] [AC:AE000483:U00096] [PN:low-affinity transport system; proline permease] [GN:proP] [FN:transport; Transport of small molecules: Amino] [OR:Escherichia coli] [DB:genpept-bct2] [DE:Escherichia coli K-12 MG1655 section 373 of 400 of the completegenome.] [NT:o500; 100 pct identical to PROP_ECOLI SW: P30848;] [LE:5301] [RE:6803] [DI:direct]

| ORF_Name | NTID | AAID | NT Length | AA Length | score | probability |
|---|---|---|---|---|---|---|
| AI7503000998_14460882_c1_217 | 2825 | 6597 | 1695 | 564 | 1304 | 4.9e-133 |

Description
gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF_Name | NTID | AAID | NT Length | AA Length | score | probability |
|---|---|---|---|---|---|---|
| AI7503000998_14485686_c2_287 | 2826 | 6598 | 153 | 50 | | |

Description
NO-HIT

| ORF_Name | NTID | AAID | NT Length | AA Length | score | probability |
|---|---|---|---|---|---|---|
| AI7503000998_15022153_f1_73 | 2827 | 6599 | 189 | 62 | | |

Description
NO-HIT

| ORF_Name | NTID | AAID | NT Length | AA Length | score | probability |
|---|---|---|---|---|---|---|
| AI7503000998_15900305_f3_177 | 2828 | 6600 | 789 | 262 | 78 | 0.019 |

Description
gp:[GI:g453517] [LN:TETRRTRNA] [AC:L28677] [OR:Mitochondrion Tetrahymena pyriformis] [SR:Mitochondrion Tetrahymena pyriformis (strain ST, organell] [DB:genpept-inv1] [DE:Tetrahymena pyriformis ribosomal RNA; tRNA-Trp; ORF 1-4; tRNA-Glu;cytochrome oxidase subunit 1; NADH dehydrogenase; ribosomal proteinL14.] [NT:ORF3] [LE:4384] [RE:4680] [DI:direct]

| ORF_Name | NTID | AAID | NT Length | AA Length | score | probability |
|---|---|---|---|---|---|---|
| AI7503000998_16196963_f2_133 | 2829 | 6601 | 192 | 63 | | |

Description
NO-HIT

| ORF_Name | NTID | AAID | NT Length | AA Length | score | probability |
|---|---|---|---|---|---|---|
| AI7503000998_16257665_f1_37 | 2830 | 6602 | 192 | 63 | | |

Description
NO-HIT

| ORF_Name | NTID | AAID | NT Length | AA Length | score | probability |
|---|---|---|---|---|---|---|
| AI7503000998_16281286_c3_322 | 2831 | 6603 | 1359 | 452 | 1059 | 4.5e-107 |

Description
pir:[LN:F69825] [AC:F69825 ] [PN:sodium-dependent transporter homolog yhdH] [GN:yhdH ] [CL:gamma-aminobutyric acid transporter] [OR:Bacillus subtilis] [DB:pir2] >gp:[GI:e1182948:g2633282] [LN:BSUB0006] [AC:Z99109=AL009126] [GN:yhdH] [FN:unknown] [OR:Bacillus subtilis] [DB:genpept-bct1] [DE:Bacillus subtilis complete genome (section 6 of 21): from 999501 to1209940.] [NT:similar to sodium-dependent transporter] [LE:24845] [RE:26200] [DI:direct] >gp:[GI:e1191879:g2226203] [LN:BSY14082] [AC:Y14082] [PN:hypothetical protein] [GN:yhdH] [OR:Bacillus subtilis] [DB:genpept-bct1] [DE:Bacillus subtilis chromosomal DNA, region 72 to 75 degrees: spoVRto sspB.] [NT:Similarity to sodium dependent transporters;] [LE:11493] [RE:12848] [DI:direct]

| ORF_Name | NTID | AAID | NT Length | AA Length | score | probability |
|---|---|---|---|---|---|---|
| AI7503000998_19712762_c3_347 | 2832 | 6604 | 600 | 199 | 813 | 5.2e-81 |

Description
sp:[LN:RECR_BACSU] [AC:P24277] [GN:RECR:RECM:RECD] [OR:BACILLUS SUBTILIS]
[DE:RECOMBINATION PROTEIN RECR] [SP:P24277] [DB:swissprot] >pir:[LN:B69691]
[AC:B69691:S13788:S66051 ] [PN:DNA repair and genetic recombination recR:recM protein]
[GN:recR ] [CL:recR protein] [OR:Bacillus subtilis] [DB:pir2] >gp:[GI:d1005799:g467411]
[LN:BAC180K] [AC:D26185] [PN:recombination protein] [GN:recR] [OR:Bacillus subtilis]
[SR:Bacillus subtilis (sub_species:Marburg, strain:168) DNA] [DB:genpept-bct1] [DE:B.
subtilis DNA, 180 kilobase region of replication origin.] [LE:92467] [RE:93063]
[DI:direct] >gp:[GI:g453239] [LN:BSRECM] [AC:X17014] [GN:recR] [OR:Bacillus subtilis]
[DB:genpept-bct1] [DE:Bacillus subtilis dnaZX and recR genes and two unidentified
readingframes.] [SP:P24277] [LE:2314] [RE:2910] [DI:direct] >gp:[GI:e1181954:g2632288]
[LN:BSUB0001] [AC:Z99104:AL009126] [GN:recR] [FN:DNA repair and genetic recombination]
[OR:Bacillus subtilis] [DB:genpept-bct1] [DE:Bacillus subtilis complete genome (section
1 of 21): from 1 to213080.] [NT:alternate gene name: recM] [SP:P24277] [LE:28865]
[RE:29461] [DI:direct]

| ORF_Name | NTID | AAID | NT Length | AA Length | score | probability |
|---|---|---|---|---|---|---|
| AI7503000998_19960162_c1_232 | 2833 | 6605 | 2631 | 876 | 1785 | 5.2e-184 |

Description
pir:[LN:E69745] [AC:E69745 ] [PN:hypothetical protein ybcD] [GN:ybcD ] [OR:Bacillus
subtilis] [DB:pir2] >gp:[GI:e1182118:g2632452] [LN:BSUB0001] [AC:Z99104:AL009126]
[GN:ybcD] [FN:unknown] [OR:Bacillus subtilis] [DB:genpept-bct1] [DE:Bacillus subtilis
complete genome (section 1 of 21): from 1 to213080.] [LE:207166] [RE:209430]
[DI:direct] >gp:[GI:e1182136:g2632470] [LN:BSUB0002] [AC:Z99105:AL009126] [GN:ybcD]
[FN:unknown] [OR:Bacillus subtilis] [DB:genpept-bct1] [DE:Bacillus subtilis complete
genome (section 2 of 21): from 194651 to415810.] [LE:12516] [RE:14780] [DI:direct]

| ORF_Name | NTID | AAID | NT Length | AA Length | score | probability |
|---|---|---|---|---|---|---|
| AI7503000998_20093_c3_311 | 2834 | 6606 | 306 | 101 | | |

Description
NO-HIT

| ORF_Name | NTID | AAID | NT Length | AA Length | score | probability |
|---|---|---|---|---|---|---|
| AI7503000998_20314005_c3_335 | 2835 | 6607 | 4590 | 1529 | 4186 | 0.0 |

Description
sp:[LN:GLTB_BACSU] [AC:P39812] [GN:GLTB:GLTA] [OR:BACILLUS SUBTILIS] [EC:1.4.1.13]
[DE:GLUTAMATE SYNTHASE [NADPH] LARGE CHAIN, (NADPH-GOGAT)] [SP:P39812] [DB:swissprot]
>pir:[LN:G69634] [AC:G69634 ] [PN:glutamate synthase (large subunit) gltA] [GN:gltA ]
[CL:glutamate synthase (NADPH)] [OR:Bacillus subtilis] [DB:pir2]
>gp:[GI:e1183503:g2634228] [LN:BSUB0010] [AC:Z99113:AL009126] [PN:glutamate synthase
(large subunit)] [GN:gltA] [FN:glutamate biosynthesis] [OR:Bacillus subtilis]
[DB:genpept-bct1] [EC:1.4.1.13] [DE:Bacillus subtilis complete genome (section 10 of
21): from 1781201to 2014980.] [SP:P39812] [LE:228126] [RE:232688] [DI:complement]
>gp:[GI:e1185318:g2634239] [LN:BSUB0011] [AC:Z99114:AL009126] [PN:glutamate synthase
(large subunit)] [GN:gltA] [FN:glutamate biosynthesis] [OR:Bacillus subtilis]
[DB:genpept-bct1] [EC:1.4.1.13] [DE:Bacillus subtilis complete genome (section 11 of
21): from 2000171to 2207900.] [SP:P39812] [LE:9156] [RE:13718] [DI:complement]

| ORF Name | NTID | AAID | NT Length | AA Length | score | probability |
|---|---|---|---|---|---|---|
| AI7503000998_203886_f2_137 | 2836 | 6608 | 159 | 52 | 116 | 2.8e-06 |

Description gp:[GI:g2689564] [LN:U93688] [AC:U93688] [PN:integrase] [GN:int] [OR:Staphylococcus aureus] [DB:genpept-bct2] [DE:Staphylococcus aureus toxic shock syndrome toxin-1 (tst),enterotoxin (ent), and integrase (int) genes, complete cds.] [NT:similar to staphylococcal phage integrase] [LE:13871] [RE:15091] [DI:direct]

| ORF Name | NTID | AAID | NT Length | AA Length | score | probability |
|---|---|---|---|---|---|---|
| AI7503000998_20602262_c2_303 | 2837 | 6609 | 543 | 180 | 105 | 0.00015 |

Description sp:[LN:YHBS_ECOLI] [AC:P45473] [GN:YHBS] [OR:ESCHERICHIA COLI] [DE:HYPOTHETICAL 18.5 KD PROTEIN IN SOHA-MTR INTERGENIC REGION (F167)] [SP:P45473] [DB:swissprot] >pir:[LN:H65105] [AC:H65105 ] [PN:hypothetical protein b3156] [OR:Escherichia coli] [DB:pir2] >gp:[GI:g606096] [LN:ECOUW67] [AC:U18997] [OR:Escherichia coli] [DB:genpept-bct1] [DE:Escherichia coli K-12 chromosomal region from 67.4 to 76.0 minutes.] [NT:ORF_f167; end overlaps end of o100 by 14 bases;] [LE:81007] [RE:81510] [DI:complement] >gp:[GI:g1789546] [LN:AE000396] [AC:AE000396:U00096] [PN:orf, hypothetical protein] [GN:yhbS] [FN:orf; Unknown] [OR:Escherichia coli] [DB:genpept-bct2] [DE:Escherichia coli K-12 MG1655 section 286 of 400 of the completegenome.] [NT:f167; f167; end overlaps end of o100 by 14] [LE:6918] [RE:7421] [DI:complement]

| ORF Name | NTID | AAID | NT Length | AA Length | score | probability |
|---|---|---|---|---|---|---|
| AI7503000998_20602263_c2_270 | 2838 | 6610 | 1512 | 503 | 1414 | 1.1e-144 |

Description sp:[LN:NDHF_BACSU] [AC:P39755] [GN:NDHF] [OR:BACILLUS SUBTILIS] [EC:1.6.5.3] [DE:OXIDOREDUCTASE CHAIN 5)] [SP:P39755] [DB:swissprot] >pir:[LN:C69666] [AC:C69666 ] [PN:NADH dehydrogenase (subunit 5) ndhF] [GN:ndhF ] [OR:Bacillus subtilis] [DB:pir2] >gp:[GI:d1034042:g3599601] [LN:AB006424] [AC:AB006424] [PN:NADH DEHYDROGENASE SUBUNIT 5] [GN:ndhF] [OR:Bacillus subtilis] [SR:Bacillus subtilis (strain:168) DNA] [DB:genpept-bct1] [DE:Bacillus subtilis genomic DNA, 70 kb region between 17 and 23degree.] [LE:8378] [RE:9895] [DI:direct] >gp:[GI:g903587] [LN:BSU28323] [AC:U28323] [PN:NADH dehydrogenase subunit 5] [GN:ndhF] [OR:Bacillus subtilis] [DB:genpept-bct1] [DE:Bacillus subtilis NADH dehydrogenase subunit 5 (ndhF) gene,complete cds.] [LE:519] [RE:2036] [DI:direct] >gp:[GI:e1182116:g2632450] [LN:BSUB0001] [AC:Z99104:AL009126] [PN:NADH dehydrogenase (subunit 5)] [GN:ndhF] [OR:Bacillus subtilis] [DB:genpept-bct1] [EC:1.6.5.3] [DE:Bacillus subtilis complete genome (section 1 of 21): from 1 to213080.] [NT:alternate gene name: ybxE] [SP:P39755] [LE:205395] [RE:206912] [DI:direct] >gp:[GI:e1182134:g2632468] [LN:BSUB0002] [AC:Z99105:AL009126] [PN:NADH dehydrogenase (subunit 5)] [GN:ndhF] [OR:Bacillus subtilis] [DB:genpept-bct1] [EC:1.6.5.3] [DE:Bacillus subtilis complete genome (section 2 of 21): from 194651 to415810.] [NT:alternate gene name: ybxE] [SP:P39755] [LE:10745] [RE:12262] [DI:direct]

| ORF Name | NTID | AAID | NT Length | AA Length | score | probability |
|---|---|---|---|---|---|---|
| AI7503000998_2142316_f3_207 | 2839 | 6611 | 213 | 70 | 52 | 0.040 |

Description gp:[GI:e1287275:g3063696] [LN:ATF4D11] [AC:AL022537] [PN:putative protein] [GN:F4D11.60] [OR:Arabidopsis thaliana] [SR:thale cress] [DB:genpept-pln1] [DE:Arabidopsis thaliana DNA chromosome 4, BAC clone F4D11 (ESSAIIproject).] [NT:contains EST gb:W43721] [LE:21418:21729:22060] [RE:21537:22004:22174] [DI:complementJoin]

| ORF_Name | NTID | AAID | NT Length | AA Length | score | probability |
|---|---|---|---|---|---|---|
| AI7503000998_21516287_f1_2 | 2840 | 6612 | 126 | 41 | | |

Description
NO-HIT

| ORF_Name | NTID | AAID | NT Length | AA Length | score | probability |
|---|---|---|---|---|---|---|
| AI7503000998_2195338_c3_342 | 2841 | 6613 | 165 | 54 | | |

Description
NO-HIT

| ORF_Name | NTID | AAID | NT Length | AA Length | score | probability |
|---|---|---|---|---|---|---|
| AI7503000998_22305342_f3_205 | 2842 | 6614 | 543 | 180 | 162 | 8.7e-11 |

Description
gp:[GI:g4019275] [LN:AF083424] [AC:AF083424] [OR:Ateline herpesvirus 3] [DB:genpept-vrl] [DE:Ateline herpesvirus 3 complete genome.] [NT:orf 48] [LE:62159] [RE:64537] [DI:complement]

| ORF_Name | NTID | AAID | NT Length | AA Length | score | probability |
|---|---|---|---|---|---|---|
| AI7503000998_22437751_c3_307 | 2843 | 6615 | 489 | 162 | 160 | 5.5e-11 |

Description
pir:[LN:T03492] [AC:T03492 ] [PN:hypothetical protein] [OR:Rhodobacter capsulatus] [DB:pir2] [MP:1 ] >gp:[GI:g3128293] [LN:AF010496] [AC:AF010496] [PN:hypothetical protein] [OR:Rhodobacter capsulatus] [DB:genpept-bct2] [DE:Rhodobacter capsulatus strain SB1003, partial genome.] [LE:54291] [RE:55613] [DI:complement]

| ORF_Name | NTID | AAID | NT Length | AA Length | score | probability |
|---|---|---|---|---|---|---|
| AI7503000998_22459802_f2_135 | 2844 | 6616 | 156 | 51 | 117 | 1.0e-06 |

Description
gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF_Name | NTID | AAID | NT Length | AA Length | score | probability |
|---|---|---|---|---|---|---|
| AI7503000998_22688428_c3_348 | 2845 | 6617 | 144 | 47 | | |

Description
NO-HIT

| ORF Name | NTID | AAID | NT Length | AA Length | score | probability |
|---|---|---|---|---|---|---|
| AI7503000998_23484678_c2_304 | 2846 | 6618 | 1731 | 576 | 1263 | 1.1e-128 |

Description
pir:[LN:S13786] [AC:S13786:S00745:S66049:B69618 ] [PN:DNA-directed DNA polymerase, III chain dnaX:DNA polymerase III (gamma and tau subunits) dnaX] [GN:dnaX:dnaZX ] [OR:Bacillus subtilis] [EC:2.7.7.7] [DB:pir2] >gp:[GI:d1005797:g467409] [LN:BAC180K] [AC:D26185] [PN:DNA polymerase III subunit] [GN:dnaH] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:90414] [RE:92105] [DI:direct] >gp:[GI:g580914] [LN:BSRECM] [AC:X17014] [GN:dnaZX] [OR:Bacillus subtilis] [DB:genpept-bct1] [DE:Bacillus subtilis dnaZX and recR genes and two unidentified readingframes.] [SP:P09122] [LE:261] [RE:1952] [DI:direct] >gp:[GI:e1181952:g2632286] [LN:BSUB0001] [AC:Z99104:AL009126] [PN:DNA polymerase III (gamma and tau subunits)] [GN:dnaX] [FN:DNA synthesis] [OR:Bacillus subtilis] [DB:genpept-bct1] [EC:2.7.7.7] [DE:Bacillus subtilis complete genome (section 1 of 21): from 1 to213080.] [NT:alternate gene name: dnaH, dna-8132] [SP:P09122] [LE:26812] [RE:28503] [DI:direct]

| ORF Name | NTID | AAID | NT Length | AA Length | score | probability |
|---|---|---|---|---|---|---|
| AI7503000998_23556500_f1_33 | 2847 | 6619 | 282 | 93 | | |

Description
NO-HIT

| ORF Name | NTID | AAID | NT Length | AA Length | score | probability |
|---|---|---|---|---|---|---|
| AI7503000998_2359675_c3_329 | 2848 | 6620 | 141 | 46 | 68 | 0.047 |

Description
pir:[LN:S72295] [AC:S72295 ] [PN:ribosomal protein S8] [GN:rps8 ] [OR:plastid Plasmodium falciparum] [DB:pir2] >gp:[GI:e220199:g1171601] [LN:PFCOMPIRB] [AC:X95276] [GN:rps8] [OR:Plasmodium falciparum] [SR:malaria parasite P. falciparum] [DB:genpept-inv1] [DE:P.falciparum complete gene map of plastid-like DNA (IR-B).] [LE:5492] [RE:5878] [DI:direct]

| ORF Name | NTID | AAID | NT Length | AA Length | score | probability |
|---|---|---|---|---|---|---|
| AI7503000998_23631262_f2_94 | 2849 | 6621 | 150 | 49 | | |

Description
NO-HIT

| ORF Name | NTID | AAID | NT Length | AA Length | score | probability |
|---|---|---|---|---|---|---|
| AI7503000998_23994687_f1_45 | 2850 | 6622 | 132 | 43 | | |

Description
NO-HIT

| ORF Name | NTID | AAID | NT Length | AA Length | score | probability |
|---|---|---|---|---|---|---|
| AI7503000998_24016916_c3_341 | 2851 | 6623 | 1044 | 347 | 396 | 8.1e-37 |

Description
sp:[LN:YEIH_ECOLI] [AC:P33019] [GN:YEIH] [OR:ESCHERICHIA COLI] [DE:HYPOTHETICAL 36.9 KD PROTEIN IN LYSP-NFO INTERGENIC REGION] [SP:P33019] [DB:swissprot] >pir:[LN:E64984] [AC:E64984 ] [PN:hypothetical 36.9 kD protein in lysP-nfo intergenic region] [GN:yeiH ] [OR:Escherichia coli] [DB:pir2] >gp:[GI:g405879] [LN:ECOHU47] [AC:U00007] [PN:yeiH] [OR:Escherichia coli] [SR:Escherichia coli K12 BHB2600] [DB:genpept-bct1] [DE:47 to 48 centisome region of E.coli K12 BHB2600.] [LE:57462] [RE:58511] [DI:direct] >gp:[GI:g1788482] [LN:AE000305] [AC:AE000305:U00096] [PN:orf, hypothetical protein] [GN:yeiH] [FN:orf; Unknown] [OR:Escherichia coli] [DB:genpept-bct2] [DE:Escherichia coli K-12 MG1655 section 195 of 400 of the completegenome.] [NT:o349; 100 pct identical to YEIH_ECOLI SW: P33019] [LE:2831] [RE:3880] [DI:direct]

| ORF Name | NTID | AAID | NT Length | AA Length | score | probability |
|---|---|---|---|---|---|---|
| AI7503000998_24220967_c1_228 | 2852 | 6624 | 138 | 45 | | |

Description
NO-HIT

| ORF Name | NTID | AAID | NT Length | AA Length | score | probability |
|---|---|---|---|---|---|---|
| AI7503000998_24227192_c3_343 | 2853 | 6625 | 147 | 48 | | |

Description
NO-HIT

| ORF Name | NTID | AAID | NT Length | AA Length | score | probability |
|---|---|---|---|---|---|---|
| AI7503000998_24235626_c1_257 | 2854 | 6626 | 159 | 52 | | |

Description
NO-HIT

| ORF Name | NTID | AAID | NT Length | AA Length | score | probability |
|---|---|---|---|---|---|---|
| AI7503000998_24272337_f3_204 | 2855 | 6627 | 432 | 143 | 96 | 0.0025 |

Description
pir:[LN:D69633] [AC:D69633 ] [PN:glutamine ABC transporter (glutamine-binding protein) glnH] [GN:glnH ] [CL:lysine-arginine-ornithine-binding protein] [OR:Bacillus subtilis] [DB:pir2] >gp:[GI:e1183973:g2635189] [LN:BSUB0014] [AC:Z99117:AL009126] [PN:glutamine ABC transporter (glutamine-binding] [GN:glnH] [OR:Bacillus subtilis] [DB:genpept-bct1] [DE:Bacillus subtilis complete genome (section 14 of 21): from 2599451to 2812870.] [LE:202928] [RE:203749] [DI:direct] >gp:[GI:e1183991:g2635207] [LN:BSUB0015] [AC:Z99118:AL009126] [PN:glutamine ABC transporter (glutamine-binding] [GN:glnH] [OR:Bacillus subtilis] [DB:genpept-bct1] [DE:Bacillus subtilis complete genome (section 15 of 21): from 2795131to 3013540.] [LE:7248] [RE:8069] [DI:direct]

| ORF Name | NTID | AAID | NT Length | AA Length | score | probability |
|---|---|---|---|---|---|---|
| AI7503000998_24350953_f1_6 | 2856 | 6628 | 132 | 43 | 72 | 0.017 |

Description
pir:[LN:G71244] [AC:G71244 ] [PN:hypothetical protein PH0217] [GN:PH0217 ] [OR:Pyrococcus horikoshii] [DB:pir2] >gp:[GI:d1030229:g3256603] [LN:AP000001] [AC:AP000001:AB009465:AB009464:AB009466:AB009467:AB009468:AB009469] [PN:106aa long hypothetical protein] [GN:PH0217] [OR:Pyrococcus horikoshii] [SR:Pyrococcus horikoshii (strain:OT3) DNA] [DB:genpept-bct1] [DE:Pyrococcus horikoshii OT3 genomic DNA, 1-287000 nt. position (1/7).] [LE:191072] [RE:191392] [DI:complement]

| ORF Name | NTID | AAID | NT Length | AA Length | score | probability |
|---|---|---|---|---|---|---|
| AI7503000998_24390937_f3_198 | 2857 | 6629 | 156 | 51 | | |

Description
NO-HIT

| ORF Name | NTID | AAID | NT Length | AA Length | score | probability |
|---|---|---|---|---|---|---|
| AI7503000998_24391885_f3_178 | 2858 | 6630 | 183 | 60 | | |

Description
NO-HIT

| ORF Name | NTID | AAID | NT Length | AA Length | score | probability |
|---|---|---|---|---|---|---|
| AI7503000998_24475252_f3_213 | 2859 | 6631 | 159 | 52 | | |

Description
NO-HIT

| ORF Name | NTID | AAID | NT Length | AA Length | score | probability |
|---|---|---|---|---|---|---|
| AI7503000998_24664802_c1_234 | 2860 | 6632 | 747 | 248 | 380 | 4.0e-35 |

Description
pir:[LN:H70027] [AC:H70027 ] [PN:carboxylesterase homolog yvaK] [GN:yvaK ] [OR:Bacillus subtilis] [DB:pir2] >gp:[GI:e1186050:g2635875] [LN:BSUB0018] [AC:Z99121:AL009126] [GN:yvaK] [FN:unknown] [OR:Bacillus subtilis] [DB:genpept-bct1] [DE:Bacillus subtilis complete genome (section 18 of 21): from 3399551to 3609060.] [NT:similar to carboxylesterase] [LE:53733] [RE:54479] [DI:complement]

| ORF Name | NTID | AAID | NT Length | AA Length | score | probability |
|---|---|---|---|---|---|---|
| AI7503000998_25422288_c2_277 | 2861 | 6633 | 153 | 50 | | |

Description
NO-HIT

| ORF Name | NTID | AAID | NT Length | AA Length | score | probability |
|---|---|---|---|---|---|---|
| AI7503000998_25442803_c2_306 | 2862 | 6634 | 261 | 86 | | |

Description
NO-HIT

| ORF Name | NTID | AAID | NT Length | AA Length | score | probability |
|---|---|---|---|---|---|---|
| AI7503000998_25586693_c3_346 | 2863 | 6635 | 333 | 110 | 374 | 1.7e-34 |

Description
sp:[LN:YAAK_BACSU] [AC:P24281] [GN:YAAK] [OR:BACILLUS SUBTILIS] [DE:HYPOTHETICAL 11.8 KD PROTEIN IN DNAZ-RECR INTERGENIC REGION] [SP:P24281] [DB:swissprot] >pir:[LN:S13787] [AC:S13787:S66050:C69737 ] [PN:conserved hypothetical protein yaaK] [GN:yaaK ] [OR:Bacillus subtilis] [DB:pir2] >gp:[GI:d1005798:g467410] [LN:BAC180K] [AC:D26185] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:92129] [RE:92452] [DI:direct] >gp:[GI:g40073] [LN:BSRECM] [AC:X17014] [OR:Bacillus subtilis] [DB:genpept-bct1] [DE:Bacillus subtilis dnaZX and recR genes and two unidentified readingframes.] [NT:ORF107] [SP:P24281] [LE:1976] [RE:2299] [DI:direct] >gp:[GI:e1181953:g2632287] [LN:BSUB0001] [AC:Z99104:AL009126] [GN:yaaK] [FN:unknown] [OR:Bacillus subtilis] [DB:genpept-bct1] [DE:Bacillus subtilis complete genome (section 1 of 21): from 1 to213080.] [NT:similar to hypothetical proteins] [SP:P24281] [LE:28527] [RE:28850] [DI:direct]

| ORF Name | NTID | AAID | NT Length | AA Length | score | probability |
|---|---|---|---|---|---|---|
| AI7503000998_256468_c2_294 | 2864 | 6636 | 330 | 109 | | |

Description
NO-HIT

| ORF Name | NTID | AAID | NT Length | AA Length | score | probability |
|---|---|---|---|---|---|---|
| AI7503000998_26460887_f1_34 | 2865 | 6637 | 1524 | 507 | 366 | 6.4e-32 |

Description
sp:[LN:TAGE_BACSU] [AC:P13484] [GN:TAGE:RODD:GTAA] [OR:BACILLUS SUBTILIS] [EC:2.4.1.52]
[DE:(EC 2.4.1.52) (TEICHOIC ACID BIOSYNTHESIS PROTEIN E)] [SP:P13484] [DB:swissprot]
>pir:[LN:S06048] [AC:S06048:F69720 ] [PN:poly(glycerol-phosphate)
alpha-glucosyltransferase, tagE:probable rodD protein:UDP-glucose--polyglycerol
phosphate glucosyltransferase tagE] [GN:tagE:rodD ] [OR:Bacillus subtilis] [EC:
2.4.1.52] [DB:pir2] [MP:310 degrees ] >gp:[GI:g580920] [LN:BSRODC] [AC:X15200]
[OR:Bacillus subtilis] [DB:genpept-bct1] [DE:Bacillus subtilis rodC operon.] [NT:rodD
(gtaA) polypeptide (AA 1-673)] [SP:P13484] [LE:157] [RE:2178] [DI:direct]
>gp:[GI:e1184479:g2636099] [LN:BSUB0019] [AC:Z99122:AL009126]
[PN:UDP-glucose:polyglycerol phosphate] [GN:tagE] [FN:teichoic acid biosynthesis]
[OR:Bacillus subtilis] [DB:genpept-bct1] [EC:2.4.1.52] [DE:Bacillus subtilis complete
genome (section 19 of 21): from 3597091to 3809700.] [NT:alternate gene name: rodD,
gtaA, gtaD] [SP:P13484] [LE:80369] [RE:82390] [DI:complement]
>gp:[GI:e1184479:g2636099] [LN:BSUB0019] [AC:Z99122:AL009126]
[PN:UDP-glucose:polyglycerol phosphate] [GN:tagE] [FN:teichoic acid biosynthesis]
[OR:Bacillus subtilis] [DB:genpept] [EC:2.4.1.52] [DE:Bacillus subtilis complete genome
(section 19 of 21): from 3597091to 3809700.] [NT:alternate gene name: rodD, gtaA, gtaD]
[SP:P13484] [LE:80369] [RE:82390] [DI:complement]

| ORF Name | NTID | AAID | NT Length | AA Length | score | probability |
|---|---|---|---|---|---|---|
| AI7503000998_26776562_c3_317 | 2866 | 6638 | 399 | 132 | | |

Description
NO-HIT

| ORF Name | NTID | AAID | NT Length | AA Length | score | probability |
|---|---|---|---|---|---|---|
| AI7503000998_2769816_f3_206 | 2867 | 6639 | 135 | 44 | 135 | 2.5e-08 |

Description
gp:[GI:g2689564] [LN:U93688] [AC:U93688] [PN:integrase] [GN:int] [OR:Staphylococcus
aureus] [DB:genpept-bct2] [DE:Staphylococcus aureus toxic shock syndrome toxin-1
(tst),enterotoxin (ent), and integrase (int) genes, complete cds.] [NT:similar to
staphylococcal phage integrase] [LE:13871] [RE:15091] [DI:direct]

| ORF Name | NTID | AAID | NT Length | AA Length | score | probability |
|---|---|---|---|---|---|---|
| AI7503000998_30265952_c2_291 | 2868 | 6640 | 387 | 128 | 118 | 2.3e-07 |

Description
pir:[LN:H69029] [AC:H69029 ] [PN:mutator MutT related protein] [GN:MTH122 ] [CL:mutT
domain homology] [OR:Methanobacterium thermoautotrophicum] [DB:pir2] >gp:[GI:g2621161]
[LN:AE000801] [AC:AE000801:AE000666] [PN:mutator MutT related protein] [GN:MTH122]
[OR:Methanobacterium thermoautotrophicum] [DB:genpept-bct1] [DE:Methanobacterium
thermoautotrophicum from bases 68653 to 79584(section 7 of 148) of the complete
genome.] [NT:Function Code:10.09 - Metabolism of Macromolecules,] [LE:9193] [RE:9660]
[DI:complement]

| ORF_Name | NTID | AAID | NT Length | AA Length | score | probability |
|---|---|---|---|---|---|---|
| AI7503000998_30682802_c3_321 | 2869 | 6641 | 261 | 86 | | |

Description
NO-HIT

| ORF_Name | NTID | AAID | NT Length | AA Length | score | probability |
|---|---|---|---|---|---|---|
| AI7503000998_33399055_c2_273 | 2870 | 6642 | 393 | 130 | 419 | 3.0e-39 |

Description
pir:[LN:H69745] [AC:H69745 ] [PN:hypothetical protein ybcI] [GN:ybcI ] [OR:Bacillus subtilis] [DB:pir2] >gp:[GI:d1034047:g3599606] [LN:AB006424] [AC:AB006424] [GN:ybcI] [OR:Bacillus subtilis] [SR:Bacillus subtilis (strain:168) DNA] [DB:genpept-bct1] [DE:Bacillus subtilis genomic DNA, 70 kb region between 17 and 23degree.] [LE:13549] [RE:13923] [DI:direct] >gp:[GI:e1182121:g2632455] [LN:BSUB0001] [AC:Z99104:AL009126] [GN:ybcI] [FN:unknown] [OR:Bacillus subtilis] [DB:genpept-bct1] [DE:Bacillus subtilis complete genome (section 1 of 21): from 1 to213080.] [LE:210558] [RE:210932] [DI:direct] >gp:[GI:e1182139:g2632473] [LN:BSUB0002] [AC:Z99105:AL009126] [GN:ybcI] [FN:unknown] [OR:Bacillus subtilis] [DB:genpept-bct1] [DE:Bacillus subtilis complete genome (section 2 of 21): from 194651 to415810.] [LE:15908] [RE:16282] [DI:direct]

| ORF_Name | NTID | AAID | NT Length | AA Length | score | probability |
|---|---|---|---|---|---|---|
| AI7503000998_33756432_f1_7 | 2871 | 6643 | 141 | 46 | | |

Description
NO-HIT

| ORF_Name | NTID | AAID | NT Length | AA Length | score | probability |
|---|---|---|---|---|---|---|
| AI7503000998_34407625_c3_309 | 2872 | 6644 | 354 | 117 | 587 | 4.7e-57 |

Description
gp:[GI:g1658281] [LN:SLU74623] [AC:U74623] [PN:CadX] [FN:cadmium resistance] [OR:Staphylococcus lugdunensis] [DB:genpept-bct1] [DE:Staphylococcus lugdunensis strain 995 cadmium resistance plasmidpLUG10, complete sequence.] [LE:2624] [RE:2971] [DI:direct]

| ORF_Name | NTID | AAID | NT Length | AA Length | score | probability |
|---|---|---|---|---|---|---|
| AI7503000998_34557262_c3_349 | 2873 | 6645 | 135 | 44 | | |

Description
NO-HIT

| ORF_Name | NTID | AAID | NT Length | AA Length | score | probability |
|---|---|---|---|---|---|---|
| AI7503000998_35431657_f2_114 | 2874 | 6646 | 135 | 44 | | |

Description
NO-HIT

| ORF Name | NTID | AAID | NT Length | AA Length | score | probability |
|---|---|---|---|---|---|---|
| AI7503000998_36227142_c1_240 | 2875 | 6647 | 993 | 330 | 409 | 3.4e-38 |

Description
sp:[LN:LYTE_BACSU] [AC:P54421] [GN:LYTE:PAPQ] [OR:BACILLUS SUBTILIS] [DE:PAPQ PRECURSOR) (CELL WALL-ASSOCIATED POLYPEPTIDE CWBP33)] [SP:P54421] [DB:swissprot] >gp:[GI:g1488662] [LN:BSU38819] [AC:U38819] [PN:phosphatase-associated protein] [GN:lytE] [OR:Bacillus subtilis] [DB:genpept-bct2] [DE:Bacillus subtilis phosphatase-associated protein (lytE) gene,complete cds.] [NT:Muralytic when cloned in E.coli; Iap60 homolog;] [LE:443] [RE:1447] [DI:direct]

| ORF Name | NTID | AAID | NT Length | AA Length | score | probability |
|---|---|---|---|---|---|---|
| AI7503000998_36568828_c2_266 | 2876 | 6648 | 1050 | 349 | 984 | 4.0e-99 |

Description
pir:[LN:A43577] [AC:A43577 ] [PN:regulatory protein pfoR] [OR:Clostridium perfringens] [DB:pir2]

| ORF Name | NTID | AAID | NT Length | AA Length | score | probability |
|---|---|---|---|---|---|---|
| AI7503000998_36593802_c2_282 | 2877 | 6649 | 867 | 288 | 454 | 5.8e-43 |

Description
sp:[LN:PLPA_PASHA] [AC:Q08868:Q07363] [GN:PLPA] [OR:PASTEURELLA HAEMOLYTICA] [DE:OUTER MEMBRANE LIPOPROTEIN 1 PRECURSOR (PLP1)] [SP:Q08868:Q07363] [DB:swissprot] >pir:[LN:JN0751] [AC:JN0751 ] [PN:Outer membrane 30K protein:ORF1] [CL:lipoprotein-28] [OR:Pasteurella haemolytica] [DB:pir2] >gp:[GI:g349530] [LN:PASLIPOPR] [AC:L11037] [PN:lipoprotein] [OR:Pasteurella haemolytica] [SR:Pasteurella haemolytica (strain A1) DNA] [DB:genpept-bct1] [DE:Pasteurella haemolytica lipoprotein gene, complete cds.] [NT:precursor] [LE:171] [RE:1004] [DI:direct] >gp:[GI:g150508] [LN:PASLIPOPRO] [AC:M91072] [PN:lipoprotein] [OR:Pasteurella haemolytica] [SR:Pasteurella haemolytica (strain A1) (library: pUC19 of R. Craven e] [DB:genpept-bct1] [DE:Pasteurella haemolytica (clones pGEB2830,pBRES2830) lipoproteingene, complete cds.] [LE:136] [RE:969] [DI:direct]

| ORF Name | NTID | AAID | NT Length | AA Length | score | probability |
|---|---|---|---|---|---|---|
| AI7503000998_3944143_c3_308 | 2878 | 6650 | 627 | 208 | 971 | 9.5e-98 |

Description
gp:[GI:g1916729] [LN:AF134905] [AC:AF134905:U76550] [PN:CadD] [GN:cadD] [OR:Staphylococcus aureus] [DB:genpept-bct2] [DE:Staphylococcus aureus plasmid pRW001 CadD (cadD) gene, completecds.] [NT:confers low level cadmium resistance] [LE:2328] [RE:2957] [DI:direct]

| ORF Name | NTID | AAID | NT Length | AA Length | score | probability |
|---|---|---|---|---|---|---|
| AI7503000998_3945253_f3_203 | 2879 | 6651 | 126 | 41 | | |

Description
NO-HIT

| ORF Name | NTID | AAID | NT Length | AA Length | score | probability |
|---|---|---|---|---|---|---|
| AI7503000998_3954385_f1_32 | 2880 | 6652 | 123 | 40 | | |

Description
NO-HIT

| ORF Name | NTID | AAID | NT Length | AA Length | score | probability |
|---|---|---|---|---|---|---|
| AI7503000998_4064818_c1_239 | 2881 | 6653 | 675 | 224 | 533 | 2.5e-51 |

Description sp:[LN:YAEE_ECOLI] [AC:P31547] [GN:YAEE] [OR:ESCHERICHIA COLI] [DE:HYPOTHETICAL ABC TRANSPORTER PERMEASE PROTEIN YAEE] [SP:P31547] [DB:swissprot] >pir:[LN:F64744] [AC:F64744 ] [PN:probable transport protein yaeE] [GN:yaeE ] [CL:probable transport protein yaeE] [OR:Escherichia coli] [DB:pir2] >gp:[GI:d1041643:g4902941] [LN:ECOTSF] [AC:D83536] [PN:Hypothetical 23.3 kd protein in rcsF-abc] [GN:yaeE] [OR:Escherichia coli] [SR:Escherichia coli (strain:K12) DNA] [DB:genpept-bct1] [DE:Escherichia coli genomic DNA. (4.1 - 6.1 min).] [NT:ORF_ID:o124#1; similar to SwissProt Accession] [LE:30521] [RE:31174] [DI:complement] >gp:[GI:g1552774] [LN:ECU70214] [AC:U70214] [GN:yaeE] [OR:Escherichia coli] [DB:genpept-bct1] [DE:Escherichia coli chromosome minutes 4-6.] [NT:hypothetical] [LE:52043] [RE:52696] [DI:complement] >gp:[GI:g1786397] [LN:AE000129] [AC:AE000129:U00096] [PN:putative transport system permease protein] [GN:yaeE] [FN:putative transport; Not classified] [OR:Escherichia coli] [DB:genpept-bct2] [DE:Escherichia coli K-12 MG1655 section 19 of 400 of the completegenome.] [NT:f218; 100 pct identical to YAEE_ECOLI SW: P31547] [LE:944] [RE:1597] [DI:complement]

| ORF Name | NTID | AAID | NT Length | AA Length | score | probability |
|---|---|---|---|---|---|---|
| AI7503000998_4082828_c3_320 | 2882 | 6654 | 702 | 233 | 211 | 3.3e-17 |

Description pir:[LN:F71886] [AC:F71886 ] [PN:hypothetical protein jhp0787] [GN:jhp0787 ] [OR:Helicobacter pylori] [SR:strain J99, , strain J99] [SR:strain J99, ] [DB:pir2] >gp:[GI:g4155367] [LN:AE001509] [AC:AE001509:AE001439] [PN:putative] [GN:jhp0787] [OR:Helicobacter pylori J99] [DB:genpept-bct2] [DE:Helicobacter pylori, strain J99 section 70 of 132 of the completegenome.] [NT:similar to H. pylori 26695 gene HP0851] [LE:2708] [RE:3394] [DI:direct]

| ORF Name | NTID | AAID | NT Length | AA Length | score | probability |
|---|---|---|---|---|---|---|
| AI7503000998_4101525_f1_60 | 2883 | 6655 | 135 | 44 | | |

Description

NO-HIT

| ORF Name | NTID | AAID | NT Length | AA Length | score | probability |
|---|---|---|---|---|---|---|
| AI7503000998_4328468_c2_298 | 2884 | 6656 | 1473 | 490 | 1279 | 2.2e-130 |

Description pir:[LN:H69634] [AC:H69634 ] [PN:glutamate synthase (small subunit) gltB] [GN:gltB ] [OR:Bacillus subtilis] [DB:pir2] >gp:[GI:e1183502:g2634227] [LN:BSUB0010] [AC:Z99113:AL009126] [PN:glutamate synthase (small subunit)] [GN:gltB] [FN:glutamate biosynthesis] [OR:Bacillus subtilis] [DB:genpept-bct1] [EC:1.4.1.13] [DE:Bacillus subtilis complete genome (section 10 of 21): from 1781201to 2014980.] [LE:226628] [RE:228109] [DI:complement] >gp:[GI:e1185317:g2634238] [LN:BSUB0011] [AC:Z99114:AL009126] [PN:glutamate synthase (small subunit)] [GN:gltB] [FN:glutamate biosynthesis] [OR:Bacillus subtilis] [DB:genpept-bct1] [EC:1.4.1.13] [DE:Bacillus subtilis complete genome (section 11 of 21): from 2000171to 2207900.] [LE:7658] [RE:9139] [DI:complement]

| ORF Name | NTID | AAID | NT Length | AA Length | score | probability |
|---|---|---|---|---|---|---|
| AI7503000998_4335766_c1_261 | 2885 | 6657 | 141 | 46 | | |

Description

NO-HIT

| ORF Name | NTID | AAID | NT Length | AA Length | score | probability |
|---|---|---|---|---|---|---|
| AI7503000998_4344011_f3_152 | 2886 | 6658 | 252 | 83 | 60 | 0.023 |

Description
gp:[GI:d1036760:g4062561] [LN:D90737] [AC:D90737:AB001340] [PN:4-hydroxyphenylacetate 3-monooxygenase (EC] [GN:nmoB] [OR:Escherichia coli] [SR:Escherichia coli(strain:K12) DNA, clone:Kohara clone #227] [DB:genpept-bct1] [DE:Escherichia coli genomic DNA. (22.8 - 23.1 min).] [NT:ORF_ID:o228#5; similar to PIR Accession Number] [LE:15357] [RE:15932] [DI:complement] >gp:[GI:d1036770:g4062570] [LN:D90738] [AC:D90738:AB001340] [PN:4-hydroxyphenylacetate 3-monooxygenase (EC] [GN:nmoB] [OR:Escherichia coli] [SR:Escherichia coli(strain:K12) DNA, clone:Kohara clone #228] [DB:genpept-bct1] [DE:Escherichia coli genomic DNA. (23.0 - 23.4 min).] [NT:ORF_ID:o228#5; similar to PIR Accession Number] [LE:3821] [RE:4396] [DI:complement]

| ORF Name | NTID | AAID | NT Length | AA Length | score | probability |
|---|---|---|---|---|---|---|
| AI7503000998_4485682_f3_159 | 2887 | 6659 | 264 | 87 | | |

Description
NO-HIT

| ORF Name | NTID | AAID | NT Length | AA Length | score | probability |
|---|---|---|---|---|---|---|
| AI7503000998_4580132_f1_72 | 2888 | 6660 | 171 | 56 | 161 | 3.6e-11 |

Description
gp:[GI:g2689564] [LN:U93688] [AC:U93688] [PN:integrase] [GN:int] [OR:Staphylococcus aureus] [DB:genpept-bct2] [DE:Staphylococcus aureus toxic shock syndrome toxin-1 (tst),enterotoxin (ent), and integrase (int) genes, complete cds.] [NT:similar to staphylococcal phage integrase] [LE:13871] [RE:15091] [DI:direct]

| ORF Name | NTID | AAID | NT Length | AA Length | score | probability |
|---|---|---|---|---|---|---|
| AI7503000998_4703167_f1_44 | 2889 | 6661 | 144 | 47 | | |

Description
NO-HIT

| ORF Name | NTID | AAID | NT Length | AA Length | score | probability |
|---|---|---|---|---|---|---|
| AI7503000998_4703512_c3_315 | 2890 | 6662 | 486 | 161 | 335 | 2.4e-30 |

Description
pir:[LN:A70068] [AC:A70068 ] [PN:conserved hypothetical protein ywqN] [GN:ywqN ] [OR:Bacillus subtilis] [DB:pir2] >gp:[GI:e1184521:g2636140] [LN:BSUB0019] [AC:Z99122:AL009126] [GN:ywqN] [FN:unknown] [OR:Bacillus subtilis] [DB:genpept-bct1] [DE:Bacillus subtilis complete genome (section 19 of 21): from 3597091to 3809700.] [NT:similar to hypothetical proteins] [LE:124753] [RE:125298] [DI:complement] >gp:[GI:e308071:g1894752] [LN:BSZ92952] [AC:Z92952] [PN:unknown] [GN:ywqN] [OR:Bacillus subtilis] [DB:genpept-bct1] [DE:B.subtilis ywq[A,B,C,D,E,F,G,H,I,J,K,L,M,N,O] genes.] [LE:13028] [RE:13573] [DI:direct] >gp:[GI:e1184521:g2636140] [LN:BSUB0019] [AC:Z99122:AL009126] [GN:ywqN] [FN:unknown] [OR:Bacillus subtilis] [DB:genpept] [DE:Bacillus subtilis complete genome (section 19 of 21): from 3597091to 3809700.] [NT:similar to hypothetical proteins] [LE:124753] [RE:125298] [DI:complement]

| ORF Name | NTID | AAID | NT Length | AA Length | score | probability |
|---|---|---|---|---|---|---|
| AI7503000998_47343_c1_219 | 2891 | 6663 | 132 | 43 | | |

Description
NO-HIT

| ORF Name | NTID | AAID | NT Length | AA Length | score | probability |
|---|---|---|---|---|---|---|
| AI7503000998_5265643_f1_30 | 2892 | 6664 | 1122 | 373 | | |

Description
NO-HIT

| ORF Name | NTID | AAID | NT Length | AA Length | score | probability |
|---|---|---|---|---|---|---|
| AI7503000998_5343760_f2_129 | 2893 | 6665 | 267 | 88 | | |

Description
NO-HIT

| ORF Name | NTID | AAID | NT Length | AA Length | score | probability |
|---|---|---|---|---|---|---|
| AI7503000998_5860927_f2_138 | 2894 | 6666 | 189 | 62 | 75 | 0.023 |

Description
gp:[GI:e1283542:g4455153] [LN:ATF6I18] [AC:AL022198] [PN:putative protein]
[GN:F6I18.10] [OR:Arabidopsis thaliana] [SR:thale cress] [DB:genpept-pln1]
[DE:Arabidopsis thaliana DNA chromosome 4, BAC clone F6I18 (ESSAIIproject).]
[NT:contains EST gb:T22575, T22317] [LE:>199:404:631] [RE:347:548:921]
[DI:complementJoin]

| ORF Name | NTID | AAID | NT Length | AA Length | score | probability |
|---|---|---|---|---|---|---|
| AI7503000998_6052175_f1_65 | 2895 | 6667 | 153 | 50 | | |

Description
NO-HIT

| ORF Name | NTID | AAID | NT Length | AA Length | score | probability |
|---|---|---|---|---|---|---|
| AI7503000998_6053437_c3_310 | 2896 | 6668 | 123 | 40 | | |

Description
NO-HIT

| ORF Name | NTID | AAID | NT Length | AA Length | score | probability |
|---|---|---|---|---|---|---|
| AI7503000998_6251262_f3_146 | 2897 | 6669 | 189 | 62 | 75 | 0.0084 |

Description
gp:[GI:d1044717:g5105618] [LN:AP000062] [AC:AP000062] [PN:121aa long hypothetical
protein] [GN:APE1925] [OR:Aeropyrum pernix] [SR:Aeropyrum pernix (strain:K1) DNA]
[DB:genpept] [DE:Aeropyrum pernix genomic DNA, section 5/7.] [NT:similar to
OWL:AB00947213 percent identity:62.500] [LE:233017] [RE:233382] [DI:direct]

| ORF Name | NTID | AAID | NT Length | AA Length | score | probability |
|---|---|---|---|---|---|---|
| AI7503000998_657678_f3_208 | 2898 | 6670 | 135 | 44 | | |

Description
NO-HIT

| ORF Name | NTID | AAID | NT Length | AA Length | score | probability |
|---|---|---|---|---|---|---|
| AI7503000998_6698526_c2_264 | 2899 | 6671 | 174 | 57 | | |

Description
NO-HIT

| ORF Name | NTID | AAID | NT Length | AA Length | score | probability |
|---|---|---|---|---|---|---|
| AI7503000998_6743788_c2_272 | 2900 | 6672 | 132 | 43 | | |

Description
NO-HIT

| ORF Name | NTID | AAID | NT Length | AA Length | score | probability |
|---|---|---|---|---|---|---|
| AI7503000998_6760887_f3_174 | 2901 | 6673 | 924 | 307 | 333 | 3.8e-30 |

Description
sp:[LN:GLTC_BACSU] [AC:P20668] [GN:GLTC] [OR:BACILLUS SUBTILIS] [DE:TRANSCRIPTIONAL REGULATORY PROTEIN GLTC] [SP:P20668] [DB:swissprot] >pir:[LN:A69635] [AC:A69635:A33951:A61642 ] [PN:transcription activator of glutamate synthase operon gltC:regulatory protein gltC] [GN:gltC ] [CL:probable transcription regulator lsyR] [OR:Bacillus subtilis] [DB:pir2] >gp:[GI:e1183504:g2634229] [LN:BSUB0010] [AC:Z99113:AL009126] [PN:transcriptional regulator (LysR family)] [GN:gltC] [FN:positive regulation of the glutamate synthase] [OR:Bacillus subtilis] [DB:genpept-bct1] [DE:Bacillus subtilis complete genome (section 10 of 21): from 1781201to 2014980.] [SP:P20668] [LE:232835] [RE:233737] [DI:direct] >gp:[GI:e1185319:g2634240] [LN:BSUB0011] [AC:Z99114:AL009126] [PN:transcriptional regulator (LysR family)] [GN:gltC] [FN:positive regulation of the glutamate synthase] [OR:Bacillus subtilis] [DB:genpept-bct1] [DE:Bacillus subtilis complete genome (section 11 of 21): from 2000171to 2207900.] [SP:P20668] [LE:13865] [RE:14767] [DI:direct] >gp:[GI:g457514] [LN:M28509] [AC:M28509] [GN:gltC] [FN:positive transcriptional regulator] [OR:Bacillus subtilis] [DB:genpept-bct1] [DE:Bacillus subtilis (gltC) gene, complete cds and glutamate synthase,large subunit (gltA) gene, partial cds. gene.] [LE:34] [RE:936] [DI:complement]

| ORF Name | NTID | AAID | NT Length | AA Length | score | probability |
|---|---|---|---|---|---|---|
| AI7503000998_6832950_c1_218 | 2902 | 6674 | 189 | 62 | | |

Description
NO-HIT

| ORF Name | NTID | AAID | NT Length | AA Length | score | probability |
|---|---|---|---|---|---|---|
| AI7503000998_956312_f2_139 | 2903 | 6675 | 144 | 47 | | |

Description
NO-HIT

| ORF Name | NTID | AAID | NT Length | AA Length | score | probability |
|---|---|---|---|---|---|---|
| AI7503000998_984703_c2_281 | 2904 | 6676 | 1026 | 341 | 763 | 1.0e-75 |

Description
sp:[LN:ABC_ECOLI] [AC:P30750:P77517] [GN:ABC] [OR:ESCHERICHIA COLI] [DE:ATP-BINDING PROTEIN ABC] [SP:P30750:P77517] [DB:swissprot] >pir:[LN:G64744] [AC:G64744:I41113 ] [PN:probable ABC-type transport protein abc] [GN:abc ] [CL:unassigned ATP-binding cassette proteins: ATP-binding cassette homology] [OR:Escherichia coli] [DB:pir2] >gp:[GI:g1552775] [LN:ECU70214] [AC:U70214] [PN:ATP-binding protein] [GN:abc] [OR:Escherichia coli] [DB:genpept-bct1] [DE:Escherichia coli chromosome minutes 4-6.] [LE:52689] [RE:53720] [DI:complement] >gp:[GI:g1786398] [LN:AE000129] [AC:AE000129:U00096] [PN:ATP-binding component of a transporter] [GN:abc] [FN:transport; Not classified] [OR:Escherichia coli] [DB:genpept-bct2] [DE:Escherichia coli K-12 MG1655 section 19 of 400 of the completegenome.] [NT:f343; 98 pct identical to fragment (231) [LE:1590] [RE:2621] [DI:complement]

| ORF Name | NTID | AAID | NT Length | AA Length | score | probability |
|---|---|---|---|---|---|---|
| AI7503000999_10191427_c1_745 | 2905 | 6677 | 135 | 44 | | |

Description
NO-HIT

| ORF Name | NTID | AAID | NT Length | AA Length | score | probability |
|---|---|---|---|---|---|---|
| AI7503000999_10320337_c3_1119 | 2906 | 6678 | 192 | 63 | | |

Description
NO-HIT

| ORF Name | NTID | AAID | NT Length | AA Length | score | probability |
|---|---|---|---|---|---|---|
| AI7503000999_10359688_f3_663 | 2907 | 6679 | 198 | 65 | | |

Description
NO-HIT

| ORF Name | NTID | AAID | NT Length | AA Length | score | probability |
|---|---|---|---|---|---|---|
| AI7503000999_10546925_c3_1155 | 2908 | 6680 | 978 | 325 | 1246 | 6.8e-127 |

Description
sp:[LN:DNAA_STAAU] [AC:P49994] [GN:DNAA] [OR:STAPHYLOCOCCUS AUREUS] [DE:CHROMOSOMAL REPLICATION INITIATOR PROTEIN DNAA] [SP:P49994] [DB:swissprot] >pir:[LN:JC5607] [AC:JC5607 ] [PN:replication initiation protein dnaA] [GN:dnaA ] [CL:replication initiation protein dnaA] [OR:Staphylococcus aureus] [DB:pir2] >gp:[GI:d1014451:g1694677] [LN:D89066] [AC:D89066] [PN:DnaA] [GN:dnaA] [OR:Staphylococcus aureus] [SR:Staphylococcus aureus DNA] [DB:genpept-bct1] [DE:Staphylococcus aureus DNA for DnaA, complete cds.] [LE:456] [RE:1817] [DI:direct]

| ORF Name | NTID | AAID | NT Length | AA Length | score | probability |
|---|---|---|---|---|---|---|
| AI7503000999_10556300_f2_428 | 2909 | 6681 | 174 | 57 | | |

Description
NO-HIT

| ORF Name | NTID | AAID | NT Length | AA Length | score | probability |
|---|---|---|---|---|---|---|
| AI7503000999_10556712_c3_1187 | 2910 | 6682 | 990 | 329 | 1667 | 1.7e-171 |

Description
gp:[GI:g1408063] [LN:STAMECRA] [AC:L14017] [PN:methicillin-resistance protein] [GN:mecR] [OR:Staphylococcus aureus] [SR:Staphylococcus aureus (strain COL) DNA] [DB:genpept-bct1] [DE:Staphylococcus aureus methicillin-resistance protein (mecR) geneand unknown ORF, complete cds.] [NT:putative] [LE:125] [RE:1111] [DI:direct]

| ORF Name | NTID | AAID | NT Length | AA Length | score | probability |
|---|---|---|---|---|---|---|
| AI7503000999_10582782_f3_549 | 2911 | 6683 | 141 | 46 | | |

Description
NO-HIT

| ORF Name | NTID | AAID | NT Length | AA Length | score | probability |
|---|---|---|---|---|---|---|
| AI7503000999_10629385_f1_185 | 2912 | 6684 | 153 | 50 | | |

Description
NO-HIT

| ORF_Name | NTID | AAID | NT Length | AA Length | score | probability |
|---|---|---|---|---|---|---|
| AI7503000999_10634800_c1_819 | 2913 | 6685 | 966 | 321 | 143 | 2.4e-07 |

Description
pir:[LN:D69900] [AC:D69900 ] [PN:conserved hypothetical protein yobV] [GN:yobV ]
[OR:Bacillus subtilis] [DB:pir2] >gp:[GI:g2619048] [LN:AF027868] [AC:AF027868]
[PN:transcription regulator] [GN:yobV] [OR:Bacillus subtilis] [DB:genpept-bct1]
[DE:Bacillus subtilis chromosome region between terC and odhAB.] [NT:similar to
Mycobacterium tuberculosis hypothetical] [LE:63061] [RE:64002] [DI:complement]
>gp:[GI:e1185382:g2634303] [LN:BSUB0011] [AC:Z99114:AL009126] [GN:yobV] [FN:unknown]
[OR:Bacillus subtilis] [DB:genpept-bct1] [DE:Bacillus subtilis complete genome (section
11 of 21): from 2000171to 2207900.] [NT:similar to hypothetical proteins] [LE:82152]
[RE:83093] [DI:complement]

| ORF_Name | NTID | AAID | NT Length | AA Length | score | probability |
|---|---|---|---|---|---|---|
| AI7503000999_1071002_f3_616 | 2914 | 6686 | 411 | 136 | 71 | 0.026 |

Description
gp:[GI:g142964] [LN:BACGERD] [AC:M27259] [OR:Bacillus subtilis] [SR:B.subtilis (strain
168) DNA, clone lambda-EMBL-3-2H] [DB:genpept-bct1] [DE:B.subtilis gerD gene, complete
cds.] [NT:unknown ORF] [LE:<1] [RE:282] [DI:complement]

| ORF_Name | NTID | AAID | NT Length | AA Length | score | probability |
|---|---|---|---|---|---|---|
| AI7503000999_10727217_f1_212 | 2915 | 6687 | 270 | 89 | 212 | 2.5e-17 |

Description
pir:[LN:B69770] [AC:B69770 ] [PN:conserved hypothetical protein ydaS] [GN:ydaS ]
[OR:Bacillus subtilis] [DB:pir2] >gp:[GI:d1020027:g1881247] [LN:AB001488] [AC:AB001488]
[GN:ydaS] [OR:Bacillus subtilis] [SR:Bacillus subtilis (strain:168) DNA]
[DB:genpept-bct1] [DE:Bacillus subtilis genome sequence, 148 kb sequence of the
regionbetween 35 and 47 degree.] [NT:FUNCTION UNKNOWN.] [LE:25711] [RE:25968]
[DI:complement] >gp:[GI:e1182403:g2632737] [LN:BSUB0003] [AC:Z99106:AL009126] [GN:ydaS]
[FN:unknown] [OR:Bacillus subtilis] [DB:genpept-bct1] [DE:Bacillus subtilis complete
genome (section 3 of 21): from 402751 to611850.] [NT:similar to hypothetical proteins
from B. subtilis] [LE:89455] [RE:89712] [DI:complement]

| ORF_Name | NTID | AAID | NT Length | AA Length | score | probability |
|---|---|---|---|---|---|---|
| AI7503000999_10928_c2_1083 | 2916 | 6688 | 1242 | 413 | 240 | 8.2e-18 |

Description
pir:[LN:T03492] [AC:T03492 ] [PN:hypothetical protein] [OR:Rhodobacter capsulatus]
[DB:pir2] [MP:1 ] >gp:[GI:g3128293] [LN:AF010496] [AC:AF010496] [PN:hypothetical
protein] [OR:Rhodobacter capsulatus] [DB:genpept-bct2] [DE:Rhodobacter capsulatus
strain SB1003, partial genome.] [LE:54291] [RE:55613] [DI:complement]

| ORF_Name | NTID | AAID | NT Length | AA Length | score | probability |
|---|---|---|---|---|---|---|
| AI7503000999_10928_f1_226 | 2917 | 6689 | 1017 | 338 | 175 | 1.3e-10 |

Description
pir:[LN:T03492] [AC:T03492 ] [PN:hypothetical protein] [OR:Rhodobacter capsulatus]
[DB:pir2] [MP:1 ] >gp:[GI:g3128293] [LN:AF010496] [AC:AF010496] [PN:hypothetical
protein] [OR:Rhodobacter capsulatus] [DB:genpept-bct2] [DE:Rhodobacter capsulatus
strain SB1003, partial genome.] [LE:54291] [RE:55613] [DI:complement]

| ORF Name | NTID | AAID | NT Length | AA Length | score | probability |
|---|---|---|---|---|---|---|
| AI7503000999_111500_c3_1239 | 2918 | 6690 | 546 | 181 | 101 | 1.9e-05 |

Description
gp:[GI:g940735] [LN:LMIAP1270] [AC:X85869] [PN:invasive associated protein] [GN:iap]
[OR:Listeria monocytogenes] [DB:genpept-bct1] [DE:L.monocytogenes type 1 partial iap
gene (strain 12705/89).] [NT:invades nonprofessional phagocytic cells] [LE:<1]
[RE:>260] [DI:direct]

| ORF Name | NTID | AAID | NT Length | AA Length | score | probability |
|---|---|---|---|---|---|---|
| AI7503000999_111592_c2_931 | 2919 | 6691 | 243 | 80 | 83 | 0.0083 |

Description
gp:[GI:e1349691:g3880163] [LN:CET24A11] [AC:Z49072] [GN:T24A11.2] [OR:Caenorhabditis
elegans] [DB:genpept-inv1] [DE:Caenorhabditis elegans cosmid T24A11, complete
sequence.] [LE:22751:23187:23506] [RE:23145:23464:23646] [DI:complementJoin]

| ORF Name | NTID | AAID | NT Length | AA Length | score | probability |
|---|---|---|---|---|---|---|
| AI7503000999_115627_f2_344 | 2920 | 6692 | 168 | 55 | | |

Description
NO-HIT

| ORF Name | NTID | AAID | NT Length | AA Length | score | probability |
|---|---|---|---|---|---|---|
| AI7503000999_1205000_f1_183 | 2921 | 6693 | 555 | 184 | 314 | 4.0e-28 |

Description
pir:[LN:F69768] [AC:F69768 ] [PN:acetyltransferase homolog ydaF] [GN:ydaF ]
[OR:Bacillus subtilis] [DB:pir2] >gp:[GI:d1020012:g1881232] [LN:AB001488] [AC:AB001488]
[GN:ydaF] [OR:Bacillus subtilis] [SR:Bacillus subtilis (strain:168) DNA]
[DB:genpept-bct1] [DE:Bacillus subtilis genome sequence, 148 kb sequence of the
regionbetween 35 and 47 degree.] [NT:PROBABLE ACETYLTRANSFERASE.] [LE:6233] [RE:6784]
[DI:direct] >gp:[GI:e1182387:g2632721] [LN:BSUB0003] [AC:Z99106:AL009126] [GN:ydaF]
[FN:unknown] [OR:Bacillus subtilis] [DB:genpept-bct1] [DE:Bacillus subtilis complete
genome (section 3 of 21): from 402751 to611850.] [NT:similar to acetyltransferase]
[LE:69977] [RE:70528] [DI:direct]

| ORF Name | NTID | AAID | NT Length | AA Length | score | probability |
|---|---|---|---|---|---|---|
| AI7503000999_12536337_f2_405 | 2922 | 6694 | 327 | 108 | | |

Description
NO-HIT

| ORF Name | NTID | AAID | NT Length | AA Length | score | probability |
|---|---|---|---|---|---|---|
| AI7503000999_12588250_c1_671 | 2923 | 6695 | 198 | 65 | | |

Description
NO-HIT

| ORF Name | NTID | AAID | NT Length | AA Length | score | probability |
|---|---|---|---|---|---|---|
| AI7503000999_1259387_f2_250 | 2924 | 6696 | 126 | 41 | | |

Description
NO-HIT

| ORF_Name | NTID | AAID | NT Length | AA Length | score | probability |
|---|---|---|---|---|---|---|
| AI7503000999_1261078_f1_223 | 2925 | 6697 | 579 | 192 | 471 | 9.1e-45 |

Description sp:[LN:XPT_BACSU] [AC:P42085] [GN:XPT] [OR:BACILLUS SUBTILIS] [EC:2.4.2.-] [DE:XANTHINE PHOSPHORIBOSYLTRANSFERASE,] [SP:P42085] [DB:swissprot] >pir:[LN:S51309] [AC:S51309:E69734 ] [PN:xanthine phosphoribosyltransferase xpt] [GN:xpt ] [OR:Bacillus subtilis] [DB:pir2] >gp:[GI:g1256617] [LN:BACYACA] [AC:L77246] [PN:adenine phosphoribosyltransferase] [GN:xpt] [FN:purine biosynthesis] [OR:Bacillus subtilis] [DB:genpept-bct1] [EC:2.4.2.7] [DE:Bacillus subtilis (YAC10-9 clone) DNA region between the serA andkdg loci.] [NT:27% identity with E.coli adenine] [LE:1426] [RE:2010] [DI:direct] >gp:[GI:e1183653:g2634626] [LN:BSUB0012] [AC:Z99115:AL009126] [PN:xanthine phosphoribosyltransferase] [GN:xpt] [FN:purine biosynthesis] [OR:Bacillus subtilis] [DB:genpept-bct1] [EC:2.4.2.7] [DE:Bacillus subtilis complete genome (section 12 of 21): from 2195541to 2409220.] [SP:P42085] [LE:123142] [RE:123726] [DI:complement] >gp:[GI:g633169] [LN:BSXPTPBUX] [AC:X83878] [PN:xanthine phosphoribosyltransferase] [GN:xpt] [OR:Bacillus subtilis] [DB:genpept-bct1] [DE:B.subtilis xpt and pbuX genes.] [SP:P42085] [LE:357] [RE:941] [DI:direct]

| ORF_Name | NTID | AAID | NT Length | AA Length | score | probability |
|---|---|---|---|---|---|---|
| AI7503000999_1301_f3_471 | 2926 | 6698 | 123 | 40 | | |

Description
NO-HIT

| ORF_Name | NTID | AAID | NT Length | AA Length | score | probability |
|---|---|---|---|---|---|---|
| AI7503000999_13089052_f1_2 | 2927 | 6699 | 123 | 40 | | |

Description
NO-HIT

| ORF_Name | NTID | AAID | NT Length | AA Length | score | probability |
|---|---|---|---|---|---|---|
| AI7503000999_134677_f2_417 | 2928 | 6700 | 1101 | 366 | 1373 | 2.4e-140 |

Description sp:[LN:YYAF_BACSU] [AC:P37518] [GN:YYAF] [OR:BACILLUS SUBTILIS] [DE:REGION] [SP:P37518] [DB:swissprot] >pir:[LN:S66016] [AC:S66016:E70084 ] [PN:probable GTP-binding protein yyaF] [GN:yyaF ] [CL:yeast probable purine nucleotide-binding protein YBR025c] [OR:Bacillus subtilis] [DB:pir2] >gp:[GI:d1005764:g467376] [LN:BAC180K] [AC:D26185] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:47839] [RE:48939] [DI:complement] >gp:[GI:e1184818:g2636639] [LN:BSUB0021] [AC:Z99124:AL009126] [GN:yyaF] [FN:unknown] [OR:Bacillus subtilis] [DB:genpept-bct1] [DE:Bacillus subtilis complete genome (section 21 of 21): from 3999281to 4214814.] [NT:similar to hypothetical proteins] [SP:P37518] [LE:199771] [RE:200871] [DI:complement]

| ORF_Name | NTID | AAID | NT Length | AA Length | score | probability |
|---|---|---|---|---|---|---|
| AI7503000999_13704191_c1_811 | 2929 | 6701 | 171 | 56 | | |

Description
NO-HIT

| ORF_Name | NTID | AAID | NT Length | AA Length | score | probability |
|---|---|---|---|---|---|---|
| AI7503000999_13750258_f1_41 | 2930 | 6702 | 162 | 53 | | |

Description
NO-HIT

| ORF Name | NTID | AAID | NT Length | AA Length | score | probability |
|---|---|---|---|---|---|---|
| AI7503000999_1379132_c1_806 | 2931 | 6703 | 564 | 187 | 589 | 2.9e-57 |

Description
gp:[GI:d1045999:g5360823] [LN:D86934] [AC:D86934] [PN:IS150-like transposase]
[OR:Staphylococcus aureus] [SR:Staphylococcus aureus (strain:N315) DNA,
clone_lib:library of N31] [DB:genpept] [DE:Staphylococcus aureus genes, mec region,
partial and complete cds.] [NT:ORF N028; putative] [LE:<20180] [RE:20578] [DI:direct]

| ORF Name | NTID | AAID | NT Length | AA Length | score | probability |
|---|---|---|---|---|---|---|
| AI7503000999_13828575_f1_31 | 2932 | 6704 | 444 | 147 | 617 | 3.1e-60 |

Description
sp:[LN:ARSC_STAAU] [AC:P30330] [GN:ARSC] [OR:STAPHYLOCOCCUS AUREUS] [DE:ARSENATE
REDUCTASE (ARSENICAL PUMP MODIFIER)] [SP:P30330] [DB:swissprot] >pir:[LN:D41903]
[AC:D41903 ] [PN:arsenate reductase,] [GN:arsC ] [CL:protein-tyrosine-phosphatase, low
molecular weight] [OR:Staphylococcus aureus] [EC:1.-.-.-] [DB:pir1] >gp:[GI:g150729]
[LN:PI2ARSRBC] [AC:M86824] [PN:arsenate reductase] [GN:arsC] [FN:Reduction of arsenate
to arsenite] [OR:Plasmid pI258] [SR:Plasmid pI258 DNA] [DB:genpept-bct1] [DE:Plasmid
pI258 arsenic resistance operon (arsRBC) genes, completecds.] [LE:1894] [RE:2289]
[DI:direct]

| ORF Name | NTID | AAID | NT Length | AA Length | score | probability |
|---|---|---|---|---|---|---|
| AI7503000999_1384628_f2_290 | 2933 | 6705 | 1278 | 425 | 251 | 4.3e-19 |

Description
pir:[LN:H64514] [AC:H64514 ] [PN:hypothetical protein MJECL41] [OR:Methanococcus
jannaschii] [DB:pir2] [MP:ECLREV53908-52610 ] >gp:[GI:g1522674] [LN:MII2CG] [AC:L77118]
[PN:M. jannaschii predicted coding region MJECL41] [GN:MJECL41] [OR:Methanococcus
jannaschii] [DB:genpept-bct2] [DE:Methanococcus jannaschii large extra-chromosomal
element, completesequence.] [NT:identified by GeneMark; putative] [LE:52610] [RE:53908]
[DI:complement]

| ORF Name | NTID | AAID | NT Length | AA Length | score | probability |
|---|---|---|---|---|---|---|
| AI7503000999_13864680_c2_1056 | 2934 | 6706 | 384 | 127 | 247 | 5.0e-21 |

Description
sp:[LN:YQCJ_BACSU] [AC:P45949] [GN:YQCJ] [OR:BACILLUS SUBTILIS] [DE:HYPOTHETICAL 12.3
KD PROTEIN IN CWLA-CISA INTERGENIC REGION] [SP:P45949] [DB:swissprot] >pir:[LN:H69949]
[AC:H69949 ] [PN:transcription regulator ArsR family homolog yqcJ] [GN:yqcJ ]
[CL:arsenical resistance operon repressor] [OR:Bacillus subtilis] [DB:pir2]
>gp:[GI:d1013110:g1303775] [LN:BACJH642] [AC:D84432:D82370] [PN:YqcJ] [OR:Bacillus
subtilis] [SR:Bacillus subtilis (strain:JH642(trpC2 PheA1)) DNA] [DB:genpept-bct1]
[DE:Bacillus subtilis DNA, 283 Kb region containing skin element.] [LE:61977]
[RE:62294] [DI:direct] >gp:[GI:d1007542:g1217882] [LN:BACSKIN] [AC:D32216] [PN:ORF3]
[OR:Bacillus subtilis] [SR:Bacillus subtilis (strain:JH642 (trpC2 pheA1)) DNA]
[DB:genpept-bct1] [DE:Bacillus subtilis 48 kb region including a skin element which
islocated between spoIVCB and spoIIIC.] [NT:similarity to arsenical resistance operon]
[LE:43732] [RE:44049] [DI:direct] >gp:[GI:e1183810:g2635026] [LN:BSUB0014]
[AC:Z99117:AL009126] [GN:yqcJ] [FN:unknown] [OR:Bacillus subtilis] [DB:genpept-bct1]
[DE:Bacillus subtilis complete genome (section 14 of 21): from 2599451to 2812870.]
[NT:similar to transcriptional regulator (ArsR family)] [SP:P45949] [LE:57136]
[RE:57453] [DI:complement]

| ORF_Name | NTID | AAID | NT Length | AA Length | score | probability |
|---|---|---|---|---|---|---|
| AI7503000999_13912551_c1_827 | 2935 | 6707 | 1695 | 564 | 156 | 6.7e-08 |

Description
gp:[GI:g4530172] [LN:AF085222] [AC:AF085222] [PN:putative primase] [OR:Streptococcus thermophilus bacteriophage DT1] [DB:genpept-phg] [DE:Streptococcus thermophilus bacteriophage DT1, complete genome.] [NT:Orf36] [LE:28549] [RE:30063] [DI:direct]

| ORF_Name | NTID | AAID | NT Length | AA Length | score | probability |
|---|---|---|---|---|---|---|
| AI7503000999_14111687_f3_529 | 2936 | 6708 | 225 | 74 | 104 | 3.3e-05 |

Description
sp:[LN:Y4IQ_RHISN] [AC:P55500] [GN:Y4IQ,Y4ND,Y4SD] [OR:RHIZOBIUM SP] [SR:NGR234,]
[DE:PUTATIVE INSERTION SEQUENCE ATP-BINDING PROTEIN Y4IQ/Y4ND/Y4SD] [SP:P55500]
[DB:swissprot] >gp:[GI:g2182455] [LN:AE000079] [AC:AE000079:U00090] [PN:Y4iQ] [GN:y4iQ]
[OR:Rhizobium sp. NGR234] [DB:genpept-bct2] [DE:Rhizobium sp. NGR234 plasmid pNGR234a,
section 16 of 46 of thecomplete plasmid sequence.] [NT:putative insertion sequence
ATP-binding protein;] [LE:1883] [RE:2779] [DI:complement] >gp:[GI:g2182539]
[LN:AE000086] [AC:AE000086:U00090] [PN:Y4nD] [GN:y4nD] [OR:Rhizobium sp. NGR234]
[DB:genpept-bct2] [DE:Rhizobium sp. NGR234 plasmid pNGR234a, section 23 of 46 of
thecomplete plasmid sequence.] [NT:putative insertion sequence ATP-binding protein;]
[LE:8640] [RE:9536] [DI:complement] >gp:[GI:g2182618] [LN:AE000095]
[AC:AE000095:U00090] [PN:Y4sD] [GN:y4sD] [OR:Rhizobium sp. NGR234] [DB:genpept-bct2]
[DE:Rhizobium sp. NGR234 plasmid pNGR234a, section 32 of 46 of thecomplete plasmid
sequence.] [NT:putative insertion sequence ATP-binding protein;] [LE:7675] [RE:8571]
[DI:complement]

| ORF_Name | NTID | AAID | NT Length | AA Length | score | probability |
|---|---|---|---|---|---|---|
| AI7503000999_14220027_f3_618 | 2937 | 6709 | 1143 | 380 | 190 | 3.0e-12 |

Description
gp:[GI:d1025733:g2879913] [LN:D85752] [AC:D85752] [GN:bacG] [OR:Enterococcus faecalis]
[SR:Enterococcus faecalis plasmid:pPD1 DNA] [DB:genpept-bct1] [DE:Enterococcus faecalis
plasmid pPD1 bacA, bacB, bacC, bacD, bacE,bacF, bacG, bacH and bacI genes, complete
cds.] [LE:5832] [RE:7055] [DI:direct]

| ORF_Name | NTID | AAID | NT Length | AA Length | score | probability |
|---|---|---|---|---|---|---|
| AI7503000999_14460882_c3_1296 | 2938 | 6710 | 342 | 114 | 484 | 3.8e-46 |

Description
gp:[GI:g1022726] [LN:SHU35635] [AC:U35635] [PN:unknown] [OR:Staphylococcus
haemolyticus] [SR:Staphylococcus haemolyticus strain=Y176] [DB:genpept-bct1]
[DE:Staphylococcus haemolyticus IS1272 ORF1 and ORF2 genes, completecds.] [NT:ORF1]
[LE:1101] [RE:1922] [DI:complement]

| ORF_Name | NTID | AAID | NT Length | AA Length | score | probability |
|---|---|---|---|---|---|---|
| AI7503000999_14532058_c3_1228 | 2939 | 6711 | 273 | 90 | 452 | 9.4e-43 |

Description sp:[LN:TRA1_STAAU] [AC:P14506] [OR:STAPHYLOCOCCUS AUREUS] [DE:TRANSPOSASE FOR INSERTION SEQUENCE ELEMENT IS257 IN TRANSPOSON TN4003] [SP:P14506] [DB:swissprot] >pir:[LN:S04162] [AC:S04162 ] [PN:transposase 1] [OR:Staphylococcus aureus] [DB:pir2] >gp:[GI:g46748] [LN:SATN4003] [AC:X13290] [OR:Staphylococcus aureus] [DB:genpept-bct1] [DE:Staphylococcus aureus multi-resistance plasmid pSK1 DNA containingtransposon Tn4003.] [NT:transposase (AA 1-224)] [SP:P14506] [LE:89] [RE:763] [DI:complement] >gp:[GI:g46753] [LN:SATN4003] [AC:X13290] [OR:Staphylococcus aureus] [DB:genpept-bct1] [DE:Staphylococcus aureus multi-resistance plasmid pSK1 DNA containingtransposon Tn4003.] [NT:transposase (AA 1-224)] [SP:P14506] [LE:4017] [RE:4691] [DI:complement] >gp:[GI:g1762092] [LN:SEU40381] [AC:U40381] [PN:transposase] [GN:tnp] [OR:Staphylococcus epidermidis] [DB:genpept-bct1] [DE:Staphyloccous epidermidis plasmid pSK697 insertion sequenceIS257(697A) putative transposase gene, complete cds.] [NT:Tnp; putative transposase] [LE:57] [RE:731] [DI:direct] >gp:[GI:g1762098] [LN:SEU40384] [AC:U40384] [PN:transposase] [GN:tnp] [OR:Staphylococcus epidermidis] [DB:genpept-bct1] [DE:Staphyloccous epidermidis plasmid pSK818 insertion sequenceIS257(818A) putative transposase gene, complete cds.] [NT:Tnp; putative transposase] [LE:57] [RE:731] [DI:direct] >gp:[GI:g3676405] [LN:AF051916] [AC:AF051916] [PN:putative transposase TnpC] [GN:tnpC] [OR:Staphylococcus aureus] [DB:genpept-bct2] [DE:Staphylococcus aureus plasmid pJE1 remnant of replication proteinRep (rep), trimethoprim resistance protein DfrA (dfrA), thymidylatesynthetase ThyE (thyE), and putative transposase Tnp (tnp) genes,complete cds; and unknown gene.] [LE:65] [RE:739] [DI:direct] >gp:[GI:g3676411] [LN:AF051916] [AC:AF051916] [PN:putative transposase TnpE] [GN:tnpE] [OR:Staphylococcus aureus] [DB:genpept-bct2] [DE:Staphylococcus aureus plasmid pJE1 remnant of replication proteinRep (rep), trimethoprim resistance protein DfrA (dfrA), thymidylatesynthetase ThyE (thyE), and putative transposase Tnp (tnp) genes,complete cds; and unknown gene.] [LE:4409] [RE:5083] [DI:direct] >gp:[GI:g3676433] [LN:AF051917] [AC:AF051917:L19570] [PN:putative transposase TnpC] [GN:tnpC] [OR:Staphylococcus aureus] [DB:genpept-bct2] [DE:Staphylococcus aureus plasmid pSK41, complete sequence.] [LE:22981] [RE:23655] [DI:direct] >gp:[GI:g1762090] [LN:SEU40259] [AC:U40259] [PN:Tnp] [GN:tnp] [FN:putative transposase] [OR:Staphylococcus epidermidis] [DB:genpept-bct2] [DE:Staphyloccous epidermidis trimethoprim resistance plasmid pSK639.] [LE:7281] [RE:7955] [DI:direct]

| ORF_Name | NTID | AAID | NT Length | AA Length | score | probability |
|---|---|---|---|---|---|---|
| AI7503000999_14578382_f1_27 | 2940 | 6712 | 192 | 63 | | |

Description

NO-HIT

| ORF_Name | NTID | AAID | NT Length | AA Length | score | probability |
|---|---|---|---|---|---|---|
| AI7503000999_14625031_f3_489 | 2941 | 6713 | 132 | 43 | | |

Description

NO-HIT

| ORF_Name | NTID | AAID | NT Length | AA Length | score | probability |
|---|---|---|---|---|---|---|
| AI7503000999_14719827_c3_1275 | 2942 | 6714 | 330 | 109 | 85 | 0.0070 |

Description gp:[GI:g4049891] [LN:AF063866] [AC:AF063866] [PN:ORF MSV019 hypothetical protein] [GN:MSV019] [OR:Melanoplus sanguinipes entomopoxvirus] [DB:genpept-vrl] [DE:Melanoplus sanguinipes entomopoxvirus, complete genome.] [LE:21761] [RE:23074] [DI:complement]

| ORF Name | NTID | AAID | NT Length | AA Length | score | probability |
|---|---|---|---|---|---|---|
| AI7503000999_14728382_f1_210 | 2943 | 6715 | 300 | 99 | 336 | 1.8e-30 |

Description
sp:[LN:RS6_BACSU] [AC:P21468] [GN:RPSF] [OR:BACILLUS SUBTILIS] [DE:30S RIBOSOMAL PROTEIN S6 (BS9)] [SP:P21468] [DB:swissprot] >pir:[LN:S66015] [AC:S66015:S11356:E69699 ] [PN:ribosomal protein S6 (BS9) rpsF:ribosomal protein BS9] [GN:rpsF ] [CL:Escherichia coli ribosomal protein S6] [OR:Bacillus subtilis] [DB:pir2] >gp:[GI:d1005763:g467375] [LN:BAC180K] [AC:D26185] [PN:ribosomal protein S6] [GN:rpsF] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:47441] [RE:47728] [DI:complement] >gp:[GI:e1184817:g2636638] [LN:BSUB0021] [AC:Z99124:AL009126] [PN:ribosomal protein S6 (BS9)] [GN:rpsF] [OR:Bacillus subtilis] [DB:genpept-bct1] [DE:Bacillus subtilis complete genome (section 21 of 21): from 3999281to 4214814.] [SP:P21468] [LE:199373] [RE:199660] [DI:complement]

| ORF Name | NTID | AAID | NT Length | AA Length | score | probability |
|---|---|---|---|---|---|---|
| AI7503000999_14881552_f1_187 | 2944 | 6716 | 216 | 71 | | |

Description
NO-HIT

| ORF Name | NTID | AAID | NT Length | AA Length | score | probability |
|---|---|---|---|---|---|---|
| AI7503000999_15033181_c3_1093 | 2945 | 6717 | 444 | 147 | 90 | 0.0071 |

Description
gp:[GI:g4176374] [LN:AC004953] [AC:AC004953] [GN:WUGSC:H_DJ1059M17.2] [OR:Homo sapiens] [SR:INFORMATION] [DB:genpept-pri3] [DE:Homo sapiens PAC clone DJ1059M17 from 7q21-q31.1, completesequence.] [NT:myosin regulatory light chain 2; similar to S22715] [LE:67137:67324:69882] [RE:67235:67372:69960] [DI:complementJoin]

| ORF Name | NTID | AAID | NT Length | AA Length | score | probability |
|---|---|---|---|---|---|---|
| AI7503000999_15052318_f2_391 | 2946 | 6718 | 1395 | 464 | 1606 | 4.9e-165 |

Description
sp:[LN:THDF_BACSU] [AC:P25811] [GN:THDF] [OR:BACILLUS SUBTILIS] [DE:POSSIBLE THIOPHENE AND FURAN OXIDATION PROTEIN THDF] [SP:P25811] [DB:swissprot] >pir:[LN:JQ1215] [AC:I40439:S66026:C69722:JQ1215:S18075 ] [PN:thiophen / furan oxidation protein thdF:50K protein homolog] [GN:thdF ] [CL:thiophen / furan oxidation protein:translation elongation factor Tu homology] [OR:Bacillus subtilis] [DB:pir2] >gp:[GI:d1005774:g467386] [LN:BAC180K] [AC:D26185] [PN:thiophen and furan oxidation] [GN:tdhF] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:59506] [RE:60885] [DI:complement] >gp:[GI:g40025] [LN:BSORIGS] [AC:X62539] [OR:Bacillus subtilis] [DB:genpept-bct1] [DE:B.subtilis genes rpmH, rnpA, 50kd, gidA and gidB.] [NT:homologous to E.coli 50K] [SP:P25811] [LE:2515] [RE:3894] [DI:direct] >gp:[GI:e1184828:g2636649] [LN:BSUB0021] [AC:Z99124:AL009126] [GN:thdF] [PN:thiophen and furan oxidation] [OR:Bacillus subtilis] [DB:genpept-bct1] [DE:Bacillus subtilis complete genome (section 21 of 21): from 3999281to 4214814.] [SP:P25811] [LE:211438] [RE:212817] [DI:complement]

| ORF Name | NTID | AAID | NT Length | AA Length | score | probability |
|---|---|---|---|---|---|---|
| AI7503000999_15055313_c3_1183 | 2947 | 6719 | 444 | 147 | 753 | 1.2e-74 |

Description
gp:[GI:d1046028:g5360852] [LN:D86934] [AC:D86934] [OR:Staphylococcus aureus]
[SR:Staphylococcus aureus (strain:N315) DNA, clone_lib:library of N31] [DB:genpept]
[DE:Staphylococcus aureus genes, mec region, partial and complete cds.] [NT:ORF CN038]
[LE:45523] [RE:>45966] [DI:complement]

| ORF Name | NTID | AAID | NT Length | AA Length | score | probability |
|---|---|---|---|---|---|---|
| AI7503000999_15632952_c1_833 | 2948 | 6720 | 489 | 162 | | |

Description
NO-HIT

| ORF Name | NTID | AAID | NT Length | AA Length | score | probability |
|---|---|---|---|---|---|---|
| AI7503000999_157500_c1_771 | 2949 | 6721 | 729 | 242 | 253 | 1.2e-21 |

Description
sp:[LN:YD31_HELPY] [AC:O25889] [GN:HP1331] [OR:HELICOBACTER PYLORI] [SR:,CAMPYLOBACTER
PYLORI] [DE:HYPOTHETICAL PROTEIN HP1331] [SP:O25889] [DB:swissprot] >pir:[LN:C64686]
[AC:C64686 ] [PN:conserved hypothetical integral membrane protein HP1331]
[CL:hypothetical protein b2682] [OR:Helicobacter pylori] [DB:pir2] >gp:[GI:g2314496]
[LN:AE000634] [AC:AE000634:AE000511] [PN:conserved hypothetical integral membrane]
[GN:HP1331] [OR:Helicobacter pylori 26695] [DB:genpept-bct2] [DE:Helicobacter pylori
26695 section 112 of 134 of the completegenome.] [NT:similar to GB:L42023 SP:P44302
PID:1008819] [LE:10600] [RE:11286] [DI:complement]

| ORF Name | NTID | AAID | NT Length | AA Length | score | probability |
|---|---|---|---|---|---|---|
| AI7503000999_15752213_f1_167 | 2950 | 6722 | 270 | 89 | 74 | 0.034 |

Description
gp:[GI:g2645365] [LN:SHU83823] [AC:U83823] [PN:NADH dehydrogenase subunit 4] [GN:ND4]
[OR:Mitochondrion Sigmodon hispidus] [SR:Sigmodon hispidus] [DB:genpept-rod]
[DE:Sigmodon hispidus NADH dehydrogenase subunit 3 (ND3) and NADHdehydrogenase subunit
4L (ND4L) genes, complete cds, NADHdehydrogenase subunit 4 (ND4) gene, partial cds, and
tRNA-Arg gene,complete sequence, mitochondrial genes encoding mitochondrialproducts.]
[LE:709] [RE:>1332] [DI:direct]

| ORF Name | NTID | AAID | NT Length | AA Length | score | probability |
|---|---|---|---|---|---|---|
| AI7503000999_15788276_f3_494 | 2951 | 6723 | 198 | 65 | 56 | 0.028 |

Description
gp:[GI:g452394] [LN:BMFLC3] [AC:Z26886] [PN:Nd-sD mutant fibroin light chain]
[OR:Bombyx mori] [SR:domestic silkworm] [DB:genpept-inv1] [DE:B.mori gene for Nd-sD
mutant fibroin light chain.] [LE:<1:1275:1732] [RE:125:1447:2074] [DI:directJoin]

| ORF Name | NTID | AAID | NT Length | AA Length | score | probability |
|---|---|---|---|---|---|---|
| AI7503000999_15893843_f2_246 | 2952 | 6724 | 135 | 44 | | |

Description
NO-HIT

| ORF Name | NTID | AAID | NT Length | AA Length | score | probability |
|---|---|---|---|---|---|---|
| AI7503000999_161661_f3_507 | 2953 | 6725 | 147 | 48 | | |

Description
NO-HIT

| ORF Name | NTID | AAID | NT Length | AA Length | score | probability |
|---|---|---|---|---|---|---|
| AI7503000999_16222092_f1_44 | 2954 | 6726 | 141 | 46 | | |

Description
NO-HIT

| ORF Name | NTID | AAID | NT Length | AA Length | score | probability |
|---|---|---|---|---|---|---|
| AI7503000999_162812_c2_1058 | 2955 | 6727 | 147 | 48 | | |

Description
NO-HIT

| ORF Name | NTID | AAID | NT Length | AA Length | score | probability |
|---|---|---|---|---|---|---|
| AI7503000999_16432963_c1_709 | 2956 | 6728 | 1116 | 371 | 972 | 7.4e-98 |

Description
pir:[LN:A69847] [AC:A69847 ] [PN:cystathionine gamma-synthase homolog yjcI] [GN:yjcI ]
[CL:O-succinylhomoserine (thiol)-lyase] [OR:Bacillus subtilis] [DB:pir2]
>gp:[GI:e1183207:g2633541] [LN:BSUB0007] [AC:Z99110:AL009126] [GN:yjcI] [FN:unknown]
[OR:Bacillus subtilis] [DB:genpept-bct1] [DE:Bacillus subtilis complete genome (section
7 of 21): from 1194391to 1411140.] [NT:similar to cystathionine gamma-synthase]
[LE:63573] [RE:64694] [DI:direct]

| ORF Name | NTID | AAID | NT Length | AA Length | score | probability |
|---|---|---|---|---|---|---|
| AI7503000999_16601512_c1_834 | 2957 | 6729 | 510 | 169 | 98 | 0.0027 |

Description
gp:[GI:e1346924:g3877219] [LN:CEF46F3] [AC:Z81085] [GN:F46F3.3] [OR:Caenorhabditis
elegans] [DB:genpept-inv1] [DE:Caenorhabditis elegans cosmid F46F3, complete sequence.]
[LE:12629:13473:14592:14734] [RE:12740:13771:14687:14877] [DI:directJoin]

| ORF Name | NTID | AAID | NT Length | AA Length | score | probability |
|---|---|---|---|---|---|---|
| AI7503000999_16688_c2_1062 | 2958 | 6730 | 216 | 71 | 95 | 6.4e-05 |

Description
gp:[GI:g5230679] [LN:AF036485] [AC:AF036485:AF036486:AF036487:U93364] [PN:hypothetical
protein] [OR:Plasmid pNZ4000] [DB:genpept] [DE:Plasmid pNZ4000, complete sequence.]
[NT:Orf-100] [LE:42675:1] [RE:42810:167] [DI:complementJoin]

| ORF_Name | NTID | AAID | NT Length | AA Length | score | probability |
|---|---|---|---|---|---|---|
| AI7503000999_16695311_f2_259 | 2959 | 6731 | 693 | 230 | 1184 | 2.5e-120 |

Description sp:[LN:TRA2_STAAU] [AC:P19380] [OR:STAPHYLOCOCCUS AUREUS] [DE:TRANSPOSASE FOR INSERTION SEQUENCE-LIKE ELEMENT IS431MEC] [SP:P19380] [DB:swissprot] >pir:[LN:S12093] [AC:S12093:JU0116 ] [PN:probable transposase] [OR:Staphylococcus aureus] [DB:pir2] >gp:[GI:g46602] [LN:SAIS431M] [AC:X53818:M18438] [OR:Staphylococcus aureus] [DB:genpept-bct1] [DE:S. aureus IS431mec gene associated with methicillin resistance.] [NT:putative transposase (AA 1 - 224)] [SP:P19380] [LE:272] [RE:946] [DI:direct] >gp:[GI:e1237900:g2791991] [LN:SAMECAR1I] [AC:Y14051] [PN:putative transposase] [OR:Staphylococcus aureus] [DB:genpept-bct1] [DE:Staphylococcus aureus mecA, mecR1, mecI genes and ORF168, ORF142,ORF44, ORF145 and ORF224.] [NT:ORF224] [LE:8096] [RE:8770] [DI:direct] >gp:[GI:d1046034:g5360858] [LN:D86934] [AC:D86934] [PN:transposase for insertion sequence-like element] [OR:Staphylococcus aureus] [SR:Staphylococcus aureus (strain:N315) DNA, clone_lib:library of N31] [DB:genpept] [DE:Staphylococcus aureus genes, mec region, partial and complete cds.] [NT:ORF N062] [LE:48054] [RE:48728] [DI:direct] >gp:[GI:d1046044:g5360868] [LN:D86934] [AC:D86934] [PN:transposase for insertion sequence-like element] [OR:Staphylococcus aureus] [SR:Staphylococcus aureus (strain:N315) DNA, clone_lib:library of N31] [DB:genpept] [DE:Staphylococcus aureus genes, mec region, partial and complete cds.] [NT:ORF N070] [LE:53400] [RE:54074] [DI:direct]

| ORF_Name | NTID | AAID | NT Length | AA Length | score | probability |
|---|---|---|---|---|---|---|
| AI7503000999_16695311_f2_282 | 2960 | 6732 | 693 | 230 | 1191 | 4.6e-121 |

Description sp:[LN:TRA2_STAAU] [AC:P19380] [OR:STAPHYLOCOCCUS AUREUS] [DE:TRANSPOSASE FOR INSERTION SEQUENCE-LIKE ELEMENT IS431MEC] [SP:P19380] [DB:swissprot] >pir:[LN:S12093] [AC:S12093:JU0116 ] [PN:probable transposase] [OR:Staphylococcus aureus] [DB:pir2] >gp:[GI:g46602] [LN:SAIS431M] [AC:X53818:M18438] [OR:Staphylococcus aureus] [DB:genpept-bct1] [DE:S. aureus IS431mec gene associated with methicillin resistance.] [NT:putative transposase (AA 1 - 224)] [SP:P19380] [LE:272] [RE:946] [DI:direct] >gp:[GI:e1237900:g2791991] [LN:SAMECAR1I] [AC:Y14051] [PN:putative transposase] [OR:Staphylococcus aureus] [DB:genpept-bct1] [DE:Staphylococcus aureus mecA, mecR1, mecI genes and ORF168, ORF142,ORF44, ORF145 and ORF224.] [NT:ORF224] [LE:8096] [RE:8770] [DI:direct] >gp:[GI:d1046034:g5360858] [LN:D86934] [AC:D86934] [PN:transposase for insertion sequence-like element] [OR:Staphylococcus aureus] [SR:Staphylococcus aureus (strain:N315) DNA, clone_lib:library of N31] [DB:genpept] [DE:Staphylococcus aureus genes, mec region, partial and complete cds.] [NT:ORF N062] [LE:48054] [RE:48728] [DI:direct] >gp:[GI:d1046044:g5360868] [LN:D86934] [AC:D86934] [PN:transposase for insertion sequence-like element] [OR:Staphylococcus aureus] [SR:Staphylococcus aureus (strain:N315) DNA, clone_lib:library of N31] [DB:genpept] [DE:Staphylococcus aureus genes, mec region, partial and complete cds.] [NT:ORF N070] [LE:53400] [RE:54074] [DI:direct]

| ORF_Name | NTID | AAID | NT Length | AA Length | score | probability |
|---|---|---|---|---|---|---|
| AI7503000999_16975082_c1_860 | 2961 | 6733 | 306 | 101 | | |

Description

NO-HIT

| ORF_Name | NTID | AAID | NT Length | AA Length | score | probability |
|---|---|---|---|---|---|---|
| AI7503000999_17004551_f1_11 | 2962 | 6734 | 144 | 47 | | |

Description

NO-HIT

| ORF Name | NTID | AAID | NT Length | AA Length | score | probability |
|---|---|---|---|---|---|---|
| AI7503000999_193812_c1_810 | 2963 | 6735 | 129 | 42 | | |

Description
NO-HIT

| ORF Name | NTID | AAID | NT Length | AA Length | score | probability |
|---|---|---|---|---|---|---|
| AI7503000999_19531308_c1_778 | 2964 | 6736 | 129 | 42 | | |

Description
NO-HIT

| ORF Name | NTID | AAID | NT Length | AA Length | score | probability |
|---|---|---|---|---|---|---|
| AI7503000999_19548192_c3_1120 | 2965 | 6737 | 765 | 254 | 68 | 0.00074 |

Description
pir:[LN:S44477] [AC:S44477:S58747 ] [PN:NADH dehydrogenase (ubiquinone), chain 4L] [GN:ND4L ] [CL:NADH dehydrogenase (ubiquinone) chain 4L] [OR:mitochondrion Hansenula wingei] [EC:1.6.5.3] [DB:pir2]

| ORF Name | NTID | AAID | NT Length | AA Length | score | probability |
|---|---|---|---|---|---|---|
| AI7503000999_1960300_f1_181 | 2966 | 6738 | 201 | 66 | | |

Description
NO-HIT

| ORF Name | NTID | AAID | NT Length | AA Length | score | probability |
|---|---|---|---|---|---|---|
| AI7503000999_19613436_f2_338 | 2967 | 6739 | 162 | 53 | | |

Description
NO-HIT

| ORF Name | NTID | AAID | NT Length | AA Length | score | probability |
|---|---|---|---|---|---|---|
| AI7503000999_19647213_c3_1213 | 2968 | 6740 | 342 | 113 | 157 | 1.7e-11 |

Description
pir:[LN:C69774] [AC:C69774 ] [PN:transcription regulator phage-related homolog ydcN] [GN:ydcN ] [OR:Bacillus subtilis] [DB:pir2] >gp:[GI:d1020073:g1881293] [LN:AB001488] [AC:AB001488] [GN:ydcN] [OR:Bacillus subtilis] [SR:Bacillus subtilis (strain:168) DNA] [DB:genpept-bct1] [DE:Bacillus subtilis genome sequence, 148 kb sequence of the regionbetween 35 and 47 degree.] [NT:PROBABLE REPRESSOR PROTEIN.] [LE:64366] [RE:64749] [DI:complement] >gp:[GI:e1182448:g2632782] [LN:BSUB0003] [AC:Z99106:AL009126] [GN:ydcN] [FN:unknown] [OR:Bacillus subtilis] [DB:genpept-bct1] [DE:Bacillus subtilis complete genome (section 3 of 21): from 402751 to611850.] [NT:similar to transcriptional regulator] [LE:128111] [RE:128494] [DI:complement]

| ORF Name | NTID | AAID | NT Length | AA Length | score | probability |
|---|---|---|---|---|---|---|
| AI7503000999_19719812_c1_877 | 2969 | 6741 | 474 | 157 | 803 | 6.0e-80 |

Description sp:[LN:TRA1_STAAU] [AC:P14506] [OR:STAPHYLOCOCCUS AUREUS] [DE:TRANSPOSASE FOR INSERTION SEQUENCE ELEMENT IS257 IN TRANSPOSON TN4003] [SP:P14506] [DB:swissprot]
>pir:[LN:S04162] [AC:S04162 ] [PN:transposase 1] [OR:Staphylococcus aureus] [DB:pir2]
>gp:[GI:g46748] [LN:SATN4003] [AC:X13290] [OR:Staphylococcus aureus] [DB:genpept-bct1]
[DE:Staphylococcus aureus multi-resistance plasmid pSK1 DNA containingtransposon
Tn4003.] [NT:transposase (AA 1-224)] [SP:P14506] [LE:89] [RE:763] [DI:complement]
>gp:[GI:g46753] [LN:SATN4003] [AC:X13290] [OR:Staphylococcus aureus] [DB:genpept-bct1]
[DE:Staphylococcus aureus multi-resistance plasmid pSK1 DNA containingtransposon
Tn4003.] [NT:transposase (AA 1-224)] [SP:P14506] [LE:4017] [RE:4691] [DI:complement]
>gp:[GI:g1762092] [LN:SEU40381] [AC:U40381] [PN:transposase] [GN:tnp]
[OR:Staphylococcus epidermidis] [DB:genpept-bct1] [DE:Staphyloccous epidermidis plasmid
pSK697 insertion sequenceIS257(697A) putative transposase gene, complete cds.] [NT:Tnp;
putative transposase] [LE:57] [RE:731] [DI:direct] >gp:[GI:g1762098] [LN:SEU40384]
[AC:U40384] [PN:transposase] [GN:tnp] [OR:Staphylococcus epidermidis] [DB:genpept-bct1]
[DE:Staphyloccous epidermidis plasmid pSK818 insertion sequenceIS257(818A) putative
transposase gene, complete cds.] [NT:Tnp; putative transposase] [LE:57] [RE:731]
[DI:direct] >gp:[GI:g3676405] [LN:AF051916] [AC:AF051916] [PN:putative transposase
TnpC] [GN:tnpC] [OR:Staphylococcus aureus] [DB:genpept-bct2] [DE:Staphylococcus aureus
plasmid pJE1 remnant of replication proteinRep (rep), trimethoprim resistance protein
DfrA (dfrA), thymidylatesynthetase ThyE (thyE), and putative transposase Tnp (tnp)
genes,complete cds; and unknown gene.] [LE:65] [RE:739] [DI:direct] >gp:[GI:g3676411]
[LN:AF051916] [AC:AF051916] [PN:putative transposase TnpE] [GN:tnpE] [OR:Staphylococcus
aureus] [DB:genpept-bct2] [DE:Staphylococcus aureus plasmid pJE1 remnant of replication
proteinRep (rep), trimethoprim resistance protein DfrA (dfrA), thymidylatesynthetase
ThyE (thyE), and putative transposase Tnp (tnp) genes,complete cds; and unknown gene.]
[LE:4409] [RE:5083] [DI:direct] >gp:[GI:g3676433] [LN:AF051917] [AC:AF051917:L19570]
[PN:putative transposase TnpC] [GN:tnpC] [OR:Staphylococcus aureus] [DB:genpept-bct2]
[DE:Staphylococcus aureus plasmid pSK41, complete sequence.] [LE:22981] [RE:23655]
[DI:direct] >gp:[GI:g1762090] [LN:SEU40259] [AC:U40259] [PN:Tnp] [GN:tnp] [FN:putative
transposase] [OR:Staphylococcus epidermidis] [DB:genpept-bct2] [DE:Staphyloccous
epidermidis trimethoprim resistance plasmid pSK639.] [LE:7281] [RE:7955] [DI:direct]

| ORF Name | NTID | AAID | NT Length | AA Length | score | probability |
|---|---|---|---|---|---|---|
| AI7503000999_19720462_f2_314 | 2970 | 6742 | 1203 | 400 | 370 | 4.6e-34 |

Description sp:[LN:YJIJ_ECOLI] [AC:P39381] [GN:YJIJ] [OR:ESCHERICHIA COLI] [DE:HYPOTHETICAL 41.4 KD
PROTEIN IN IADA-MCRD INTERGENIC REGION (F392)] [SP:P39381] [DB:swissprot]
>pir:[LN:S56557] [AC:S56557:F65247 ] [PN:hypothetical 41.4K protein (iadA-mcrD
intergenic region):hypothetical protein f392] [GN:yjiJ ] [OR:Escherichia coli]
[DB:pir2] >gp:[GI:g537173] [LN:ECOUW93] [AC:U14003] [OR:Escherichia coli]
[DB:genpept-bct1] [DE:Escherichia coli K-12 chromosomal region from 92.8 to 00.1
minutes.] [NT:ORF_f392] [LE:252329] [RE:253507] [DI:complement] >gp:[GI:g1790788]
[LN:AE000503] [AC:AE000503:U00096] [PN:putative transport protein] [GN:yjiJ]
[FN:putative transport; Not classified] [OR:Escherichia coli] [DB:genpept-bct2]
[DE:Escherichia coli K-12 MG1655 section 393 of 400 of the completegenome.] [NT:f392;
100 pct identical amino acid sequence and] [LE:10037] [RE:11215] [DI:complement]

| ORF Name | NTID | AAID | NT Length | AA Length | score | probability |
|---|---|---|---|---|---|---|
| AI7503000999_19767150_c3_1177 | 2971 | 6743 | 567 | 188 | 746 | 6.6e-74 |

Description
gp:[GI:d1046049:g5360873] [LN:D86934] [AC:D86934] [PN:orfX] [OR:Staphylococcus aureus] [SR:Staphylococcus aureus (strain:N315) DNA, clone_lib:library of N31] [DB:genpept] [DE:Staphylococcus aureus genes, mec region, partial and complete cds.] [NT:ORF CN051] [LE:56338] [RE:>56817] [DI:complement] >gp:[GI:d1046058:g5391439] [LN:AB014440] [AC:AB014440] [PN:orfX] [OR:Staphylococcus aureus] [SR:Staphylococcus aureus (strain:NCTC8325) DNA] [DB:genpept] [DE:Staphylococcus aureus genes for orf1, orfX, orf2, orf3, partial andcomplete cds.] [NT:integration site of mecDNA was predicted to locate] [LE:1396] [RE:1875] [DI:direct]

| ORF Name | NTID | AAID | NT Length | AA Length | score | probability |
|---|---|---|---|---|---|---|
| AI7503000999_19803150_f2_421 | 2972 | 6744 | 129 | 42 | | |

Description
NO-HIT

| ORF Name | NTID | AAID | NT Length | AA Length | score | probability |
|---|---|---|---|---|---|---|
| AI7503000999_20194532_c1_732 | 2973 | 6745 | 156 | 51 | | |

Description
NO-HIT

| ORF Name | NTID | AAID | NT Length | AA Length | score | probability |
|---|---|---|---|---|---|---|
| AI7503000999_20329376_f1_94 | 2974 | 6746 | 174 | 57 | 57 | 0.013 |

Description
pir:[LN:D70158] [AC:D70158 ] [PN:lipoprotein signal peptidase,] [OR:Borrelia burgdorferi] [SR:, Lyme disease spirochete] [EC:3.4.23.36] [DB:pir2] >gp:[GI:g2688373] [LN:AE001151] [AC:AE001151:AE000783] [PN:signal peptidase II (lsp)] [GN:BB0469] [OR:Borrelia burgdorferi] [SR:Lyme disease spirochete] [DB:genpept-bct2] [DE:Borrelia burgdorferi (section 37 of 70) of the complete genome.] [NT:similar to GB:X78084 PID:459545 SP:Q59835 percent] [LE:10907] [RE:11419] [DI:direct]

| ORF Name | NTID | AAID | NT Length | AA Length | score | probability |
|---|---|---|---|---|---|---|
| AI7503000999_20359682_f1_169 | 2975 | 6747 | 168 | 55 | | |

Description
NO-HIT

| ORF Name | NTID | AAID | NT Length | AA Length | score | probability |
|---|---|---|---|---|---|---|
| AI7503000999_20517318_f1_193 | 2976 | 6748 | 1200 | 399 | 1171 | 6.1e-119 |

Description
gp:[GI:e281310:g1667356] [LN:CTZ82038] [AC:Z82038] [PN:acetyl coenzyme A acetyltransferase (thiolase)] [GN:thlA] [OR:Thermoanaerobacterium thermosaccharolyticum] [DB:genpept-bct1] [EC:2.3.1.9] [DE:C.thermosaccharolyticum etfB, etfA, hbd, thlA and actA genes.] [LE:2642] [RE:3820] [DI:direct] >gp:[GI:e308220:g1903332] [LN:TTBCSOPRN] [AC:Z92974] [PN:acetyl coenzyme A acetyltransferase (thiolase)] [GN:thl] [OR:Thermoanaerobacterium thermosaccharolyticum] [DB:genpept-bct1] [EC:2.3.1.9] [DE:T.thermosaccharolyticum BCS operon DNA.] [LE:4835] [RE:6013] [DI:direct]

| ORF Name | NTID | AAID | NT Length | AA Length | score | probability |
|---|---|---|---|---|---|---|
| AI7503000999_20523253_c3_1227 | 2977 | 6749 | 252 | 83 | 447 | 3.2e-42 |

Description
sp:[LN:TRA1_STAAU] [AC:P14506] [OR:STAPHYLOCOCCUS AUREUS] [DE:TRANSPOSASE FOR INSERTION SEQUENCE ELEMENT IS257 IN TRANSPOSON TN4003] [SP:P14506] [DB:swissprot]
>pir:[LN:S04162] [AC:S04162 ] [PN:transposase 1] [OR:Staphylococcus aureus] [DB:pir2]
>gp:[GI:g46748] [LN:SATN4003] [AC:X13290] [OR:Staphylococcus aureus] [DB:genpept-bct1] [DE:Staphylococcus aureus multi-resistance plasmid pSK1 DNA containingtransposon Tn4003.] [NT:transposase (AA 1-224)] [SP:P14506] [LE:89] [RE:763] [DI:complement]
>gp:[GI:g46753] [LN:SATN4003] [AC:X13290] [OR:Staphylococcus aureus] [DB:genpept-bct1] [DE:Staphylococcus aureus multi-resistance plasmid pSK1 DNA containingtransposon Tn4003.] [NT:transposase (AA 1-224)] [SP:P14506] [LE:4017] [RE:4691] [DI:complement]
>gp:[GI:g1762092] [LN:SEU40381] [AC:U40381] [PN:transposase] [GN:tnp] [OR:Staphylococcus epidermidis] [DB:genpept-bct1] [DE:Staphyloccous epidermidis plasmid pSK697 insertion sequenceIS257(697A) putative transposase gene, complete cds.] [NT:Tnp; putative transposase] [LE:57] [RE:731] [DI:direct] >gp:[GI:g1762098] [LN:SEU40384] [AC:U40384] [PN:transposase] [GN:tnp] [OR:Staphylococcus epidermidis] [DB:genpept-bct1] [DE:Staphyloccous epidermidis plasmid pSK818 insertion sequenceIS257(818A) putative transposase gene, complete cds.] [NT:Tnp; putative transposase] [LE:57] [RE:731] [DI:direct] >gp:[GI:g3676405] [LN:AF051916] [AC:AF051916] [PN:putative transposase TnpC] [GN:tnpC] [OR:Staphylococcus aureus] [DB:genpept-bct2] [DE:Staphylococcus aureus plasmid pJE1 remnant of replication proteinRep (rep), trimethoprim resistance protein DfrA (dfrA), thymidylatesynthetase ThyE (thyE), and putative transposase Tnp (tnp) genes,complete cds; and unknown gene.] [LE:65] [RE:739] [DI:direct] >gp:[GI:g3676411] [LN:AF051916] [AC:AF051916] [PN:putative transposase TnpE] [GN:tnpE] [OR:Staphylococcus aureus] [DB:genpept-bct2] [DE:Staphylococcus aureus plasmid pJE1 remnant of replication proteinRep (rep), trimethoprim resistance protein DfrA (dfrA), thymidylatesynthetase ThyE (thyE), and putative transposase Tnp (tnp) genes,complete cds; and unknown gene.] [LE:4409] [RE:5083] [DI:direct] >gp:[GI:g3676433] [LN:AF051917] [AC:AF051917:L19570] [PN:putative transposase TnpC] [GN:tnpC] [OR:Staphylococcus aureus] [DB:genpept-bct2] [DE:Staphylococcus aureus plasmid pSK41, complete sequence.] [LE:22981] [RE:23655] [DI:direct] >gp:[GI:g1762090] [LN:SEU40259] [AC:U40259] [PN:Tnp] [GN:tnp] [FN:putative transposase] [OR:Staphylococcus epidermidis] [DB:genpept-bct2] [DE:Staphyloccous epidermidis trimethoprim resistance plasmid pSK639.] [LE:7281] [RE:7955] [DI:direct]

| ORF Name | NTID | AAID | NT Length | AA Length | score | probability |
|---|---|---|---|---|---|---|
| AI7503000999_20585963_c3_1206 | 2978 | 6750 | 348 | 115 | 478 | 1.7e-45 |

Description
gp:[GI:d1045998:g5360822] [LN:D86934] [AC:D86934] [PN:IS150-like transposase] [OR:Staphylococcus aureus] [SR:Staphylococcus aureus (strain:N315) DNA, clone_lib:library of N31] [DB:genpept] [DE:Staphylococcus aureus genes, mec region, partial and complete cds.] [NT:ORF N027; putative] [LE:19826] [RE:20179] [DI:direct]

| ORF Name | NTID | AAID | NT Length | AA Length | score | probability |
|---|---|---|---|---|---|---|
| AI7503000999_20585963_c3_1283 | 2979 | 6751 | 906 | 301 | 647 | 2.0e-63 |

Description gp:[GI:g929972] [LN:BAU30714] [AC:U30714] [OR:Bacillus anthracis] [SR:plasmid pXO1] [DB:genpept-bct1] [DE:Bacillus anthracis Weybridge A toxin plasmid pXO1 right invertedrepeat element (WeyAR) bordering the toxin-encoding region, ORFAand ORFB genes, complete cds.] [NT:ORFB; similar to B. anthracis SterneL element ORFB;] [LE:512] [RE:1336] [DI:direct] >gp:[GI:g929975] [LN:BAU30715] [AC:U30715] [OR:Bacillus anthracis] [SR:plasmid pXO1] [DB:genpept-bct1] [DE:Bacillus anthracis Sterne toxin plasmid pXO1 left inverted repeatelement (SterneL) bordering the toxin-encoding region, ORFB andtruncated ORFA genes, complete cds.] [NT:ORFB; similar to B. anthracis WeyAR element ORFB;] [LE:458] [RE:1282] [DI:direct] >gp:[GI:g4894312] [LN:AF065404] [AC:AF065404] [PN:pXO1-96] [OR:Bacillus anthracis] [DB:genpept-bct2] [DE:Bacillus anthracis virulence plasmid PX01, complete sequence.] [LE:116307] [RE:117131] [DI:direct]

| ORF Name | NTID | AAID | NT Length | AA Length | score | probability |
|---|---|---|---|---|---|---|
| AI7503000999_20964212_c3_1232 | 2980 | 6752 | 1692 | 563 | 652 | 6.0e-64 |

Description gp:[GI:d1046002:g5360826] [LN:D86934] [AC:D86934] [PN:site-specific recombinase] [GN:ccrB] [OR:Staphylococcus aureus] [SR:Staphylococcus aureus (strain:N315) DNA, clone_lib:library of N31] [DB:genpept] [DE:Staphylococcus aureus genes, mec region, partial and complete cds.] [NT:ORF N037; cassette chromosome recombinase B] [LE:25508] [RE:27136] [DI:direct]

| ORF Name | NTID | AAID | NT Length | AA Length | score | probability |
|---|---|---|---|---|---|---|
| AI7503000999_2116643_f3_472 | 2981 | 6753 | 189 | 62 | 47 | 0.0062 |

Description sp:[LN:TYB4_MOUSE] [AC:P20065] [GN:TMSB4:PTMB4] [OR:MUS MUSCULUS] [SR:,MOUSE] [DE:THYMOSIN BETA-4] [SP:P20065] [DB:swissprot] >pir:[LN:A37217] [AC:A37217:S08074:S12884 ] [PN:thymosin beta-4] [CL:thymosin beta] [OR:Mus musculus] [SR:, house mouse] [DB:pir2] >gp:[GI:g54794] [LN:MMTHYB4] [AC:X16053:M38039:M54991] [OR:Mus musculus] [SR:house mouse] [DB:genpept-rod] [DE:Mouse mRNA for thymosin beta-4.] [NT:thymosin beta-4a (AA 1 - 50)] [SP:P20065] [LE:140] [RE:292] [DI:direct]

| ORF Name | NTID | AAID | NT Length | AA Length | score | probability |
|---|---|---|---|---|---|---|
| AI7503000999_2120265_c3_1214 | 2982 | 6754 | 870 | 289 | 151 | 6.1e-08 |

Description pir:[LN:S76167] [AC:S76167 ] [PN:hypothetical protein] [OR:Synechocystis sp.] [SR:PCC 6803, , PCC 6803] [SR:PCC 6803, ] [DB:pir2] >gp:[GI:d1019159:g1653513] [LN:D90914] [AC:D90914:AB001339] [PN:hypothetical protein] [OR:Synechocystis sp.] [SR:Synechocystis sp. (strain:PCC6803) DNA] [DB:genpept-bct1] [DE:Synechocystis sp. PCC6803 complete genome, 16/27, 1991550-2137258.] [NT:ORF_ID:slr0959] [LE:37283] [RE:38872] [DI:direct]

| ORF Name | NTID | AAID | NT Length | AA Length | score | probability |
|---|---|---|---|---|---|---|
| AI7503000999_2128400_f1_188 | 2983 | 6755 | 138 | 45 | | |

Description

NO-HIT

| ORF Name | NTID | AAID | NT Length | AA Length | score | probability |
|---|---|---|---|---|---|---|
| AI7503000999_2148468_f2_400 | 2984 | 6756 | 2073 | 690 | 1718 | 6.6e-177 |

Description
gp:[GI:g3789932] [LN:AF090142] [AC:AF090142] [PN:lipase precursor] [GN:gehD] [OR:Staphylococcus epidermidis] [DB:genpept-bct2] [EC:3.1.1.3] [DE:Staphylococcus epidermidis lipase precursor (gehD) gene, completecds.] [NT:GehD] [LE:293] [RE:2224] [DI:direct]

| ORF Name | NTID | AAID | NT Length | AA Length | score | probability |
|---|---|---|---|---|---|---|
| AI7503000999_21506575_c1_702 | 2985 | 6757 | 897 | 298 | 331 | 6.2e-30 |

Description
pir:[LN:JC5911] [AC:JC5911 ] [PN:lysin] [GN:lys ] [OR:Lactobacillus phage phi-gle] [DB:pir2]

| ORF Name | NTID | AAID | NT Length | AA Length | score | probability |
|---|---|---|---|---|---|---|
| AI7503000999_21521878_c1_795 | 2986 | 6758 | 354 | 117 | 181 | 1.2e-12 |

Description
pir:[LN:F64114] [AC:F64114 ] [PN:type I site-specific deoxyribonuclease, chain hsdR] [GN:hsdR ] [CL:DEAD/H box helicase homology] [OR:Haemophilus influenzae] [EC:3.1.21.3] [DB:pir2] >gp:[GI:g1574743] [LN:U32808] [AC:U32808:L42023] [PN:type I restriction enzyme (hsdR)] [GN:HI1285] [OR:Haemophilus influenzae Rd] [DB:genpept-bct2] [DE:Haemophilus influenzae Rd section 123 of 163 of the completegenome.] [NT:similar to PID:1685100 percent identity: 59.01;] [LE:5702] [RE:8869] [DI:complement]

| ORF Name | NTID | AAID | NT Length | AA Length | score | probability |
|---|---|---|---|---|---|---|
| AI7503000999_21532937_f2_349 | 2987 | 6759 | 129 | 42 | | |

Description
NO-HIT

| ORF Name | NTID | AAID | NT Length | AA Length | score | probability |
|---|---|---|---|---|---|---|
| AI7503000999_21644175_c3_1179 | 2988 | 6760 | 273 | 90 | 439 | 2.2e-41 |

Description
gp:[GI:d1046045:g5360869] [LN:D86934] [AC:D86934] [OR:Staphylococcus aureus] [SR:Staphylococcus aureus (strain:N315) DNA, clone_lib:library of N31] [DB:genpept] [DE:Staphylococcus aureus genes, mec region, partial and complete cds.] [NT:ORF CN049] [LE:54106] [RE:>54378] [DI:complement]

| ORF Name | NTID | AAID | NT Length | AA Length | score | probability |
|---|---|---|---|---|---|---|
| AI7503000999_21660805_f1_145 | 2989 | 6761 | 1017 | 338 | 867 | 9.9e-87 |

Description
gp:[GI:g3044072] [LN:AF055713] [AC:AF055713] [PN:beta-hemolysin] [GN:hlb] [OR:Staphylococcus schleiferi] [DB:genpept-bct2] [DE:Staphylococcus schleiferi beta-hemolysin (hlb) gene, partial cds.] [LE:1] [RE:>987] [DI:direct]

| ORF Name | NTID | AAID | NT Length | AA Length | score | probability |
|---|---|---|---|---|---|---|
| AI7503000999_21736277_f2_365 | 2990 | 6762 | 171 | 56 | | |

Description
NO-HIT

| ORF Name | NTID | AAID | NT Length | AA Length | score | probability |
|---|---|---|---|---|---|---|
| AI7503000999_22078331_f2_355 | 2991 | 6763 | 180 | 59 | | |

Description
NO-HIT

| ORF Name | NTID | AAID | NT Length | AA Length | score | probability |
|---|---|---|---|---|---|---|
| AI7503000999_2209675_f1_61 | 2992 | 6764 | 1470 | 489 | 465 | 3.9e-44 |

Description
sp:[LN:TYD2_PETCR] [AC:Q06086] [GN:TYRDC-2] [OR:PETROSELINUM CRISPUM]
[SR:,PARSLEY:PETROSELINUM HORTENSE] [EC:4.1.1.25] [DE:TYROSINE DECARBOXYLASE 2,]
[SP:Q06086] [DB:swissprot] >pir:[LN:A44405] [AC:A44405 ] [PN:tyrosine decarboxylase,]
[GN:tyrCD ] [CL:aromatic-L-amino-acid decarboxylase:animal histidine decarboxylase
homology] [OR:Petroselinum crispum] [SR:, parsley] [EC:4.1.1.25] [DB:pir2]
>gp:[GI:g169671] [LN:PUMTRYDC2X] [AC:M96070] [PN:tyrosine decarboxylase] [GN:TryDC-2]
[OR:Petroselinum crispum] [SR:Petroselinum crispum (library: lambda gt11) cDNA to mRNA]
[DB:genpept-pln1] [EC:4.1.1.25] [DE:Parsley tyrosine decarboxylase (TryDC-2) mRNA,
complete cds.] [LE:4] [RE:1548] [DI:direct]

| ORF Name | NTID | AAID | NT Length | AA Length | score | probability |
|---|---|---|---|---|---|---|
| AI7503000999_2214217_c2_984 | 2993 | 6765 | 1845 | 614 | 2888 | 6.9e-301 |

Description
gp:[GI:g5114231] [LN:AF136709] [AC:AF136709] [PN:histidine kinase YycG] [GN:yycG]
[OR:Staphylococcus aureus] [DB:genpept] [DE:Staphylococcus aureus response regulator
YycF (yycF) and histidinekinase YycG (yycG) genes, complete cds.] [LE:1363] [RE:3189]
[DI:direct]

| ORF Name | NTID | AAID | NT Length | AA Length | score | probability |
|---|---|---|---|---|---|---|
| AI7503000999_22275082_f2_264 | 2994 | 6766 | 135 | 44 | | |

Description
NO-HIT

| ORF Name | NTID | AAID | NT Length | AA Length | score | probability |
|---|---|---|---|---|---|---|
| AI7503000999_22291327_c2_908 | 2995 | 6767 | 141 | 46 | | |

Description
NO-HIT

| ORF Name | NTID | AAID | NT Length | AA Length | score | probability |
|---|---|---|---|---|---|---|
| AI7503000999_22383437_f2_293 | 2996 | 6768 | 321 | 106 | 80 | 0.0091 |

Description
pir:[LN:S29577] [AC:I51043:S29577 ] [PN:Ig light chain] [GN:IgL ] [OR:Oncorhynchus
mykiss] [SR:, rainbow trout] [DB:pir2]

| ORF Name | NTID | AAID | NT Length | AA Length | score | probability |
|---|---|---|---|---|---|---|
| AI7503000999_22475037_c3_1209 | 2997 | 6769 | 126 | 41 | 114 | 2.3e-06 |

Description
gp:[GI:g2605928] [LN:AF029727] [AC:AF029727] [OR:Enterococcus faecium]
[DB:genpept-bct2] [DE:Enterococcus faecium insertion sequence IS1485, complete
sequence.] [NT:putative; orfB] [LE:402] [RE:1238] [DI:direct]

| ORF_Name | NTID | AAID | NT Length | AA Length | score | probability |
|---|---|---|---|---|---|---|
| AI7503000999_22537563_c1_840 | 2998 | 6770 | 231 | 76 | | |

Description
NO-HIT

| ORF_Name | NTID | AAID | NT Length | AA Length | score | probability |
|---|---|---|---|---|---|---|
| AI7503000999_22679825_f1_84 | 2999 | 6771 | 168 | 55 | 111 | 7.6e-06 |

Description
pir:[LN:B69978] [AC:B69978 ] [PN:2-nitropropane dioxygenase homolog yrpB] [GN:yrpB ] [OR:Bacillus subtilis] [DB:pir2] >gp:[GI:g1934639] [LN:BSU93875] [AC:U93875] [PN:2-nitropropane dioxygenase] [GN:yrpB] [OR:Bacillus subtilis] [DB:genpept-bct1] [DE:Bacillus subtilis alcohol dehydrogenase (adhB) gene, partial cds,hypothetical spore coat protein (yraF), hypothetical spore coatprotein (yraG), YraH (yraH), YraI (yraI), YraJ (yraJ), YraK (yraK),YraL (yraL), chitosanase precursor (csn), YraM (yraM), LysR-familytranscription regulator (yraN), YraO (yraO), YrpG (yrpG), RNApolymerase sigma factor SigZ (sigZ), YrpE (yrpE), YrpD (yrpD), YrpC(yrpC) and 2-nitropropane dioxygenase (yrpB) genes, complete cds,and aminoglycoside 6-adenylyltransferase (aadK) gene, partial cds.] [NT:similar to 2-nitropropane dioxigenase of Williopsis] [LE:16473] [RE:17516] [DI:complement] >gp:[GI:e1183909:g2635125] [LN:BSUB0014] [AC:Z99117:AL009126] [GN:yrpB] [FN:unknown] [OR:Bacillus subtilis] [DB:genpept-bct1] [DE:Bacillus subtilis complete genome (section 14 of 21): from 2599451to 2812870.] [NT:similar to 2-nitropropane dioxygenase] [LE:136734] [RE:137777] [DI:direct]

| ORF_Name | NTID | AAID | NT Length | AA Length | score | probability |
|---|---|---|---|---|---|---|
| AI7503000999_22900337_c2_906 | 3000 | 6772 | 135 | 44 | | |

Description
NO-HIT

| ORF_Name | NTID | AAID | NT Length | AA Length | score | probability |
|---|---|---|---|---|---|---|
| AI7503000999_22902302_c1_767 | 3001 | 6773 | 1407 | 468 | 2010 | 7.5e-208 |

Description
sp:[LN:SYS_STAAU] [AC:P95689] [GN:SERS] [OR:STAPHYLOCOCCUS AUREUS] [EC:6.1.1.11] [DE:SERYL-TRNA SYNTHETASE, (SERINE--TRNA LIGASE) (SERRS)] [SP:P95689] [DB:swissprot] >gp:[GI:e291101:g1835218] [LN:SASERS] [AC:Y09924] [PN:seryl-trna synthetase] [GN:serS] [OR:Staphylococcus aureus] [DB:genpept-bct1] [EC:6.1.1.11] [DE:S.aureus serS gene.] [SP:P95689] [LE:1] [RE:1287] [DI:direct]

| ORF_Name | NTID | AAID | NT Length | AA Length | score | probability |
|---|---|---|---|---|---|---|
| AI7503000999_23437803_f3_452 | 3002 | 6774 | 714 | 237 | 129 | 7.7e-07 |

Description
gp:[GI:g4981720] [LN:AE001774] [AC:AE001774:AE000512] [PN:transcriptional regulator, crp family] [GN:TM1171] [OR:Thermotoga maritima] [DB:genpept-bct2] [DE:Thermotoga maritima section 86 of 136 of the complete genome.] [NT:similar to GB:Z26044 SP:P47200 PID:398391 percent] [LE:5164] [RE:5769] [DI:complement]

| ORF_Name | NTID | AAID | NT Length | AA Length | score | probability |
|---|---|---|---|---|---|---|
| AI7503000999_23438301_f1_87 | 3003 | 6775 | 255 | 84 | | |

Description
NO-HIT

| ORF_Name | NTID | AAID | NT Length | AA Length | score | probability |
|---|---|---|---|---|---|---|
| AI7503000999_23438876_f3_528 | 3004 | 6776 | 258 | 85 | | |

Description
NO-HIT

| ORF_Name | NTID | AAID | NT Length | AA Length | score | probability |
|---|---|---|---|---|---|---|
| AI7503000999_23439193_c3_1263 | 3005 | 6777 | 495 | 164 | 453 | 7.4e-43 |

Description
pir:[LN:G69784] [AC:G69784 ] [PN:hypothetical protein ydhK] [GN:ydhK ] [OR:Bacillus subtilis] [DB:pir2] >gp:[GI:e1182558:g2632892] [LN:BSUB0004] [AC:Z99107:AL009126] [GN:ydhK] [FN:unknown] [OR:Bacillus subtilis] [DB:genpept-bct1] [DE:Bacillus subtilis complete genome (section 4 of 21): from 600701 to813890.] [LE:23509] [RE:24126] [DI:direct] >gp:[GI:d1020482:g1945095] [LN:D88802] [AC:D88802] [GN:ydhK] [OR:Bacillus subtilis] [SR:Bacillus subtilis (sub_species:Marburg, strain:168, isolate:JH642) [DB:genpept-bct1] [DE:Bacillus subtilis DNA for phoB-rrnE-groESL region, complete cds.] [NT:membrane protein] [LE:10511] [RE:11128] [DI:direct]

| ORF_Name | NTID | AAID | NT Length | AA Length | score | probability |
|---|---|---|---|---|---|---|
| AI7503000999_2345025_c2_913 | 3006 | 6778 | 144 | 47 | | |

Description
NO-HIT

| ORF_Name | NTID | AAID | NT Length | AA Length | score | probability |
|---|---|---|---|---|---|---|
| AI7503000999_23462762_c3_1097 | 3007 | 6779 | 1527 | 508 | 2298 | 2.3e-238 |

Description
sp:[LN:AHPF_STAAU] [AC:O05204] [GN:AHPF] [OR:STAPHYLOCOCCUS AUREUS] [EC:1.6.4.-] [DE:ALKYL HYDROPEROXIDE REDUCTASE SUBUNIT F,] [SP:O05204] [DB:swissprot] >gp:[GI:g1916317] [LN:SAU92441] [AC:U92441:X85029] [PN:alkyl hydroperoxide reductase subunit F] [GN:ahpF] [OR:Staphylococcus aureus] [DB:genpept-bct1] [DE:Staphylococcus aureus alkyl hydroperoxide reductase subunit C(aphC) and subunit F (aphF) genes, complete cds.] [NT:AhpF] [LE:1376] [RE:2899] [DI:direct]

| ORF_Name | NTID | AAID | NT Length | AA Length | score | probability |
|---|---|---|---|---|---|---|
| AI7503000999_23468762_f3_521 | 3008 | 6780 | 132 | 43 | | |

Description
NO-HIT

| ORF_Name | NTID | AAID | NT Length | AA Length | score | probability |
|---|---|---|---|---|---|---|
| AI7503000999_23507_c1_765 | 3009 | 6781 | 2709 | 902 | 3998 | 0.0 |

Description
gp:[GI:d1001842:g540542] [LN:STAGYRABA] [AC:D10489] [PN:DNA gyrase A] [GN:gyrA] [OR:Staphylococcus aureus] [SR:Staphylococcus aureus (strain:ATCC12600) DNA] [DB:genpept-bct1] [EC:5.99.1.3] [DE:Staphylococcus aureus genes for DNA gyrase A and B, complete cds.] [LE:2152] [RE:4815] [DI:direct]

| ORF_Name | NTID | AAID | NT Length | AA Length | score | probability |
|---|---|---|---|---|---|---|
| AI7503000999_23537785_f2_233 | 3010 | 6782 | 138 | 45 | | |

Description
NO-HIT

| ORF Name | NTID | AAID | NT Length | AA Length | score | probability |
|---|---|---|---|---|---|---|
| AI7503000999_23538427_c2_887 | 3011 | 6783 | 309 | 102 | 132 | 8.3e-09 |

Description
pir:[LN:F71456] [AC:F71456 ] [PN:hypothetical protein PH0308] [GN:PH0308 ]
[OR:Pyrococcus horikoshii] [DB:pir2] >gp:[GI:d1030324:g3256698] [LN:AP000001]
[AC:AP000001:AB009465:AB009464:AB009466:AB009467:AB009468:AB009469] [PN:215aa long
hypothetical protein] [GN:PH0308] [OR:Pyrococcus horikoshii] [SR:Pyrococcus horikoshii
(strain:OT3) DNA] [DB:genpept-bct1] [DE:Pyrococcus horikoshii OT3 genomic DNA, 1-287000
nt. position (1/7).] [NT:motif=prokaryotic membrane lipoprotein lipid] [LE:271764]
[RE:272411] [DI:complement]

| ORF Name | NTID | AAID | NT Length | AA Length | score | probability |
|---|---|---|---|---|---|---|
| AI7503000999_23556577_f1_99 | 3012 | 6784 | 324 | 107 | | |

Description
NO-HIT

| ORF Name | NTID | AAID | NT Length | AA Length | score | probability |
|---|---|---|---|---|---|---|
| AI7503000999_23563500_c1_706 | 3013 | 6785 | 156 | 51 | | |

Description
NO-HIT

| ORF Name | NTID | AAID | NT Length | AA Length | score | probability |
|---|---|---|---|---|---|---|
| AI7503000999_235678_f2_239 | 3014 | 6786 | 216 | 71 | 203 | 2.3e-16 |

Description
pir:[LN:F69903] [AC:F69903 ] [PN:D-alanyl-D-alanine carboxypeptidase homolog yodJ]
[GN:yodJ ] [OR:Bacillus subtilis] [DB:pir2] >gp:[GI:g2415396] [LN:AF015775]
[AC:AF015775] [PN:carboxypeptidase] [GN:yodJ] [OR:Bacillus subtilis] [DB:genpept-bct1]
[DE:Bacillus subtilis YodA (yodA), YodB (yodB), YodC (yodC), YodD(yodD),
ABC-transporter (yodE), permease (yodF), proteinase (ctpA),YodH (yodH), YodI (yodI),
carboxypeptidase (yodJ), purinenucleoside phosphorylase (deoD), YodL (yodL), YodM
(yodM), YodN(yodN), YodO (yodO), YodP (yodP), acetylornitine deacetylase(argE),
butirate-acetoacetate CoA transferase (yodR), butyrateacetoacetate-CoA transferase
(yodS), YodT (yodT), CgeE (cgeE), CgeD(cgeD), CgeC (cgeC), CgeA (cgeA), CgeB (cgeB),
YzxA (yzxA),UDP-glucose epimerase (yodU), YodV (yodV), and YodW (yodW) genes,complete
cds; and YodZ (yodZ) gene, partial cds.] [NT:similar to Enterococcus faecium
D-alanil-D-alanine] [LE:8510] [RE:9331] [DI:complement] >gp:[GI:e1185433:g2634354]
[LN:BSUB0011] [AC:Z99114:AL009126] [GN:yodJ] [FN:unknown] [OR:Bacillus subtilis]
[DB:genpept-bct1] [DE:Bacillus subtilis complete genome (section 11 of 21): from
2000171to 2207900.] [NT:similar to D-alanyl-D-alanine carboxypeptidase] [LE:133640]
[RE:134461] [DI:complement]

| ORF Name | NTID | AAID | NT Length | AA Length | score | probability |
|---|---|---|---|---|---|---|
| AI7503000999_23610885_c1_820 | 3015 | 6787 | 126 | 41 | | |

Description
NO-HIT

| ORF Name | NTID | AAID | NT Length | AA Length | score | probability |
|---|---|---|---|---|---|---|
| AI7503000999_23610952_c2_1082 | 3016 | 6788 | 855 | 284 | 305 | 3.6e-27 |

Description
pir:[LN:H69468] [AC:H69468 ] [PN:lysophospholipase homolog] [OR:Archaeoglobus fulgidus] [DB:pir2] >gp:[GI:g2648798] [LN:AE000982] [AC:AE000982:AE000782] [PN:lysophospholipase] [GN:AF1753] [OR:Archaeoglobus fulgidus] [DB:genpept-bct2] [DE:Archaeoglobus fulgidus section 125 of 172 of the complete genome.] [NT:similar to GP:1763011 percent identity: 33.46;] [LE:10776] [RE:11576] [DI:complement]

| ORF Name | NTID | AAID | NT Length | AA Length | score | probability |
|---|---|---|---|---|---|---|
| AI7503000999_23612907_c1_696 | 3017 | 6789 | 144 | 47 | | |

Description
NO-HIT

| ORF Name | NTID | AAID | NT Length | AA Length | score | probability |
|---|---|---|---|---|---|---|
| AI7503000999_23631512_c3_1178 | 3018 | 6790 | 1323 | 440 | 2289 | 2.0e-237 |

Description
gp:[GI:d1046046:g5360870] [LN:D86934] [AC:D86934] [OR:Staphylococcus aureus] [SR:Staphylococcus aureus (strain:N315) DNA, clone_lib:library of N31] [DB:genpept] [DE:Staphylococcus aureus genes, mec region, partial and complete cds.] [NT:ORF CN050] [LE:54760] [RE:>56082] [DI:complement]

| ORF Name | NTID | AAID | NT Length | AA Length | score | probability |
|---|---|---|---|---|---|---|
| AI7503000999_23632883_c1_844 | 3019 | 6791 | 183 | 60 | | |

Description
NO-HIT

| ORF Name | NTID | AAID | NT Length | AA Length | score | probability |
|---|---|---|---|---|---|---|
| AI7503000999_23634682_c2_1013 | 3020 | 6792 | 375 | 124 | | |

Description
NO-HIT

| ORF Name | NTID | AAID | NT Length | AA Length | score | probability |
|---|---|---|---|---|---|---|
| AI7503000999_23634786_f3_619 | 3021 | 6793 | 1200 | 399 | 692 | 3.5e-68 |

Description
gp:[GI:d1025735:g2879915] [LN:D85752] [AC:D85752] [GN:bacI] [OR:Enterococcus faecalis] [SR:Enterococcus faecalis plasmid:pPD1 DNA] [DB:genpept-bct1] [DE:Enterococcus faecalis plasmid pPD1 bacA, bacB, bacC, bacD, bacE,bacF, bacG, bacH and bacI genes, complete cds.] [LE:7732] [RE:8931] [DI:direct]

| ORF Name | NTID | AAID | NT Length | AA Length | score | probability |
|---|---|---|---|---|---|---|
| AI7503000999_23635302_c1_867 | 3022 | 6794 | 138 | 45 | | |

Description
NO-HIT

| ORF Name | NTID | AAID | NT Length | AA Length | score | probability |
|---|---|---|---|---|---|---|
| AI7503000999_23635931_c1_854 | 3023 | 6795 | 375 | 124 | 637 | 2.3e-62 |

Description
sp:[LN:MERT_STAAU] [AC:P08656] [GN:MERT] [OR:STAPHYLOCOCCUS AUREUS] [DE:MERCURIC TRANSPORT PROTEIN (MERCURY ION TRANSPORT PROTEIN)] [SP:P08656] [DB:swissprot] >pir:[LN:D29504] [AC:D29504 ] [PN:hypothetical 14K protein (mer operon)] [OR:Staphylococcus aureus] [DB:pir2] >gp:[GI:g459906] [LN:L29436] [AC:L29436:M15048:N00048] [GN:mert] [OR:Plasmid pI258] [SR:Plasmid pI258 DNA] [DB:genpept-bct1] [DE:Plasmid pI258 (from S.aureus strain RN23 8325) mercury resistance(mer) operon encoding mercuric reductase (merA), organomercuriallyase (merB), regulatory protein (merR) and membrane transportprotein (merT), complete cds.] [LE:2704] [RE:3090] [DI:direct]

| ORF Name | NTID | AAID | NT Length | AA Length | score | probability |
|---|---|---|---|---|---|---|
| AI7503000999_23679765_f3_449 | 3024 | 6796 | 1269 | 422 | 1274 | 7.4e-130 |

Description
gp:[GI:e1299582:g3687416] [LN:BLY17554] [AC:Y17554] [PN:arginine deiminase] [GN:arcA] [OR:Bacillus licheniformis] [DB:genpept-bct1] [EC:3.5.3.6] [DE:Bacillus licheniformis arcA, arcB, arcC and arcD genes.] [LE:248] [RE:1489] [DI:direct]

| ORF Name | NTID | AAID | NT Length | AA Length | score | probability |
|---|---|---|---|---|---|---|
| AI7503000999_23703175_c3_1103 | 3025 | 6797 | 135 | 44 | | |

Description
NO-HIT

| ORF Name | NTID | AAID | NT Length | AA Length | score | probability |
|---|---|---|---|---|---|---|
| AI7503000999_23704502_f1_158 | 3026 | 6798 | 267 | 88 | | |

Description
NO-HIT

| ORF Name | NTID | AAID | NT Length | AA Length | score | probability |
|---|---|---|---|---|---|---|
| AI7503000999_23834461_f3_588 | 3027 | 6799 | 162 | 53 | | |

Description
NO-HIT

| ORF Name | NTID | AAID | NT Length | AA Length | score | probability |
|---|---|---|---|---|---|---|
| AI7503000999_23860812_f2_403 | 3028 | 6800 | 603 | 200 | 540 | 4.5e-52 |

Description
gp:[GI:g4185302] [LN:AF089862] [AC:AF089862] [PN:type-I signal peptidase SipB] [GN:sipB] [OR:Staphylococcus carnosus] [DB:genpept-bct2] [DE:Staphylococcus carnosus type-I signal peptidase SipA (sipA) andtype-I signal peptidase SipB (sipB) genes, complete cds; andunknown gene.] [NT:leader peptidase] [LE:1502] [RE:2071] [DI:direct]

| ORF Name | NTID | AAID | NT Length | AA Length | score | probability |
|---|---|---|---|---|---|---|
| AI7503000999_23866566_c2_1067 | 3029 | 6801 | 159 | 52 | | |

Description
NO-HIT

| ORF_Name | NTID | AAID | NT Length | AA Length | score | probability |
|---|---|---|---|---|---|---|
| AI7503000999_23959802_c1_787 | 3030 | 6802 | 171 | 56 | | |

Description
NO-HIT

| ORF_Name | NTID | AAID | NT Length | AA Length | score | probability |
|---|---|---|---|---|---|---|
| AI7503000999_23959802_c3_1250 | 3031 | 6803 | 153 | 50 | | |

Description
NO-HIT

| ORF_Name | NTID | AAID | NT Length | AA Length | score | probability |
|---|---|---|---|---|---|---|
| AI7503000999_23959802_c3_1261 | 3032 | 6804 | 132 | 43 | | |

Description
NO-HIT

| ORF_Name | NTID | AAID | NT Length | AA Length | score | probability |
|---|---|---|---|---|---|---|
| AI7503000999_23959802_f2_313 | 3033 | 6805 | 210 | 69 | | |

Description
NO-HIT

| ORF_Name | NTID | AAID | NT Length | AA Length | score | probability |
|---|---|---|---|---|---|---|
| AI7503000999_23959802_f3_447 | 3034 | 6806 | 141 | 46 | | |

Description
NO-HIT

| ORF_Name | NTID | AAID | NT Length | AA Length | score | probability |
|---|---|---|---|---|---|---|
| AI7503000999_24016062_f1_168 | 3035 | 6807 | 129 | 42 | | |

Description
NO-HIT

| ORF_Name | NTID | AAID | NT Length | AA Length | score | probability |
|---|---|---|---|---|---|---|
| AI7503000999_24023300_c2_964 | 3036 | 6808 | 516 | 171 | 760 | 2.2e-75 |

Description
sp:[LN:DNAA_STAAU] [AC:P49994] [GN:DNAA] [OR:STAPHYLOCOCCUS AUREUS] [DE:CHROMOSOMAL REPLICATION INITIATOR PROTEIN DNAA] [SP:P49994] [DB:swissprot] >pir:[LN:JC5607] [AC:JC5607 ] [PN:replication initiation protein dnaA] [GN:dnaA ] [CL:replication initiation protein dnaA] [OR:Staphylococcus aureus] [DB:pir2]
>gp:[GI:d1014451:g1694677] [LN:D89066] [AC:D89066] [PN:DnaA] [GN:dnaA] [OR:Staphylococcus aureus] [SR:Staphylococcus aureus DNA] [DB:genpept-bct1] [DE:Staphylococcus aureus DNA for DnaA, complete cds.] [LE:456] [RE:1817] [DI:direct]

| ORF Name | NTID | AAID | NT Length | AA Length | score | probability |
|---|---|---|---|---|---|---|
| AI7503000999_24101587_f3_455 | 3037 | 6809 | 339 | 112 | 79 | 0.0098 |

Description
pir:[LN:S42040] [AC:S42040 ] [PN:hypothetical protein 3] [OR:Leuconostoc oenos] [DB:pir2] >gp:[GI:g515739] [LN:LEUORF15X] [AC:L28806] [FN:unknown] [OR:Oenococcus oeni] [DB:genpept-bct1] [DE:Leuconostoc oenos complete ORF1-ORF5.] [NT:ORF3; putative] [LE:2571] [RE:2975] [DI:direct] >gp:[GI:g454968] [LN:LOPLORFG] [AC:Z29976] [OR:Oenococcus oeni] [DB:genpept-bct1] [DE:L.oenos plasmid p4028 ORF1, ORF2, ORF3, ORF4, ORF5 genes.] [NT:ORF3] [LE:2571] [RE:2975] [DI:direct]

| ORF Name | NTID | AAID | NT Length | AA Length | score | probability |
|---|---|---|---|---|---|---|
| AI7503000999_24110635_c3_1231 | 3038 | 6810 | 132 | 43 | | |

Description
NO-HIT

| ORF Name | NTID | AAID | NT Length | AA Length | score | probability |
|---|---|---|---|---|---|---|
| AI7503000999_24220062_c3_1104 | 3039 | 6811 | 285 | 94 | 68 | 0.045 |

Description
gp:[GI:g4731269] [LN:AF110706] [AC:AF110706] [PN:cytochrome oxidase I] [OR:Mitochondrion Bemisia tabaci] [SR:sweet potato whitefly] [DB:genpept-inv2] [DE:Bemisia tabaci cytochrome oxidase I gene, partial cds;mitochondrial gene for mitochondrial product.] [NT:premature stop codon.] [LE:<1] [RE:330] [DI:direct]

| ORF Name | NTID | AAID | NT Length | AA Length | score | probability |
|---|---|---|---|---|---|---|
| AI7503000999_24234562_c2_890 | 3040 | 6812 | 222 | 73 | 64 | 0.026 |

Description
gp:[GI:g4808591] [LN:AF093829] [AC:AF093829] [PN:alpha-1,2-fucosyltransferase long form] [OR:Helicobacter pylori] [DB:genpept-bct2] [DE:Helicobacter pylori strain UA1182 alpha-1,2-fucosyltransferasegene, alternative products, complete cds.] [NT:ribosomal slippage] [LE:141:573] [RE:573:1042] [DI:directJoin]

| ORF Name | NTID | AAID | NT Length | AA Length | score | probability |
|---|---|---|---|---|---|---|
| AI7503000999_24250010_c3_1271 | 3041 | 6813 | 225 | 74 | | |

Description
NO-HIT

| ORF Name | NTID | AAID | NT Length | AA Length | score | probability |
|---|---|---|---|---|---|---|
| AI7503000999_24255312_f1_128 | 3042 | 6814 | 159 | 52 | | |

Description
NO-HIT

| ORF Name | NTID | AAID | NT Length | AA Length | score | probability |
|---|---|---|---|---|---|---|
| AI7503000999_24256437_c1_717 | 3043 | 6815 | 141 | 46 | | |

Description
NO-HIT

| ORF Name | NTID | AAID | NT Length | AA Length | score | probability |
|---|---|---|---|---|---|---|
| AI7503000999_24273442_f1_22 | 3044 | 6816 | 384 | 127 | 144 | 4.1e-10 |

Description
pir:[LN:C70043] [AC:C70043 ] [PN:hypothetical protein yvlA] [GN:yvlA ] [OR:Bacillus subtilis] [DB:pir2] >gp:[GI:e1186201:g2636026] [LN:BSUB0018] [AC:Z99121:AL009126] [GN:yvlA] [FN:unknown] [OR:Bacillus subtilis] [DB:genpept-bct1] [DE:Bacillus subtilis complete genome (section 18 of 21): from 3399551to 3609060.] [LE:207957] [RE:208283] [DI:complement] >gp:[GI:e1184419:g2636039] [LN:BSUB0019] [AC:Z99122:AL009126] [GN:yvlA] [FN:unknown] [OR:Bacillus subtilis] [DB:genpept-bct1] [DE:Bacillus subtilis complete genome (section 19 of 21): from 3597091to 3809700.] [LE:10417] [RE:10743] [DI:complement] >gp:[GI:g2618844] [LN:AF017113] [AC:AF017113] [PN:YvlA] [GN:yvlA] [OR:Bacillus subtilis] [DB:genpept-bct2] [DE:Bacillus subtilis 300-304 degree genomic sequence.] [LE:19550] [RE:19876] [DI:direct] >gp:[GI:e1184419:g2636039] [LN:BSUB0019] [AC:Z99122:AL009126] [GN:yvlA] [FN:unknown] [OR:Bacillus subtilis] [DB:genpept] [DE:Bacillus subtilis complete genome (section 19 of 21): from 3597091to 3809700.] [LE:10417] [RE:10743] [DI:complement]

| ORF Name | NTID | AAID | NT Length | AA Length | score | probability |
|---|---|---|---|---|---|---|
| AI7503000999_24273442_f1_85 | 3045 | 6817 | 384 | 127 | 142 | 6.7e-10 |

Description
pir:[LN:C70043] [AC:C70043 ] [PN:hypothetical protein yvlA] [GN:yvlA ] [OR:Bacillus subtilis] [DB:pir2] >gp:[GI:e1186201:g2636026] [LN:BSUB0018] [AC:Z99121:AL009126] [GN:yvlA] [FN:unknown] [OR:Bacillus subtilis] [DB:genpept-bct1] [DE:Bacillus subtilis complete genome (section 18 of 21): from 3399551to 3609060.] [LE:207957] [RE:208283] [DI:complement] >gp:[GI:e1184419:g2636039] [LN:BSUB0019] [AC:Z99122:AL009126] [GN:yvlA] [FN:unknown] [OR:Bacillus subtilis] [DB:genpept-bct1] [DE:Bacillus subtilis complete genome (section 19 of 21): from 3597091to 3809700.] [LE:10417] [RE:10743] [DI:complement] >gp:[GI:g2618844] [LN:AF017113] [AC:AF017113] [PN:YvlA] [GN:yvlA] [OR:Bacillus subtilis] [DB:genpept-bct2] [DE:Bacillus subtilis 300-304 degree genomic sequence.] [LE:19550] [RE:19876] [DI:direct] >gp:[GI:e1184419:g2636039] [LN:BSUB0019] [AC:Z99122:AL009126] [GN:yvlA] [FN:unknown] [OR:Bacillus subtilis] [DB:genpept] [DE:Bacillus subtilis complete genome (section 19 of 21): from 3597091to 3809700.] [LE:10417] [RE:10743] [DI:complement]

| ORF Name | NTID | AAID | NT Length | AA Length | score | probability |
|---|---|---|---|---|---|---|
| AI7503000999_24297050_c2_904 | 3046 | 6818 | 141 | 46 | | |

Description
NO-HIT

| ORF Name | NTID | AAID | NT Length | AA Length | score | probability |
|---|---|---|---|---|---|---|
| AI7503000999_24299037_c3_1238 | 3047 | 6819 | 255 | 84 | 68 | 0.045 |

Description
gp:[GI:g4049677] [LN:AF063866] [AC:AF063866] [PN:ORF MSV084 hypothetical protein] [GN:MSV084] [OR:Melanoplus sanguinipes entomopoxvirus] [DB:genpept-vrl] [DE:Melanoplus sanguinipes entomopoxvirus, complete genome.] [LE:80206] [RE:80577] [DI:direct]

| ORF Name | NTID | AAID | NT Length | AA Length | score | probability |
|---|---|---|---|---|---|---|
| AI7503000999_24329192_c2_986 | 3048 | 6820 | 180 | 59 | | |

Description
NO-HIT

| ORF Name | NTID | AAID | NT Length | AA Length | score | probability |
|---|---|---|---|---|---|---|
| AI7503000999_24332641_c1_768 | 3049 | 6821 | 129 | 42 | | |

Description
NO-HIT

| ORF Name | NTID | AAID | NT Length | AA Length | score | probability |
|---|---|---|---|---|---|---|
| AI7503000999_24401712_c1_826 | 3050 | 6822 | 1125 | 374 | 117 | 0.0014 |

Description
pir:[LN:C70168] [AC:C70168 ] [PN:DNA polymerase I (polA) homolog] [OR:Borrelia burgdorferi] [SR:, Lyme disease spirochete] [DB:pir2] >gp:[GI:g2688462] [LN:AE001156] [AC:AE001156:AE000783] [PN:DNA polymerase I (polA)] [GN:BB0548] [OR:Borrelia burgdorferi] [SR:Lyme disease spirochete] [DB:genpept-bct2] [DE:Borrelia burgdorferi (section 42 of 70) of the complete genome.] [NT:similar to GB:L42023 SP:P43741 PID:1005915] [LE:6171] [RE:8897] [DI:complement]

| ORF Name | NTID | AAID | NT Length | AA Length | score | probability |
|---|---|---|---|---|---|---|
| AI7503000999_24406311_c3_1111 | 3051 | 6823 | 135 | 44 | | |

Description
NO-HIT

| ORF Name | NTID | AAID | NT Length | AA Length | score | probability |
|---|---|---|---|---|---|---|
| AI7503000999_24406338_c3_1122 | 3052 | 6824 | 186 | 61 | | |

Description
NO-HIT

| ORF Name | NTID | AAID | NT Length | AA Length | score | probability |
|---|---|---|---|---|---|---|
| AI7503000999_24407313_c2_880 | 3053 | 6825 | 126 | 41 | | |

Description
NO-HIT

| ORF Name | NTID | AAID | NT Length | AA Length | score | probability |
|---|---|---|---|---|---|---|
| AI7503000999_24407812_c3_1182 | 3054 | 6826 | 771 | 256 | 1062 | 2.2e-107 |

Description
gp:[GI:d1046030:g5360854] [LN:D86934] [AC:D86934] [PN:glycerophosphoryldiester phosphodiesterase] [OR:Staphylococcus aureus] [SR:Staphylococcus aureus (strain:N315) DNA, clone_lib:library of N31] [DB:genpept] [DE:Staphylococcus aureus genes, mec region, partial and complete cds.] [NT:ORF N039; putative] [LE:46160] [RE:>46792] [DI:complement]

| ORF Name | NTID | AAID | NT Length | AA Length | score | probability |
|---|---|---|---|---|---|---|
| AI7503000999_24407828_c3_1230 | 3055 | 6827 | 2013 | 670 | 157 | 2.1e-07 |

Description
gp:[GI:g4049717] [LN:AF063866] [AC:AF063866] [PN:ORF MSV156 hypothetical protein] [GN:MSV156] [OR:Melanoplus sanguinipes entomopoxvirus] [DB:genpept-vrl] [DE:Melanoplus sanguinipes entomopoxvirus, complete genome.] [LE:140126] [RE:143509] [DI:direct]

| ORF Name | NTID | AAID | NT Length | AA Length | score | probability |
|---|---|---|---|---|---|---|
| AI7503000999_24409452_c3_1294 | 3056 | 6828 | 432 | 143 | 132 | 7.6e-09 |

Description
sp:[LN:Y577_METJA] [AC:Q57997] [GN:MJ0577] [OR:METHANOCOCCUS JANNASCHII] [DE:PROTEIN MJ0577] [SP:Q57997] [DB:swissprot] >pir:[LN:A64372] [AC:A64372 ] [PN:hypothetical protein homolog MJ0577] [CL:Escherichia coli ybdQ protein] [OR:Methanococcus jannaschii] [DB:pir2] [MP:FOR512975-513463 ] >gp:[GI:g1591284] [LN:U67506] [AC:U67506:L77117] [PN:conserved hypothetical protein] [GN:MJ0577] [OR:Methanococcus jannaschii] [DB:genpept-bct2] [DE:Methanococcus jannaschii section 48 of 150 of the complete genome.] [NT:similar to SP:P42297 PID:603780 PID:849027] [LE:8204] [RE:8692] [DI:direct]

| ORF Name | NTID | AAID | NT Length | AA Length | score | probability |
|---|---|---|---|---|---|---|
| AI7503000999_24411262_f1_37 | 3057 | 6829 | 180 | 59 | | |

Description
NO-HIT

| ORF Name | NTID | AAID | NT Length | AA Length | score | probability |
|---|---|---|---|---|---|---|
| AI7503000999_24412507_f2_339 | 3058 | 6830 | 135 | 44 | | |

Description
NO-HIT

| ORF Name | NTID | AAID | NT Length | AA Length | score | probability |
|---|---|---|---|---|---|---|
| AI7503000999_24414680_c1_843 | 3059 | 6831 | 1287 | 428 | 141 | 1.3e-05 |

Description
gp:[GI:g1041785] [LN:PYU36927] [AC:U36927] [PN:rhoptry protein] [FN:erythrocyte invasion and possible binding] [OR:Plasmodium yoelii] [DB:genpept-invl] [DE:Plasmodium yoelii rhoptry protein gene, partial cds.] [LE:<1] [RE:7206] [DI:direct]

| ORF Name | NTID | AAID | NT Length | AA Length | score | probability |
|---|---|---|---|---|---|---|
| AI7503000999_24414818_f3_516 | 3060 | 6832 | 441 | 146 | 94 | 0.00083 |

Description
sp:[LN:PHNB_ECOLI] [AC:P16681] [GN:PHNB] [OR:ESCHERICHIA COLI] [DE:PHNB PROTEIN] [SP:P16681] [DB:swissprot] >pir:[LN:C35718] [AC:C35718:S56335:B65220 ] [PN:phnB protein] [GN:phnB ] [OR:Escherichia coli] [DB:pir2] >gp:[GI:g147195] [LN:ECOPHNAQ] [AC:J05260] [OR:Escherichia coli] [SR:E.coli (strain B) DNA] [DB:genpept-bct1] [DE:E.coli psiD locus containing alkylphosphonate uptake (phn) genes Athrough·Q, complete cds.] [NT:phnB protein] [LE:3767] [RE:4210] [DI:direct] >gp:[GI:g536951] [LN:ECOUW93] [AC:U14003] [GN:phnB] [OR:Escherichia coli] [DB:genpept-bct1] [DE:Escherichia coli K-12 chromosomal region from 92.8 to 00.1 minutes.] [LE:16226] [RE:16669] [DI:complement] >gp:[GI:g1790546] [LN:AE000483] [AC:AE000483:U00096] [PN:orf, hypothetical protein] [GN:phnB] [FN:orf; Unknown] [OR:Escherichia coli] [DB:genpept-bct2] [DE:Escherichia coli K-12 MG1655 section 373 of 400 of the completegenome.] [NT:f147; 100 pct identical amino acid sequence and] [LE:97] [RE:540] [DI:complement]

| ORF Name | NTID | AAID | NT Length | AA Length | score | probability |
|---|---|---|---|---|---|---|
| AI7503000999_24424092_c2_1017 | 3061 | 6833 | 522 | 173 | 104 | 0.00027 |

Description gp:[GI:e1488089:g5051453] [LN:NME242841] [AC:AJ242841] [PN:hypothetical protein]
[OR:Neisseria meningitidis] [DB:genpept-bct1] [DE:Neisseria meningitidis DNA for opcA
region, strain Z2491.] [NT:ORFA] [LE:10162] [RE:10707] [DI:direct]
>gp:[GI:e1488089:g5051453] [LN:NME242841] [AC:AJ242841] [PN:hypothetical protein]
[OR:Neisseria meningitidis] [DB:genpept] [DE:Neisseria meningitidis DNA for opcA
region, strain Z2491.] [NT:orfA] [LE:10162] [RE:10707] [DI:direct]

| ORF Name | NTID | AAID | NT Length | AA Length | score | probability |
|---|---|---|---|---|---|---|
| AI7503000999_24430392_c1_856 | 3062 | 6834 | 681 | 226 | 1116 | 4.1e-113 |

Description sp:[LN:MERB_STAAU] [AC:P08653] [GN:MERB] [OR:STAPHYLOCOCCUS AUREUS] [EC:4.99.1.2]
[DE:ALKYLMERCURY LYASE, (ORGANOMERCURIAL LYASE)] [SP:P08653] [DB:swissprot]
>pir:[LN:F29504] [AC:F29504 ] [PN:alkylmercury lyase,] [CL:alkylmercury lyase]
[OR:Staphylococcus aureus] [EC:4.99.1.2] [DB:pir2] >gp:[GI:g459908] [LN:L29436]
[AC:L29436:M15048:N00048] [PN:organomercurial lyase] [GN:merB] [OR:Plasmid pI258]
[SR:Plasmid pI258 DNA] [DB:genpept-bct1] [DE:Plasmid pI258 (from S.aureus strain RN23
8325) mercury resistance(mer) operon encoding mercuric reductase (merA),
organomercuriallyase (merB), regulatory protein (merR) and membrane transportprotein
(merT), complete cds.] [LE:4873] [RE:5523] [DI:direct]

| ORF Name | NTID | AAID | NT Length | AA Length | score | probability |
|---|---|---|---|---|---|---|
| AI7503000999_24431502_c3_1121 | 3063 | 6835 | 846 | 281 | 347 | 1.3e-31 |

Description gp:[GI:g3818562] [LN:AF076529] [AC:AF076529] [PN:ATP binding protein BviA] [GN:bviA]
[OR:Butyrivibrio fibrisolvens] [DB:genpept-bct2] [DE:Butyrivibrio fibrisolvens response
regulator homolog gene, partialcds; histidine kinase homolog, butyrivibriocin AR10
operon,complete sequence; and unknown gene.] [LE:2342] [RE:3187] [DI:direct]

| ORF Name | NTID | AAID | NT Length | AA Length | score | probability |
|---|---|---|---|---|---|---|
| AI7503000999_24432662_c2_1052 | 3064 | 6836 | 969 | 322 | 301 | 2.3e-47 |

Description sp:[LN:YACK_ECOLI] [AC:P36649:P75655] [GN:YACK] [OR:ESCHERICHIA COLI] [DE:PROBABLE 53.4
KD BLUE-COPPER PROTEIN YACQ PRECURSOR] [SP:P36649:P75655] [DB:swissprot]
>pir:[LN:C64735] [AC:C64735:S45200 ] [PN:probable copper-binding protein yacK] [GN:yacK
] [OR:Escherichia coli] [DB:pir2] >gp:[GI:g1786314] [LN:AE000121] [AC:AE000121:U00096]
[PN:orf, hypothetical protein] [GN:yacK] [FN:orf; Unknown] [OR:Escherichia coli]
[DB:genpept-bct2] [DE:Escherichia coli K-12 MG1655 section 11 of 400 of the
completegenome.] [NT:o516; 100 pct identical to 463 residues] [LE:9364] [RE:10914]
[DI:direct]

| ORF Name | NTID | AAID | NT Length | AA Length | score | probability |
|---|---|---|---|---|---|---|
| AI7503000999_24475252_f1_1 | 3065 | 6837 | 159 | 52 | | |

Description

NO-HIT

| ORF Name | NTID | AAID | NT Length | AA Length | score | probability |
|---|---|---|---|---|---|---|
| AI7503000999_24486008_c2_1059 | 3066 | 6838 | 978 | 325 | 136 | 1.6e-06 |

Description
gp:[GI:g4378164] [LN:AF102543] [AC:AF102543] [PN:unknown] [OR:Zymomonas mobilis] [DB:genpept-bct2] [DE:Zymomonas mobilis 5,10-methylenetetrahydrofolate reductase (metF)gene, partial cds; lipoprotein precursor (vacJ), ferredoxin-NADP+reductase (fpr), succinic semialdehyde dehydrogenase (gabD),thymidylate synthetase (thyA), gluconate permease (gntP),UTP-glucose-1-phosphate uridyltransferase, diaminopimelatedecarboxylase (lysA), arginosuccinate lyase (argH), NADH-dependentbutanol dehydrogenase (yugJ), and morphine 6-dehydrogenase (mdh)genes, complete cds; tRNA-Ala gene, complete sequence;aminopeptidase N (pepN) gene, complete cds; and unknown genes.] [NT:zm4orf2] [LE:12502] [RE:13458] [DI:complement]

| ORF Name | NTID | AAID | NT Length | AA Length | score | probability |
|---|---|---|---|---|---|---|
| AI7503000999_24641941_f3_456 | 3067 | 6839 | 510 | 169 | | |

Description
NO-HIT

| ORF Name | NTID | AAID | NT Length | AA Length | score | probability |
|---|---|---|---|---|---|---|
| AI7503000999_24645817_c2_979 | 3068 | 6840 | 453 | 150 | 461 | 1.0e-43 |

Description
gp:[GI:g143421] [LN:BACRGC] [AC:M57623:J05723] [PN:ribosomal protein L9] [GN:ribosomal protein L9] [OR:Bacillus stearothermophilus] [SR:B.stearothermophilus DNA] [DB:genpept-bct1] [DE:B.stearothermophilus ribosomal protein L9 gene, complete cds.] [LE:1] [RE:450] [DI:direct]

| ORF Name | NTID | AAID | NT Length | AA Length | score | probability |
|---|---|---|---|---|---|---|
| AI7503000999_24647142_c2_930 | 3069 | 6841 | 645 | 214 | 575 | 8.7e-56 |

Description
gp:[GI:e352094:g2462707] [LN:SXLACRPH] [AC:Y14599] [PN:hypothetical protein] [GN:orf5] [OR:Staphylococcus xylosus] [DB:genpept-bct1] [DE:Staphylococcus xylosus lacR, lacP, lacH genes and 2 ORF's.] [LE:6476] [RE:7105] [DI:complement]

| ORF Name | NTID | AAID | NT Length | AA Length | score | probability |
|---|---|---|---|---|---|---|
| AI7503000999_24647292_f3_668 | 3070 | 6842 | 1275 | 424 | 1180 | 6.7e-120 |

Description
sp:[LN:PBUX_BACSU] [AC:P42086] [GN:PBUX] [OR:BACILLUS SUBTILIS] [DE:XANTHINE PERMEASE] [SP:P42086] [DB:swissprot] >pir:[LN:S51310] [AC:S51310:E69673 ] [PN:xanthine permease pbuX] [GN:pbuX] [CL:xanthine permease pbuX] [OR:Bacillus subtilis] [DB:pir2] >gp:[GI:g1256618] [LN:BACYACA] [AC:L77246] [PN:transport protein] [GN:ypaQ] [FN:pyrimidine salvage] [OR:Bacillus subtilis] [DB:genpept-bct1] [DE:Bacillus subtilis (YAC10-9 clone) DNA region between the serA andkdg loci.] [NT:26% of identity to the Bacillus caldolyticus uracil] [LE:2007] [RE:3323] [DI:direct]
>gp:[GI:e1183652:g2634625] [LN:BSUB0012] [AC:Z99115:AL009126] [PN:xanthine permease] [GN:pbuX] [OR:Bacillus subtilis] [DB:genpept-bct1] [DE:Bacillus subtilis complete genome (section 12 of 21): from 2195541to 2409220.] [NT:alternate gene name: ypaQ] [SP:P42086] [LE:121829] [RE:123145] [DI:complement] >gp:[GI:g633170] [LN:BSXPTPBUX] [AC:X83878] [PN:xanthine permease] [GN:pbuX] [OR:Bacillus subtilis] [DB:genpept-bct1] [DE:B.subtilis xpt and pbuX genes.] [SP:P42086] [LE:938] [RE:2254] [DI:direct]

| ORF Name | NTID | AAID | NT Length | AA Length | score | probability |
|---|---|---|---|---|---|---|
| AI7503000999_24650427_f3_493 | 3071 | 6843 | 3126 | 1041 | 1653 | 2.3e-220 |

Description
pir:[LN:F64114] [AC:F64114 ] [PN:type I site-specific deoxyribonuclease, chain hsdR]
[GN:hsdR ] [CL:DEAD/H box helicase homology] [OR:Haemophilus influenzae] [EC:3.1.21.3]
[DB:pir2] >gp:[GI:g1574743] [LN:U32808] [AC:U32808:L42023] [PN:type I restriction
enzyme (hsdR)] [GN:HI1285] [OR:Haemophilus influenzae Rd] [DB:genpept-bct2]
[DE:Haemophilus influenzae Rd section 123 of 163 of the completegenome.] [NT:similar to
PID:1685100 percent identity: 59.01;] [LE:5702] [RE:8869] [DI:complement]

| ORF Name | NTID | AAID | NT Length | AA Length | score | probability |
|---|---|---|---|---|---|---|
| AI7503000999_24783462_c2_1016 | 3072 | 6844 | 339 | 112 | 77 | 0.0086 |

Description
gp:[GI:g2772544] [LN:STREMM40G] [AC:L46817] [PN:M-40 protein] [GN:emm40]
[FN:antiphagocytic] [OR:Streptococcus pyogenes] [DB:genpept-bct2] [DE:Streptococcus
pyogenes M-40 protein (emm40) gene, partial cds.] [LE:<1] [RE:>341] [DI:direct]

| ORF Name | NTID | AAID | NT Length | AA Length | score | probability |
|---|---|---|---|---|---|---|
| AI7503000999_24797126_f1_88 | 3073 | 6845 | 249 | 82 | 69 | 0.036 |

Description
gp:[GI:g2772603] [LN:DMU85764] [AC:U85764] [PN:accessory gland protein Acp32CD]
[GN:Acp32CD] [FN:responsible for physiological and behavioral] [OR:Drosophila
melanogaster] [SR:fruit fly] [DB:genpept-inv1] [DE:Drosophila melanogaster accessory
gland protein Acp32CD (Acp32CD)gene, partial cds.] [LE:74] [RE:>377] [DI:direct]

| ORF Name | NTID | AAID | NT Length | AA Length | score | probability |
|---|---|---|---|---|---|---|
| AI7503000999_24800412_c2_981 | 3074 | 6846 | 147 | 48 | | |

Description
NO-HIT

| ORF Name | NTID | AAID | NT Length | AA Length | score | probability |
|---|---|---|---|---|---|---|
| AI7503000999_24812927_f2_227 | 3075 | 6847 | 183 | 60 | | |

Description
NO-HIT

| ORF Name | NTID | AAID | NT Length | AA Length | score | probability |
|---|---|---|---|---|---|---|
| AI7503000999_24817142_c1_764 | 3076 | 6848 | 1947 | 648 | 3147 | 0.0 |

Description
pir:[LN:A40585] [AC:A40585:A35406:S54711:A42295:S36024 ] [PN:DNA topoisomerase
(ATP-hydrolyzing), chain B] [GN:gyrB ] [CL:DNA topoisomerase (ATP-hydrolyzing) chain B]
[OR:Staphylococcus aureus] [EC:5.99.1.3] [DB:pir1] >gp:[GI:g296395] [LN:SAGYRREC]
[AC:X71437] [PN:DNA gyrase] [GN:gyrB] [OR:Staphylococcus aureus] [DB:genpept-bct1]
[DE:S.aureus genes gyrB, gyrA and recF (partial).] [SP:P20832] [LE:282] [RE:2216]
[DI:direct] >gp:[GI:d1001841:g540541] [LN:STAGYRABA] [AC:D10489] [PN:DNA gyrase B]
[GN:gyrB] [OR:Staphylococcus aureus] [SR:Staphylococcus aureus (strain:ATCC12600) DNA]
[DB:genpept-bct1] [EC:5.99.1.3] [DE:Staphylococcus aureus genes for DNA gyrase A and B,
complete cds.] [LE:181] [RE:2115] [DI:direct]

| ORF Name | NTID | AAID | NT Length | AA Length | score | probability |
|---|---|---|---|---|---|---|
| AI7503000999_24847250_f2_320 | 3077 | 6849 | 153 | 50 | | |

Description
NO-HIT

| ORF Name | NTID | AAID | NT Length | AA Length | score | probability |
|---|---|---|---|---|---|---|
| AI7503000999_24848452_c3_1175 | 3078 | 6850 | 792 | 263 | 223 | 1.7e-18 |

Description
pir:[LN:H70089] [AC:H70089 ] [PN:hypothetical protein yycI] [GN:yycI ] [OR:Bacillus subtilis] [DB:pir2] >gp:[GI:d1011959:g1064811] [LN:BACGNTZA] [AC:D78193] [GN:yycI] [OR:Bacillus subtilis] [SR:Bacillus subtilis (strain:168) DNA] [DB:genpept-bct1] [DE:Bacillus subtilis 36kb sequence between gntZ and trnY genesencoding 34 ORFs.] [LE:31210] [RE:32052] [DI:complement] >gp:[GI:e1184764:g2636585] [LN:BSUB0021] [AC:Z99124:AL009126] [GN:yycI] [FN:unknown] [OR:Bacillus subtilis] [DB:genpept-bct1] [DE:Bacillus subtilis complete genome (section 21 of 21): from 3999281to 4214814.] [LE:149594] [RE:150436] [DI:complement]

| ORF Name | NTID | AAID | NT Length | AA Length | score | probability |
|---|---|---|---|---|---|---|
| AI7503000999_254527_c2_1038 | 3079 | 6851 | 186 | 61 | | |

Description
NO-HIT

| ORF Name | NTID | AAID | NT Length | AA Length | score | probability |
|---|---|---|---|---|---|---|
| AI7503000999_25548452_f1_207 | 3080 | 6852 | 915 | 304 | 354 | 2.3e-32 |

Description
pir:[LN:A69867] [AC:A69867 ] [PN:conserved hypothetical protein ykuT] [GN:ykuT ] [OR:Bacillus subtilis] [DB:pir2] >gp:[GI:e1181925:g2632241] [LN:BS16829KB] [AC:AJ222587] [PN:YkuT protein] [GN:ykuT] [OR:Bacillus subtilis] [DB:genpept-bct1] [DE:Bacillus subtilis 29kB DNA fragment from ykwC gene to cse15 gene.] [LE:25580] [RE:26383] [DI:complement] >gp:[GI:e1185011:g2633792] [LN:BSUB0008] [AC:Z99111:AL009126] [GN:ykuT] [FN:unknown] [OR:Bacillus subtilis] [DB:genpept-bct1] [DE:Bacillus subtilis complete genome (section 8 of 21): from 1394791to 1603020.] [NT:similar to hypothetical proteins] [LE:95836] [RE:96639] [DI:complement]

| ORF Name | NTID | AAID | NT Length | AA Length | score | probability |
|---|---|---|---|---|---|---|
| AI7503000999_25554012_c2_912 | 3081 | 6853 | 213 | 70 | | |

Description
NO-HIT

| ORF Name | NTID | AAID | NT Length | AA Length | score | probability |
|---|---|---|---|---|---|---|
| AI7503000999_25554675_c3_1094 | 3082 | 6854 | 927 | 308 | 179 | 2.5e-11 |

Description
sp:[LN:SR40_YEAST] [AC:P32583] [GN:SRP40:YKR092C:YKR412A] [OR:SACCHAROMYCES CEREVISIAE] [SR:,BAKER'S YEAST] [DE:SUPPRESSOR PROTEIN SRP40] [SP:P32583] [DB:swissprot] >pir:[LN:S38170] [AC:S38170:S40645:S37702 ] [PN:SRP40 protein:protein YKR092c:protein YKR412a] [GN:SRP40 ] [OR:Saccharomyces cerevisiae] [DB:pir2] [MP:11R ] >gp:[GI:g450552] [LN:SCDNACHXI] [AC:X73541] [OR:Saccharomyces cerevisiae] [SR:baker's yeast] [DB:genpept-pln1] [DE:S.cerevisiae DNA of chromosome XI, right arm.] [NT:ORF YKR412] [SP:P32583] [LE:1952] [RE:3172] [DI:complement] >gp:[GI:g486581] [LN:SCYKR092C] [AC:Z28317:Y13137] [GN:SRP40] [OR:Saccharomyces cerevisiae] [SR:baker's yeast] [DB:genpept-pln1] [DE:S.cerevisiae chromosome XI reading frame ORF YKR092c.] [NT:ORF YKR092c] [SP:P32583] [LE:400] [RE:1620] [DI:complement]

| ORF_Name | NTID | AAID | NT Length | AA Length | score | probability |
|---|---|---|---|---|---|---|
| AI7503000999_25565637_f2_257 | 3083 | 6855 | 126 | 41 | | |

Description
NO-HIT

| ORF_Name | NTID | AAID | NT Length | AA Length | score | probability |
|---|---|---|---|---|---|---|
| AI7503000999_25583568_f1_12 | 3084 | 6856 | 363 | 120 | 71 | 0.022 |

Description
pir:[LN:T03326] [AC:T03326 ] [PN:gene 119 protein] [GN:119 ] [OR:Lactococcus phage bIL170] [DB:pir2] >gp:[GI:g3282279] [LN:AF009630] [AC:AF009630] [PN:119] [GN:119] [OR:bacteriophage bIL170] [DB:genpept-phg] [DE:Bacteriophage bIL170, complete genome.] [LE:15351] [RE:15644] [DI:direct]

| ORF_Name | NTID | AAID | NT Length | AA Length | score | probability |
|---|---|---|---|---|---|---|
| AI7503000999_25587802_c1_809 | 3085 | 6857 | 777 | 258 | 114 | 0.00010 |

Description
sp:[LN:FLIZ_BORBU] [AC:Q44904:Q44764] [GN:FLIZ:BB0276] [OR:BORRELIA BURGDORFERI] [SR:,LYME DISEASE SPIROCHETE] [DE:FLAGELLAR PROTEIN FLIZ] [SP:Q44904:Q44764] [DB:swissprot] >pir:[LN:D70134] [AC:D70134 ] [PN:flagellar biosynthesis protein (fliZ) homolog] [OR:Borrelia burgdorferi] [SR:, Lyme disease spirochete] [DB:pir2] >gp:[GI:g1165261] [LN:BBU43739] [AC:U43739] [PN:FliZ] [GN:fliZ] [OR:Borrelia burgdorferi] [SR:Lyme disease spirochete strain=B31] [DB:genpept-bct1] [DE:Borrelia burgdorferi fesmid clone 31, complete sequence.] [NT:flagellar protein required for flagella formation] [LE:9847] [RE:10473] [DI:complement] >gp:[GI:g2688190] [LN:AE001137] [AC:AE001137:AE000783] [PN:flagellar biosynthesis protein (fliZ)] [GN:BB0276] [OR:Borrelia burgdorferi] [SR:Lyme disease spirochete] [DB:genpept-bct2] [DE:Borrelia burgdorferi (section 23 of 70) of the complete genome.] [NT:similar to PID:1165261 PID:1185058 SP:Q44904] [LE:15237] [RE:15863] [DI:complement]

| ORF_Name | NTID | AAID | NT Length | AA Length | score | probability |
|---|---|---|---|---|---|---|
| AI7503000999_25642038_f3_481 | 3086 | 6858 | 138 | 45 | | |

Description
NO-HIT

| ORF_Name | NTID | AAID | NT Length | AA Length | score | probability |
|---|---|---|---|---|---|---|
| AI7503000999_25660880_c2_975 | 3087 | 6859 | 177 | 58 | | |

Description
NO-HIT

| ORF_Name | NTID | AAID | NT Length | AA Length | score | probability |
|---|---|---|---|---|---|---|
| AI7503000999_25667767_c3_1114 | 3088 | 6860 | 1191 | 396 | 907 | 5.7e-91 |

Description
pir:[LN:B69847] [AC:B69847 ] [PN:cystathionine beta-lyase homolog yjcJ] [GN:yjcJ ] [CL:O-succinylhomoserine (thiol)-lyase] [OR:Bacillus subtilis] [DB:pir2] >gp:[GI:e1183208:g2633542] [LN:BSUB0007] [AC:Z99110:AL009126] [GN:yjcJ] [FN:unknown] [OR:Bacillus subtilis] [DB:genpept-bct1] [DE:Bacillus subtilis complete genome (section 7 of 21): from 1194391to 1411140.] [NT:similar to cystathionine beta-lyase] [LE:64687] [RE:65859] [DI:direct]

| ORF Name | NTID | AAID | NT Length | AA Length | score | probability |
|---|---|---|---|---|---|---|
| AI7503000999_25679712_f3_626 | 3089 | 6861 | 660 | 219 | 153 | 2.0e-09 |

Description
gp:[GI:e1315386:g3417427] [LN:SPBC30B4] [AC:AL031262] [PN:hypothetical protein]
[GN:SPBC30B4.01c] [OR:Schizosaccharomyces pombe] [SR:fission yeast] [DB:genpept-pln1]
[DE:S.pombe chromosome II cosmid c30B4.] [NT:SPBC30B4.01c, len:344aa, similarity,
YNL283C,] [LE:<1] [RE:1034] [DI:complement]

| ORF Name | NTID | AAID | NT Length | AA Length | score | probability |
|---|---|---|---|---|---|---|
| AI7503000999_25792911_c1_777 | 3090 | 6862 | 129 | 42 | | |

Description
NO-HIT

| ORF Name | NTID | AAID | NT Length | AA Length | score | probability |
|---|---|---|---|---|---|---|
| AI7503000999_25831512_c3_1105 | 3091 | 6863 | 129 | 42 | | |

Description
NO-HIT

| ORF Name | NTID | AAID | NT Length | AA Length | score | probability |
|---|---|---|---|---|---|---|
| AI7503000999_26172675_f1_124 | 3092 | 6864 | 129 | 42 | | |

Description
NO-HIT

| ORF Name | NTID | AAID | NT Length | AA Length | score | probability |
|---|---|---|---|---|---|---|
| AI7503000999_26181512_c2_1003 | 3093 | 6865 | 126 | 41 | | |

Description
NO-HIT

| ORF Name | NTID | AAID | NT Length | AA Length | score | probability |
|---|---|---|---|---|---|---|
| AI7503000999_26198535_c3_1116 | 3094 | 6866 | 765 | 254 | 136 | 5.4e-07 |

Description
pir:[LN:D70817] [AC:D70817 ] [PN:hypothetical protein Rv1716] [GN:Rv1716 ]
[OR:Mycobacterium tuberculosis] [DB:pir2] >gp:[GI:e1299966:g3261548] [LN:MTV048]
[AC:AL022003:AL123456] [PN:hypothetical protein Rv1716] [GN:Rv1716] [OR:Mycobacterium
tuberculosis] [DB:genpept-bct1] [DE:Mycobacterium tuberculosis H37Rv complete genome;
segment 77/162.] [NT:Rv1716, (MTV048.03,MTCY04C12.01) len: 276. Unknown] [LE:1750]
[RE:2580] [DI:direct]

| ORF Name | NTID | AAID | NT Length | AA Length | score | probability |
|---|---|---|---|---|---|---|
| AI7503000999_26214002_f3_647 | 3095 | 6867 | 870 | 289 | 627 | 2.7e-61 |

Description sp:[LN:SP0J_BACSU] [AC:P26497] [GN:SPO0J] [OR:BACILLUS SUBTILIS] [DE:STAGE 0 SPORULATION PROTEIN J] [SP:P26497] [DB:swissprot] >pir:[LN:A38536] [AC:I40445:A38536:S66020:E69710:S18081 ] [PN:Soj antagonist / chromosome positioning and transport protein spoOJ:spo0J93 protein:stage 0 sporulation protein J93] [GN:spo0J:spo0J93 ] [CL:Bacillus subtilis transport protein spo0J] [OR:Bacillus subtilis] [DB:pir2] >gp:[GI:d1005768:g467380] [LN:BAC180K] [AC:D26185] [PN:stage 0 sporultion] [GN:spo0J] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:53552] [RE:54400] [DI:complement] >gp:[GI:g40031] [LN:BSORIGS] [AC:X62539] [GN:spo0J93] [OR:Bacillus subtilis] [DB:genpept-bct1] [DE:B.subtilis genes rpmH, rnpA, 50kd, gidA and gidB.] [SP:P26497] [LE:9000] [RE:9848] [DI:direct] >gp:[GI:e1184822:g2636643] [LN:BSUB0021] [AC:Z99124:AL009126] [PN:antagonist of Soj] [GN:spo0J] [FN:involved in positionning part of the chromosome] [OR:Bacillus subtilis] [DB:genpept-bct1] [DE:Bacillus subtilis complete genome (section 21 of 21): from 3999281to 4214814.] [SP:P26497] [LE:205484] [RE:206332] [DI:complement]

| ORF Name | NTID | AAID | NT Length | AA Length | score | probability |
|---|---|---|---|---|---|---|
| AI7503000999_26261512_f2_275 | 3096 | 6868 | 162 | 53 | | |

Description
NO-HIT

| ORF Name | NTID | AAID | NT Length | AA Length | score | probability |
|---|---|---|---|---|---|---|
| AI7503000999_26351510_f2_375 | 3097 | 6869 | 138 | 45 | | |

Description
NO-HIT

| ORF Name | NTID | AAID | NT Length | AA Length | score | probability |
|---|---|---|---|---|---|---|
| AI7503000999_26365911_f1_165 | 3098 | 6870 | 561 | 186 | 203 | 2.3e-16 |

Description pir:[LN:E69779] [AC:E69779 ] [PN:transcription regulator TetR/AcrR family homolog ydeS] [GN:ydeS ] [OR:Bacillus subtilis] [DB:pir2] >gp:[GI:d1020119:g1881339] [LN:AB001488] [AC:AB001488] [GN:ydeS] [OR:Bacillus subtilis] [SR:Bacillus subtilis (strain:168) DNA] [DB:genpept-bct1] [DE:Bacillus subtilis genome sequence, 148 kb sequence of the regionbetween 35 and 47 degree.] [NT:PROBABLE TRANSCRIPTIONAL REGULATOR, SIMILAR TO] [LE:111555] [RE:112151] [DI:direct] >gp:[GI:e1182498:g2632832] [LN:BSUB0003] [AC:Z99106:AL009126] [GN:ydeS] [FN:unknown] [OR:Bacillus subtilis] [DB:genpept-bct1] [DE:Bacillus subtilis complete genome (section 3 of 21): from 402751 to611850.] [NT:similar to transcriptional regulator (TetR/AcrR] [LE:175301] [RE:175897] [DI:direct]

| ORF Name | NTID | AAID | NT Length | AA Length | score | probability |
|---|---|---|---|---|---|---|
| AI7503000999_26597010_f3_530 | 3099 | 6871 | 186 | 61 | 103 | 2.9e-05 |

Description
sp:[LN:Y4UH_RHISN] [AC:Q53200] [GN:Y4UH] [OR:RHIZOBIUM SP] [SR:NGR234,] [DE:PUTATIVE INSERTION SEQUENCE ATP-BINDING PROTEIN Y4UH] [SP:Q53200] [DB:swissprot] >gp:[GI:e213893:g1486429] [LN:RSPNGR234] [AC:Z68203] [PN:transposase homologue] [GN:orf10] [OR:Rhizobium sp.] [SR:Rhizobium sp] [DB:genpept-bct1] [DE:Rhizobium sp. plasmid NGR234a DNA.] [NT:putative] [SP:Q53200] [LE:13370] [RE:14116] [DI:complement] >gp:[GI:g2182658] [LN:AE000099] [AC:AE000099:U00090] [PN:Y4uH] [GN:y4uH] [OR:Rhizobium sp. NGR234] [DB:genpept-bct2] [DE:Rhizobium sp. NGR234 plasmid pNGR234a, section 36 of 46 of thecomplete plasmid sequence.] [NT:putative insertion sequence ATP-binding protein] [LE:8181] [RE:8927] [DI:complement]

| ORF Name | NTID | AAID | NT Length | AA Length | score | probability |
|---|---|---|---|---|---|---|
| AI7503000999_26600015_f1_162 | 3100 | 6872 | 354 | 117 | 280 | 1.6e-24 |

Description
sp:[LN:RNPA_BACSU] [AC:P25814] [GN:RNPA] [OR:BACILLUS SUBTILIS] [EC:3.1.26.5] [DE:RIBONUCLEASE P PROTEIN COMPONENT, (PROTEIN C5) (RNASE P)] [SP:P25814] [DB:swissprot] >pir:[LN:S66029] [AC:S66029:D69693 ] [PN:ribonuclease P protein component rnpA] [GN:rnpA ] [CL:ribonuclease P, protein component] [OR:Bacillus subtilis] [DB:pir2] >gp:[GI:d1005777:g467389] [LN:BAC180K] [AC:D26185] [PN:protein component of ribonuclease P] [GN:rnpA] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:62749] [RE:63099] [DI:complement] >gp:[GI:e1184831:g2636652] [LN:BSUB0021] [AC:Z99124:AL009126] [PN:ribonuclease P (protein component)] [GN:rnpA] [OR:Bacillus subtilis] [DB:genpept-bct1] [EC:3.1.26.5] [DE:Bacillus subtilis complete genome (section 21 of 21): from 3999281to 4214814.] [SP:P25814] [LE:214681] [RE:215031] [DI:complement]

| ORF Name | NTID | AAID | NT Length | AA Length | score | probability |
|---|---|---|---|---|---|---|
| AI7503000999_26604502_f2_390 | 3101 | 6873 | 159 | 52 | 205 | 1.4e-16 |

Description
sp:[LN:RL34_BACST] [AC:P23376] [GN:RPMH] [OR:BACILLUS STEAROTHERMOPHILUS] [DE:50S RIBOSOMAL PROTEIN L34] [SP:P23376] [DB:swissprot] >pir:[LN:C48396] [AC:C48396 ] [PN:ribosomal protein L34] [CL:Escherichia coli ribosomal protein L34] [OR:Bacillus stearothermophilus] [DB:pir2]

| ORF Name | NTID | AAID | NT Length | AA Length | score | probability |
|---|---|---|---|---|---|---|
| AI7503000999_26615636_f1_194 | 3102 | 6874 | 144 | 47 | | |

Description
NO-HIT

| ORF Name | NTID | AAID | NT Length | AA Length | score | probability |
|---|---|---|---|---|---|---|
| AI7503000999_26756660_c2_950 | 3103 | 6875 | 651 | 216 | 109 | 0.00035 |

Description
pir:[LN:B69858] [AC:B69858 ] [PN:hypothetical protein yknW] [GN:yknW ] [OR:Bacillus subtilis] [DB:pir2] >gp:[GI:e1185024:g2633805] [LN:BSUB0008] [AC:Z99111:AL009126] [GN:yknW] [FN:unknown] [OR:Bacillus subtilis] [DB:genpept-bct1] [DE:Bacillus subtilis complete genome (section 8 of 21): from 1394791to 1603020.] [LE:108197] [RE:108892] [DI:direct] >gp:[GI:g3282118] [LN:AF012285] [AC:AF012285:AF012284:U51911] [PN:YknW] [GN:yknW] [OR:Bacillus subtilis] [DB:genpept-bct2] [DE:Bacillus subtilis mobA-nprE gene region.] [LE:8685] [RE:9380] [DI:direct]

| ORF Name | NTID | AAID | NT Length | AA Length | score | probability |
|---|---|---|---|---|---|---|
| AI7503000999_26759707_c1_830 | 3104 | 6876 | 450 | 149 | 504 | 2.9e-48 |

Description
gp:[GI:d1046006:g5360830] [LN:D86934] [AC:D86934] [OR:Staphylococcus aureus]
[SR:Staphylococcus aureus (strain:N315) DNA, clone_lib:library of N31] [DB:genpept]
[DE:Staphylococcus aureus genes, mec region, partial and complete cds.] [NT:ORF N044]
[LE:28947] [RE:29264] [DI:direct]

| ORF Name | NTID | AAID | NT Length | AA Length | score | probability |
|---|---|---|---|---|---|---|
| AI7503000999_270890_c3_1162 | 3105 | 6877 | 186 | 61 | | |

Description
NO-HIT

| ORF Name | NTID | AAID | NT Length | AA Length | score | probability |
|---|---|---|---|---|---|---|
| AI7503000999_2745462_c1_691 | 3106 | 6878 | 642 | 213 | 116 | 0.00066 |

Description
gp:[GI:e1407824:g4493894] [LN:PFMAL3P2] [AC:AL034558] [GN:MAL3P2.16] [OR:Plasmodium
falciparum] [SR:malaria parasite P. falciparum] [DB:genpept-invl] [DE:Plasmodium
falciparum MAL3P2, complete sequence.] [NT:predicted using hexExon; MAL3P2.16
(PF0235w),] [LE:73132:73647] [RE:73149:77270] [DI:directJoin]

| ORF Name | NTID | AAID | NT Length | AA Length | score | probability |
|---|---|---|---|---|---|---|
| AI7503000999_2782563_c3_1129 | 3107 | 6879 | 153 | 50 | | |

Description
NO-HIT

| ORF Name | NTID | AAID | NT Length | AA Length | score | probability |
|---|---|---|---|---|---|---|
| AI7503000999_2819632_f1_105 | 3108 | 6880 | 387 | 128 | | |

Description
NO-HIT

| ORF Name | NTID | AAID | NT Length | AA Length | score | probability |
|---|---|---|---|---|---|---|
| AI7503000999_2867812_c2_1060 | 3109 | 6881 | 213 | 70 | | |

Description
NO-HIT

| ORF Name | NTID | AAID | NT Length | AA Length | score | probability |
|---|---|---|---|---|---|---|
| AI7503000999_2921941_c1_680 | 3110 | 6882 | 159 | 52 | | |

Description
NO-HIT

| ORF Name | NTID | AAID | NT Length | AA Length | score | probability |
|---|---|---|---|---|---|---|
| AI7503000999_2925292_f2_325 | 3111 | 6883 | 123 | 40 | | |

Description
NO-HIT

| ORF_Name | NTID | AAID | NT Length | AA Length | score | probability |
|---|---|---|---|---|---|---|
| AI7503000999_2931557_c3_1158 | 3112 | 6884 | 1119 | 372 | 1692 | 3.7e-174 |

Description
sp:[LN:RECF_STAAU] [AC:P29232] [GN:RECF] [OR:STAPHYLOCOCCUS AUREUS] [DE:RECF PROTEIN] [SP:P29232] [DB:swissprot] >pir:[LN:C40585] [AC:S54710:C40585:C42295:S36023 ] [PN:recF protein] [CL:recF protein] [OR:Staphylococcus aureus] [DB:pir2]

| ORF_Name | NTID | AAID | NT Length | AA Length | score | probability |
|---|---|---|---|---|---|---|
| AI7503000999_29320127_c3_1181 | 3113 | 6885 | 390 | 129 | 677 | 1.4e-66 |

Description
gp:[GI:d1046033:g5360857] [LN:D86934] [AC:D86934] [OR:Staphylococcus aureus] [SR:Staphylococcus aureus (strain:N315) DNA, clone_lib:library of N31] [DB:genpept] [DE:Staphylococcus aureus genes, mec region, partial and complete cds.] [NT:ORF CN041] [LE:47629] [RE:>48018] [DI:complement]

| ORF_Name | NTID | AAID | NT Length | AA Length | score | probability |
|---|---|---|---|---|---|---|
| AI7503000999_2946092_c2_1006 | 3114 | 6886 | 435 | 144 | 97 | 0.00051 |

Description
pir:[LN:F71224] [AC:F71224 ] [PN:hypothetical protein PH0057] [GN:PH0057 ] [CL:protein kinase C inhibitor:histidine triad homology] [OR:Pyrococcus horikoshii] [DB:pir2] >gp:[GI:d1030068:g3256442] [LN:AP000001] [AC:AP000001:AB009465:AB009464:AB009466:AB009467:AB009468:AB009469] [PN:168aa long hypothetical protein] [GN:PH0057] [OR:Pyrococcus horikoshii] [SR:Pyrococcus horikoshii (strain:OT3) DNA] [DB:genpept-bct1] [DE:Pyrococcus horikoshii OT3 genomic DNA, 1-287000 nt. position (1/7).] [NT:similar to owl:HPAE00058613 percent identity:] [LE:49752] [RE:50258] [DI:complement]

| ORF_Name | NTID | AAID | NT Length | AA Length | score | probability |
|---|---|---|---|---|---|---|
| AI7503000999_29532926_c3_1128 | 3115 | 6887 | 156 | 51 | | |

Description
NO-HIT

| ORF_Name | NTID | AAID | NT Length | AA Length | score | probability |
|---|---|---|---|---|---|---|
| AI7503000999_29860902_c3_1115 | 3116 | 6888 | 2277 | 758 | 1816 | 2.7e-187 |

Description
pir:[LN:C69657] [AC:C69657 ] [PN:cobalamin-independent methionine synthase metC] [GN:metC ] [CL:cobalamin-independent methionine synthase] [OR:Bacillus subtilis] [DB:pir2] >gp:[GI:e1181518:g2632038] [LN:BSAJ2571] [AC:AJ002571] [PN:MetC] [GN:metC] [FN:involved in methionine metabolism] [OR:Bacillus subtilis] [DB:genpept-bct1] [DE:Bacillus subtilis 168 56 kb DNA fragment between xlyA and ykoR.] [SP:P80877] [LE:35445] [RE:37733] [DI:complement] >gp:[GI:e1183338:g2633672] [LN:BSUB0007] [AC:Z99110:AL009126] [PN:cobalamin-independent methionine synthase] [GN:metC] [FN:methionine biosynthesis] [OR:Bacillus subtilis] [DB:genpept-bct1] [DE:Bacillus subtilis complete genome (section 7 of 21): from 1194391to 1411140.] [SP:P80877] [LE:188394] [RE:190682] [DI:complement]

| ORF_Name | NTID | AAID | NT Length | AA Length | score | probability |
|---|---|---|---|---|---|---|
| AI7503000999_3007887_f1_113 | 3117 | 6889 | 129 | 42 | | |

Description
NO-HIT

| ORF Name | NTID | AAID | NT Length | AA Length | score | probability |
|---|---|---|---|---|---|---|
| AI7503000999_30080255_f1_172 | 3118 | 6890 | 384 | 127 | | |

Description
NO-HIT

| ORF Name | NTID | AAID | NT Length | AA Length | score | probability |
|---|---|---|---|---|---|---|
| AI7503000999_30084637_f3_567 | 3119 | 6891 | 156 | 51 | | |

Description
NO-HIT

| ORF Name | NTID | AAID | NT Length | AA Length | score | probability |
|---|---|---|---|---|---|---|
| AI7503000999_30086682_c2_1041 | 3120 | 6892 | 732 | 243 | 1134 | 5.1e-115 |

Description
pir:[LN:C29504] [AC:C29504 ] [PN:hypothetical 24K protein (mer operon)]
[OR:Staphylococcus aureus] [DB:pir2] >gp:[GI:g459905] [LN:L29436]
[AC:L29436:M15048:N00048] [OR:Plasmid pI258] [SR:Plasmid pI258 DNA] [DB:genpept-bct1]
[DE:Plasmid pI258 (from S.aureus strain RN23 8325) mercury resistance(mer) operon
encoding mercuric reductase (merA), organomercuriallyase (merB), regulatory protein
(merR) and membrane transportprotein (merT), complete cds.] [NT:ORF4] [LE:1936]
[RE:2616] [DI:direct]

| ORF Name | NTID | AAID | NT Length | AA Length | score | probability |
|---|---|---|---|---|---|---|
| AI7503000999_30111718_c2_1051 | 3121 | 6893 | 2124 | 707 | 1980 | 7.5e-211 |

Description
sp:[LN:COPB_ENTHR] [AC:P05425] [GN:COPB] [OR:ENTEROCOCCUS HIRAE] [EC:3.6.1.36]
[DE:COPPER/POTASSIUM-TRANSPORTING ATPASE B,] [SP:P05425] [DB:swissprot]
>pir:[LN:B45995] [AC:B45995 ] [PN:copper-transporting ATPase, copB] [GN:copB ]
[CL:Enterococcus copper-transporting ATPase copB: ATPase nucleotide-binding domain
homology:ATPase transduction domain homology] [OR:Enterococcus hirae] [EC:3.6.1.-]
[DB:pir1] >gp:[GI:g290643] [LN:ENECOPPUMP] [AC:L13292:J02729] [PN:ATPase] [GN:copB]
[FN:copper pump] [OR:Enterococcus hirae] [SR:Enterococcus hirae DNA] [DB:genpept-bct1]
[DE:Enterococcus hirae ATPase (copA) gene, complete cds; ATPase (copB)gene, complete
cds.] [NT:putative] [LE:2273] [RE:4510] [DI:direct]

| ORF Name | NTID | AAID | NT Length | AA Length | score | probability |
|---|---|---|---|---|---|---|
| AI7503000999_30516552_f1_160 | 3122 | 6894 | 144 | 47 | | |

Description
NO-HIT

| ORF Name | NTID | AAID | NT Length | AA Length | score | probability |
|---|---|---|---|---|---|---|
| AI7503000999_31267125_c3_1216 | 3123 | 6895 | 132 | 43 | | |

Description
NO-HIT

| ORF Name | NTID | AAID | NT Length | AA Length | score | probability |
|---|---|---|---|---|---|---|
| AI7503000999_31443827_f2_419 | 3124 | 6896 | 510 | 169 | 563 | 1.6e-54 |

Description sp:[LN:SSB_BACSU] [AC:P37455] [GN:SSB] [OR:BACILLUS SUBTILIS] [DE:SINGLE-STRAND BINDING PROTEIN (SSB) (HELIX-DESTABILIZING PROTEIN)] [SP:P37455] [DB:swissprot] >pir:[LN:S66014] [AC:S66014:F69718 ] [PN:single strand DNA binding protein ssb] [GN:ssb ] [CL:single-stranded DNA-binding protein: single-stranded DNA-binding protein homology] [OR:Bacillus subtilis] [DB:pir2] >gp:[GI:d1005762:g467374] [LN:BAC180K] [AC:D26185] [PN:single strand DNA binding protein] [GN:ssb] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:46882] [RE:47400] [DI:complement] >gp:[GI:e1184816:g2636637] [LN:BSUB0021] [AC:Z99124:AL009126] [PN:single-strand DNA-binding protein] [GN:ssb] [OR:Bacillus subtilis] [DB:genpept-bct1] [DE:Bacillus subtilis complete genome (section 21 of 21): from 3999281to 4214814.] [SP:P37455] [LE:198814] [RE:199332] [DI:complement]

| ORF Name | NTID | AAID | NT Length | AA Length | score | probability |
|---|---|---|---|---|---|---|
| AI7503000999_31535626_f3_569 | 3125 | 6897 | 153 | 50 | | |

Description

NO-HIT

| ORF Name | NTID | AAID | NT Length | AA Length | score | probability |
|---|---|---|---|---|---|---|
| AI7503000999_3158177_f2_232 | 3126 | 6898 | 123 | 40 | | |

Description

NO-HIT

| ORF Name | NTID | AAID | NT Length | AA Length | score | probability |
|---|---|---|---|---|---|---|
| AI7503000999_32062762_c2_954 | 3127 | 6899 | 183 | 60 | | |

Description

NO-HIT

| ORF Name | NTID | AAID | NT Length | AA Length | score | probability |
|---|---|---|---|---|---|---|
| AI7503000999_32226577_c3_1254 | 3128 | 6900 | 354 | 117 | 596 | 5.2e-58 |

Description pir:[LN:B29504] [AC:B29504 ] [PN:hypothetical 18K protein (mer operon)] [OR:Staphylococcus aureus] [DB:pir2] >gp:[GI:g459904] [LN:L29436] [AC:L29436:M15048:N00048] [OR:Plasmid pI258] [SR:Plasmid pI258 DNA] [DB:genpept-bct1] [DE:Plasmid pI258 (from S.aureus strain RN23 8325) mercury resistance(mer) operon encoding mercuric reductase (merA), organomercuriallyase (merB), regulatory protein (merR) and membrane transportprotein (merT), complete cds.] [NT:ORF3] [LE:1454] [RE:1939] [DI:direct]

| ORF Name | NTID | AAID | NT Length | AA Length | score | probability |
|---|---|---|---|---|---|---|
| AI7503000999_32423410_c1_718 | 3129 | 6901 | 210 | 69 | 167 | 1.5e-12 |

Description sp:[LN:YG27_ARCFU] [AC:O28646] [GN:AF1627] [OR:ARCHAEOGLOBUS FULGIDUS] [DE:HYPOTHETICAL TRANSCRIPTIONAL REGULATOR AF1627] [SP:O28646] [DB:swissprot] >pir:[LN:B69453] [AC:B69453 ] [PN:repressor protein homolog] [OR:Archaeoglobus fulgidus] [DB:pir2] >gp:[GI:g2648932] [LN:AE000990] [AC:AE000990:AE000782] [PN:repressor protein] [GN:AF1627] [OR:Archaeoglobus fulgidus] [DB:genpept-bct2] [DE:Archaeoglobus fulgidus section 117 of 172 of the complete genome.] [NT:similar to GB:L77117 PID:1590997 percent identity:] [LE:7667] [RE:7882] [DI:direct]

| ORF Name | NTID | AAID | NT Length | AA Length | score | probability |
|---|---|---|---|---|---|---|
| AI7503000999_32577_f3_495 | 3130 | 6902 | 138 | 45 | | |

Description
NO-HIT

| ORF Name | NTID | AAID | NT Length | AA Length | score | probability |
|---|---|---|---|---|---|---|
| AI7503000999_3320317_f3_648 | 3131 | 6903 | 237 | 78 | 150 | 9.5e-11 |

Description
gp:[GI:g2109447] [LN:SPDNAARG] [AC:AF000658] [FN:unknown] [OR:Streptococcus pneumoniae]
[DB:genpept-bct2] [DE:Streptococcus pneumoniae R801 tRNA-Arg gene, partial sequence,
andputative serine protease (sphtra), SPSpoJ (spspoJ), initiatorprotein (spdnaa) and
beta subunit of DNA polymerase III (spdnan)genes, complete cds.] [NT:ORFX] [LE:5708]
[RE:5902] [DI:direct]

| ORF Name | NTID | AAID | NT Length | AA Length | score | probability |
|---|---|---|---|---|---|---|
| AI7503000999_33228180_f1_192 | 3132 | 6904 | 243 | 80 | | |

Description
NO-HIT

| ORF Name | NTID | AAID | NT Length | AA Length | score | probability |
|---|---|---|---|---|---|---|
| AI7503000999_33244187_c3_1168 | 3133 | 6905 | 1989 | 662 | 1592 | 1.5e-163 |

Description
sp:[LN:YYBT_BACSU] [AC:P37484] [GN:YYBT] [OR:BACILLUS SUBTILIS] [DE:HYPOTHETICAL 74.3
KD PROTEIN IN RPLI-COTF INTERGENIC REGION] [SP:P37484] [DB:swissprot] >pir:[LN:S65976]
[AC:S65976:G70088 ] [PN:hypothetical protein yybT] [GN:yybT ] [OR:Bacillus subtilis]
[DB:pir2] >gp:[GI:d1005724:g467336] [LN:BAC180K] [AC:D26185] [PN:unknown] [OR:Bacillus
subtilis] [SR:Bacillus subtilis (sub_species:Marburg, strain:168) DNA]
[DB:genpept-bct1] [DE:B. subtilis DNA, 180 kilobase region of replication origin.]
[LE:11639] [RE:13618] [DI:complement] >gp:[GI:e1184777:g2636598] [LN:BSUB0021]
[AC:Z99124:AL009126] [GN:yybT] [FN:unknown] [OR:Bacillus subtilis] [DB:genpept-bct1]
[DE:Bacillus subtilis complete genome (section 21 of 21): from 3999281to 4214814.]
[SP:P37484] [LE:163571] [RE:165550] [DI:complement]

| ORF Name | NTID | AAID | NT Length | AA Length | score | probability |
|---|---|---|---|---|---|---|
| AI7503000999_33261588_c2_1004 | 3134 | 6906 | 690 | 229 | | |

Description
NO-HIT

| ORF Name | NTID | AAID | NT Length | AA Length | score | probability |
|---|---|---|---|---|---|---|
| AI7503000999_33261637_c3_1237 | 3135 | 6907 | 543 | 180 | 79 | 0.0068 |

Description
gp:[GI:g765070] [LN:STAATL] [AC:L41499] [OR:Staphylococcus aureus] [SR:Staphylococcus
aureus (strain 8325/4) DNA] [DB:genpept-bct1] [DE:Staphylococcus aureus ORF1, partial
cds, ORF2, ORF3, autolysin(atl) genes, complete cds.] [NT:ORF1] [LE:<1] [RE:249]
[DI:direct]

| ORF Name | NTID | AAID | NT Length | AA Length | score | probability |
|---|---|---|---|---|---|---|
| AI7503000999_33337760_c2_983 | 3136 | 6908 | 705 | 234 | 1191 | 4.6e-121 |

Description
gp:[GI:g5114230] [LN:AF136709] [AC:AF136709] [PN:response regulator YycF] [GN:yycF] [OR:Staphylococcus aureus] [DB:genpept] [DE:Staphylococcus aureus response regulator YycF (yycF) and histidinekinase YycG (yyCG) genes, complete cds.] [LE:649] [RE:1350] [DI:direct]

| ORF Name | NTID | AAID | NT Length | AA Length | score | probability |
|---|---|---|---|---|---|---|
| AI7503000999_33720053_c1_808 | 3137 | 6909 | 126 | 41 | | |

Description
NO-HIT

| ORF Name | NTID | AAID | NT Length | AA Length | score | probability |
|---|---|---|---|---|---|---|
| AI7503000999_33790702_f3_612 | 3138 | 6910 | 150 | 49 | | |

Description
NO-HIT

| ORF Name | NTID | AAID | NT Length | AA Length | score | probability |
|---|---|---|---|---|---|---|
| AI7503000999_33867212_f3_548 | 3139 | 6911 | 339 | 112 | | |

Description
NO-HIT

| ORF Name | NTID | AAID | NT Length | AA Length | score | probability |
|---|---|---|---|---|---|---|
| AI7503000999_33994126_f3_633 | 3140 | 6912 | 144 | 47 | 47 | 0.045 |

Description
gp:[GI:g1204027] [LN:UREUREASEA] [AC:L40489] [OR:Ureaplasma urealyticum] [SR:Ureaplasma urealyticum (strain 7) DNA] [DB:genpept-bct1] [DE:Ureaplasma urealyticum strain 7 urease operon encoding ORF1, ureA,ureB, ureC, ureE, ureF, and ureG, complete cds, and ureD genes, 5'end of cds.] [NT:ORF1; Protein sequence is in conflict with the] [LE:136] [RE:468] [DI:direct]

| ORF Name | NTID | AAID | NT Length | AA Length | score | probability |
|---|---|---|---|---|---|---|
| AI7503000999_34016880_f2_333 | 3141 | 6913 | 2028 | 675 | 3474 | 0.0 |

Description
pir:[LN:JQ0774] [AC:JQ0774 ] [PN:penicillin-binding protein mecA, low-affinity:penicillin-binding protein 2'] [GN:mecA ] [OR:Staphylococcus epidermidis] [DB:pir2] >gp:[GI:g46994] [LN:SEMECAPB] [AC:X52592] [OR:Staphylococcus epidermidis] [DB:genpept-bct1] [DE:S. epidermidis mecA gene for PBP2' (penicillin binding protein 2').] [NT:PBP2' (AA 1 - 668)] [LE:141] [RE:2147] [DI:direct] >gp:[GI:d1046026:g5360850] [LN:D86934] [AC:D86934] [PN:penicillin binding protein 2] [GN:mecA] [OR:Staphylococcus aureus] [SR:Staphylococcus aureus (strain:N315) DNA, clone_lib:library of N31] [DB:genpept] [DE:Staphylococcus aureus genes, mec region, partial and complete cds.] [NT:ORF N058] [LE:43471] [RE:45477] [DI:direct]

| ORF Name | NTID | AAID | NT Length | AA Length | score | probability |
|---|---|---|---|---|---|---|
| AI7503000999_3401887_f1_225 | 3142 | 6914 | 1485 | 494 | 1969 | 1.7e-203 |

Description
pir:[LN:DEBSMP] [AC:S66039:S12623:D69638 ] [PN:IMP dehydrogenase,:inositol-monophosphate dehydrogenase guaB] [GN:guaB ] [CL:IMP dehydrogenase:CBS homology] [OR:Bacillus subtilis] [EC:1.1.1.205] [DB:pir1] >gp:[GI:d1005787:g467399] [LN:BAC180K] [AC:D26185] [PN:IMP dehydrogenase] [GN:guaB] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:79515] [RE:80981] [DI:direct] >gp:[GI:e1181942:g2632276] [LN:BSUB0001] [AC:Z99104:AL009126] [PN:inositol-monophosphate dehydrogenase] [GN:guaB] [FN:GMP biosynthesis] [OR:Bacillus subtilis] [DB:genpept-bct1] [EC:1.1.1.205] [DE:Bacillus subtilis complete genome (section 1 of 21): from 1 to213080.] [NT:alternate gene name: guaA] [SP:P21879] [LE:15913] [RE:17379] [DI:direct]

| ORF Name | NTID | AAID | NT Length | AA Length | score | probability |
|---|---|---|---|---|---|---|
| AI7503000999_34023251_f2_389 | 3143 | 6915 | 198 | 65 | 68 | 0.045 |

Description
gp:[GI:g205733] [LN:RATNKBNT4] [AC:M21187:J03185:M18622] [OR:Rattus norvegicus] [SR:Rat testis DNA, clone rNT19] [DB:genpept-rod] [DE:Rat neurotensin/neuromedin N gene, exon 4.] [NT:preproneurotensin/neuromedin N] [LE:M21218.1:8:11] [RE:232:163] [DI:directJoin]

| ORF Name | NTID | AAID | NT Length | AA Length | score | probability |
|---|---|---|---|---|---|---|
| AI7503000999_34160260_f2_322 | 3144 | 6916 | 138 | 45 | | |

Description
NO-HIT

| ORF Name | NTID | AAID | NT Length | AA Length | score | probability |
|---|---|---|---|---|---|---|
| AI7503000999_34178401_f3_462 | 3145 | 6917 | 150 | 49 | | |

Description
NO-HIT

| ORF Name | NTID | AAID | NT Length | AA Length | score | probability |
|---|---|---|---|---|---|---|
| AI7503000999_34179761_c2_903 | 3146 | 6918 | 147 | 48 | | |

Description
NO-HIT

| ORF Name | NTID | AAID | NT Length | AA Length | score | probability |
|---|---|---|---|---|---|---|
| AI7503000999_34180340_f2_398 | 3147 | 6919 | 711 | 236 | 609 | 2.2e-59 |

Description
gp:[GI:d1025734:g2879914] [LN:D85752] [AC:D85752] [GN:bacH] [OR:Enterococcus faecalis] [SR:Enterococcus faecalis plasmid:pPD1 DNA] [DB:genpept-bct1] [DE:Enterococcus faecalis plasmid pPD1 bacA, bacB, bacC, bacD, bacE,bacF, bacG, bacH and bacI genes, complete cds.] [LE:7148] [RE:7735] [DI:direct]

| ORF Name | NTID | AAID | NT Length | AA Length | score | probability |
|---|---|---|---|---|---|---|
| AI7503000999_34182952_f3_625 | 3148 | 6920 | 402 | 133 | 88 | 0.013 |

Description
pir:[LN:G69850] [AC:G69850 ] [PN:hypothetical protein yjhA] [GN:yjhA ] [OR:Bacillus subtilis] [DB:pir2] >gp:[GI:e1183238:g2633572] [LN:BSUB0007] [AC:Z99110:AL009126] [GN:yjhA] [FN:unknown] [OR:Bacillus subtilis] [DB:genpept-bct1] [DE:Bacillus subtilis complete genome (section 7 of 21): from 1194391to 1411140.] [LE:94377] [RE:95018] [DI:direct] >gp:[GI:g2612890] [LN:AF015825] [AC:AF015825] [PN:putative lipoprotein] [GN:yjhA] [OR:Bacillus subtilis] [DB:genpept-bct2] [DE:Bacillus subtilis 168 cotT-rapA region sequence.] [LE:8537] [RE:9178] [DI:direct]

| ORF Name | NTID | AAID | NT Length | AA Length | score | probability |
|---|---|---|---|---|---|---|
| AI7503000999_34266582_c2_965 | 3149 | 6921 | 1158 | 385 | 1796 | 3.6e-185 |

Description
sp:[LN:DP3B_STAAU] [AC:P50029] [GN:DNAN] [OR:STAPHYLOCOCCUS AUREUS] [EC:2.7.7.7] [DE:DNA POLYMERASE III, BETA CHAIN,] [SP:P50029] [DB:swissprot] >pir:[LN:S54708] [AC:S54708 ] [PN:DNA-directed DNA polymerase, III beta chain:dnaN] [GN:dnaN ] [CL:DNA-directed DNA polymerase III beta chain] [OR:Staphylococcus aureus] [EC:2.7.7.7] [DB:pir1]

| ORF Name | NTID | AAID | NT Length | AA Length | score | probability |
|---|---|---|---|---|---|---|
| AI7503000999_34414012_f1_211 | 3150 | 6922 | 273 | 90 | 336 | 1.8e-30 |

Description
pir:[LN:S66013] [AC:S66013:S11368:A69701 ] [PN:ribosomal protein S18 (rpsR):ribosomal protein BS21] [GN:rpsR ] [CL:Escherichia coli ribosomal protein S18] [OR:Bacillus subtilis] [DB:pir2] >gp:[GI:d1005761:g467373] [LN:BAC180K] [AC:D26185] [PN:ribosomal protein S18] [GN:rpsR] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:46599] [RE:46844] [DI:complement] >gp:[GI:e1184815:g2636636] [LN:BSUB0021] [AC:Z99124:AL009126] [PN:ribosomal protein S18] [GN:rpsR] [OR:Bacillus subtilis] [DB:genpept-bct1] [DE:Bacillus subtilis complete genome (section 21 of 21): from 3999281to 4214814.] [SP:P21475] [LE:198531] [RE:198776] [DI:complement]

| ORF Name | NTID | AAID | NT Length | AA Length | score | probability |
|---|---|---|---|---|---|---|
| AI7503000999_34414187_c1_692 | 3151 | 6923 | 399 | 132 | 152 | 5.8e-11 |

Description
pir:[LN:B69778] [AC:B69778 ] [PN:hypothetical protein ydeH] [GN:ydeH ] [OR:Bacillus subtilis] [DB:pir2] >gp:[GI:d1020108:g1881328] [LN:AB001488] [AC:AB001488] [GN:ydeH] [OR:Bacillus subtilis] [SR:Bacillus subtilis (strain:168) DNA] [DB:genpept-bct1] [DE:Bacillus subtilis genome sequence, 148 kb sequence of the regionbetween 35 and 47 degree.] [NT:FUNCTION UNKNOWN.] [LE:100881] [RE:101327] [DI:direct] >gp:[GI:e1182486:g2632820] [LN:BSUB0003] [AC:Z99106:AL009126] [GN:ydeH] [FN:unknown] [OR:Bacillus subtilis] [DB:genpept-bct1] [DE:Bacillus subtilis complete genome (section 3 of 21): from 402751 to611850.] [LE:164626] [RE:165072] [DI:direct]

| ORF Name | NTID | AAID | NT Length | AA Length | score | probability |
|---|---|---|---|---|---|---|
| AI7503000999_34417552_f3_615 | 3152 | 6924 | 381 | 126 | | |

Description
NO-HIT

| ORF Name | NTID | AAID | NT Length | AA Length | score | probability |
|---|---|---|---|---|---|---|
| AI7503000999_34417813_c2_985 | 3153 | 6925 | 807 | 268 | 851 | 4.9e-85 |

Description
pir:[LN:A70090] [AC:A70090 ] [PN:hypothetical protein yycJ] [GN:yycJ ] [OR:Bacillus subtilis] [DB:pir2] >gp:[GI:d1011958:g1064810] [LN:BACGNTZA] [AC:D78193] [GN:yycJ] [OR:Bacillus subtilis] [SR:Bacillus subtilis (strain:168) DNA] [DB:genpept-bct1] [DE:Bacillus subtilis 36kb sequence between gntZ and trnY genesencoding 34 ORFs.] [LE:30382] [RE:31188] [DI:complement] >gp:[GI:e1184763:g2636584] [LN:BSUB0021] [AC:Z99124:AL009126] [GN:yycJ] [FN:unknown] [OR:Bacillus subtilis] [DB:genpept-bct1] [DE:Bacillus subtilis complete genome (section 21 of 21): from 3999281to 4214814.] [LE:148766] [RE:149572] [DI:complement]

| ORF Name | NTID | AAID | NT Length | AA Length | score | probability |
|---|---|---|---|---|---|---|
| AI7503000999_34580342_c1_730 | 3154 | 6926 | 771 | 256 | 802 | 7.7e-80 |

Description
pir:[LN:A70001] [AC:A70001 ] [PN:ABC transporter (ATP-binding protein) homolog ytsC] [GN:ytsC ] [CL:ATP-binding cassette homology] [OR:Bacillus subtilis] [DB:pir2] >gp:[GI:e1185911:g2635522] [LN:BSUB0016] [AC:Z99119:AL009126] [GN:ytsC] [FN:unknown] [OR:Bacillus subtilis] [DB:genpept-bct1] [DE:Bacillus subtilis complete genome (section 16 of 21): from 2997771to 3213410.] [NT:similar to ABC transporter (ATP-binding protein)] [LE:112638] [RE:113399] [DI:complement] >gp:[GI:g2293177] [LN:AF008220] [AC:AF008220] [PN:transporter] [GN:ytsC] [OR:Bacillus subtilis] [DB:genpept-bct2] [DE:Bacillus subtilis rrnB-dnaB genomic region.] [LE:67028] [RE:67789] [DI:direct]

| ORF Name | NTID | AAID | NT Length | AA Length | score | probability |
|---|---|---|---|---|---|---|
| AI7503000999_34631527_f1_20 | 3155 | 6927 | 834 | 277 | 609 | 2.2e-59 |

Description
gp:[GI:d1045999:g5360823] [LN:D86934] [AC:D86934] [PN:IS150-like transposase] [OR:Staphylococcus aureus] [SR:Staphylococcus aureus (strain:N315) DNA, clone_lib:library of N31] [DB:genpept] [DE:Staphylococcus aureus genes, mec region, partial and complete cds.] [NT:ORF N028; putative] [LE:<20180] [RE:20578] [DI:direct]

| ORF Name | NTID | AAID | NT Length | AA Length | score | probability |
|---|---|---|---|---|---|---|
| AI7503000999_34643751_c1_688 | 3156 | 6928 | 591 | 196 | 910 | 2.8e-91 |

Description
gp:[GI:g1916316] [LN:SAU92441] [AC:U92441:X85029] [PN:alkyl hydroperoxide reductase subunit C] [GN:ahpC] [OR:Staphylococcus aureus] [DB:genpept-bct1] [DE:Staphylococcus aureus alkyl hydroperoxide reductase subunit C(aphC) and subunit F (aphF) genes, complete cds.] [NT:AhpC] [LE:791] [RE:1360] [DI:direct]

| ORF_Name | NTID | AAID | NT Length | AA Length | score | probability |
|---|---|---|---|---|---|---|
| AI7503000999_34664700_f2_393 | 3157 | 6929 | 861 | 286 | 617 | 3.1e-60 |

Description sp:[LN:YYAA_BACSU] [AC:P37524] [GN:YYAA] [OR:BACILLUS SUBTILIS] [DE:HYPOTHETICAL 32.8 KD PROTEIN IN SPO0J-GIDB INTERGENIC REGION] [SP:P37524] [DB:swissprot] >pir:[LN:I40442] [AC:I40442:S66023:H70083:S18078 ] [PN:DNA-binding protein Spo0J-like homolog yyaA:probable DNA binding protein (replication origin region)] [GN:yyaA ] [CL:Bacillus subtilis transport protein spo0J] [OR:Bacillus subtilis] [DB:pir2]
>gp:[GI:d1005771:g467383] [LN:BAC180K] [AC:D26185] [PN:DNA binding protein (probable)] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:55893] [RE:56744] [DI:complement] >gp:[GI:g40028] [LN:BSORIGS] [AC:X62539] [OR:Bacillus subtilis] [DB:genpept-bct1] [DE:B.subtilis genes rpmH, rnpA, 50kd, gidA and gidB.] [NT:unnamed protein product] [SP:P37524] [LE:6656] [RE:7507] [DI:direct]
>gp:[GI:e1184825:g2636646] [LN:BSUB0021] [AC:Z99124:AL009126] [GN:yyaA] [FN:unknown] [OR:Bacillus subtilis] [DB:genpept-bct1] [DE:Bacillus subtilis complete genome (section 21 of 21): from 3999281to 4214814.] [NT:similar to DNA-binding protein Spo0J-like] [SP:P37524] [LE:207825] [RE:208676] [DI:complement]

| ORF_Name | NTID | AAID | NT Length | AA Length | score | probability |
|---|---|---|---|---|---|---|
| AI7503000999_35157813_f2_244 | 3158 | 6930 | 519 | 172 | 473 | 5.6e-45 |

Description sp:[LN:ATDA_ECOLI] [AC:P37354] [GN:SPEG] [OR:ESCHERICHIA COLI] [EC:2.3.1.57] [DE:ACETYLTRANSFERASE) (SAT)] [SP:P37354] [DB:swissprot] >gp:[GI:d1016007:g1742583] [LN:D90799] [AC:D90799:AB001340] [PN:Spermidine N1-acetyltransferase (EC 2.3.1.57)] [GN:speG] [OR:Escherichia coli] [SR:Escherichia coli (strain:K12) DNA, clone_lib:Kohara lambda minise] [DB:genpept-bct1] [DE:E.coli genomic DNA, Kohara clone #308(35.3-35.7 min.).] [NT:ORF_ID:o309#16; similar to [SwissProt Accession] [LE:<18154] [RE:18711] [DI:direct] >gp:[GI:d1016029:g1742606] [LN:D90800] [AC:D90800:AB001340] [PN:Spermidine N1-acetyltransferase (EC 2.3.1.57)] [GN:speG] [OR:Escherichia coli] [SR:Escherichia coli (strain:K12) DNA, clone_lib:Kohara lambda minise] [DB:genpept-bct1] [DE:E.coli genomic DNA, Kohara clone #309(35.4-35.7 min.).] [NT:ORF_ID:o309#16; similar to [SwissProt Accession] [LE:<14930] [RE:15487] [DI:direct] >gp:[GI:d1016031:g1742609] [LN:D90801] [AC:D90801:AB001340] [PN:Spermidine N1-acetyltransferase (EC 2.3.1.57)] [GN:speG] [OR:Escherichia coli] [SR:Escherichia coli (strain:K12) DNA, clone_lib:Kohara lambda minise] [DB:genpept-bct1] [DE:E.coli genomic DNA, Kohara clone #310(35.7-36.0 min.).] [NT:ORF_ID:o309#16; similar to [SwissProt Accession] [LE:<814] [RE:1371] [DI:direct]

| ORF_Name | NTID | AAID | NT Length | AA Length | score | probability |
|---|---|---|---|---|---|---|
| AI7503000999_35324092_c1_772 | 3159 | 6931 | 987 | 328 | 219 | 9.3e-28 |

Description sp:[LN:MET2_YEAST] [AC:P08465] [GN:MET2:YNL277W:N0615] [OR:SACCHAROMYCES CEREVISIAE] [SR:,BAKER'S YEAST] [EC:2.3.1.31] [DE:ACETYLASE)] [SP:P08465] [DB:swissprot]
>pir:[LN:S63251] [AC:S63251:A27163 ] [PN:homoserine O-acetyltransferase,:protein N0615:protein YNL277w] [GN:MET2 ] [CL:homoserine acetyltransferase] [OR:Saccharomyces cerevisiae] [EC:2.3.1.31] [DB:pir2] [MP:14L ] >gp:[GI:e239735:g1302344] [LN:SCYNL277W] [AC:Z71553:Y13139] [GN:MET2] [OR:Saccharomyces cerevisiae] [SR:baker's yeast] [DB:genpept-pln1] [DE:S.cerevisiae chromosome XIV reading frame ORF YNL277w.] [NT:ORF YNL277w] [SP:P08465] [LE:896] [RE:2356] [DI:direct]

| ORF_Name | NTID | AAID | NT Length | AA Length | score | probability |
|---|---|---|---|---|---|---|
| AI7503000999_35334686_f2_331 | 3160 | 6932 | 1659 | 552 | 1253 | 1.2e-127 |

Description
gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF_Name | NTID | AAID | NT Length | AA Length | score | probability |
|---|---|---|---|---|---|---|
| AI7503000999_35343807_f1_220 | 3161 | 6933 | 237 | 78 | | |

Description
NO-HIT

| ORF_Name | NTID | AAID | NT Length | AA Length | score | probability |
|---|---|---|---|---|---|---|
| AI7503000999_35369052_c1_774 | 3162 | 6934 | 1404 | 467 | 1261 | 1.8e-128 |

Description
gp:[GI:g4416322] [LN:AF106032] [AC:AF106032] [PN:replicative helicase] [GN:dnaB] [OR:Bacillus stearothermophilus] [DB:genpept-bct2] [DE:Bacillus stearothermophilus replicative helicase (dnaB) gene,complete cds.] [NT:5'- 3' helicase; similar to Bacillus subtilis DnaC;] [LE:1] [RE:1365] [DI:direct]

| ORF_Name | NTID | AAID | NT Length | AA Length | score | probability |
|---|---|---|---|---|---|---|
| AI7503000999_35554635_c2_1001 | 3163 | 6935 | 132 | 43 | | |

Description
NO-HIT

| ORF_Name | NTID | AAID | NT Length | AA Length | score | probability |
|---|---|---|---|---|---|---|
| AI7503000999_35944052_c1_682 | 3164 | 6936 | 690 | 229 | | |

Description
NO-HIT

| ORF_Name | NTID | AAID | NT Length | AA Length | score | probability |
|---|---|---|---|---|---|---|
| AI7503000999_35978127_f3_661 | 3165 | 6937 | 777 | 258 | 559 | 4.3e-54 |

Description
sp:[LN:YWCG_BACSU] [AC:P39605] [GN:YWCG:IPA-43D] [OR:BACILLUS SUBTILIS] [DE:HYPOTHETICAL 28.3 KD PROTEIN IN QOXD-VPR INTERGENIC REGION] [SP:P39605] [DB:swissprot] >pir:[LN:S39698] [AC:S39698:B70053 ] [PN:NADPH-flavin oxidoreductase homolog ywcG:protein ipa-43d] [GN:ywcG ] [CL:NADPH-flavin oxidoreductase homolog] [OR:Bacillus subtilis] [DB:pir2] >gp:[GI:g413967] [LN:BSGENR] [AC:X73124] [GN:ipa-43d] [OR:Bacillus subtilis] [DB:genpept-bct1] [DE:B.subtilis genomic region (325 to 333).] [SP:P39605] [LE:45340] [RE:46089] [DI:direct] >gp:[GI:e1186310:g2636346] [LN:BSUB0020] [AC:Z99123:AL009126] [GN:ywcG] [FN:unknown] [OR:Bacillus subtilis] [DB:genpept-bct1] [DE:Bacillus subtilis complete genome (section 20 of 21): from 3798401to 4010550.] [NT:alternate gene name: ipa-43d; similar to] [SP:P39605] [LE:111873] [RE:112622] [DI:complement]

| ORF_Name | NTID | AAID | NT Length | AA Length | score | probability |
|---|---|---|---|---|---|---|
| AI7503000999_35984430_f2_444 | 3166 | 6938 | 126 | 41 | | |

Description
NO-HIT

| ORF Name | NTID | AAID | NT Length | AA Length | score | probability |
|---|---|---|---|---|---|---|
| AI7503000999_35991677_c2_973 | 3167 | 6939 | 177 | 58 | | |

Description
NO-HIT

| ORF Name | NTID | AAID | NT Length | AA Length | score | probability |
|---|---|---|---|---|---|---|
| AI7503000999_36135952_f2_327 | 3168 | 6940 | 1650 | 549 | 2777 | 4.0e-289 |

Description
gp:[GI:d1046002:g5360826] [LN:D86934] [AC:D86934] [PN:site-specific recombinase] [GN:ccrB] [OR:Staphylococcus aureus] [SR:Staphylococcus aureus (strain:N315) DNA, clone_lib:library of N31] [DB:genpept] [DE:Staphylococcus aureus genes, mec region, partial and complete cds.] [NT:ORF N037; cassette chromosome recombinase B] [LE:25508] [RE:27136] [DI:direct]

| ORF Name | NTID | AAID | NT Length | AA Length | score | probability |
|---|---|---|---|---|---|---|
| AI7503000999_36147301_f3_670 | 3169 | 6941 | 237 | 78 | 78 | 0.0090 |

Description
sp:[LN:COTE_BACSU] [AC:P14016] [GN:COTE] [OR:BACILLUS SUBTILIS] [DE:SPORE COAT PROTEIN E] [SP:P14016] [DB:swissprot] >pir:[LN:A31245] [AC:A31245:B69605 ] [PN:outer spore coat protein cotE] [GN:cotE ] [OR:Bacillus subtilis] [DB:pir2] >gp:[GI:g1200225] [LN:BSCOTE] [AC:X13009] [PN:coat protein] [GN:cotE] [OR:Bacillus subtilis] [DB:genpept-bct1] [DE:Bacillus subtilis cotE gene for 21kD coat protein.] [SP:P14016] [LE:390] [RE:935] [DI:direct] >gp:[GI:e1185294:g2634075] [LN:BSUB0009] [AC:Z99112:AL009126] [PN:morphogenic protein] [GN:cotE] [FN:outer coat assembly] [OR:Bacillus subtilis] [DB:genpept-bct1] [DE:Bacillus subtilis complete genome (section 9 of 21): from 1598421to 1807200.] [SP:P14016] [LE:176015] [RE:176560] [DI:direct]

| ORF Name | NTID | AAID | NT Length | AA Length | score | probability |
|---|---|---|---|---|---|---|
| AI7503000999_36211052_c1_855 | 3170 | 6942 | 1662 | 553 | 2755 | 8.5e-287 |

Description
sp:[LN:MERA_STAAU] [AC:P08663] [GN:MERA] [OR:STAPHYLOCOCCUS AUREUS] [EC:1.16.1.1] [DE:MERCURIC REDUCTASE, (HG(II) REDUCTASE)] [SP:P08663] [DB:swissprot] >pir:[LN:E29504] [AC:E29504 ] [PN:mercury(II) reductase,:Hg(II) reductase:mercuric reductase] [GN:merA ] [CL:Bacillus mercury(II) reductase:dihydrolipoamide dehydrogenase homology:heavy-metal-associated homology] [OR:Staphylococcus aureus] [EC:1.16.1.1] [DB:pir2] >gp:[GI:g459907] [LN:L29436] [AC:L29436:M15048:N00048] [PN:mercuric reductase] [GN:merA] [OR:Plasmid pI258] [SR:Plasmid pI258 DNA] [DB:genpept-bct1] [DE:Plasmid pI258 (from S.aureus strain RN23 8325) mercury resistance(mer) operon encoding mercuric reductase (merA), organomercuriallyase (merB), regulatory protein (merR) and membrane transportprotein (merT), complete cds.] [LE:3148] [RE:4791] [DI:direct]

| ORF Name | NTID | AAID | NT Length | AA Length | score | probability |
|---|---|---|---|---|---|---|
| AI7503000999_36225427_f2_319 | 3171 | 6943 | 615 | 204 | | |

Description
NO-HIT

| ORF Name | NTID | AAID | NT Length | AA Length | score | probability |
|---|---|---|---|---|---|---|
| AI7503000999_36226501_c2_1018 | 3172 | 6944 | 891 | 296 | | |

Description
NO-HIT

| ORF_Name | NTID | AAID | NT Length | AA Length | score | probability |
|---|---|---|---|---|---|---|
| AI7503000999_36228126_f2_392 | 3173 | 6945 | 1896 | 631 | 2407 | 6.4e-250 |

Description
sp:[LN:GIDA_BACSU] [AC:P25812] [GN:GIDA] [OR:BACILLUS SUBTILIS] [DE:GLUCOSE INHIBITED DIVISION PROTEIN A] [SP:P25812] [DB:swissprot] >pir:[LN:BWBSGA] [AC:I40440:S66025:G69631:JQ1216:S18076 ] [PN:glucose-inhibited division protein gidA] [GN:gidA ] [CL:gidA protein] [OR:Bacillus subtilis] [DB:pirl] >gp:[GI:d1005773:g467385] [LN:BAC180K] [AC:D26185] [PN:unknown] [GN:gidA] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:57599] [RE:59485] [DI:complement] >gp:[GI:g40026] [LN:BSORIGS] [AC:X62539] [OR:Bacillus subtilis] [DB:genpept-bct1] [DE:B.subtilis genes rpmH, rnpA, 50kd, gidA and gidB.] [NT:homologous to E.coli gidA] [SP:P25812] [LE:3915] [RE:5801] [DI:direct] >gp:[GI:e1184827:g2636648] [LN:BSUB0021] [AC:Z99124:AL009126] [PN:glucose-inhibited division protein] [GN:gidA] [OR:Bacillus subtilis] [DB:genpept-bct1] [DE:Bacillus subtilis complete genome (section 21 of 21): from 3999281to 4214814.] [SP:P25812] [LE:209531] [RE:211417] [DI:complement]

| ORF_Name | NTID | AAID | NT Length | AA Length | score | probability |
|---|---|---|---|---|---|---|
| AI7503000999_36359761_f3_604 | 3174 | 6946 | 840 | 279 | 581 | 2.0e-56 |

Description
sp:[LN:YFOL_STRTR] [AC:P96051] [OR:STREPTOCOCCUS THERMOPHILUS] [DE:(ORF1091)] [SP:P96051] [DB:swissprot] >gp:[GI:g1685111] [LN:STU58210] [AC:U58210] [OR:Streptococcus thermophilus] [SR:Streptococcus thermophilus strain=Sfi6] [DB:genpept-bct2] [DE:Streptococcus thermophilus tetrahydrofolatedehydrogenase/cyclohydrolase (folD), penicillin-binding protein 2b(pbp2b) and DNA repair and recombination protein (recM) genes,complete cds.] [NT:orf1091] [LE:1091] [RE:1927] [DI:direct]

| ORF_Name | NTID | AAID | NT Length | AA Length | score | probability |
|---|---|---|---|---|---|---|
| AI7503000999_36522507_f1_163 | 3175 | 6947 | 741 | 246 | 740 | 2.9e-73 |

Description
sp:[LN:GIDB_BACSU] [AC:P25813] [GN:GIDB] [OR:BACILLUS SUBTILIS] [DE:GLUCOSE INHIBITED DIVISION PROTEIN B] [SP:P25813] [DB:swissprot] >pir:[LN:BWBSGB] [AC:I40441:S66024:H69631:JQ1217:S18077 ] [PN:glucose-inhibited division protein gidB] [GN:gidB ] [CL:gidB protein] [OR:Bacillus subtilis] [DB:pirl] >gp:[GI:d1005772:g467384] [LN:BAC180K] [AC:D26185] [PN:unknown] [GN:gidB] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:56866] [RE:57585] [DI:complement] >gp:[GI:g40027] [LN:BSORIGS] [AC:X62539] [OR:Bacillus subtilis] [DB:genpept-bct1] [DE:B.subtilis genes rpmH, rnpA, 50kd, gidA and gidB.] [NT:homologous to E.coli gidB] [SP:P25813] [LE:5815] [RE:6534] [DI:direct] >gp:[GI:e1184826:g2636647] [LN:BSUB0021] [AC:Z99124:AL009126] [PN:glucose-inhibited division protein] [GN:gidB] [OR:Bacillus subtilis] [DB:genpept-bct1] [DE:Bacillus subtilis complete genome (section 21 of 21): from 3999281to 4214814.] [SP:P25813] [LE:208798] [RE:209517] [DI:complement]

| ORF_Name | NTID | AAID | NT Length | AA Length | score | probability |
|---|---|---|---|---|---|---|
| AI7503000999_36584652_c1_805 | 3176 | 6948 | 339 | 112 | 380 | 4.0e-35 |

Description
gp:[GI:d1045996:g5360820] [LN:D86934] [AC:D86934] [PN:transposase] [OR:Staphylococcus aureus] [SR:Staphylococcus aureus (strain:N315) DNA, clone_lib:library of N31] [DB:genpept] [DE:Staphylococcus aureus genes, mec region, partial and complete cds.] [NT:ORF N026; putative] [LE:19527] [RE:19751] [DI:direct]

| ORF_Name | NTID | AAID | NT Length | AA Length | score | probability |
|---|---|---|---|---|---|---|
| AI7503000999_37892_f1_217 | 3177 | 6949 | 162 | 53 | | |

Description
NO-HIT

| ORF_Name | NTID | AAID | NT Length | AA Length | score | probability |
|---|---|---|---|---|---|---|
| AI7503000999_3906578_f1_8 | 3178 | 6950 | 123 | 40 | | |

Description
NO-HIT

| ORF_Name | NTID | AAID | NT Length | AA Length | score | probability |
|---|---|---|---|---|---|---|
| AI7503000999_3913137_f2_262 | 3179 | 6951 | 570 | 189 | 982 | 6.5e-99 |

Description
gp:[GI:g459909] [LN:L29436] [AC:L29436:M15048:N00048] [OR:Plasmid pI258] [SR:Plasmid pI258 DNA] [DB:genpept-bct1] [DE:Plasmid pI258 (from S.aureus strain RN23 8325) mercury resistance(mer) operon encoding mercuric reductase (merA), organomercuriallyase (merB), regulatory protein (merR) and membrane transportprotein (merT), complete cds.] [NT:ORF1] [LE:5718] [RE:6266] [DI:complement]

| ORF_Name | NTID | AAID | NT Length | AA Length | score | probability |
|---|---|---|---|---|---|---|
| AI7503000999_3937713_c3_1215 | 3180 | 6952 | 174 | 57 | | |

Description
NO-HIT

| ORF_Name | NTID | AAID | NT Length | AA Length | score | probability |
|---|---|---|---|---|---|---|
| AI7503000999_3938802_f2_326 | 3181 | 6953 | 1383 | 460 | 2306 | 3.2e-239 |

Description
gp:[GI:d1046000:g5360824] [LN:D86934] [AC:D86934] [PN:site-specific recombinase] [GN:ccrA] [OR:Staphylococcus aureus] [SR:Staphylococcus aureus (strain:N315) DNA, clone_lib:library of N31] [DB:genpept] [DE:Staphylococcus aureus genes, mec region, partial and complete cds.] [NT:ORF N034; cassette chromosome recombinase A] [LE:24137] [RE:25486] [DI:direct]

| ORF_Name | NTID | AAID | NT Length | AA Length | score | probability |
|---|---|---|---|---|---|---|
| AI7503000999_3954450_c3_1101 | 3182 | 6954 | 129 | 42 | | |

Description
NO-HIT

| ORF_Name | NTID | AAID | NT Length | AA Length | score | probability |
|---|---|---|---|---|---|---|
| AI7503000999_4016887_f1_6 | 3183 | 6955 | 174 | 57 | 157 | 2.6e-10 |

Description
sp:[LN:CADA_LISMO] [AC:Q60048] [GN:CADA] [OR:LISTERIA MONOCYTOGENES] [EC:3.6.1.-] [DE:ATPASE)] [SP:Q60048] [DB:swissprot] >gp:[GI:g495646] [LN:LISCADTNP] [AC:L28104] [PN:ATPase] [GN:cadA] [FN:cadmium resistance] [OR:Transposon Tn5422] [SR:Listeria monocytogenes (individual_isolate Lm74) DNA; Transposo] [DB:genpept-una] [DE:Listeria monocytogenes ATPase (cadA) gene; accessory protein (cadC)gene; resolvase (tnpR) gene and transposase (tnpA) gene.] [LE:158] [RE:2293] [DI:complement]

| ORF Name | NTID | AAID | NT Length | AA Length | score | probability |
|---|---|---|---|---|---|---|
| AI7503000999_4022952_f1_64 | 3184 | 6956 | 1515 | 504 | 1186 | 3.9e-140 |

Description pir:[LN:C70880] [AC:C70880 ] [PN:probable hsdM protein] [GN:hsdM ] [OR:Mycobacterium tuberculosis] [DB:pir2] >gp:[GI:e1173886;g2624278] [LN:MTV002] [AC:AL008967:AL123456] [PN:hsdM] [GN:hsdM] [OR:Mycobacterium tuberculosis] [DB:genpept-bct1] [DE:Mycobacterium tuberculosis H37Rv complete genome; segment 122/162.] [NT:Rv2756c, (MTV002.21c), len: 540 aa. hsdM, type I] [LE:19902] [RE:21524] [DI:complement]

| ORF Name | NTID | AAID | NT Length | AA Length | score | probability |
|---|---|---|---|---|---|---|
| AI7503000999_4025302_f3_464 | 3185 | 6957 | 1293 | 430 | 1892 | 2.4e-195 |

Description sp:[LN:ARSB_STAAU] [AC:P30329] [GN:ARSB] [OR:STAPHYLOCOCCUS AUREUS] [DE:ARSENICAL PUMP MEMBRANE PROTEIN] [SP:P30329] [DB:swissprot] >pir:[LN:C41903] [AC:C41903 ] [PN:arsenical pump membrane protein] [GN:arsB ] [CL:arsenical pump membrane protein] [OR:Staphylococcus aureus] [DB:pir1] >gp:[GI:g150728] [LN:PI2ARSRBC] [AC:M86824] [PN:arsenic efflux pump protein] [GN:arsB] [FN:arsenic efflux pump component (membrane] [OR:Plasmid pI258] [SR:Plasmid pI258 DNA] [DB:genpept-bct1] [DE:Plasmid pI258 arsenic resistance operon (arsRBC) genes, completecds.] [LE:587] [RE:1876] [DI:direct]

| ORF Name | NTID | AAID | NT Length | AA Length | score | probability |
|---|---|---|---|---|---|---|
| AI7503000999_4093937_c3_1172 | 3186 | 6958 | 192 | 63 | | |

Description

NO-HIT

| ORF Name | NTID | AAID | NT Length | AA Length | score | probability |
|---|---|---|---|---|---|---|
| AI7503000999_4098518_c2_1040 | 3187 | 6959 | 417 | 138 | 682 | 4.0e-67 |

Description sp:[LN:MERR_STAAU] [AC:P22874] [GN:MERR] [OR:STAPHYLOCOCCUS AUREUS] [DE:MERCURIC RESISTANCE OPERON REGULATORY PROTEIN] [SP:P22874] [DB:swissprot] >pir:[LN:A29504] [AC:A29504 ] [PN:hypothetical 16K protein (mer operon)] [CL:transcription repressor glnR] [OR:Staphylococcus aureus] [DB:pir2] >gp:[GI:g459903] [LN:L29436] [AC:L29436:M15048:N00048] [OR:Plasmid pI258] [SR:Plasmid pI258 DNA] [DB:genpept-bct1] [DE:Plasmid pI258 (from S.aureus strain RN23 8325) mercury resistance(mer) operon encoding mercuric reductase (merA), organomercuriallyase (merB), regulatory protein (merR) and membrane transportprotein (merT), complete cds.] [NT:ORF2] [LE:1030] [RE:1437] [DI:direct]

| ORF Name | NTID | AAID | NT Length | AA Length | score | probability |
|---|---|---|---|---|---|---|
| AI7503000999_4120462_f2_235 | 3188 | 6960 | 945 | 314 | 791 | 1.1e-78 |

Description sp:[LN:ARCL_ECOLI] [AC:Q46807] [GN:YQEA] [OR:ESCHERICHIA COLI] [DE:CARBAMATE KINASE-LIKE PROTEIN 1] [SP:Q46807] [DB:swissprot] >pir:[LN:B65071] [AC:B65071 ] [PN:hypothetical protein b2874] [CL:carbamate kinase] [OR:Escherichia coli] [DB:pir2] >gp:[GI:g887824] [LN:ECU28375] [AC:U28375] [OR:Escherichia coli] [DB:genpept-bct1] [DE:Escherichia coli K-12 genome; approximately 64 to 65 minutes.] [NT:ORF_o310] [LE:21276] [RE:22208] [DI:direct] >gp:[GI:g1789238] [LN:AE000370] [AC:AE000370:U00096] [PN:putative kinase] [GN:yqeA] [FN:putative enzyme; Not classified] [OR:Escherichia coli] [DB:genpept-bct2] [DE:Escherichia coli K-12 MG1655 section 260 of 400 of the completegenome.] [NT:o310; This 310 aa ORF is 45 pct identical (21 gaps)] [LE:11360] [RE:12292] [DI:direct]

| ORF Name | NTID | AAID | NT Length | AA Length | score | probability |
|---|---|---|---|---|---|---|
| AI7503000999_41265_c3_1170 | 3189 | 6961 | 1365 | 454 | 1593 | 1.2e-163 |

Description pir:[LN:A42280] [AC:S65968:A42280:H69683 ] [PN:adenylosuccinate synthase, purA:IMP--aspartate ligase] [GN:purA ] [CL:adenylosuccinate synthase] [OR:Bacillus subtilis] [EC:6.3.4.4] [DB:pir2] >gp:[GI:d1005716:g467328] [LN:BAC180K] [AC:D26185] [PN:adenylosuccinate synthetase] [GN:purA] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:3429] [RE:4721] [DI:complement] >gp:[GI:e1184768:g2636589] [LN:BSUB0021] [AC:Z99124:AL009126] [PN:adenylosuccinate synthetase] [GN:purA] [FN:AMP biosynthesis] [OR:Bacillus subtilis] [DB:genpept-bct1] [EC:6.3.4.4] [DE:Bacillus subtilis complete genome (section 21 of 21): from 3999281to 4214814.] [SP:P29726] [LE:155361] [RE:156653] [DI:complement]

| ORF Name | NTID | AAID | NT Length | AA Length | score | probability |
|---|---|---|---|---|---|---|
| AI7503000999_4179680_c2_977 | 3190 | 6962 | 936 | 311 | 214 | 1.7e-16 |

Description sp:[LN:YYBS_BACSU] [AC:P37485] [GN:YYBS] [OR:BACILLUS SUBTILIS] [DE:HYPOTHETICAL 34.5 KD PROTEIN IN RPLI-COTF INTERGENIC REGION] [SP:P37485] [DB:swissprot] >pir:[LN:S65977] [AC:S65977:F70088 ] [PN:hypothetical protein yybS] [GN:yybS ] [OR:Bacillus subtilis] [DB:pir2] >gp:[GI:d1005725:g467337] [LN:BAC180K] [AC:D26185] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:13655] [RE:14584] [DI:complement] >gp:[GI:e1184778:g2636599] [LN:BSUB0021] [AC:Z99124:AL009126] [GN:yybS] [FN:unknown] [OR:Bacillus subtilis] [DB:genpept-bct1] [DE:Bacillus subtilis complete genome (section 21 of 21): from 3999281to 4214814.] [SP:P37485] [LE:165587] [RE:166516] [DI:complement]

| ORF Name | NTID | AAID | NT Length | AA Length | score | probability |
|---|---|---|---|---|---|---|
| AI7503000999_4196051_f1_29 | 3191 | 6963 | 333 | 110 | 424 | 8.7e-40 |

Description pir:[LN:A41902] [AC:A41902 ] [PN:arsenical resistance operon repressor] [GN:arsR ] [CL:arsenical resistance operon repressor] [OR:Staphylococcus xylosus] [DB:pir1]

| ORF Name | NTID | AAID | NT Length | AA Length | score | probability |
|---|---|---|---|---|---|---|
| AI7503000999_42162_c3_1124 | 3192 | 6964 | 126 | 41 | | |

Description

NO-HIT

| ORF_Name | NTID | AAID | NT Length | AA Length | score | probability |
|---|---|---|---|---|---|---|
| AI7503000999_4305342_f2_445 | 3193 | 6965 | 1557 | 518 | 2015 | 2.2e-208 |

Description sp:[LN:GUAA_BACSU] [AC:P29727:O34531] [GN:GUAA] [OR:BACILLUS SUBTILIS] [EC:6.3.5.2] [DE:AMIDOTRANSFERASE) (GMP SYNTHETASE)] [SP:P29727:O34531] [DB:swissprot] >pir:[LN:C69638] [AC:C69638:B42280 ] [PN:GMP synthase (glutamine-hydrolyzing), guaA] [GN:guaA ] [CL:GMP synthase (glutamine-hydrolyzing):trpG homology] [OR:Bacillus subtilis] [EC:6.3.5.2] [DB:pir2] >gp:[GI:g2239288] [LN:BSU51115] [AC:U51115] [PN:GMP synthetase] [GN:guaA] [OR:Bacillus subtilis] [DB:genpept-bct1] [DE:Bacillus subtilis CotA (cotA), GabP (gabP), YeaB (yeaB), YeaC(yeaC), YebA (yebA), GMP synthetase (guaA) genes, complete cds, andAIR carboxylase I (purE) gene, partial cds.] [LE:9970] [RE:11511] [DI:direct] >gp:[GI:e1182615:g2632949] [LN:BSUB0004] [AC:Z99107:AL009126] [PN:GMP synthetase] [GN:guaA] [FN:GMP biosynthesis] [OR:Bacillus subtilis] [DB:genpept-bct1] [EC:6.3.5.2] [DE:Bacillus subtilis complete genome (section 4 of 21): from 600701 to813890.] [NT:alternate gene name: guaB] [SP:P29727] [LE:91559] [RE:93100] [DI:direct]

| ORF_Name | NTID | AAID | NT Length | AA Length | score | probability |
|---|---|---|---|---|---|---|
| AI7503000999_4335750_f1_166 | 3194 | 6966 | 600 | 199 | 158 | 2.0e-11 |

Description pir:[LN:I40868] [AC:I40868 ] [PN:hypothetical protein 3] [OR:Clostridium perfringens] [DB:pir2] >gp:[GI:g853809] [LN:CPNANH] [AC:X87369] [OR:Clostridium perfringens] [DB:genpept-bct1] [DE:C.perfringens nanH gene & ORF1,2,3 & 4.] [NT:ORF3] [LE:4957] [RE:5754] [DI:direct]

| ORF_Name | NTID | AAID | NT Length | AA Length | score | probability |
|---|---|---|---|---|---|---|
| AI7503000999_4453165_c1_862 | 3195 | 6967 | 537 | 178 | 202 | 1.8e-15 |

Description gp:[GI:d1006123:g473790] [LN:ECO82K] [AC:D26562] [PN:'ORF'] [OR:Escherichia coli] [SR:Escherichia coli (sub_strain W3110, strain K-12) (library: Kohara'] [DB:genpept-bct1] [DE:Escherichia coli genome, 2.4-4.1 min region (110,917-193,643 bpfrom 0 min).] [NT:'copper resistance protein copA homology'] [LE:25693] [RE:27117] [DI:direct]

| ORF_Name | NTID | AAID | NT Length | AA Length | score | probability |
|---|---|---|---|---|---|---|
| AI7503000999_446062_c3_1226 | 3196 | 6968 | 159 | 52 | 231 | 2.5e-19 |

Description pir:[LN:A60634] [AC:A60634:C30471:S26349 ] [PN:probable transposase] [OR:Staphylococcus aureus] [DB:pir2] >gp:[GI:g46597] [LN:SAIS2571] [AC:X53952] [PN:transposase] [OR:Staphylococcus aureus] [DB:genpept-bct1] [DE:S.aureus plasmid pSH6 DNA for insertion sequences IS257-1 andIS256.] [LE:188] [RE:862] [DI:direct] >gp:[GI:g3676452] [LN:AF051917] [AC:AF051917:L19570] [PN:putative transposase TnpE] [GN:tnpE] [OR:Staphylococcus aureus] [DB:genpept-bct2] [DE:Staphylococcus aureus plasmid pSK41, complete sequence.] [LE:40946] [RE:41620] [DI:direct]

| ORF_Name | NTID | AAID | NT Length | AA Length | score | probability |
|---|---|---|---|---|---|---|
| AI7503000999_4475050_f2_341 | 3197 | 6969 | 162 | 53 | 68 | 0.045 |

Description pir:[LN:F71007] [AC:F71007 ] [PN:hypothetical protein PH1356] [GN:PH1356 ]
[OR:Pyrococcus horikoshii] [DB:pir2] >gp:[GI:d1031405:g3257779] [LN:AP000006]
[AC:AP000006:AB005215:AB009510:AB009511:AB009512:AB009513:AB009514] [PN:111aa long
hypothetical protein] [GN:PH1356] [OR:Pyrococcus horikoshii] [SR:Pyrococcus horikoshii
(strain:OT3) DNA, clone:Pyrococcus horikoshi] [DB:genpept-bct1] [DE:Pyrococcus
horikoshii OT3 genomic DNA, 1166001-1485000 nt. position(6/7).] [LE:56557] [RE:56892]
[DI:direct]

| ORF_Name | NTID | AAID | NT Length | AA Length | score | probability |
|---|---|---|---|---|---|---|
| AI7503000999_4485937_f1_10 | 3198 | 6970 | 1044 | 347 | 1060 | 3.5e-107 |

Description sp:[LN:OTCC_HAEIN] [AC:P44770] [GN:ARCB:HI0596] [OR:HAEMOPHILUS INFLUENZAE]
[EC:2.1.3.3] [DE:ORNITHINE CARBAMOYLTRANSFERASE, CATABOLIC, (OTCASE)] [SP:P44770]
[DB:swissprot] >pir:[LN:H64079] [AC:H64079 ] [PN:ornithine carbamoyltransferase,]
[CL:ornithine carbamoyltransferase: aspartate/ornithine carbamoyltransferase homology]
[OR:Haemophilus influenzae] [EC:2.1.3.3] [DB:pir2] >gp:[GI:g1573585] [LN:U32741]
[AC:U32741:L42023] [PN:ornithine carbamoyltransferase (arcB)] [GN:HI0596]
[OR:Haemophilus influenzae Rd] [DB:genpept-bct2] [DE:Haemophilus influenzae Rd section
56 of 163 of the complete genome.] [NT:similar to GB:X05637 SP:P08308 PID:45288
percent] [LE:3467] [RE:4471] [DI:complement]

| ORF_Name | NTID | AAID | NT Length | AA Length | score | probability |
|---|---|---|---|---|---|---|
| AI7503000999_448785_f3_518 | 3199 | 6971 | 927 | 308 | 408 | 4.3e-38 |

Description sp:[LN:SOXR_ARTSP] [AC:Q44311] [GN:SOXR] [OR:ARTHROBACTER SP] [SR:TE1826,]
[DE:TRANSCRIPTIONAL REGULATOR SOXR] [SP:Q44311] [DB:swissprot]
>gp:[GI:d1026865:g3116220] [LN:AB007122] [AC:AB007122] [PN:negative regulator]
[OR:Arthrobacter sp.] [SR:Arthrobacter sp. (strain:TE1826) DNA] [DB:genpept-bct1]
[DE:Arthrobacter sp. gene for negative regulator, sarcosine oxidase,transporter,
creatinase, creatininase and transporter,complete cds.] [LE:321] [RE:1190]
[DI:complement] >gp:[GI:d1010363:g1333651] [LN:ARGTE1826] [AC:D63413] [PN:regulator]
[GN:soxR] [OR:Arthrobacter sp.] [SR:Arthrobacter sp. (strain:TE1826) DNA]
[DB:genpept-bct1] [DE:Arthrobacter sp. gene for sarcosine oxidase, complete cds.]
[LE:1539] [RE:2408] [DI:direct]

| ORF_Name | NTID | AAID | NT Length | AA Length | score | probability |
|---|---|---|---|---|---|---|
| AI7503000999_4694677_c1_832 | 3200 | 6972 | 324 | 107 | | |

Description

NO-HIT

| ORF Name | NTID | AAID | NT Length | AA Length | score | probability |
|---|---|---|---|---|---|---|
| AI7503000999_4697337_f3_519 | 3201 | 6973 | 549 | 182 | 255 | 7.1e-22 |

Description pir:[LN:B69978] [AC:B69978 ] [PN:2-nitropropane dioxygenase homolog yrpB] [GN:yrpB ] [OR:Bacillus subtilis] [DB:pir2] >gp:[GI:g1934639] [LN:BSU93875] [AC:U93875] [PN:2-nitropropane dioxygenase] [GN:yrpB] [OR:Bacillus subtilis] [DB:genpept-bct1] [DE:Bacillus subtilis alcohol dehydrogenase (adhB) gene, partial cds,hypothetical spore coat protein (yraF), hypothetical spore coatprotein (yraG), YraH (yraH), YraI (yraI), YraJ (yraJ), YraK (yraK),YraL (yraL), chitosanase precursor (csn), YraM (yraM), LysR-familytranscription regulator (yraN), YraO (yraO), YrpG (yrpG), RNApolymerase sigma factor SigZ (sigZ), YrpE (yrpE), YrpD (yrpD), YrpC(yrpC) and 2-nitropropane dioxygenase (yrpB) genes, complete cds,and aminoglycoside 6-adenylyltransferase (aadK) gene, partial cds.] [NT:similar to 2-nitropropane dioxigenase of Williopsis] [LE:16473] [RE:17516] [DI:complement] >gp:[GI:e1183909:g2635125] [LN:BSUB0014] [AC:Z99117:AL009126] [GN:yrpB] [FN:unknown] [OR:Bacillus subtilis] [DB:genpept-bct1] [DE:Bacillus subtilis complete genome (section 14 of 21): from 2599451to 2812870.] [NT:similar to 2-nitropropane dioxygenase] [LE:136734] [RE:137777] [DI:direct]

| ORF Name | NTID | AAID | NT Length | AA Length | score | probability |
|---|---|---|---|---|---|---|
| AI7503000999_4714062_c1_759 | 3202 | 6974 | 135 | 44 | | |

Description

NO-HIT

| ORF Name | NTID | AAID | NT Length | AA Length | score | probability |
|---|---|---|---|---|---|---|
| AI7503000999_4722338_c3_1233 | 3203 | 6975 | 234 | 77 | 57 | 0.047 |

Description gp:[GI:g1354131] [LN:EHU48386] [AC:U48386] [PN:pEhS4] [GN:EhS4] [OR:Entamoeba histolytica] [DB:genpept-inv2] [DE:Entamoeba histolytica putative serine/threonine protein kinase(EhS4) gene, complete cds.] [NT:putative serine/threonine protein kinase] [LE:243:510] [RE:463:1791] [DI:directJoin]

| ORF Name | NTID | AAID | NT Length | AA Length | score | probability |
|---|---|---|---|---|---|---|
| AI7503000999_4725385_f1_213 | 3204 | 6976 | 675 | 224 | 366 | 1.2e-33 |

Description sp:[LN:YRHP_BACSU] [AC:O05406] [GN:YRHP] [OR:BACILLUS SUBTILIS] [DE:HYPOTHETICAL 23.4 KD PROTEIN IN AAPA-SIGV INTERGENIC REGION] [SP:O05406] [DB:swissprot] >pir:[LN:F69975] [AC:F69975 ] [PN:dihydrodipicolinate reductase homolog yrhP] [GN:yrhP ] [CL:hypothetical protein b1798] [OR:Bacillus subtilis] [DB:pir2] >gp:[GI:e1183940:g2635156] [LN:BSUB0014] [AC:Z99117:AL009126] [GN:yrhP] [FN:unknown] [OR:Bacillus subtilis] [DB:genpept-bct1] [DE:Bacillus subtilis complete genome (section 14 of 21): from 2599451to 2812870.] [NT:similar to dihydrodipicolinate reductase] [SP:O05406] [LE:167862] [RE:168494] [DI:complement]

| ORF Name | NTID | AAID | NT Length | AA Length | score | probability |
|---|---|---|---|---|---|---|
| AI7503000999_4726555_f2_234 | 3205 | 6977 | 474 | 157 | 203 | 2.3e-16 |

Description gp:[GI:g4980875] [LN:AE001717] [AC:AE001717:AE000512] [PN:arginine repressor] [GN:TM0371] [OR:Thermotoga maritima] [DB:genpept-bct2] [DE:Thermotoga maritima section 29 of 136 of the complete genome.] [NT:similar to GB:M27869 SP:P17893 PID:142450] [LE:2550] [RE:3008] [DI:direct] >gp:[GI:e1489641:g5102818] [LN:TMA132286] [AC:AJ132286] [PN:arginine repressor] [GN:argR] [FN:regulation of arginine biosynthesis genes] [OR:Thermotoga maritima] [DB:genpept] [DE:Thermotoga maritima argR gene, strain MSB8.] [LE:1] [RE:459] [DI:direct]

| ORF Name | NTID | AAID | NT Length | AA Length | score | probability |
|---|---|---|---|---|---|---|
| AI7503000999_4766933_f3_490 | 3206 | 6978 | 129 | 42 | | |

Description
NO-HIT

| ORF Name | NTID | AAID | NT Length | AA Length | score | probability |
|---|---|---|---|---|---|---|
| AI7503000999_4770028_c1_740 | 3207 | 6979 | 174 | 57 | | |

Description
NO-HIT

| ORF Name | NTID | AAID | NT Length | AA Length | score | probability |
|---|---|---|---|---|---|---|
| AI7503000999_48412_f2_258 | 3208 | 6980 | 159 | 52 | 124 | 1.8e-07 |

Description
pir:[LN:H65154] [AC:H65154:S47779:S01252 ] [PN:probable transposase, 33.3K:hypothetical
protein o283:probable transposase B] [GN:yi5B ] [OR:Escherichia coli] [DB:pir2]
>gp:[GI:g1789981] [LN:AE000433] [AC:AE000433:U00096] [PN:IS150 putative transposase]
[GN:t150] [FN:IS, phage, Tn; Transposon-related functions] [OR:Escherichia coli]
[DB:genpept-bct2] [DE:Escherichia coli K-12 MG1655 section 323 of 400 of the
completegenome.] [NT:o283; 99 pct identical amino acid sequence and] [LE:1897]
[RE:2748] [DI:direct]

| ORF Name | NTID | AAID | NT Length | AA Length | score | probability |
|---|---|---|---|---|---|---|
| AI7503000999_4866425_f2_315 | 3209 | 6981 | 465 | 154 | 305 | 3.6e-27 |

Description
pir:[LN:B69978] [AC:B69978 ] [PN:2-nitropropane dioxygenase homolog yrpB] [GN:yrpB ]
[OR:Bacillus subtilis] [DB:pir2] >gp:[GI:g1934639] [LN:BSU93875] [AC:U93875]
[PN:2-nitropropane dioxygenase] [GN:yrpB] [OR:Bacillus subtilis] [DB:genpept-bct1]
[DE:Bacillus subtilis alcohol dehydrogenase (adhB) gene, partial cds,hypothetical spore
coat protein (yraF), hypothetical spore coatprotein (yraG), YraH (yraH), YraI (yraI),
YraJ (yraJ), YraK (yraK),YraL (yraL), chitosanase precursor (csn), YraM (yraM),
LysR-familytranscription regulator (yraN), YraO (yraO), YrpG (yrpG), RNApolymerase
sigma factor SigZ (sigZ), YrpE (yrpE), YrpD (yrpD), YrpC(yrpC) and 2-nitropropane
dioxygenase (yrpB) genes, complete cds,and aminoglycoside 6-adenylyltransferase (aadK)
gene, partial cds.] [NT:similar to 2-nitropropane dioxigenase of Williopsis] [LE:16473]
[RE:17516] [DI:complement] >gp:[GI:e1183909:g2635125] [LN:BSUB0014]
[AC:Z99117:AL009126] [GN:yrpB] [FN:unknown] [OR:Bacillus subtilis] [DB:genpept-bct1]
[DE:Bacillus subtilis complete genome (section 14 of 21): from 2599451to 2812870.]
[NT:similar to 2-nitropropane dioxygenase] [LE:136734] [RE:137777] [DI:direct]

| ORF Name | NTID | AAID | NT Length | AA Length | score | probability |
|---|---|---|---|---|---|---|
| AI7503000999_4867343_c3_1210 | 3210 | 6982 | 2739 | 912 | 234 | 6.2e-16 |

Description
pir:[LN:G70178] [AC:G70178 ] [PN:exodeoxyribonuclease V, alpha chain (recD) homolog]
[OR:Borrelia burgdorferi] [SR:, Lyme disease spirochete] [DB:pir2] >gp:[GI:g2688552]
[LN:AE001164] [AC:AE001164:AE000783] [PN:exodeoxyribonuclease V, alpha chain (recD)]
[GN:BB0632] [OR:Borrelia burgdorferi] [SR:Lyme disease spirochete] [DB:genpept-bct2]
[DE:Borrelia burgdorferi (section 50 of 70) of the complete genome.] [NT:similar to
SP:P04993 GB:X04581 GB:X04582 PID:42683] [LE:9371] [RE:11203] [DI:complement]

| ORF Name | NTID | AAID | NT Length | AA Length | score | probability |
|---|---|---|---|---|---|---|
| AI7503000999_4895250_f3_627 | 3211 | 6983 | 180 | 59 | | |

Description
NO-HIT

| ORF Name | NTID | AAID | NT Length | AA Length | score | probability |
|---|---|---|---|---|---|---|
| AI7503000999_492086_f3_540 | 3212 | 6984 | 1824 | 607 | | |

Description
NO-HIT

| ORF Name | NTID | AAID | NT Length | AA Length | score | probability |
|---|---|---|---|---|---|---|
| AI7503000999_4957943_f3_655 | 3213 | 6985 | 600 | 199 | 205 | 7.3e-16 |

Description
sp:[LN:F26_CAEEL] [AC:Q21122] [GN:K02B2.1] [OR:CAENORHABDITIS ELEGANS]
[EC:2.7.1.105:3.1.3.46] [DE:BISPHOSPHATASE,] [SP:Q21122] [DB:swissprot]
>gp:[GI:g1118103] [LN:CELK02B2] [AC:U41558] [GN:K02B2.1] [OR:Caenorhabditis elegans]
[DB:genpept-inv2] [DE:Caenorhabditis elegans cosmid K02B2.] [NT:Contains similarity to
Pfam domain: PF00300 (PGAM),] [LE:5652:5766:6320:6579] [RE:5700:5991:6527:6830]
[DI:directJoin]

| ORF Name | NTID | AAID | NT Length | AA Length | score | probability |
|---|---|---|---|---|---|---|
| AI7503000999_4971051_c2_1028 | 3214 | 6986 | 825 | 274 | 196 | 1.3e-15 |

Description
gp:[GI:g1405404] [LN:LLU60336] [AC:U60336] [PN:AbiGi] [GN:abiGi] [FN:with AbiGii,
causes abortive infection of phage] [OR:Lactococcus lactis subsp. cremoris]
[DB:genpept-bct1] [DE:Lactococcus lactis cremoris abortive infection proteins (abiGi
andabiGii) genes, complete cds.] [LE:4376] [RE:5125] [DI:direct]

| ORF Name | NTID | AAID | NT Length | AA Length | score | probability |
|---|---|---|---|---|---|---|
| AI7503000999_5133462_f3_538 | 3215 | 6987 | 1530 | 509 | 146 | 1.2e-06 |

Description
pir:[LN:G71620] [AC:G71620 ] [PN:hypothetical protein PFB0195c] [GN:PFB0195c ]
[OR:Plasmodium falciparum] [DB:pir2] >gp:[GI:g3845121] [LN:AE001380]
[AC:AE001380:AE001362] [PN:hypothetical protein] [GN:PFB0195c] [OR:Plasmodium
falciparum] [SR:malaria parasite P. falciparum] [DB:genpept-inv2] [DE:Plasmodium
falciparum chromosome 2, section 17 of 73 of thecomplete sequence.] [NT:predicted by
GlimmerM] [LE:1011] [RE:3101] [DI:complement]

| ORF Name | NTID | AAID | NT Length | AA Length | score | probability |
|---|---|---|---|---|---|---|
| AI7503000999_5190938_c3_1167 | 3216 | 6988 | 471 | 156 | 77 | 0.031 |

Description
sp:[LN:YH37_HAEIN] [AC:P44301] [GN:HI1737] [OR:HAEMOPHILUS INFLUENZAE] [DE:HYPOTHETICAL
PROTEIN HI1737] [SP:P44301] [DB:swissprot] >pir:[LN:E64041] [AC:E64041 ]
[PN:branched-chain amino acid transport protein azlD homolog HI1737] [CL:branched-chain
amino acid transport protein azlD] [OR:Haemophilus influenzae] [DB:pir2]
>gp:[GI:g1574595] [LN:U32846] [AC:U32846:L42023] [PN:conserved hypothetical protein]
[GN:HI1737] [OR:Haemophilus influenzae Rd] [DB:genpept-bct2] [DE:Haemophilus influenzae
Rd section 161 of 163 of the completegenome.] [NT:similar to GB:AL009126 percent
identity: 53.70;] [LE:9500] [RE:9829] [DI:complement]

| ORF Name | NTID | AAID | NT Length | AA Length | score | probability |
|---|---|---|---|---|---|---|
| AI7503000999_5275393_f1_18 | 3217 | 6989 | 132 | 43 | | |

Description
NO-HIT

| ORF Name | NTID | AAID | NT Length | AA Length | score | probability |
|---|---|---|---|---|---|---|
| AI7503000999_5292300_c2_1002 | 3218 | 6990 | 342 | 113 | 83 | 0.029 |

Description
pir:[LN:A71655] [AC:A71655 ] [PN:hypothetical protein RP511] [GN:RP511 ] [OR:Rickettsia prowazekii] [DB:pir2] >gp:[GI:e1342807:g3861063] [LN:RPXX03] [AC:AJ235272:AJ235269] [PN:unknown] [GN:RP511] [OR:Rickettsia prowazekii] [DB:genpept-bct1] [DE:Rickettsia prowazekii strain Madrid E, complete genome; segment3/4.] [LE:35291] [RE:38143] [DI:complement]

| ORF Name | NTID | AAID | NT Length | AA Length | score | probability |
|---|---|---|---|---|---|---|
| AI7503000999_5313316_c2_936 | 3219 | 6991 | 1413 | 470 | 245 | 8.3e-38 |

Description
pir:[LN:S74046] [AC:S74046 ] [PN:probable sugar transport protein c0110] [OR:Sulfolobus solfataricus] [DB:pir2] >gp:[GI:e283949:g1707740] [LN:SS100KBFR] [AC:Y08256] [PN:sugar transporter] [GN:orf c01010] [OR:Sulfolobus solfataricus] [DB:genpept-bct1] [DE:S.solfataricus 100 kbp DNA fragment.] [LE:71310] [RE:72581] [DI:complement]

| ORF Name | NTID | AAID | NT Length | AA Length | score | probability |
|---|---|---|---|---|---|---|
| AI7503000999_5367337_c3_1274 | 3220 | 6992 | 138 | 45 | | |

Description
NO-HIT

| ORF Name | NTID | AAID | NT Length | AA Length | score | probability |
|---|---|---|---|---|---|---|
| AI7503000999_57217_c1_735 | 3221 | 6993 | 207 | 68 | | |

Description
NO-HIT

| ORF Name | NTID | AAID | NT Length | AA Length | score | probability |
|---|---|---|---|---|---|---|
| AI7503000999_582777_c2_892 | 3222 | 6994 | 1476 | 491 | 1405 | 9.7e-144 |

Description
sp:[LN:YHCL_BACSU] [AC:P54596] [GN:YHCL] [OR:BACILLUS SUBTILIS] [DE:HYPOTHETICAL 49.0 KD PROTEIN IN CSPB-GLPP INTERGENIC REGION] [SP:P54596] [DB:swissprot] >pir:[LN:H69822] [AC:H69822 ] [PN:sodium-glutamate symporter homolog yhcL] [GN:yhcL ] [CL:Bacillus subtilis sodium-glutamate symporter homolog yhcL] [OR:Bacillus subtilis] [DB:pir2] >gp:[GI:e233874:g1239988] [LN:BS75DGREG] [AC:X96983] [PN:hypothetical protein] [GN:yhcL] [OR:Bacillus subtilis] [DB:genpept-bct1] [DE:B.subtilis chromosomal DNA (region 75 degrees: cspB upstream ofglpPFKD operon).] [NT:similarity to the proton/sodium-glutamate symport] [SP:P54596] [LE:7868] [RE:9259] [DI:direct] >gp:[GI:e1182902:g2633236] [LN:BSUB0005] [AC:Z99108:AL009126] [GN:yhcL] [FN:unknown] [OR:Bacillus subtilis] [DB:genpept-bct1] [DE:Bacillus subtilis complete genome (section 5 of 21): from 802821 to1011250.] [NT:similar to sodium-glutamate symporter] [SP:P54596] [LE:183674] [RE:185065] [DI:direct]

| ORF Name | NTID | AAID | NT Length | AA Length | score | probability |
|---|---|---|---|---|---|---|
| AI7503000999_595937_f2_394 | 3223 | 6995 | 177 | 58 | | |

Description
NO-HIT

| ORF Name | NTID | AAID | NT Length | AA Length | score | probability |
|---|---|---|---|---|---|---|
| AI7503000999_6016063_f3_662 | 3224 | 6996 | 123 | 40 | | |

Description
NO-HIT

| ORF Name | NTID | AAID | NT Length | AA Length | score | probability |
|---|---|---|---|---|---|---|
| AI7503000999_6054512_f3_600 | 3225 | 6997 | 207 | 68 | | |

Description
NO-HIT

| ORF Name | NTID | AAID | NT Length | AA Length | score | probability |
|---|---|---|---|---|---|---|
| AI7503000999_6095000_f2_425 | 3226 | 6998 | 147 | 48 | | |

Description
NO-HIT

| ORF Name | NTID | AAID | NT Length | AA Length | score | probability |
|---|---|---|---|---|---|---|
| AI7503000999_649141_f2_330 | 3227 | 6999 | 567 | 188 | | |

Description
NO-HIT

| ORF Name | NTID | AAID | NT Length | AA Length | score | probability |
|---|---|---|---|---|---|---|
| AI7503000999_6521882_f1_32 | 3228 | 7000 | 195 | 64 | 81 | 0.0019 |

Description
gp:[GI:g5306165] [LN:AF160864] [AC:AF160864] [PN:orf98] [GN:orf98] [OR:Mitochondrion Tetrahymena pyriformis] [SR:Tetrahymena pyriformis] [DB:genpept] [DE:Tetrahymena pyriformis mitochondrial DNA, complete genome.] [NT:Open reading frame ymf71 (CPGN); ATT initiation] [LE:37598] [RE:37894] [DI:direct]

| ORF Name | NTID | AAID | NT Length | AA Length | score | probability |
|---|---|---|---|---|---|---|
| AI7503000999_6643751_c1_859 | 3229 | 7001 | 270 | 89 | | |

Description
NO-HIT

| ORF Name | NTID | AAID | NT Length | AA Length | score | probability |
|---|---|---|---|---|---|---|
| AI7503000999_6644537_f1_178 | 3230 | 7002 | 258 | 85 | | |

Description
NO-HIT

| ORF Name | NTID | AAID | NT Length | AA Length | score | probability |
|---|---|---|---|---|---|---|
| AI7503000999_6650267_f3_611 | 3231 | 7003 | 123 | 40 | | |

Description
NO-HIT

| ORF_Name | NTID | AAID | NT Length | AA Length | score | probability |
|---|---|---|---|---|---|---|
| AI7503000999_6715_c3_1123 | 3232 | 7004 | 510 | 169 | | |

Description
NO-HIT

| ORF_Name | NTID | AAID | NT Length | AA Length | score | probability |
|---|---|---|---|---|---|---|
| AI7503000999_6728178_f1_176 | 3233 | 7005 | 129 | 42 | | |

Description
NO-HIT

| ORF_Name | NTID | AAID | NT Length | AA Length | score | probability |
|---|---|---|---|---|---|---|
| AI7503000999_6728578_c2_942 | 3234 | 7006 | 1893 | 630 | 678 | 1.1e-66 |

Description
pir:[LN:B70001] [AC:B70001 ] [PN:ABC transporter (permease) homolog ytsD] [GN:ytsD ]
[OR:Bacillus subtilis] [DB:pir2] >gp:[GI:e1185910:g2635521] [LN:BSUB0016]
[AC:Z99119:AL009126] [GN:ytsD] [FN:unknown] [OR:Bacillus subtilis] [DB:genpept-bct1]
[DE:Bacillus subtilis complete genome (section 16 of 21): from 2997771to 3213410.]
[NT:similar to ABC transporter (permease)] [LE:110708] [RE:112648] [DI:complement]
>gp:[GI:g2293178] [LN:AF008220] [AC:AF008220] [PN:YtsD] [GN:ytsD] [OR:Bacillus
subtilis] [DB:genpept-bct2] [DE:Bacillus subtilis rrnB-dnaB genomic region.]
[NT:similarity to NADH dehydrogenase] [LE:67779] [RE:69719] [DI:direct]

| ORF_Name | NTID | AAID | NT Length | AA Length | score | probability |
|---|---|---|---|---|---|---|
| AI7503000999_6819462_f1_9 | 3235 | 7007 | 1491 | 496 | 1508 | 1.2e-154 |

Description
gp:[GI:e1299584:g3687418] [LN:BLY17554] [AC:Y17554] [PN:permease] [GN:arcD]
[OR:Bacillus licheniformis] [DB:genpept-bct1] [DE:Bacillus licheniformis arcA, arcB,
arcC and arcD genes.] [LE:2579] [RE:3985] [DI:direct]

| ORF_Name | NTID | AAID | NT Length | AA Length | score | probability |
|---|---|---|---|---|---|---|
| AI7503000999_6828125_c1_788 | 3236 | 7008 | 252 | 83 | 398 | 5.0e-37 |

Description
gp:[GI:d1046032:g5360856] [LN:D86934] [AC:D86934] [OR:Staphylococcus aureus]
[SR:Staphylococcus aureus (strain:N315) DNA, clone_lib:library of N31] [DB:genpept]
[DE:Staphylococcus aureus genes, mec region, partial and complete cds.] [NT:ORF CN040]
[LE:47301] [RE:>47552] [DI:complement]

| ORF_Name | NTID | AAID | NT Length | AA Length | score | probability |
|---|---|---|---|---|---|---|
| AI7503000999_6834501_c1_828 | 3237 | 7009 | 231 | 76 | | |

Description
NO-HIT

| ORF Name | NTID | AAID | NT Length | AA Length | score | probability |
|---|---|---|---|---|---|---|
| AI7503000999_6929627_c2_1064 | 3238 | 7010 | 1146 | 381 | 756 | 5.7e-75 |

Description
pir:[LN:F70903] [AC:F70903 ] [PN:probable adhE protein] [GN:adhE ] [CL:long-chain alcohol dehydrogenase homology] [OR:Mycobacterium tuberculosis] [DB:pir2] >gp:[GI:e322878:g2213499] [LN:MTCI28] [AC:Z97050:AL123456] [PN:adhE] [GN:adhE] [OR:Mycobacterium tuberculosis] [DB:genpept-bct1] [DE:Mycobacterium tuberculosis H37Rv complete genome; segment 10/162.] [NT:Rv0162c, (MTCI28.02c), len: 383,adhE, alcohol] [LE:1482] [RE:2633] [DI:complement]

| ORF Name | NTID | AAID | NT Length | AA Length | score | probability |
|---|---|---|---|---|---|---|
| AI7503000999_6929642_f1_14 | 3239 | 7011 | 243 | 80 | | |

Description
NO-HIT

| ORF Name | NTID | AAID | NT Length | AA Length | score | probability |
|---|---|---|---|---|---|---|
| AI7503000999_6929686_c2_1081 | 3240 | 7012 | 264 | 87 | 368 | 7.5e-34 |

Description
pir:[LN:A60634] [AC:A60634:C30471:S26349 ] [PN:probable transposase] [OR:Staphylococcus aureus] [DB:pir2] >gp:[GI:g46597] [LN:SAIS2571] [AC:X53952] [PN:transposase] [OR:Staphylococcus aureus] [DB:genpept-bct1] [DE:S.aureus plasmid pSH6 DNA for insertion sequences IS257-1 andIS256.] [LE:188] [RE:862] [DI:direct] >gp:[GI:g3676452] [LN:AF051917] [AC:AF051917:L19570] [PN:putative transposase TnpE] [GN:tnpE] [OR:Staphylococcus aureus] [DB:genpept-bct2] [DE:Staphylococcus aureus plasmid pSK41, complete sequence.] [LE:40946] [RE:41620] [DI:direct]

| ORF Name | NTID | AAID | NT Length | AA Length | score | probability |
|---|---|---|---|---|---|---|
| AI7503000999_6929686_f1_111 | 3241 | 7013 | 693 | 230 | 1195 | 1.7e-121 |

Description
sp:[LN:TRA2_STAAU] [AC:P19380] [OR:STAPHYLOCOCCUS AUREUS] [DE:TRANSPOSASE FOR INSERTION SEQUENCE-LIKE ELEMENT IS431MEC] [SP:P19380] [DB:swissprot] >pir:[LN:S12093] [AC:S12093:JU0116 ] [PN:probable transposase] [OR:Staphylococcus aureus] [DB:pir2] >gp:[GI:g46602] [LN:SAIS431M] [AC:X53818:M18438] [OR:Staphylococcus aureus] [DB:genpept-bct1] [DE:S. aureus IS431mec gene associated with methicillin resistance.] [NT:putative transposase (AA 1 - 224)] [SP:P19380] [LE:272] [RE:946] [DI:direct] >gp:[GI:e1237900:g2791991] [LN:SAMECAR1I] [AC:Y14051] [PN:putative transposase] [OR:Staphylococcus aureus] [DB:genpept-bct1] [DE:Staphylococcus aureus mecA, mecR1, mecI genes and ORF168, ORF142,ORF44, ORF145 and ORF224.] [NT:ORF224] [LE:8096] [RE:8770] [DI:direct] >gp:[GI:d1046034:g5360858] [LN:D86934] [AC:D86934] [PN:transposase for insertion sequence-like element] [OR:Staphylococcus aureus] [SR:Staphylococcus aureus (strain:N315) DNA, clone_lib:library of N31] [DB:genpept] [DE:Staphylococcus aureus genes, mec region, partial and complete cds.] [NT:ORF N062] [LE:48054] [RE:48728] [DI:direct] >gp:[GI:d1046044:g5360868] [LN:D86934] [AC:D86934] [PN:transposase for insertion sequence-like element] [OR:Staphylococcus aureus] [SR:Staphylococcus aureus (strain:N315) DNA, clone_lib:library of N31] [DB:genpept] [DE:Staphylococcus aureus genes, mec region, partial and complete cds.] [NT:ORF N070] [LE:53400] [RE:54074] [DI:direct]

| ORF Name | NTID | AAID | NT Length | AA Length | score | probability |
|---|---|---|---|---|---|---|
| AI7503000999_7031563_c1_763 | 3242 | 7014 | 243 | 80 | 358 | 8.6e-33 |

Description
pir:[LN:S54709] [AC:S54709 ] [PN:hypothetical protein 81] [OR:Staphylococcus aureus] [DB:pir2]

| ORF Name | NTID | AAID | NT Length | AA Length | score | probability |
|---|---|---|---|---|---|---|
| AI7503000999_7223587_c3_1174 | 3243 | 7015 | 1401 | 466 | 218 | 4.9e-15 |

Description
gp:[GI:d1011960:g1064812] [LN:BACGNTZA] [AC:D78193] [GN:yycH] [OR:Bacillus subtilis] [SR:Bacillus subtilis (strain:168) DNA] [DB:genpept-bct1] [DE:Bacillus subtilis 36kb sequence between gntZ and trnY genesencoding 34 ORFs.] [LE:32039] [RE:33415] [DI:complement]

| ORF Name | NTID | AAID | NT Length | AA Length | score | probability |
|---|---|---|---|---|---|---|
| AI7503000999_7297338_f1_190 | 3244 | 7016 | 213 | 70 | | |

Description
NO-HIT

| ORF Name | NTID | AAID | NT Length | AA Length | score | probability |
|---|---|---|---|---|---|---|
| AI7503000999_791307_c3_1273 | 3245 | 7017 | 156 | 51 | | |

Description
NO-HIT

| ORF Name | NTID | AAID | NT Length | AA Length | score | probability |
|---|---|---|---|---|---|---|
| AI7503000999_862927_c3_1289 | 3246 | 7018 | 195 | 64 | | |

Description
NO-HIT

| ORF Name | NTID | AAID | NT Length | AA Length | score | probability |
|---|---|---|---|---|---|---|
| AI7503000999_87562_f3_550 | 3247 | 7019 | 162 | 53 | | |

Description
NO-HIT

| ORF Name | NTID | AAID | NT Length | AA Length | score | probability |
|---|---|---|---|---|---|---|
| AI7503000999_892142_f2_249 | 3248 | 7020 | 198 | 65 | | |

Description
NO-HIT

| ORF Name | NTID | AAID | NT Length | AA Length | score | probability |
|---|---|---|---|---|---|---|
| AI7503000999_898550_f3_629 | 3249 | 7021 | 126 | 41 | | |

Description
NO-HIT

| ORF Name | NTID | AAID | NT Length | AA Length | score | probability |
|---|---|---|---|---|---|---|
| AI7503000999_917550_c1_869 | 3250 | 7022 | 216 | 71 | 143 | 5.2e-10 |

Description gp:[GI:g929968] [LN:BAU30713] [AC:U30713] [OR:Bacillus anthracis] [SR:plasmid pXO1] [DB:genpept-bct1] [DE:Bacillus anthracis Sterne toxin plasmid pXO1 right inverted repeatelement (SterneR) bordering the toxin-encoding region, ORFA andtruncated ORFB genes, complete cds.] [NT:ORFA; similar to B. anthracis WeyAR element ORFA;] [LE:171] [RE:491] [DI:direct] >gp:[GI:g929971] [LN:BAU30714] [AC:U30714] [OR:Bacillus anthracis] [SR:plasmid pXO1] [DB:genpept-bct1] [DE:Bacillus anthracis Weybridge A toxin plasmid pXO1 right invertedrepeat element (WeyAR) bordering the toxin-encoding region, ORFAand ORFB genes, complete cds.] [NT:ORFA; similar to B. anthracis SterneR element ORFA;] [LE:171] [RE:491] [DI:direct]

---

| ORF Name | NTID | AAID | NT Length | AA Length | score | probability |
|---|---|---|---|---|---|---|
| AI7503000999_969050_c2_1031 | 3251 | 7023 | 162 | 53 | | |

Description

NO-HIT

---

| ORF Name | NTID | AAID | NT Length | AA Length | score | probability |
|---|---|---|---|---|---|---|
| AI7503000999_970077_c3_1098 | 3252 | 7024 | 135 | 44 | 52 | 0.040 |

Description gp:[GI:e264333:g1050454] [LN:CHRFBFPGE] [AC:X91081] [GN:rfbP] [OR:Campylobacter hyoilei] [DB:genpept-bct1] [DE:C.hyoilei rfbF and rfbP genes.] [LE:1896] [RE:2498] [DI:direct]

---

| ORF Name | NTID | AAID | NT Length | AA Length | score | probability |
|---|---|---|---|---|---|---|
| AI7503000999_970250_c2_1057 | 3253 | 7025 | 912 | 303 | 446 | 4.1e-42 |

Description pir:[LN:E69219] [AC:E69219 ] [PN:conserved hypothetical protein MTH894] [GN:MTH894 ] [OR:Methanobacterium thermoautotrophicum] [DB:pir2] >gp:[GI:g2621989] [LN:AE000865] [AC:AE000865:AE000666] [PN:conserved protein] [GN:MTH894] [OR:Methanobacterium thermoautotrophicum] [DB:genpept-bct1] [DE:Methanobacterium thermoautotrophicum from bases 808939 to 820180(section 71 of 148) of the complete genome.] [NT:Function Code:14.01 - Unknown, Conserved protein;] [LE:4427] [RE:5410] [DI:direct]

---

| ORF Name | NTID | AAID | NT Length | AA Length | score | probability |
|---|---|---|---|---|---|---|
| AI7503000999_970386_f1_60 | 3254 | 7026 | 333 | 110 | 270 | 5.2e-23 |

Description pir:[LN:D70073] [AC:D70073 ] [PN:metabolite transport protein homolog yxcC] [GN:yxcC ] [CL:glucose transport protein] [OR:Bacillus subtilis] [DB:pir2] >gp:[GI:e1184706:g2636527] [LN:BSUB0021] [AC:Z99124:AL009126] [GN:yxcC] [FN:unknown] [OR:Bacillus subtilis] [DB:genpept-bct1] [DE:Bacillus subtilis complete genome (section 21 of 21): from 3999281to 4214814.] [NT:similar to metabolite transport protein] [LE:87516] [RE:88901] [DI:direct]

---

| ORF Name | NTID | AAID | NT Length | AA Length | score | probability |
|---|---|---|---|---|---|---|
| AI7503000999_9765951_c1_816 | 3255 | 7027 | 144 | 47 | | |

Description

NO-HIT

---

| ORF Name | NTID | AAID | NT Length | AA Length | score | probability |
|---|---|---|---|---|---|---|
| AI7503000999_9773385_c1_687 | 3256 | 7028 | 816 | 271 | 303 | 5.8e-27 |

Description
gp:[GI:g757830] [LN:EC4HPADNA] [AC:Z37980] [PN:2-oxo-hept-3-ene-1,7-dioate hydratase] [GN:hpaH] [OR:Escherichia coli] [DB:genpept-bct1] [DE:E.coli hpa[G,R,E,D,F,H,I,X,A,B,C] genes.] [LE:4957] [RE:5760] [DI:direct] >gp:[GI:g2695682] [LN:AF036583] [AC:AF036583] [PN:2-oxo-hept-4-ene-1,7-dioate hydratase] [GN:hpcG] [OR:Escherichia coli] [DB:genpept-bct2] [DE:Escherichia coli 2-oxo-hept-4-ene-1,7-dioate hydratase (hpcG) gene,complete cds.] [NT:OHED hydratase] [LE:1] [RE:804] [DI:direct]

| ORF Name | NTID | AAID | NT Length | AA Length | score | probability |
|---|---|---|---|---|---|---|
| AI7503000999_979178_c3_1277 | 3257 | 7029 | 243 | 80 | | |

Description
NO-HIT

| ORF Name | NTID | AAID | NT Length | AA Length | score | probability |
|---|---|---|---|---|---|---|
| AI7503000999_9792842_c1_711 | 3258 | 7030 | 1851 | 616 | 1480 | 1.1e-151 |

Description
pir:[LN:C69840] [AC:C69840 ] [PN:conserved hypothetical protein yitJ] [GN:yitJ ] [OR:Bacillus subtilis] [DB:pir2] >gp:[GI:e1183103:g2633437] [LN:BSUB0006] [AC:Z99109:AL009126] [GN:yitJ] [FN:unknown] [OR:Bacillus subtilis] [DB:genpept-bct1] [DE:Bacillus subtilis complete genome (section 6 of 21): from 999501 to1209940.] [NT:similar to hypothetical proteins] [LE:178731] [RE:180569] [DI:complement] >gp:[GI:e1173535:g2145402] [LN:BSY09476] [AC:Y09476] [PN:YitJ] [OR:Bacillus subtilis] [DB:genpept-bct1] [DE:B.subtilis 54kb genomic DNA fragment.] [NT:putative - Some homology with MetH2 (S. cerevisae)] [LE:35957] [RE:37795] [DI:complement]

| ORF Name | NTID | AAID | NT Length | AA Length | score | probability |
|---|---|---|---|---|---|---|
| AI7503000999_980000_c3_1090 | 3259 | 7031 | 228 | 75 | | |

Description
NO-HIT

| ORF Name | NTID | AAID | NT Length | AA Length | score | probability |
|---|---|---|---|---|---|---|
| AI7503000999_9806332_f3_491 | 3260 | 7032 | 450 | 149 | 237 | 9.3e-20 |

Description
pir:[LN:A71175] [AC:A71175 ] [PN:probable dehydrogenase] [GN:PH0597 ] [OR:Pyrococcus horikoshii] [DB:pir2] >gp:[GI:d1030629:g3257003] [LN:AP000002] [AC:AP000002:AB009475:AB009476:AB009477:AB009478:AB009479:AB009480] [PN:376aa long hypothetical dehydrogenase] [GN:PH0597] [OR:Pyrococcus horikoshii] [SR:Pyrococcus horikoshii (strain:OT3) DNA] [DB:genpept-bct1] [DE:Pyrococcus horikoshii OT3 genomic DNA, 287001-544000 nt. position(2/7).] [NT:similar to owl:BSZ9404317 percent identity: 49.821] [LE:248539] [RE:249669] [DI:complement]

| ORF Name | NTID | AAID | NT Length | AA Length | score | probability |
|---|---|---|---|---|---|---|
| AI7503000999_9806692_c3_1251 | 3261 | 7033 | 1374 | 457 | 907 | 5.7e-91 |

Description
sp:[LN:YMER_STAAU] [AC:P08655] [OR:STAPHYLOCOCCUS AUREUS] [DE:HYPOTHETICAL 19.7 KD PROTEIN IN MERCURIC RESISTANCE OPERON] [SP:P08655] [DB:swissprot] >pir:[LN:G29504] [AC:G29504 ] [PN:hypothetical 20K protein (mer regulatory region)] [OR:Staphylococcus aureus] [DB:pir2] >gp:[GI:g459902] [LN:L29436] [AC:L29436:M15048:N00048] [PN:regulatory protein] [GN:merR] [OR:Plasmid pI258] [SR:Plasmid pI258 DNA] [DB:genpept-bct1] [DE:Plasmid pI258 (from S.aureus strain RN23 8325) mercury resistance(mer) operon encoding mercuric reductase (merA), organomercuriallyase (merB), regulatory protein (merR) and membrane transportprotein (merT), complete cds.] [LE:188] [RE:730] [DI:direct]

| ORF Name | NTID | AAID | NT Length | AA Length | score | probability |
|---|---|---|---|---|---|---|
| AI7503000999_9847811_c1_698 | 3262 | 7034 | 162 | 53 | | |

Description
NO-HIT

| ORF Name | NTID | AAID | NT Length | AA Length | score | probability |
|---|---|---|---|---|---|---|
| AI7503000999_991500_f1_182 | 3263 | 7035 | 135 | 44 | | |

Description
NO-HIT

| ORF Name | NTID | AAID | NT Length | AA Length | score | probability |
|---|---|---|---|---|---|---|
| AI7503001000_11955055_c1_45 | 3264 | 7036 | 192 | 64 | | |

Description
NO-HIT

| ORF Name | NTID | AAID | NT Length | AA Length | score | probability |
|---|---|---|---|---|---|---|
| AI7503001000_1214635_c2_48 | 3265 | 7037 | 387 | 128 | 469 | 1.5e-44 |

Description
gp:[GI:d1036080:g4001724] [LN:AB015981] [AC:AB015981] [PN:OrfA] [GN:orfA] [OR:Staphylococcus aureus] [SR:Staphylococcus aureus (strain:209P) DNA] [DB:genpept-bct1] [DE:Staphylococcus aureus genes for OrfA, MnhA, MnhB, MnhC, MnhD, MnhE, MnhF and MnhG, complete cds.] [LE:302] [RE:685] [DI:direct]

| ORF Name | NTID | AAID | NT Length | AA Length | score | probability |
|---|---|---|---|---|---|---|
| AI7503001000_13089052_c2_46 | 3266 | 7038 | 123 | 40 | | |

Description
NO-HIT

| ORF Name | NTID | AAID | NT Length | AA Length | score | probability |
|---|---|---|---|---|---|---|
| AI7503001000_1378550_f3_34 | 3267 | 7039 | 144 | 47 | | |

Description
NO-HIT

| ORF Name | NTID | AAID | NT Length | AA Length | score | probability |
|---|---|---|---|---|---|---|
| AI7503001000_14460932_f2_21 | 3268 | 7040 | 294 | 97 | 451 | 1.2e-42 |

Description gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF Name | NTID | AAID | NT Length | AA Length | score | probability |
|---|---|---|---|---|---|---|
| AI7503001000_14500036_c3_66 | 3269 | 7041 | 129 | 42 | | |

Description

NO-HIT

| ORF Name | NTID | AAID | NT Length | AA Length | score | probability |
|---|---|---|---|---|---|---|
| AI7503001000_15041078_f2_13 | 3270 | 7042 | 279 | 92 | 319 | 1.2e-28 |

Description pir:[LN:G70012] [AC:G70012 ] [PN:conserved hypothetical protein yuiF] [GN:yuiF ] [CL:conserved integral membrane protein HP0758] [OR:Bacillus subtilis] [DB:pir2] >gp:[GI:e1184283:g2635701] [LN:BSUB0017] [AC:Z99120:AL009126] [GN:yuiF] [FN:unknown] [OR:Bacillus subtilis] [DB:genpept-bct1] [DE:Bacillus subtilis complete genome (section 17 of 21): from 3197001to 3414420.] [NT:similar to hypothetical proteins] [LE:96999] [RE:98327] [DI:complement]

| ORF Name | NTID | AAID | NT Length | AA Length | score | probability |
|---|---|---|---|---|---|---|
| AI7503001000_21646015_f3_36 | 3271 | 7043 | 201 | 66 | 198 | 7.8e-16 |

Description gp:[GI:g1022725] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF2] [LE:394] [RE:1083] [DI:complement] >gp:[GI:g295162] [LN:STAMECRA] [AC:L14017] [OR:Staphylococcus aureus] [SR:Staphylococcus aureus (strain COL) DNA] [DB:genpept-bct1] [DE:Staphylococcus aureus methicillin-resistance protein (mecR) geneand unknown ORF, complete cds.] [NT:unknown ORF1; putative] [LE:1492] [RE:2181] [DI:complement]

| ORF Name | NTID | AAID | NT Length | AA Length | score | probability |
|---|---|---|---|---|---|---|
| AI7503001000_22136087_c2_53 | 3272 | 7044 | 1512 | 503 | 2102 | 1.3e-217 |

Description gp:[GI:d1036084:g4001728] [LN:AB015981] [AC:AB015981] [PN:MnhD] [GN:mnhD] [OR:Staphylococcus aureus] [SR:Staphylococcus aureus (strain:209P) DNA] [DB:genpept-bct1] [DE:Staphylococcus aureus genes for OrfA, MnhA, MnhB, MnhC, MnhD, MnhE,MnhF and MnhG, complete cds.] [LE:3976] [RE:5472] [DI:direct]

| ORF Name | NTID | AAID | NT Length | AA Length | score | probability |
|---|---|---|---|---|---|---|
| AI7503001000_22457312_f1_9 | 3273 | 7045 | 126 | 41 | | |

Description

NO-HIT

| ORF_Name | NTID | AAID | NT Length | AA Length | score | probability |
|---|---|---|---|---|---|---|
| AI7503001000_23456932_f3_26 | 3274 | 7046 | 153 | 50 | | |

Description
NO-HIT

| ORF_Name | NTID | AAID | NT Length | AA Length | score | probability |
|---|---|---|---|---|---|---|
| AI7503001000_23859843_f1_10 | 3275 | 7047 | 393 | 130 | 212 | 2.5e-17 |

Description
sp:[LN:GS13_BACSU] [AC:P80870:O05238] [GN:YUGI] [OR:BACILLUS SUBTILIS] [DE:GENERAL STRESS PROTEIN 13 (GSP13)] [SP:P80870:O05238] [DB:swissprot]

| ORF_Name | NTID | AAID | NT Length | AA Length | score | probability |
|---|---|---|---|---|---|---|
| AI7503001000_23947132_f3_23 | 3276 | 7048 | 378 | 125 | 269 | 2.3e-23 |

Description
gp:[GI:e291128:g1834379] [LN:BLCOMAB] [AC:Y10551] [GN:ComAB] [FN:positive activator of lichenysin synthetase] [OR:Bacillus licheniformis] [DB:genpept-bct1] [DE:B.licheniformis comAB gene.] [LE:617] [RE:>963] [DI:direct]

| ORF_Name | NTID | AAID | NT Length | AA Length | score | probability |
|---|---|---|---|---|---|---|
| AI7503001000_24644702_c1_41 | 3277 | 7049 | 435 | 144 | 647 | 2.0e-63 |

Description
gp:[GI:d1036082:g4001726] [LN:AB015981] [AC:AB015981] [PN:MnhB] [GN:mnhB] [OR:Staphylococcus aureus] [SR:Staphylococcus aureus (strain:209P) DNA] [DB:genpept-bct1] [DE:Staphylococcus aureus genes for OrfA, MnhA, MnhB, MnhC, MnhD, MnhE,MnhF and MnhG, complete cds.] [LE:3214] [RE:3642] [DI:direct]

| ORF_Name | NTID | AAID | NT Length | AA Length | score | probability |
|---|---|---|---|---|---|---|
| AI7503001000_26756252_c3_61 | 3278 | 7050 | 2427 | 808 | 3318 | 0.0 |

Description
gp:[GI:d1036081:g4001725] [LN:AB015981] [AC:AB015981] [PN:MnhA] [GN:mnhA] [OR:Staphylococcus aureus] [SR:Staphylococcus aureus (strain:209P) DNA] [DB:genpept-bct1] [DE:Staphylococcus aureus genes for OrfA, MnhA, MnhB, MnhC, MnhD, MnhE,MnhF and MnhG, complete cds.] [LE:816] [RE:3221] [DI:direct]

| ORF_Name | NTID | AAID | NT Length | AA Length | score | probability |
|---|---|---|---|---|---|---|
| AI7503001000_29742890_f2_22 | 3279 | 7051 | 189 | 62 | | |

Description
NO-HIT

| ORF_Name | NTID | AAID | NT Length | AA Length | score | probability |
|---|---|---|---|---|---|---|
| AI7503001000_32689812_c2_54 | 3280 | 7052 | 312 | 103 | 386 | 9.3e-36 |

Description
gp:[GI:d1036086:g4001730] [LN:AB015981] [AC:AB015981] [PN:MnhF] [GN:mnhF] [OR:Staphylococcus aureus] [SR:Staphylococcus aureus (strain:209P) DNA] [DB:genpept-bct1] [DE:Staphylococcus aureus genes for OrfA, MnhA, MnhB, MnhC, MnhD, MnhE,MnhF and MnhG, complete cds.] [LE:5953] [RE:6246] [DI:direct]

| ORF Name | NTID | AAID | NT Length | AA Length | score | probability |
|---|---|---|---|---|---|---|
| AI7503001000_33397338_c3_64 | 3281 | 7053 | 492 | 163 | 635 | 3.8e-62 |

Description
gp:[GI:d1036085:g4001729] [LN:AB015981] [AC:AB015981] [PN:MnhE] [GN:mnhE]
[OR:Staphylococcus aureus] [SR:Staphylococcus aureus (strain:209P) DNA]
[DB:genpept-bct1] [DE:Staphylococcus aureus genes for OrfA, MnhA, MnhB, MnhC, MnhD,
MnhE,MnhF and MnhG, complete cds.] [LE:5474] [RE:5953] [DI:direct]

| ORF Name | NTID | AAID | NT Length | AA Length | score | probability |
|---|---|---|---|---|---|---|
| AI7503001000_34384380_c1_42 | 3282 | 7054 | 333 | 110 | 468 | 1.9e-44 |

Description
gp:[GI:d1036083:g4001727] [LN:AB015981] [AC:AB015981] [PN:MnhC] [GN:mnhC]
[OR:Staphylococcus aureus] [SR:Staphylococcus aureus (strain:209P) DNA]
[DB:genpept-bct1] [DE:Staphylococcus aureus genes for OrfA, MnhA, MnhB, MnhC, MnhD,
MnhE,MnhF and MnhG, complete cds.] [LE:3642] [RE:3983] [DI:direct]

| ORF Name | NTID | AAID | NT Length | AA Length | score | probability |
|---|---|---|---|---|---|---|
| AI7503001000_34617286_f2_19 | 3283 | 7055 | 612 | 203 | 304 | 3.9e-35 |

Description
sp:[LN:YDJ3_SCHPO] [AC:P87051] [GN:SPAC57A10.03] [OR:SCHIZOSACCHAROMYCES POMBE]
[SR:,FISSION YEAST] [EC:5.2.1.8] [DE:PROBABLE PEPTIDYL-PROLYL CIS-TRANS ISOMERASE
C57A10.03,] [SP:P87051] [DB:swissprot] >gp:[GI:e313994:g2058370] [LN:SPAC57A10]
[AC:Z94864] [PN:peptidyl-prolyl cis-trans isomerase] [GN:SPAC57A10.03]
[OR:Schizosaccharomyces pombe] [SR:fission yeast] [DB:genpept-pln1] [DE:S.pombe
chromosome I cosmid c57A10.] [NT:SPAC57A10.03, len:155, SIMILARITY:Caenorhabditis]
[SP:P87051] [LE:5344:5414:5521:5779] [RE:5373:5455:5574:5858] [DI:directJoin]

| ORF Name | NTID | AAID | NT Length | AA Length | score | probability |
|---|---|---|---|---|---|---|
| AI7503001000_36604587_c1_44 | 3284 | 7056 | 1173 | 390 | | |

Description
NO-HIT

| ORF Name | NTID | AAID | NT Length | AA Length | score | probability |
|---|---|---|---|---|---|---|
| AI7503001000_4017050_c3_59 | 3285 | 7057 | 126 | 41 | | |

Description
NO-HIT

| ORF Name | NTID | AAID | NT Length | AA Length | score | probability |
|---|---|---|---|---|---|---|
| AI7503001000_5114680_c3_65 | 3286 | 7058 | 363 | 120 | 463 | 6.4e-44 |

Description
gp:[GI:d1036087:g4001731] [LN:AB015981] [AC:AB015981] [PN:MnhG] [GN:mnhG]
[OR:Staphylococcus aureus] [SR:Staphylococcus aureus (strain:209P) DNA]
[DB:genpept-bct1] [DE:Staphylococcus aureus genes for OrfA, MnhA, MnhB, MnhC, MnhD,
MnhE,MnhF and MnhG, complete cds.] [LE:6224] [RE:6580] [DI:direct]

| ORF Name | NTID | AAID | NT Length | AA Length | score | probability |
|---|---|---|---|---|---|---|
| AI7503001000_6672886_f3_35 | 3287 | 7059 | 1173 | 390 | 914 | 1.0e-91 |

Description
sp:[LN:YQIG_BACSU] [AC:P54524] [GN:YQIG] [OR:BACILLUS SUBTILIS] [EC:1.-.-.-]
[DE:PROBABLE NADH-DEPENDENT FLAVIN OXIDOREDUCTASE YQIG,] [SP:P54524] [DB:swissprot]
>pir:[LN:C69961] [AC:C69961 ] [PN:NADH-dependent flavin oxidoreductase homolog yqiG]
[GN:yqiG ] [OR:Bacillus subtilis] [DB:pir2] >gp:[GI:d1013261:g1303926] [LN:BACJH642]
[AC:D84432:D82370] [PN:YqiG] [OR:Bacillus subtilis] [SR:Bacillus subtilis
(strain:JH642(trpC2 PheA1)) DNA] [DB:genpept-bct1] [DE:Bacillus subtilis DNA, 283 Kb
region containing skin element.] [LE:202096] [RE:203214] [DI:complement]
>gp:[GI:e1185689:g2634855] [LN:BSUB0013] [AC:Z99116:AL009126] [GN:yqiG] [FN:unknown]
[OR:Bacillus subtilis] [DB:genpept-bct1] [DE:Bacillus subtilis complete genome (section
13 of 21): from 2395261to 2613730.] [NT:similar to NADH-dependent flavin
oxidoreductase] [SP:P54524] [LE:120407] [RE:121525] [DI:direct]

| ORF Name | NTID | AAID | NT Length | AA Length | score | probability |
|---|---|---|---|---|---|---|
| AI7503001000_783125_c3_56 | 3288 | 7060 | 183 | 60 | | |

Description
NO-HIT

| ORF Name | NTID | AAID | NT Length | AA Length | score | probability |
|---|---|---|---|---|---|---|
| AI7503001001_10000312_c3_1340 | 3289 | 7061 | 165 | 54 | | |

Description
NO-HIT

| ORF Name | NTID | AAID | NT Length | AA Length | score | probability |
|---|---|---|---|---|---|---|
| AI7503001001_10006340_f2_492 | 3290 | 7062 | 501 | 166 | 85 | 0.0011 |

Description
gp:[GI:g160616] [LN:PFAR45B] [AC:M83791] [PN:trophozoite antigen] [GN:R45]
[OR:Plasmodium falciparum] [SR:Plasmodium falciparum (strain Tak 9.96) (library:
lambda-gt11] [DB:genpept-inv1] [DE:Plasmodium falciparum trophozoite antigen gene
(repeat region),partial cds.] [LE:<1] [RE:>327] [DI:direct]

| ORF Name | NTID | AAID | NT Length | AA Length | score | probability |
|---|---|---|---|---|---|---|
| AI7503001001_10265677_f2_556 | 3291 | 7063 | 150 | 49 | | |

Description
NO-HIT

| ORF Name | NTID | AAID | NT Length | AA Length | score | probability |
|---|---|---|---|---|---|---|
| AI7503001001_10267016_c2_1133 | 3292 | 7064 | 789 | 262 | 210 | 4.1e-17 |

Description
sp:[LN:TIPA_STRLI] [AC:P32184] [GN:TIPA] [OR:STREPTOMYCES LIVIDANS] [DE:TRANSCRIPTIONAL
ACTIVATOR TIPA] [SP:P32184] [DB:swissprot] >pir:[LN:S35354] [AC:S35354:A45923 ]
[PN:tipA protein] [GN:tipA ] [CL:tipA protein] [OR:Streptomyces lividans] [DB:pir2]
>gp:[GI:g408223] [LN:S64314] [AC:S64314] [PN:TipAL-AS] [GN:tipA] [OR:Streptomyces
lividans] [DB:genpept-bct1] [DE:tipAL-AS complex: tipA=TipAL-AS [Streptomyces lividans,
Genomic,1146 nt].] [NT:thiostrepton-specific recognition protein; Method:] [LE:120]
[RE:881] [DI:direct] >gp:[GI:e1453008:g4808352] [LN:SCE9] [AC:AL049841]
[PN:transcriptional regulator] [GN:SCE9.20] [OR:Streptomyces coelicolor]
[DB:genpept-bct1] [DE:Streptomyces coelicolor cosmid E9.] [NT:SCE9.20c, tipA,
transcriptional regulator, len: 253] [LE:21108] [RE:21869] [DI:complement]

| ORF Name | NTID | AAID | NT Length | AA Length | score | probability |
|---|---|---|---|---|---|---|
| AI7503001001_10268818_f3_803 | 3293 | 7065 | 234 | 77 | | |

Description
NO-HIT

| ORF Name | NTID | AAID | NT Length | AA Length | score | probability |
|---|---|---|---|---|---|---|
| AI7503001001_10343756_f3_840 | 3294 | 7066 | 174 | 57 | | |

Description
NO-HIT

| ORF Name | NTID | AAID | NT Length | AA Length | score | probability |
|---|---|---|---|---|---|---|
| AI7503001001_10439005_f1_44 | 3295 | 7067 | 516 | 171 | 157 | 1.7e-11 |

Description
gp:[GI:d1044366:g5105267] [LN:AP000062] [AC:AP000062] [PN:114aa long hypothetical protein] [GN:APE1580] [OR:Aeropyrum pernix] [SR:Aeropyrum pernix (strain:K1) DNA] [DB:genpept] [DE:Aeropyrum pernix genomic DNA, section 5/7.] [NT:similar to OWL:AB00946832 percent identity:37.500] [LE:13911] [RE:14255] [DI:direct]

| ORF Name | NTID | AAID | NT Length | AA Length | score | probability |
|---|---|---|---|---|---|---|
| AI7503001001_10548187_f3_766 | 3296 | 7068 | 162 | 53 | | |

Description
NO-HIT

| ORF Name | NTID | AAID | NT Length | AA Length | score | probability |
|---|---|---|---|---|---|---|
| AI7503001001_10581693_f2_490 | 3297 | 7069 | 684 | 227 | 842 | 4.4e-84 |

Description
pir:[LN:A69868] [AC:A69868 ] [PN:ykvJ protein] [GN:ykvJ ] [CL:conserved hypothetical protein HI1191] [OR:Bacillus subtilis] [DB:pir2] >gp:[GI:e1184962:g2633743] [LN:BSUB0008] [AC:Z99111:AL009126] [GN:ykvJ] [FN:unknown] [OR:Bacillus subtilis] [DB:genpept-bct1] [DE:Bacillus subtilis complete genome (section 8 of 21): from 1394791to 1603020.] [NT:similar to hypothetical proteins] [LE:44124] [RE:44783] [DI:direct]

| ORF Name | NTID | AAID | NT Length | AA Length | score | probability |
|---|---|---|---|---|---|---|
| AI7503001001_10589818_f2_358 | 3298 | 7070 | 201 | 66 | 58 | 0.0051 |

Description
gp:[GI:e321942:g2664263] [LN:EFAS48C] [AC:Y12234] [PN:hypothetical protein] [OR:Enterococcus faecalis] [DB:genpept-bct1] [DE:E.faecalis plasmid DNA containing gene cluster involved inproduction and immunity to peptide antibiotic AS-48.] [NT:ORF6] [LE:4556] [RE:5065] [DI:direct]

| ORF Name | NTID | AAID | NT Length | AA Length | score | probability |
|---|---|---|---|---|---|---|
| AI7503001001_10667002_c3_1423 | 3299 | 7071 | 201 | 66 | | |

Description
NO-HIT

| ORF Name | NTID | AAID | NT Length | AA Length | score | probability |
|---|---|---|---|---|---|---|
| AI7503001001_10667002_c3_1504 | 3300 | 7072 | 168 | 55 | | |

Description
NO-HIT

| ORF Name | NTID | AAID | NT Length | AA Length | score | probability |
|---|---|---|---|---|---|---|
| AI7503001001_10737818_f1_230 | 3301 | 7073 | 471 | 156 | 223 | 1.7e-18 |

Description
sp:[LN:YP17_LISMO] [AC:P52309] [OR:LISTERIA MONOCYTOGENES] [DE:HYPOTHETICAL 17.1 KD PROTEIN IN DNAG/DNAE 5'REGION (P17)] [SP:P52309] [DB:swissprot] >gp:[GI:g664754] [LN:LMU13165] [AC:U13165] [PN:P17] [OR:Listeria monocytogenes] [DB:genpept-bct2] [DE:Listeria monocytogenes P17 (orfP17), DNA primase (dnaG) and sigma43 subunit of RNA polymerase (rpoD) genes, complete cds.] [NT:orfP17] [LE:196] [RE:645] [DI:direct]

| ORF Name | NTID | AAID | NT Length | AA Length | score | probability |
|---|---|---|---|---|---|---|
| AI7503001001_10976387_c3_1503 | 3302 | 7074 | 210 | 69 | | |

Description
NO-HIT

| ORF Name | NTID | AAID | NT Length | AA Length | score | probability |
|---|---|---|---|---|---|---|
| AI7503001001_11023402_f3_781 | 3303 | 7075 | 273 | 90 | 127 | 2.6e-08 |

Description
pir:[LN:A71007] [AC:A71007 ] [PN:hypothetical protein PH1351] [GN:PH1351 ] [OR:Pyrococcus horikoshii] [DB:pir2] >gp:[GI:d1031400:g3257774] [LN:AP000006] [AC:AP000006:AB005215:AB009510:AB009511:AB009512:AB009513:AB009514] [PN:101aa long hypothetical protein] [GN:PH1351] [OR:Pyrococcus horikoshii] [SR:Pyrococcus horikoshii (strain:OT3) DNA, clone:Pyrococcus horikoshi] [DB:genpept-bct1] [DE:Pyrococcus horikoshii OT3 genomic DNA, 1166001-1485000 nt. position(6/7).] [LE:50986] [RE:51291] [DI:direct]

| ORF Name | NTID | AAID | NT Length | AA Length | score | probability |
|---|---|---|---|---|---|---|
| AI7503001001_110275_f2_577 | 3304 | 7076 | 276 | 91 | 292 | 8.5e-26 |

Description
gp:[GI:e255528:g1617429] [LN:SEABCTS] [AC:X99127] [PN:membrane protein] [FN:iron repressible ABC transport system] [OR:Staphylococcus epidermidis] [DB:genpept-bct1] [DE:S.epidermidis gene encoding ABC transport system.] [LE:878] [RE:1624] [DI:direct]

| ORF Name | NTID | AAID | NT Length | AA Length | score | probability |
|---|---|---|---|---|---|---|
| AI7503001001_11152176_c1_967 | 3305 | 7077 | 1029 | 342 | 1111 | 1.4e-112 |

Description
pir:[LN:A69855] [AC:A69855 ] [PN:low-affinity inorganic phosphate transport homolog ykaB] [GN:ykaB ] [OR:Bacillus subtilis] [DB:pir2] >gp:[GI:e1181485:g2632005] [LN:BSAJ2571] [AC:AJ002571] [PN:YkaB] [GN:ykaB] [OR:Bacillus subtilis] [DB:genpept-bct1] [DE:Bacillus subtilis 168 56 kb DNA fragment between xlyA and ykoR.] [NT:homologous to low affinity phosphate transporter] [LE:1614] [RE:2600] [DI:complement] >gp:[GI:e1183304:g2633638] [LN:BSUB0007] [AC:Z99110:AL009126] [GN:ykaB] [FN:unknown] [OR:Bacillus subtilis] [DB:genpept-bct1] [DE:Bacillus subtilis complete genome (section 7 of 21): from 1194391to 1411140.] [NT:similar to low-affinity inorganic phosphate] [LE:154563] [RE:155549] [DI:complement]

| ORF_Name | NTID | AAID | NT Length | AA Length | score | probability |
|---|---|---|---|---|---|---|
| AI7503001001_112561_f1_99 | 3306 | 7078 | 138 | 45 | | |

Description
NO-HIT

| ORF_Name | NTID | AAID | NT Length | AA Length | score | probability |
|---|---|---|---|---|---|---|
| AI7503001001_116383_f2_590 | 3307 | 7079 | 165 | 54 | | |

Description
NO-HIT

| ORF_Name | NTID | AAID | NT Length | AA Length | score | probability |
|---|---|---|---|---|---|---|
| AI7503001001_11728376_c2_1327 | 3308 | 7080 | 249 | 82 | 241 | 2.2e-20 |

Description
pir:[LN:A70026] [AC:A70026 ] [PN:hypothetical protein yuzB] [GN:yuzB ] [OR:Bacillus subtilis] [DB:pir2] >gp:[GI:e1184298:g2635716] [LN:BSUB0017] [AC:Z99120:AL009126] [GN:yuzB] [FN:unknown] [OR:Bacillus subtilis] [DB:genpept-bct1] [DE:Bacillus subtilis complete genome (section 17 of 21): from 3197001to 3414420.] [LE:110425] [RE:110661] [DI:complement]

| ORF_Name | NTID | AAID | NT Length | AA Length | score | probability |
|---|---|---|---|---|---|---|
| AI7503001001_11831433_f2_602 | 3309 | 7081 | 159 | 52 | 48 | 0.031 |

Description
gp:[GI:g554799] [LN:HIVB54CH] [AC:M96497] [PN:envelope protein] [GN:env] [OR:Human immunodeficiency virus type 1] [SR:Human immunodeficiency virus type 1 (individual_isolate ) RNA] [DB:genpept-vrl] [DE:Human immunodeficiency virus type 1 (clone B5-4) V1 & V2 regions ofthe envelope protein (env) gene, partial cds.] [NT:hypervariable regions V1 and V2; putative] [LE:<1] [RE:>296] [DI:direct]

| ORF_Name | NTID | AAID | NT Length | AA Length | score | probability |
|---|---|---|---|---|---|---|
| AI7503001001_11883557_f1_292 | 3310 | 7082 | 195 | 64 | | |

Description
NO-HIT

| ORF_Name | NTID | AAID | NT Length | AA Length | score | probability |
|---|---|---|---|---|---|---|
| AI7503001001_1199063_f1_135 | 3311 | 7083 | 510 | 169 | 165 | 5.3e-12 |

Description
sp:[LN:YJJP_HAEIN] [AC:P44520] [GN:HI0108] [OR:HAEMOPHILUS INFLUENZAE] [DE:HYPOTHETICAL PROTEIN HI0108] [SP:P44520] [DB:swissprot] >pir:[LN:I64142] [AC:I64142 ] [PN:hypothetical protein HI0108] [OR:Haemophilus influenzae] [DB:pir2] >gp:[GI:g1573061] [LN:U32696] [AC:U32696:L42023] [PN:conserved hypothetical protein] [GN:HI0108] [OR:Haemophilus influenzae Rd] [DB:genpept-bct2] [DE:Haemophilus influenzae Rd section 11 of 163 of the complete genome.] [NT:similar to GB:U14003 SP:P39402 PID:537207 GB:U00096] [LE:4095] [RE:4988] [DI:direct]

| ORF Name | NTID | AAID | NT Length | AA Length | score | probability |
|---|---|---|---|---|---|---|
| AI7503001001_1214688_f1_146 | 3312 | 7084 | 939 | 312 | 526 | 1.4e-50 |

Description sp:[LN:MURB_BACSU] [AC:P18579:P16669:P37581] [GN:MURB] [OR:BACILLUS SUBTILIS] [EC:1.1.1.158] [DE:ACETYLMURAMATE DEHYDROGENASE)] [SP:P18579:P16669:P37581] [DB:swissprot] >pir:[LN:A43727] [AC:S26500:PC1128:A43727:B69662 ] [PN:UDP-N-acetylenolpyruvoylglucosamine reductase murB:hypothetical protein (murG 3' region)] [GN:murB ] [OR:Bacillus subtilis] [DB:pir2] >gp:[GI:g142833] [LN:BACDDSA] [AC:M31827] [OR:Bacillus subtilis] [SR:Bacillus subtilis (clone: lambda-BS1) DNA] [DB:genpept-bct1] [DE:Bacillus subtilis (clone lambda-BS1) cell division and sporulationprotein (dds) gene, complete cds.] [NT:ORF2] [LE:479] [RE:1390] [DI:direct] >gp:[GI:e1185113:g2633894] [LN:BSUB0008] [AC:Z99111:AL009126] [PN:UDP-N-acetylenolpyruvoylglucosamine reductase] [GN:murB] [FN:peptidoglycan biosynthesis] [OR:Bacillus subtilis] [DB:genpept-bct1] [EC:1.1.1.158] [DE:Bacillus subtilis complete genome (section 8 of 21): from 1394791to 1603020.] [NT:alternate gene name: ylxC] [SP:P18579] [LE:197268] [RE:198179] [DI:direct]

| ORF Name | NTID | AAID | NT Length | AA Length | score | probability |
|---|---|---|---|---|---|---|
| AI7503001001_12616018_f2_357 | 3313 | 7085 | 270 | 89 | 84 | 0.0027 |

Description gp:[GI:g48992] [LN:ECINCI2] [AC:X62169:S47694] [GN:pilU] [OR:Escherichia coli] [DB:genpept-bct1] [DE:E.coli IncI2 plasmid R721 pilU, plV, shf, rci genes.] [LE:29] [RE:664] [DI:direct]

| ORF Name | NTID | AAID | NT Length | AA Length | score | probability |
|---|---|---|---|---|---|---|
| AI7503001001_12617827_c1_1083 | 3314 | 7086 | 762 | 253 | 1160 | 8.9e-118 |

Description gp:[GI:e1393156:g4490615] [LN:SAU133520] [AC:AJ133520] [PN:triosephosphate isomerase] [GN:tpi] [OR:Staphylococcus aureus] [DB:genpept-bct1] [DE:Staphylococcus aureus gap operon (gapR, gap, pgk and tpi genes).] [LE:4307] [RE:5068] [DI:direct]

| ORF Name | NTID | AAID | NT Length | AA Length | score | probability |
|---|---|---|---|---|---|---|
| AI7503001001_12789077_c3_1469 | 3315 | 7087 | 1107 | 368 | 1311 | 8.9e-134 |

Description sp:[LN:UVRA_BACSU] [AC:O34863] [GN:UVRA] [OR:BACILLUS SUBTILIS] [DE:EXCINUCLEASE ABC SUBUNIT A] [SP:O34863] [DB:swissprot] >pir:[LN:F69729] [AC:F69729 ] [PN:excinuclease ABC chain A:excision endonuclease ABC,, chain A:uvrA protein] [GN:uvrA ] [CL:excinuclease ABC chain A:ATP-binding cassette homology] [OR:Bacillus subtilis] [EC:3.1.-.-] [DB:pir2] >gp:[GI:e1184422:g2636042] [LN:BSUB0019] [AC:Z99122:AL009126] [PN:excinuclease ABC (subunit A)] [GN:uvrA] [FN:excision of ultraviolet light-induced] [OR:Bacillus subtilis] [DB:genpept-bct1] [DE:Bacillus subtilis complete genome (section 19 of 21): from 3597091to 3809700.] [SP:O34863] [LE:12034] [RE:14907] [DI:complement] >gp:[GI:g2618842] [LN:AF017113] [AC:AF017113] [PN:excinuclease ABC subunit A] [GN:uvrA] [OR:Bacillus subtilis] [DB:genpept-bct2] [DE:Bacillus subtilis 300-304 degree genomic sequence.] [LE:15386] [RE:18259] [DI:direct] >gp:[GI:e1184422:g2636042] [LN:BSUB0019] [AC:Z99122:AL009126] [PN:excinuclease ABC (subunit A)] [GN:uvrA] [FN:excision of ultraviolet light-induced] [OR:Bacillus subtilis] [DB:genpept] [DE:Bacillus subtilis complete genome (section 19 of 21): from 3597091to 3809700.] [SP:O34863] [LE:12034] [RE:14907] [DI:complement]

| ORF Name | NTID | AAID | NT Length | AA Length | score | probability |
|---|---|---|---|---|---|---|
| AI7503001001_12929631_f2_529 | 3316 | 7088 | 156 | 51 | | |

Description
NO-HIT

| ORF Name | NTID | AAID | NT Length | AA Length | score | probability |
|---|---|---|---|---|---|---|
| AI7503001001_12948336_c3_1475 | 3317 | 7089 | 273 | 90 | 316 | 2.4e-28 |

Description
sp:[LN:CLPP_BACSU] [AC:P80244:O08433] [GN:CLPP] [OR:BACILLUS SUBTILIS] [EC:3.4.21.92]
[DE:(ENDOPEPTIDASE CLP) (CASEINOLYTIC PROTEASE) (PROTEASE TI)] [SP:P80244:O08433]
[DB:swissprot] >pir:[LN:B69601] [AC:B69601:A47683 ] [PN:ATP-dependent clp proteinase,
chain P:stress protein G7] [GN:clpP ] [CL:ATP-dependent Clp proteinase chain P]
[OR:Bacillus subtilis] [EC:3.4.21.-] [DB:pir2] >gp:[GI:e1186142:g2635967] [LN:BSUB0018]
[AC:Z99121:AL009126] [PN:ATP-dependent Clp protease proteolytic subunit] [GN:clpP]
[OR:Bacillus subtilis] [DB:genpept-bct1] [EC:3.4.21.92] [DE:Bacillus subtilis complete
genome (section 18 of 21): from 3399551to 3609060.] [NT:alternate gene name: yvdN]
[SP:P80244] [LE:145744] [RE:146337] [DI:direct] >gp:[GI:e313044:g1945673] [LN:BSZ94043]
[AC:Z94043] [PN:hypothetical protein] [GN:yvdN] [OR:Bacillus subtilis]
[DB:genpept-bct1] [DE:B.subtilis genomic DNA fragment (88 kb).] [NT:similar to
CLPP_ECOLI ATP-dependent clp protease] [SP:P80244] [LE:35334] [RE:35927]
[DI:complement] >gp:[GI:g2668494] [LN:BSU59754] [AC:U59754] [PN:ClpP] [GN:clpP]
[OR:Bacillus subtilis] [DB:genpept-bct2] [DE:Bacillus subtilis Clp protease proteolytic
component (clpP) gene,complete cds.] [NT:proteolytic component of Clp protease]
[LE:140] [RE:733] [DI:direct]

| ORF Name | NTID | AAID | NT Length | AA Length | score | probability |
|---|---|---|---|---|---|---|
| AI7503001001_1351533_c2_1261 | 3318 | 7090 | 2571 | 856 | 3966 | 0.0 |

Description
sp:[LN:SECA_STAAU] [AC:O06446] [GN:SECA] [OR:STAPHYLOCOCCUS AUREUS] [DE:PREPROTEIN
TRANSLOCASE SECA SUBUNIT] [SP:O06446] [DB:swissprot] >gp:[GI:g2078390] [LN:SAU97062]
[AC:U97062] [PN:SecA] [GN:secA] [FN:secretion] [OR:Staphylococcus aureus]
[DB:genpept-bct1] [DE:Staphylococcus aureus NCTC 8325 SecA (secA) gene, complete cds.]
[LE:440] [RE:2971] [DI:direct]

| ORF Name | NTID | AAID | NT Length | AA Length | score | probability |
|---|---|---|---|---|---|---|
| AI7503001001_1362705_c1_960 | 3319 | 7091 | 123 | 40 | | |

Description
NO-HIT

| ORF Name | NTID | AAID | NT Length | AA Length | score | probability |
|---|---|---|---|---|---|---|
| AI7503001001_1366018_f3_723 | 3320 | 7092 | 135 | 44 | | |

Description
NO-HIT

| ORF_Name | NTID | AAID | NT Length | AA Length | score | probability |
|---|---|---|---|---|---|---|
| AI7503001001_13710887_c2_1298 | 3321 | 7093 | 753 | 250 | 315 | 3.1e-28 |

Description pir:[LN:I39522] [AC:I39522 ] [PN:3-dehydroquinate dehydratase,, catabolic] [GN:quiB ] [CL:3-dehydroquinate dehydratase:3-dehydroquinate dehydratase homology] [OR:Acinetobacter calcoaceticus] [EC:4.2.1.10] [DB:pir2] >gp:[GI:g3172120] [LN:ACCPCAOP] [AC:L05770:U04359:M33798:U20284:U11554:L13114:L03407] [PN:catabolic dehydroquinate dehydratase] [GN:quiB] [FN:dehydration of dehydroquinate to] [OR:Acinetobacter sp. ADP1] [DB:genpept-bct2] [DE:Acinetobacter sp. ADP1 pca-qui-pob supraoperonic cluster, completesequence.] [LE:10923] [RE:11795] [DI:direct]

| ORF_Name | NTID | AAID | NT Length | AA Length | score | probability |
|---|---|---|---|---|---|---|
| AI7503001001_13714193_c3_1456 | 3322 | 7094 | 582 | 193 | 583 | 1.2e-56 |

Description sp:[LN:YSEA_STACA] [AC:P47995] [OR:STAPHYLOCOCCUS CARNOSUS] [DE:HYPOTHETICAL PROTEIN IN SECA 5'REGION (ORF1) (FRAGMENT)] [SP:P47995] [DB:swissprot]

| ORF_Name | NTID | AAID | NT Length | AA Length | score | probability |
|---|---|---|---|---|---|---|
| AI7503001001_13727318_f1_246 | 3323 | 7095 | 813 | 270 | 348 | 9.9e-32 |

Description gp:[GI:g2735506] [LN:SCU96107] [AC:U96107] [PN:SceB precursor] [GN:sceB] [OR:Staphylococcus carnosus] [DB:genpept-bct2] [DE:Staphylococcus carnosus N5,N10-methylenetetrahydromethanopterinreductase homolog, SceB precursor (sceB) and putative transmembraneprotein genes, complete cds, and putative Na+/H+ antiporter NhaC(nhaC) gene, partial cds.] [NT:major secreted protein] [LE:1894] [RE:2685] [DI:direct]

| ORF_Name | NTID | AAID | NT Length | AA Length | score | probability |
|---|---|---|---|---|---|---|
| AI7503001001_1376577_f2_374 | 3324 | 7096 | 675 | 224 | 77 | 0.0044 |

Description pir:[LN:F70141] [AC:F70141 ] [PN:probable oligopeptide transport ATP-binding protein oppF] [GN:oppF ] [CL:inner membrane protein malK:ATP-binding cassette homology] [OR:Borrelia burgdorferi] [SR:, Lyme disease spirochete] [DB:pir2] >gp:[GI:g2688242] [LN:AE001140] [AC:AE001140:AE000783] [PN:oligopeptide ABC transporter, ATP-binding] [GN:BB0335] [OR:Borrelia burgdorferi] [SR:Lyme disease spirochete] [DB:genpept-bct2] [DE:Borrelia burgdorferi (section 26 of 70) of the complete genome.] [NT:similar to SP:P24137 percent identity: 56.81;] [LE:3216] [RE:4187] [DI:direct] >gp:[GI:g2281463] [LN:AF000366] [AC:AF000366] [PN:oligopeptide permease homolog F] [GN:oppF] [OR:Borrelia burgdorferi] [SR:Lyme disease spirochete] [DB:genpept-bct2] [DE:Borrelia burgdorferi oligopeptide permease homologs AI (oppAI), AII(oppAII), AIII (oppAIII), B (oppB), C (oppC), D (oppD), and F(oppF), P26 (p26) and enolase homolog (eno) genes, complete cds.] [NT:OppF] [LE:9017] [RE:9988] [DI:direct]

| ORF Name | NTID | AAID | NT Length | AA Length | score | probability |
|---|---|---|---|---|---|---|
| AI7503001001_13803167_f2_373 | 3325 | 7097 | 552 | 183 | 157 | 8.0e-11 |

Description
pir:[LN:A69774] [AC:A69774 ] [PN:integrase homolog ydcL] [GN:ydcL ] [OR:Bacillus subtilis] [DB:pir2] >gp:[GI:d1020071:g1881291] [LN:AB001488] [AC:AB001488] [GN:ydcL] [OR:Bacillus subtilis] [SR:Bacillus subtilis (strain:168) DNA] [DB:genpept-bct1] [DE:Bacillus subtilis genome sequence, 148 kb sequence of the regionbetween 35 and 47 degree.] [NT:PROBABLE INTEGRASE.] [LE:62741] [RE:63847] [DI:complement] >gp:[GI:e1182446:g2632780] [LN:BSUB0003] [AC:Z99106:AL009126] [GN:ydcL] [FN:unknown] [OR:Bacillus subtilis] [DB:genpept-bct1] [DE:Bacillus subtilis complete genome (section 3 of 21): from 402751 to611850.] [NT:similar to integrase] [LE:126486] [RE:127592] [DI:complement]

| ORF Name | NTID | AAID | NT Length | AA Length | score | probability |
|---|---|---|---|---|---|---|
| AI7503001001_13834425_c2_1291 | 3326 | 7098 | 126 | 41 | | |

Description
NO-HIT

| ORF Name | NTID | AAID | NT Length | AA Length | score | probability |
|---|---|---|---|---|---|---|
| AI7503001001_13921942_c3_1483 | 3327 | 7099 | 1554 | 517 | 1690 | 6.1e-174 |

Description
pir:[LN:D69675] [AC:D69675:I40024 ] [PN:phosphoglycerate mutase,, 2, 3-diphosphoglycerate-independent] [GN:pgm ] [CL:phosphoglycerate mutase, 2, 3-bisphosphoglycerate-independent] [OR:Bacillus subtilis] [EC:5.4.2.1] [DB:pir2] >gp:[GI:e1186079:g2635904] [LN:BSUB0018] [AC:Z99121:AL009126] [PN:phosphoglycerate mutase] [GN:pgm] [FN:glycolysis] [OR:Bacillus subtilis] [DB:genpept-bct1] [EC:5.4.2.1] [DE:Bacillus subtilis complete genome (section 18 of 21): from 3399551to 3609060.] [SP:P39773] [LE:77390] [RE:78925] [DI:complement]

| ORF Name | NTID | AAID | NT Length | AA Length | score | probability |
|---|---|---|---|---|---|---|
| AI7503001001_13931527_c3_1337 | 3328 | 7100 | 723 | 240 | 87 | 0.011 |

Description
pir:[LN:S49604] [AC:S49604 ] [PN:hypothetical protein 126 (rps12 3' region)] [OR:plastid Astasia longa] [DB:pir2] >gp:[GI:e156256:g1334340] [LN:ALRPS12] [AC:X82630] [GN:orf126] [OR:Chloroplast Astasia longa] [SR:euglenophycean alga] [DB:genpept-pln1] [DE:A.longa plastid rps12, orf126 and orf288 genes.] [NT:ata start] [LE:<1424] [RE:1801] [DI:direct]

| ORF Name | NTID | AAID | NT Length | AA Length | score | probability |
|---|---|---|---|---|---|---|
| AI7503001001_1408438_f1_283 | 3329 | 7101 | 948 | 315 | 110 | 8.1e-06 |

Description
sp:[LN:YDCZ_ECOLI] [AC:P76111] [GN:YDCZ] [OR:ESCHERICHIA COLI] [DE:HYPOTHETICAL 15.9 KD PROTEIN IN TEHB-ANSP INTERGENIC REGION] [SP:P76111] [DB:swissprot] >pir:[LN:B64897] [AC:B64897 ] [PN:probable membrane protein b1447] [OR:Escherichia coli] [DB:pir2] >gp:[GI:g1787718] [LN:AE000241] [AC:AE000241:U00096] [PN:orf, hypothetical protein] [GN:b1447] [FN:orf; Unknown] [OR:Escherichia coli] [DB:genpept-bct2] [DE:Escherichia coli K-12 MG1655 section 131 of 400 of the completegenome.] [NT:f149; This 149 aa ORF is 31 pct identical (11 gaps)] [LE:9124] [RE:9573] [DI:complement]

| ORF_Name | NTID | AAID | NT Length | AA Length | score | probability |
|---|---|---|---|---|---|---|
| AI7503001001_14097163_f1_50 | 3330 | 7102 | 138 | 45 | | |

Description
NO-HIT

| ORF_Name | NTID | AAID | NT Length | AA Length | score | probability |
|---|---|---|---|---|---|---|
| AI7503001001_14120465_f1_56 | 3331 | 7103 | 513 | 170 | | |

Description
NO-HIT

| ORF_Name | NTID | AAID | NT Length | AA Length | score | probability |
|---|---|---|---|---|---|---|
| AI7503001001_14454632_f1_194 | 3332 | 7104 | 177 | 58 | 225 | 1.1e-18 |

Description
gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF_Name | NTID | AAID | NT Length | AA Length | score | probability |
|---|---|---|---|---|---|---|
| AI7503001001_14460882_c1_1104 | 3333 | 7105 | 177 | 58 | 234 | 1.2e-19 |

Description
gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF_Name | NTID | AAID | NT Length | AA Length | score | probability |
|---|---|---|---|---|---|---|
| AI7503001001_14460882_f3_776 | 3334 | 7106 | 183 | 60 | 128 | 6.0e-08 |

Description
gp:[GI:g1022726] [LN:SHU35635] [AC:U35635] [PN:unknown] [OR:Staphylococcus haemolyticus] [SR:Staphylococcus haemolyticus strain=Y176] [DB:genpept-bct1] [DE:Staphylococcus haemolyticus IS1272 ORF1 and ORF2 genes, completecds.] [NT:ORF1] [LE:1101] [RE:1922] [DI:complement]

| ORF_Name | NTID | AAID | NT Length | AA Length | score | probability |
|---|---|---|---|---|---|---|
| AI7503001001_14478377_c3_1383 | 3335 | 7107 | 1149 | 382 | 637 | 2.3e-62 |

Description
sp:[LN:HMPA_BACSU] [AC:P49852] [GN:HMP:ANE3] [OR:BACILLUS SUBTILIS] [DE:FLAVOHEMOPROTEIN (HAEMOGLOBIN-LIKE PROTEIN) (FLAVOHEMOGLOBIN)] [SP:P49852] [DB:swissprot] >pir:[LN:B69642] [AC:B69642 ] [PN:flavohemoglobin hmp] [GN:hmp ] [CL:flavohemoglobin:cytochrome-b5 reductase homology:globin homology] [OR:Bacillus subtilis] [DB:pir2] >gp:[GI:d1011920:g1063247] [LN:BAC168TRP2] [AC:D78189] [OR:Bacillus subtilis] [SR:Bacillus subtilis (strain:168trpC2) DNA] [DB:genpept-bct1] [DE:Bacillus subtilis hmp DNA for 7 ORFs, complete cds.] [NT:high homology to flavohemoprotein (Haemoglobin-like] [LE:999] [RE:2198] [DI:direct] >gp:[GI:e1181505:g2632025] [LN:BSAJ2571] [AC:AJ002571] [PN:YkiA] [GN:ykiA] [OR:Bacillus subtilis] [DB:genpept-bct1] [DE:Bacillus subtilis 168 56 kb DNA fragment between xlyA and ykoR.] [NT:Flavohemoprotein] [SP:P49852] [LE:24916] [RE:26115] [DI:direct] >gp:[GI:e1183324:g2633658] [LN:BSUB0007] [AC:Z99110:AL009126] [PN:flavohemoglobin] [GN:hmp] [OR:Bacillus subtilis] [DB:genpept-bct1] [DE:Bacillus subtilis complete genome (section 7 of 21): from 1194391to 1411140.] [NT:alternate gene name: ykiA] [SP:P49852] [LE:177865] [RE:179064] [DI:direct]

| ORF Name | NTID | AAID | NT Length | AA Length | score | probability |
|---|---|---|---|---|---|---|
| AI7503001001_14494461_c2_1178 | 3336 | 7108 | 168 | 55 | | |

Description
NO-HIT

| ORF Name | NTID | AAID | NT Length | AA Length | score | probability |
|---|---|---|---|---|---|---|
| AI7503001001_14500052_f1_64 | 3337 | 7109 | 204 | 67 | | |

Description
NO-HIT

| ORF Name | NTID | AAID | NT Length | AA Length | score | probability |
|---|---|---|---|---|---|---|
| AI7503001001_14538202_c3_1510 | 3338 | 7110 | 762 | 253 | 1034 | 2.0e-104 |

Description
sp:[LN:V296_BACSU] [AC:P80866] [GN:YURI] [OR:BACILLUS SUBTILIS] [DE:VEGETATIVE PROTEIN 296 (VEG296)] [SP:P80866] [DB:swissprot]

| ORF Name | NTID | AAID | NT Length | AA Length | score | probability |
|---|---|---|---|---|---|---|
| AI7503001001_14564005_f2_456 | 3339 | 7111 | 249 | 82 | 87 | 0.0016 |

Description
pir:[LN:B69341] [AC:B69341 ] [PN:cobalt transport protein (cbiQ-1) homolog]
[OR:Archaeoglobus fulgidus] [DB:pir2] >gp:[GI:g2649885] [LN:AE001054]
[AC:AE001054:AE000782] [PN:cobalt transport protein (cbiQ-1)] [GN:AF0730]
[OR:Archaeoglobus fulgidus] [DB:genpept-bct2] [DE:Archaeoglobus fulgidus section 53 of
172 of the complete genome.] [NT:similar to GP:1419077 percent identity: 32.61;]
[LE:978] [RE:1700] [DI:direct]

| ORF Name | NTID | AAID | NT Length | AA Length | score | probability |
|---|---|---|---|---|---|---|
| AI7503001001_14642203_c3_1363 | 3340 | 7112 | 834 | 277 | 772 | 1.2e-76 |

Description
pir:[LN:G70080] [AC:G70080 ] [PN:conserved hypothetical protein yxkD] [GN:yxkD ]
[CL:conserved hypothetical protein yitT] [OR:Bacillus subtilis] [DB:pir2]
>gp:[GI:e1186383:g2636419] [LN:BSUB0020] [AC:Z99123:AL009126] [GN:yxkD] [FN:unknown]
[OR:Bacillus subtilis] [DB:genpept-bct1] [DE:Bacillus subtilis complete genome (section
20 of 21): from 3798401to 4010550.] [NT:similar to hypothetical proteins] [LE:188319]
[RE:189155] [DI:complement] >gp:[GI:d1012387:g1783243] [LN:D83026] [AC:D83026:D45911]
[GN:yxkD] [OR:Bacillus subtilis] [SR:Bacillus subtilis (strain:BGSC 1A1) DNA]
[DB:genpept-bct1] [DE:Bacillus subtilis genome sequence covering lic-cel region.]
[NT:homologous to jojC gene product (B. subtilis;] [LE:35310] [RE:36146] [DI:direct]

| ORF Name | NTID | AAID | NT Length | AA Length | score | probability |
|---|---|---|---|---|---|---|
| AI7503001001_14648452_c3_1464 | 3341 | 7113 | 801 | 266 | 346 | 1.6e-31 |

Description
gp:[GI:e244971:g1340128] [LN:SA1234] [AC:X97985] [OR:Staphylococcus aureus]
[DB:genpept-bct1] [DE:S.aureus orfs 1,2,3 & 4.] [NT:ORF1] [LE:537] [RE:1304]
[DI:direct]

| ORF_Name | NTID | AAID | NT Length | AA Length | score | probability |
|---|---|---|---|---|---|---|
| AI7503001001_14875890_c3_1412 | 3342 | 7114 | 846 | 281 | 734 | 1.2e-72 |

Description
gp:[GI:e1359127:g4007669] [LN:SC4B5] [AC:AL034443] [PN:putative oxidoreductase]
[GN:SC4B5.01c] [OR:Streptomyces coelicolor] [DB:genpept-bct1] [DE:Streptomyces
coelicolor cosmid 4B5.] [NT:SC4B5.01c, probable oxidoreductase, len; 277aa,] [LE:52]
[RE:885] [DI:complement]

| ORF_Name | NTID | AAID | NT Length | AA Length | score | probability |
|---|---|---|---|---|---|---|
| AI7503001001_14878807_f2_599 | 3343 | 7115 | 960 | 319 | 162 | 2.8e-09 |

Description
gp:[GI:e321943:g2664264] [LN:EFAS48C] [AC:Y12234] [PN:hypothetical protein]
[OR:Enterococcus faecalis] [DB:genpept-bct1] [DE:E.faecalis plasmid DNA containing gene
cluster involved inproduction and immunity to peptide antibiotic AS-48.] [NT:ORF7]
[LE:5043] [RE:6266] [DI:direct]

| ORF_Name | NTID | AAID | NT Length | AA Length | score | probability |
|---|---|---|---|---|---|---|
| AI7503001001_14886052_c3_1386 | 3344 | 7116 | 495 | 164 | 307 | 2.2e-27 |

Description
sp:[LN:YQGC_BACSU] [AC:P54486] [GN:YQGC] [OR:BACILLUS SUBTILIS] [DE:HYPOTHETICAL 17.3
KD PROTEIN IN CCCA-SODA INTERGENIC REGION] [SP:P54486] [DB:swissprot] >pir:[LN:G69955]
[AC:G69955 ] [PN:hypothetical protein yqgC] [GN:yqgC ] [OR:Bacillus subtilis] [DB:pir2]
>gp:[GI:d1013185:g1303850] [LN:BACJH642] [AC:D84432:D82370] [PN:YqgC] [OR:Bacillus
subtilis] [SR:Bacillus subtilis (strain:JH642(trpC2 PheA1)) DNA] [DB:genpept-bct1]
[DE:Bacillus subtilis DNA, 283 Kb region containing skin element.] [LE:132903]
[RE:133385] [DI:direct] >gp:[GI:e1185770:g2634936] [LN:BSUB0013] [AC:Z99116:AL009126]
[GN:yqgC] [FN:unknown] [OR:Bacillus subtilis] [DB:genpept-bct1] [DE:Bacillus subtilis
complete genome (section 13 of 21): from 2395261to 2613730.] [SP:P54486] [LE:190236]
[RE:190718] [DI:complement]

| ORF_Name | NTID | AAID | NT Length | AA Length | score | probability |
|---|---|---|---|---|---|---|
| AI7503001001_14970251_f3_623 | 3345 | 7117 | 294 | 97 | | |

Description
NO-HIT

| ORF_Name | NTID | AAID | NT Length | AA Length | score | probability |
|---|---|---|---|---|---|---|
| AI7503001001_15057762_c2_1198 | 3346 | 7118 | 1575 | 524 | 1194 | 2.2e-121 |

Description
sp:[LN:MEMP_ALCEU] [AC:Q07252] [OR:ALCALIGENES EUTROPHUS] [DE:MEMBRANE PROTEIN]
[SP:Q07252] [DB:swissprot] >pir:[LN:I39534] [AC:I39534:S33452 ] [PN:hypothetical
protein] [OR:Alcaligenes eutrophus] [DB:pir2] >gp:[GI:g311309] [LN:AELACDEH]
[AC:Z22737] [PN:putative membrane-bound protein with four times] [OR:Ralstonia
eutropha] [DB:genpept-bct1] [DE:A.eutrophus genes for lactate dehydrogenase,
putativemembrane-bound protein with four times repitition of Pro-Ser-Ala atthe
N-terminus (function unknown) and transglycosidase (partial).] [SP:Q07252] [LE:962]
[RE:2503] [DI:direct]

| ORF Name | NTID | AAID | NT Length | AA Length | score | probability |
|---|---|---|---|---|---|---|
| AI7503001001_1561_c1_1025 | 3347 | 7119 | 1944 | 647 | 1406 | 7.6e-144 |

Description pir:[LN:A69814] [AC:A69814 ] [PN:ABC transporter (ATP-binding protein) homolog yfmR] [GN:yfmR ] [CL:ATP-binding cassette homology] [OR:Bacillus subtilis] [DB:pir2] >gp:[GI:e1182716:g2633050] [LN:BSUB0004] [AC:Z99107:AL009126] [GN:yfmR] [FN:unknown] [OR:Bacillus subtilis] [DB:genpept-bct1] [DE:Bacillus subtilis complete genome (section 4 of 21): from 600701 to813890.] [NT:similar to ABC transporter (ATP-binding protein)] [LE:208365] [RE:210254] [DI:direct] >gp:[GI:e1182727:g2633061] [LN:BSUB0005] [AC:Z99108:AL009126] [GN:yfmR] [FN:unknown] [OR:Bacillus subtilis] [DB:genpept-bct1] [DE:Bacillus subtilis complete genome (section 5 of 21): from 802821 to1011250.] [NT:similar to ABC transporter (ATP-binding protein)] [LE:6245] [RE:8134] [DI:direct] >gp:[GI:d1020922:g2116756] [LN:D86418] [AC:D86418] [PN:YfmR] [OR:Bacillus subtilis] [SR:Bacillus subtilis (strain:AC327) DNA] [DB:genpept-bct1] [DE:Bacillus subtilis genomic DNA 69-70 degree region, partialsequence.] [LE:2937] [RE:4826] [DI:complement]

| ORF Name | NTID | AAID | NT Length | AA Length | score | probability |
|---|---|---|---|---|---|---|
| AI7503001001_15661088_c2_1162 | 3348 | 7120 | 513 | 170 | | |

Description
NO-HIT

| ORF Name | NTID | AAID | NT Length | AA Length | score | probability |
|---|---|---|---|---|---|---|
| AI7503001001_15751312_f1_164 | 3349 | 7121 | 2136 | 711 | 1980 | 1.1e-204 |

Description sp:[LN:ADH2_ENTHI] [AC:Q24803:Q27649] [GN:ADH2] [OR:ENTAMOEBA HISTOLYTICA] [EC:1.1.1.1:1.2.1.10] [DE:DEHYDROGENASE, (ACDH)] [SP:Q24803:Q27649] [DB:swissprot] >gp:[GI:g488430] [LN:EHU04863] [AC:U04863] [PN:alcohol dehydrogenase 2] [OR:Entamoeba histolytica] [DB:genpept-inv1] [DE:Entamoeba histolytica HM1:IMSS alcohol dehydrogenase 2 (EhADH2)mRNA, complete cds.] [NT:The derived amino acid sequence of EhADH2 is] [LE:3] [RE:2615] [DI:direct]

| ORF Name | NTID | AAID | NT Length | AA Length | score | probability |
|---|---|---|---|---|---|---|
| AI7503001001_15752262_f3_666 | 3350 | 7122 | 153 | 50 | | |

Description
NO-HIT

| ORF Name | NTID | AAID | NT Length | AA Length | score | probability |
|---|---|---|---|---|---|---|
| AI7503001001_15756542_c2_1195 | 3351 | 7123 | 201 | 66 | | |

Description
NO-HIT

| ORF Name | NTID | AAID | NT Length | AA Length | score | probability |
|---|---|---|---|---|---|---|
| AI7503001001_157767_c3_1366 | 3352 | 7124 | 1077 | 358 | 534 | 1.9e-51 |

Description gp:[GI:d1045428:g5106360] [LN:AB028629] [AC:AB028629] [PN:lipase] [GN:lipA] [OR:Clostridium perfringens] [SR:Clostridium perfringens (strain:13) DNA, clone:pSB235] [DB:genpept] [DE:Clostridium perfringens metB, cysK, ygaG, lipA genes forcystathionine beta-synthase, cysteine synthase, hypotheticalprotein, lipase, partial and complete cds.] [NT:esterase] [LE:3248] [RE:4183] [DI:direct]

| ORF Name | NTID | AAID | NT Length | AA Length | score | probability |
|---|---|---|---|---|---|---|
| AI7503001001_15781336_c2_1131 | 3353 | 7125 | 471 | 156 | 150 | 9.5e-11 |

Description pir:[LN:C70059] [AC:C70059 ] [PN:hypothetical protein ywiB] [GN:ywiB ] [OR:Bacillus subtilis] [DB:pir2] >gp:[GI:e1186235:g2636271] [LN:BSUB0020] [AC:Z99123:AL009126] [GN:ywiB] [FN:unknown] [OR:Bacillus subtilis] [DB:genpept-bct1] [DE:Bacillus subtilis complete genome (section 20 of 21): from 3798401to 4010550.] [LE:35970] [RE:36398] [DI:complement] >gp:[GI:e324352:g2224755] [LN:BSZ97024] [AC:Z97024] [GN:ywiB] [OR:Bacillus subtilis] [DB:genpept-bct1] [DE:Bacillus subtilis ywiA, sbo, ywiB, argS and narK genes.] [LE:1255] [RE:1683] [DI:direct]

| ORF Name | NTID | AAID | NT Length | AA Length | score | probability |
|---|---|---|---|---|---|---|
| AI7503001001_16522890_f1_189 | 3354 | 7126 | 171 | 56 | | |

Description

NO-HIT

| ORF Name | NTID | AAID | NT Length | AA Length | score | probability |
|---|---|---|---|---|---|---|
| AI7503001001_16603207_f3_710 | 3355 | 7127 | 378 | 125 | 217 | 7.5e-18 |

Description pir:[LN:S72776] [AC:S72776 ] [PN:B1496_F1_41 protein] [OR:Mycobacterium leprae] [DB:pir2] >gp:[GI:g466873] [LN:U00013] [AC:U00013] [PN:B1496_F1_41] [OR:Mycobacterium leprae] [DB:genpept-bct1] [DE:Mycobacterium leprae cosmid B1496.] [LE:29815] [RE:30312] [DI:direct]

| ORF Name | NTID | AAID | NT Length | AA Length | score | probability |
|---|---|---|---|---|---|---|
| AI7503001001_166062_c2_1287 | 3356 | 7128 | 123 | 40 | 50 | 0.030 |

Description pir:[LN:S73871] [AC:S73871 ] [PN:type I restriction enzyme ecokI specificity protein homolog:hypothetical protein H10_orf145L:hypothetical protein H10_orf145L] [OR:Mycoplasma pneumoniae] [SR:ATCC 29342, , ATCC 29342] [SR:ATCC 29342, ] [DB:pir2] >gp:[GI:g1674242] [LN:MPAE000053] [AC:AE000053:U00089] [GN:H10_orf145L] [OR:Mycoplasma pneumoniae] [DB:genpept-bct2] [DE:Mycoplasma pneumoniae section 53 of 63 of the complete genome.] [NT:type I restriction enzyme ecokI specificity protein] [LE:3554] [RE:3991] [DI:complement]

| ORF Name | NTID | AAID | NT Length | AA Length | score | probability |
|---|---|---|---|---|---|---|
| AI7503001001_166713_c2_1263 | 3357 | 7129 | 2001 | 666 | 2697 | 1.2e-280 |

Description
sp:[LN:UVRB_BACSU] [AC:P37954:O34455] [GN:UVRB:DINA:UVR] [OR:BACILLUS SUBTILIS]
[DE:EXCINUCLEASE ABC SUBUNIT B (DINA PROTEIN)] [SP:P37954:O34455] [DB:swissprot]
>pir:[LN:G69729] [AC:G69729:I39817:B37317 ] [PN:excinuclease ABC chain B:DNA repair
protein DinA:excision endonuclease ABC,, chain B:hypothetical protein (DNA
damage-inducible A76 promoter 3' region):UrvB homolog DinA] [GN:uvrB:uvr:dinA ] [EC:
3.1.-.-] [DB:pir2] >gp:[GI:e1184423:g2636043] [LN:BSUB0019] [AC:Z99122:AL009126]
[PN:excinuclease ABC (subunit B)] [GN:uvrB] [FN:excision of ultraviolet light-induced]
[OR:Bacillus subtilis] [DB:genpept-bct1] [DE:Bacillus subtilis complete genome (section
19 of 21): from 3597091to 3809700.] [NT:alternate gene name: dinA, uvrA] [SP:P37954]
[LE:14915] [RE:16900] [DI:complement] >gp:[GI:g2618841] [LN:AF017113] [AC:AF017113]
[PN:excinuclease ABC subunit B] [GN:uvrB] [OR:Bacillus subtilis] [DB:genpept-bct2]
[DE:Bacillus subtilis 300-304 degree genomic sequence.] [LE:13393] [RE:15378]
[DI:direct] >gp:[GI:e1184423:g2636043] [LN:BSUB0019] [AC:Z99122:AL009126]
[PN:excinuclease ABC (subunit B)] [GN:uvrB] [FN:excision of ultraviolet light-induced]
[OR:Bacillus subtilis] [DB:genpept] [DE:Bacillus subtilis complete genome (section 19
of 21): from 3597091to 3809700.] [NT:alternate gene name: dinA, uvrA] [SP:P37954]
[LE:14915] [RE:16900] [DI:complement]

| ORF Name | NTID | AAID | NT Length | AA Length | score | probability |
|---|---|---|---|---|---|---|
| AI7503001001_16677343_c1_925 | 3358 | 7130 | 447 | 148 | 107 | 3.4e-06 |

Description
sp:[LN:Y357_METJA] [AC:Q57803] [GN:MJ0357] [OR:METHANOCOCCUS JANNASCHII]
[DE:HYPOTHETICAL PROTEIN MJ0357] [SP:Q57803] [DB:swissprot] >pir:[LN:E64344] [AC:E64344
] [PN:hypothetical protein MJ0357] [OR:Methanococcus jannaschii] [DB:pir2]
[MP:REV326407-325940 ] >gp:[GI:g1591066] [LN:U67489] [AC:U67489:L77117] [PN:M.
jannaschii predicted coding region MJ0357] [GN:MJ0357] [OR:Methanococcus jannaschii]
[DB:genpept-bct2] [DE:Methanococcus jannaschii section 31 of 150 of the complete
genome.] [NT:hypothetical protein; identified by GeneMark;] [LE:1632] [RE:2099]
[DI:complement]

| ORF Name | NTID | AAID | NT Length | AA Length | score | probability |
|---|---|---|---|---|---|---|
| AI7503001001_16834512_c3_1401 | 3359 | 7131 | 1380 | 459 | 661 | 6.7e-65 |

Description
sp:[LN:PHR_BACFI] [AC:Q04449] [GN:PHR] [OR:BACILLUS FIRMUS] [EC:4.1.99.3]
[DE:(PHOTOREACTIVATING ENZYME) (FRAGMENT)] [SP:Q04449] [DB:swissprot] >gp:[GI:g142783]
[LN:BACCTA] [AC:M94110] [PN:DNA photolyase] [GN:phr] [OR:Bacillus firmus] [SR:Bacillus
firmus (strain OF4) DNA] [DB:genpept-bct1] [EC:4.1.99.3] [DE:Bacillus firmus DNA
photolyase (phr) gene, 3' end, and cytochromeoxidase (cta) operon.] [NT:putative]
[LE:1] [RE:1020] [DI:direct]

| ORF Name | NTID | AAID | NT Length | AA Length | score | probability |
|---|---|---|---|---|---|---|
| AI7503001001_16850303_c1_1090 | 3360 | 7132 | 477 | 158 | 510 | 6.7e-49 |

Description
sp:[LN:SMPB_BACSU] [AC:O32230] [GN:SMPB] [OR:BACILLUS SUBTILIS] [DE:SMALL PROTEIN B
HOMOLOG] [SP:O32230] [DB:swissprot] >pir:[LN:F70027] [AC:F70027 ] [PN:conserved
hypothetical protein yvaI] [GN:yvaI ] [CL:small protein smpB] [OR:Bacillus subtilis]
[DB:pir2] >gp:[GI:e1186048:g2635873] [LN:BSUB0018] [AC:Z99121:AL009126] [GN:yvaI]
[FN:unknown] [OR:Bacillus subtilis] [DB:genpept-bct1] [DE:Bacillus subtilis complete
genome (section 18 of 21): from 3399551to 3609060.] [NT:similar to hypothetical
proteins] [SP:O32230] [LE:50760] [RE:51230] [DI:complement]

| ORF Name | NTID | AAID | NT Length | AA Length | score | probability |
|---|---|---|---|---|---|---|
| AI7503001001_17011562_c3_1354 | 3361 | 7133 | 168 | 55 | | |

Description
NO-HIT

| ORF Name | NTID | AAID | NT Length | AA Length | score | probability |
|---|---|---|---|---|---|---|
| AI7503001001_181500_c3_1353 | 3362 | 7134 | 798 | 265 | 415 | 7.8e-39 |

Description
sp:[LN:TAGA_BACSU] [AC:P27620] [GN:TAGA] [OR:BACILLUS SUBTILIS] [DE:TEICHOIC ACID BIOSYNTHESIS PROTEIN A] [SP:P27620] [DB:swissprot] >pir:[LN:B49757] [AC:B49757:B69720 ] [PN:polyglycerol phosphate techoic acid biosynthesis protein tagA ] [GN:tagA ] [OR:Bacillus subtilis] [DB:pir2] >gp:[GI:g143724] [LN:BACTAGABCD] [AC:M57497] [GN:tagA] [OR:Bacillus subtilis] [SR:B.subtilis (strain 168) DNA] [DB:genpept-bct1] [DE:B.subtilis tagA, tagB, tagC and tagD genes, complete cds.] [NT:putative] [LE:800] [RE:1570] [DI:direct] >gp:[GI:e1184481:g2636101] [LN:BSUB0019] [AC:Z99122:AL009126] [GN:tagA] [FN:polyglycerol phosphate assembly and export] [OR:Bacillus subtilis] [DB:genpept-bct1] [DE:Bacillus subtilis complete genome (section 19 of 21): from 3597091to 3809700.] [SP:P27620] [LE:83340] [RE:84110] [DI:direct] >gp:[GI:e1184481:g2636101] [LN:BSUB0019] [AC:Z99122:AL009126] [GN:tagA] [FN:polyglycerol phosphate assembly and export] [OR:Bacillus subtilis] [DB:genpept] [DE:Bacillus subtilis complete genome (section 19 of 21): from 3597091to 3809700.] [SP:P27620] [LE:83340] [RE:84110] [DI:direct]

| ORF Name | NTID | AAID | NT Length | AA Length | score | probability |
|---|---|---|---|---|---|---|
| AI7503001001_187568_c2_1149 | 3363 | 7135 | 327 | 108 | 178 | 1.0e-13 |

Description
pir:[LN:F70008] [AC:F70008 ] [PN:hypothetical protein yufC] [GN:yufC ] [OR:Bacillus subtilis] [DB:pir2] >gp:[GI:e1184242:g2635660] [LN:BSUB0017] [AC:Z99120:AL009126] [GN:yufC] [FN:unknown] [OR:Bacillus subtilis] [DB:genpept-bct1] [DE:Bacillus subtilis complete genome (section 17 of 21): from 3197001to 3414420.] [LE:53800] [RE:54084] [DI:direct] >gp:[GI:e311513:g1934775] [LN:BSZ93932] [AC:Z93932] [PN:unknown] [GN:yufC] [OR:Bacillus subtilis] [DB:genpept-bct1] [DE:B.subtilis genomic DNA fragment from yufA to yufE.] [LE:7444] [RE:7728] [DI:complement]

| ORF Name | NTID | AAID | NT Length | AA Length | score | probability |
|---|---|---|---|---|---|---|
| AI7503001001_187916_c2_1189 | 3364 | 7136 | 612 | 203 | 344 | 2.6e-31 |

Description
gp:[GI:e1314177:g3395518] [LN:PMAJ84] [AC:AJ000084] [PN:putative acetyl transferase] [GN:pat] [OR:Proteus mirabilis] [DB:genpept-bct1] [DE:Proteus mirabilis ccm and pat genes and partial ygbA gene.] [LE:949] [RE:1506] [DI:direct]

| ORF Name | NTID | AAID | NT Length | AA Length | score | probability |
|---|---|---|---|---|---|---|
| AI7503001001_189187_c1_1040 | 3365 | 7137 | 132 | 43 | | |

Description
NO-HIT

| ORF Name | NTID | AAID | NT Length | AA Length | score | probability |
|---|---|---|---|---|---|---|
| AI7503001001_19532277_c1_1120 | 3366 | 7138 | 126 | 41 | | |

Description
NO-HIT

| ORF Name | NTID | AAID | NT Length | AA Length | score | probability |
|---|---|---|---|---|---|---|
| AI7503001001_19537812_c2_1293 | 3367 | 7139 | 150 | 49 | 39 | 0.0042 |

Description
pir:[LN:A70221] [AC:A70221] [PN:conserved hypothetical protein BBC08] [OR:Borrelia burgdorferi] [SR:, Lyme disease spirochete] [DB:pir2] >gp:[GI:g2689920] [LN:AE000791] [AC:AE000791] [PN:conserved hypothetical protein] [GN:BBC08] [OR:Borrelia burgdorferi] [SR:Lyme disease spirochete] [DB:genpept-bct2] [DE:Borrelia burgdorferi plasmid cp9, complete plasmid sequence.] [NT:similar to GB:U03641 PID:458212 percent identity:] [LE:5534] [RE:5980] [DI:direct]

| ORF Name | NTID | AAID | NT Length | AA Length | score | probability |
|---|---|---|---|---|---|---|
| AI7503001001_19547783_f2_493 | 3368 | 7140 | 771 | 256 | 448 | 2.5e-42 |

Description
gp:[GI:g4481749] [LN:AF007865] [AC:AF007865] [PN:BacR] [GN:bacR] [OR:Bacillus licheniformis] [DB:genpept-bct2] [DE:Bacillus licheniformis bacitracin synthetase operon, completesequence; BacS (bacS), BcrA (bcrA), BcrB (bcrB), and BcrC (bcrC)genes, complete cds.] [NT:44488] [LE:44497] [RE:45213] [DI:direct]

| ORF Name | NTID | AAID | NT Length | AA Length | score | probability |
|---|---|---|---|---|---|---|
| AI7503001001_195885_f2_436 | 3369 | 7141 | 165 | 54 | | |

Description
NO-HIT

| ORF Name | NTID | AAID | NT Length | AA Length | score | probability |
|---|---|---|---|---|---|---|
| AI7503001001_19589187_f3_689 | 3370 | 7142 | 207 | 68 | 57 | 0.019 |

Description
pir:[LN:F71027] [AC:F71027] [PN:hypothetical protein PH1514] [GN:PH1514] [OR:Pyrococcus horikoshii] [DB:pir2] >gp:[GI:d1031565:g3257939] [LN:AP000006] [AC:AP000006:AB005215:AB009510:AB009511:AB009512:AB009513:AB009514] [PN:310aa long hypothetical protein] [GN:PH1514] [OR:Pyrococcus horikoshii] [SR:Pyrococcus horikoshii (strain:OT3) DNA, clone:Pyrococcus horikoshi] [DB:genpept-bct1] [DE:Pyrococcus horikoshii OT3 genomic DNA, 1166001-1485000 nt. position(6/7).] [LE:183119] [RE:184051] [DI:complement]

| ORF Name | NTID | AAID | NT Length | AA Length | score | probability |
|---|---|---|---|---|---|---|
| AI7503001001_19696951_c3_1486 | 3371 | 7143 | 183 | 60 | 193 | 2.6e-15 |

Description
pir:[LN:A70028] [AC:A70028] [PN:hypothetical protein yvaL] [GN:yvaL] [CL:protein-export protein secG] [OR:Bacillus subtilis] [DB:pir2] >gp:[GI:e1186051:g2635876] [LN:BSUB0018] [AC:Z99121:AL009126] [GN:yvaL] [FN:unknown] [OR:Bacillus subtilis] [DB:genpept-bct1] [DE:Bacillus subtilis complete genome (section 18 of 21): from 3399551to 3609060.] [LE:54605] [RE:54835] [DI:complement]

| ORF Name | NTID | AAID | NT Length | AA Length | score | probability |
|---|---|---|---|---|---|---|
| AI7503001001_19704062_f2_538 | 3372 | 7144 | 183 | 60 | | |

Description
NO-HIT

| ORF Name | NTID | AAID | NT Length | AA Length | score | probability |
|---|---|---|---|---|---|---|
| AI7503001001_197127_c3_1411 | 3373 | 7145 | 132 | 43 | | |

Description
NO-HIT

| ORF Name | NTID | AAID | NT Length | AA Length | score | probability |
|---|---|---|---|---|---|---|
| AI7503001001_19714012_c1_939 | 3374 | 7146 | 144 | 47 | | |

Description
NO-HIT

| ORF Name | NTID | AAID | NT Length | AA Length | score | probability |
|---|---|---|---|---|---|---|
| AI7503001001_197152_c3_1343 | 3375 | 7147 | 348 | 115 | 257 | 4.3e-22 |

Description
gp:[GI:d1036083:g4001727] [LN:AB015981] [AC:AB015981] [PN:MnhC] [GN:mnhC]
[OR:Staphylococcus aureus] [SR:Staphylococcus aureus (strain:209P) DNA]
[DB:genpept-bct1] [DE:Staphylococcus aureus genes for OrfA, MnhA, MnhB, MnhC, MnhD,
MnhE,MnhF and MnhG, complete cds.] [LE:3642] [RE:3983] [DI:direct]

| ORF Name | NTID | AAID | NT Length | AA Length | score | probability |
|---|---|---|---|---|---|---|
| AI7503001001_19726575_c1_942 | 3376 | 7148 | 144 | 47 | | |

Description
NO-HIT

| ORF Name | NTID | AAID | NT Length | AA Length | score | probability |
|---|---|---|---|---|---|---|
| AI7503001001_19765965_c1_1098 | 3377 | 7149 | 249 | 82 | 323 | 4.4e-29 |

Description
gp:[GI:g2226349] [LN:AF003593] [AC:AF003593] [PN:CspC] [GN:cspC] [OR:Staphylococcus
aureus] [DB:genpept-bct1] [DE:Staphylococcus aureus CspC (cspC) gene, complete cds.]
[NT:similar to major cold-shock protein] [LE:444] [RE:644] [DI:direct]

| ORF Name | NTID | AAID | NT Length | AA Length | score | probability |
|---|---|---|---|---|---|---|
| AI7503001001_19766886_f1_59 | 3378 | 7150 | 435 | 144 | 167 | 1.9e-12 |

Description
gp:[GI:e1294701:g3171734] [LN:BTPGI2XX] [AC:X13481] [OR:Bacillus thuringiensis]
[DB:genpept-bct1] [DE:Bacillus thuringiensis plasmid pGI2 with transposon Tn4430.]
[NT:ORF 2] [LE:6037] [RE:6849] [DI:direct]

| ORF Name | NTID | AAID | NT Length | AA Length | score | probability |
|---|---|---|---|---|---|---|
| AI7503001001_19804502_f2_364 | 3379 | 7151 | 144 | 47 | | |

Description
NO-HIT

| ORF Name | NTID | AAID | NT Length | AA Length | score | probability |
|---|---|---|---|---|---|---|
| AI7503001001_19814387_c1_966 | 3380 | 7152 | 135 | 44 | | |

Description
NO-HIT

| ORF Name | NTID | AAID | NT Length | AA Length | score | probability |
|---|---|---|---|---|---|---|
| AI7503001001_19929556_f2_545 | 3381 | 7153 | 129 | 42 | | |

Description
NO-HIT

| ORF Name | NTID | AAID | NT Length | AA Length | score | probability |
|---|---|---|---|---|---|---|
| AI7503001001_2007677_f2_513 | 3382 | 7154 | 144 | 47 | | |

Description
NO-HIT

| ORF Name | NTID | AAID | NT Length | AA Length | score | probability |
|---|---|---|---|---|---|---|
| AI7503001001_2007767_c2_1199 | 3383 | 7155 | 126 | 41 | | |

Description
NO-HIT

| ORF Name | NTID | AAID | NT Length | AA Length | score | probability |
|---|---|---|---|---|---|---|
| AI7503001001_20110186_f3_688 | 3384 | 7156 | 153 | 50 | | |

Description
NO-HIT

| ORF Name | NTID | AAID | NT Length | AA Length | score | probability |
|---|---|---|---|---|---|---|
| AI7503001001_20322153_c2_1212 | 3385 | 7157 | 219 | 72 | | |

Description
NO-HIT

| ORF Name | NTID | AAID | NT Length | AA Length | score | probability |
|---|---|---|---|---|---|---|
| AI7503001001_20350875_c3_1515 | 3386 | 7158 | 123 | 40 | | |

Description
NO-HIT

| ORF Name | NTID | AAID | NT Length | AA Length | score | probability |
|---|---|---|---|---|---|---|
| AI7503001001_20485663_f2_563 | 3387 | 7159 | 210 | 69 | | |

Description
NO-HIT

| ORF Name | NTID | AAID | NT Length | AA Length | score | probability |
|---|---|---|---|---|---|---|
| AI7503001001_20491385_f1_252 | 3388 | 7160 | 144 | 47 | | |

Description
NO-HIT

| ORF Name | NTID | AAID | NT Length | AA Length | score | probability |
|---|---|---|---|---|---|---|
| AI7503001001_20604832_f3_692 | 3389 | 7161 | 558 | 185 | 106 | 0.0012 |

Description
gp:[GI:g552163] [LN:PFA10B] [AC:J03986] [OR:Plasmodium falciparum] [SR:P.falciparum (strain IMTM22) asexual erythrocytic form DNA, clon] [DB:genpept-invl] [DE:P.falciparum 10b antigen gene, partial cds.] [NT:10b antigen] [LE:<1] [RE:>1124] [DI:direct]

| ORF Name | NTID | AAID | NT Length | AA Length | score | probability |
|---|---|---|---|---|---|---|
| AI7503001001_20707877_c3_1457 | 3390 | 7162 | 123 | 40 | | |

Description
NO-HIT

| ORF Name | NTID | AAID | NT Length | AA Length | score | probability |
|---|---|---|---|---|---|---|
| AI7503001001_20734387_f3_640 | 3391 | 7163 | 159 | 52 | | |

Description
NO-HIT

| ORF Name | NTID | AAID | NT Length | AA Length | score | probability |
|---|---|---|---|---|---|---|
| AI7503001001_20830417_c3_1332 | 3392 | 7164 | 147 | 48 | | |

Description
NO-HIT

| ORF Name | NTID | AAID | NT Length | AA Length | score | probability |
|---|---|---|---|---|---|---|
| AI7503001001_20893828_c1_974 | 3393 | 7165 | 219 | 72 | | |

Description
NO-HIT

| ORF Name | NTID | AAID | NT Length | AA Length | score | probability |
|---|---|---|---|---|---|---|
| AI7503001001_20900017_c2_1239 | 3394 | 7166 | 2169 | 722 | 3396 | 0.0 |

Description
gp:[GI:e1393150:g4490609] [LN:SAU133495] [AC:AJ133495] [PN:ribonucelotide reductase major subunit] [GN:rir1] [OR:Staphylococcus aureus] [DB:genpept-bct1] [DE:Staphylococcus aureus ribonucleotide reductase operon.] [LE:448] [RE:2604] [DI:direct]

| ORF Name | NTID | AAID | NT Length | AA Length | score | probability |
|---|---|---|---|---|---|---|
| AI7503001001_209452_f1_276 | 3395 | 7167 | 648 | 215 | 754 | 9.4e-75 |

Description
gp:[GI:e255528:g1617429] [LN:SEABCTS] [AC:X99127] [PN:membrane protein] [FN:iron repressible ABC transport system] [OR:Staphylococcus epidermidis] [DB:genpept-bct1] [DE:S.epidermidis gene encoding ABC transport system.] [LE:878] [RE:1624] [DI:direct]

| ORF Name | NTID | AAID | NT Length | AA Length | score | probability |
|---|---|---|---|---|---|---|
| AI7503001001_209627_c3_1444 | 3396 | 7168 | 1032 | 343 | 1571 | 2.5e-161 |

Description
gp:[GI:e1393151:g4490610] [LN:SAU133495] [AC:AJ133495] [PN:ribonucleotide reductase minor subunit] [GN:rir2] [OR:Staphylococcus aureus] [DB:genpept-bct1] [DE:Staphylococcus aureus ribonucleotide reductase operon.] [LE:2722] [RE:3693] [DI:direct]

| ORF Name | NTID | AAID | NT Length | AA Length | score | probability |
|---|---|---|---|---|---|---|
| AI7503001001_21490925_c1_1005 | 3397 | 7169 | 126 | 41 | | |

Description
NO-HIT

| ORF Name | NTID | AAID | NT Length | AA Length | score | probability |
|---|---|---|---|---|---|---|
| AI7503001001_21509430_c1_962 | 3398 | 7170 | 132 | 43 | | |

Description
NO-HIT

| ORF Name | NTID | AAID | NT Length | AA Length | score | probability |
|---|---|---|---|---|---|---|
| AI7503001001_21525061_c1_1016 | 3399 | 7171 | 681 | 226 | 110 | 0.00014 |

Description
sp:[LN:YB69_HAEIN] [AC:P44118] [GN:HI1169] [OR:HAEMOPHILUS INFLUENZAE] [DE:HYPOTHETICAL PROTEIN HI1169] [SP:P44118] [DB:swissprot] >pir:[LN:A64021] [AC:A64021 ] [PN:hypothetical protein HI1169] [OR:Haemophilus influenzae] [DB:pir2] >gp:[GI:g1574096] [LN:U32797] [AC:U32797:L42023] [PN:H. influenzae predicted coding region HI1169] [GN:HI1169] [OR:Haemophilus influenzae Rd] [DB:genpept-bct2] [DE:Haemophilus influenzae Rd section 112 of 163 of the completegenome.] [NT:hypothetical protein; identified by GeneMark;] [LE:511] [RE:1077] [DI:complement]

| ORF Name | NTID | AAID | NT Length | AA Length | score | probability |
|---|---|---|---|---|---|---|
| AI7503001001_21537811_c1_1007 | 3400 | 7172 | 1137 | 378 | 925 | 7.1e-93 |

Description
sp:[LN:CSBB_BACSU] [AC:Q45539] [GN:CSBB] [OR:BACILLUS SUBTILIS] [DE:CSBB PROTEIN] [SP:Q45539] [DB:swissprot] >pir:[LN:JC5173] [AC:JC5173:G69607 ] [PN:stress response protein csbB] [GN:csbB ] [CL:stress response protein csbB] [OR:Bacillus subtilis] [DB:pir2] >gp:[GI:g1387979] [LN:BACCSBB] [AC:L77099] [GN:csbB] [OR:Bacillus subtilis] [DB:genpept-bct1] [DE:Bacillus subtilis csbB gene, complete cds.] [NT:similar to hypothetical protein from Synechocystis] [LE:310] [RE:1299] [DI:direct] >gp:[GI:e1182849:g2633183] [LN:BSUB0005] [AC:Z99108:AL009126] [PN:stress response protein] [GN:csbB] [OR:Bacillus subtilis] [DB:genpept-bct1] [DE:Bacillus subtilis complete genome (section 5 of 21): from 802821 to1011250.] [NT:alternate gene name: yfhN] [SP:Q45539] [LE:127505] [RE:128494] [DI:direct] >gp:[GI:d1025396:g2804544] [LN:D85082] [AC:D85082] [PN:YfhN] [OR:Bacillus subtilis] [SR:Bacillus subtilis DNA] [DB:genpept-bct1] [DE:Bacillus subtilis DNA, genome sequence, 79 to 81 degree region.] [LE:20396] [RE:21385] [DI:direct]

| ORF Name | NTID | AAID | NT Length | AA Length | score | probability |
|---|---|---|---|---|---|---|
| AI7503001001_21617215_f1_36 | 3401 | 7173 | 150 | 49 | | |

Description
NO-HIT

| ORF Name | NTID | AAID | NT Length | AA Length | score | probability |
|---|---|---|---|---|---|---|
| AI7503001001_21726510_f2_612 | 3402 | 7174 | 126 | 41 | | |

Description
NO-HIT

| ORF Name | NTID | AAID | NT Length | AA Length | score | probability |
|---|---|---|---|---|---|---|
| AI7503001001_21751287_f3_684 | 3403 | 7175 | 123 | 40 | | |

Description
NO-HIT

| ORF_Name | NTID | AAID | NT Length | AA Length | score | probability |
|---|---|---|---|---|---|---|
| AI7503001001_21883512_c3_1512 | 3404 | 7176 | 225 | 74 | | |

Description
NO-HIT

| ORF_Name | NTID | AAID | NT Length | AA Length | score | probability |
|---|---|---|---|---|---|---|
| AI7503001001_21897308_f2_541 | 3405 | 7177 | 261 | 86 | | |

Description
NO-HIT

| ORF_Name | NTID | AAID | NT Length | AA Length | score | probability |
|---|---|---|---|---|---|---|
| AI7503001001_21963877_c2_1273 | 3406 | 7178 | 123 | 40 | | |

Description
NO-HIT

| ORF_Name | NTID | AAID | NT Length | AA Length | score | probability |
|---|---|---|---|---|---|---|
| AI7503001001_22265936_c3_1452 | 3407 | 7179 | 1128 | 375 | 1557 | 7.6e-160 |

Description
pir:[LN:A55856] [AC:A55856 ] [PN:llm protein] [GN:llm ] [CL:lipophilic protein lim]
[OR:Staphylococcus aureus] [DB:pir2] >gp:[GI:d1023388:g4433370] [LN:STASRM551A]
[AC:D21131] [PN:lipophilic protein which affects bacterial lysis] [GN:llm]
[OR:Staphylococcus aureus] [SR:Staphylococcus aureus (strain:SRM551) DNA,
clone_lib:lambda ZapII] [DB:genpept-bct1] [DE:Staphylococcus aureus gene for a
participant in homogeneousexpression of high-level methicillin resistance, complete
cds.] [LE:148] [RE:1203] [DI:direct]

| ORF_Name | NTID | AAID | NT Length | AA Length | score | probability |
|---|---|---|---|---|---|---|
| AI7503001001_22381693_c3_1472 | 3408 | 7180 | 852 | 283 | 1187 | 1.2e-120 |

Description
sp:[LN:LGT_STAAU] [AC:P52282] [GN:LGT] [OR:STAPHYLOCOCCUS AUREUS] [EC:2.4.99.-]
[DE:PROLIPOPROTEIN DIACYLGLYCERYL TRANSFERASE,] [SP:P52282] [DB:swissprot]
>gp:[GI:g1016770] [LN:SAU35773] [AC:U35773] [PN:prolipoprotein diacylglyceryl
transferase] [GN:lgt] [FN:transfer of diglyceride moiety to SH Group of]
[OR:Staphylococcus aureus] [DB:genpept-bct1] [DE:Staphylococcus aureus prolipoprotein
diacylglyceryl transferase(lgt) gene, complete cds.] [LE:297] [RE:1136] [DI:direct]

| ORF_Name | NTID | AAID | NT Length | AA Length | score | probability |
|---|---|---|---|---|---|---|
| AI7503001001_22391068_c1_1046 | 3409 | 7181 | 1056 | 351 | 1284 | 6.4e-131 |

Description
gp:[GI:e1330455:g3724158] [LN:SAA005352] [AC:AJ005352] [PN:lipoprotein] [GN:sstD]
[FN:iron transporter] [OR:Staphylococcus aureus] [DB:genpept-bct1] [DE:Staphylococcus
aureus, Sst putative iron transport operon.] [LE:3066] [RE:4095] [DI:direct]

| ORF Name | NTID | AAID | NT Length | AA Length | score | probability |
|---|---|---|---|---|---|---|
| AI7503001001_22446053_c2_1132 | 3410 | 7182 | 726 | 241 | 335 | 2.4e-30 |

Description
pir:[LN:A64479] [AC:A64479 ] [PN:DNA-(apurinic or apyrimidinic site) lyase,:endonuclease III] [CL:Methanococcus jannaschii conserved DNA-(apurinic or apyrimidinic site) lyase] [OR:Methanococcus jannaschii] [EC:4.2.99.18] [DB:pir2] [MP:FOR1403656-1404318 ] >gp:[GI:g1592082] [LN:U67584] [AC:U67584:L77117] [PN:endonuclease III, putative (nth2)] [GN:MJ1434] [OR:Methanococcus jannaschii] [DB:genpept-bct2] [DE:Methanococcus jannaschii section 126 of 150 of the complete genome.] [NT:similar to GB:U11289 SP:P39788 PID:533099] [LE:7078] [RE:7740] [DI:direct]

| ORF Name | NTID | AAID | NT Length | AA Length | score | probability |
|---|---|---|---|---|---|---|
| AI7503001001_22462926_c1_1122 | 3411 | 7183 | 783 | 260 | 669 | 9.5e-66 |

Description
pir:[LN:H70023] [AC:H70023 ] [PN:N-acetyl-glucosamine catabolism homolog yutF] [GN:yutF ] [CL:nagD protein] [OR:Bacillus subtilis] [DB:pir2] >gp:[GI:e1184308:g2635726] [LN:BSUB0017] [AC:Z99120:AL009126] [GN:yutF] [FN:unknown] [OR:Bacillus subtilis] [DB:genpept-bct1] [DE:Bacillus subtilis complete genome (section 17 of 21): from 3197001to 3414420.] [NT:similar to N-acetyl-glucosamine catabolism] [LE:120087] [RE:120857] [DI:complement]

| ORF Name | NTID | AAID | NT Length | AA Length | score | probability |
|---|---|---|---|---|---|---|
| AI7503001001_22687900_c3_1369 | 3412 | 7184 | 681 | 226 | 685 | 1.9e-67 |

Description
pir:[LN:G70000] [AC:G70000 ] [PN:two-component response regulator [YtsB] homolog ytsA] [GN:ytsA ] [CL:ompR protein:response regulator homology] [OR:Bacillus subtilis] [DB:pir2] >gp:[GI:e1185913:g2635524] [LN:BSUB0016] [AC:Z99119:AL009126] [GN:ytsA] [FN:unknown] [OR:Bacillus subtilis] [DB:genpept-bct1] [DE:Bacillus subtilis complete genome (section 16 of 21): from 2997771to 3213410.] [NT:similar to two-component response regulator [YtsB]] [LE:114498] [RE:115193] [DI:complement] >gp:[GI:g2293175] [LN:AF008220] [AC:AF008220] [PN:signal transduction regulator] [GN:ytsA] [OR:Bacillus subtilis] [DB:genpept-bct2] [DE:Bacillus subtilis rrnB-dnaB genomic region.] [LE:65234] [RE:65929] [DI:direct]

| ORF Name | NTID | AAID | NT Length | AA Length | score | probability |
|---|---|---|---|---|---|---|
| AI7503001001_22776938_c2_1323 | 3413 | 7185 | 156 | 51 | | |

Description
NO-HIT

| ORF Name | NTID | AAID | NT Length | AA Length | score | probability |
|---|---|---|---|---|---|---|
| AI7503001001_22895400_f3_753 | 3414 | 7186 | 138 | 45 | | |

Description
NO-HIT

| ORF Name | NTID | AAID | NT Length | AA Length | score | probability |
|---|---|---|---|---|---|---|
| AI7503001001_23437750_c1_938 | 3415 | 7187 | 171 | 56 | | |

Description
NO-HIT

| ORF Name | NTID | AAID | NT Length | AA Length | score | probability |
|---|---|---|---|---|---|---|
| AI7503001001_23438461_c1_926 | 3416 | 7188 | 687 | 228 | 103 | 0.029 |

Description
gp:[GI:g5306158] [LN:AF160864] [AC:AF160864] [PN:orf1386] [GN:orf1386]
[OR:Mitochondrion Tetrahymena pyriformis] [SR:Tetrahymena pyriformis] [DB:genpept]
[DE:Tetrahymena pyriformis mitochondrial DNA, complete genome.] [NT:Open reading frame ymf77 (CPGN); ATA initiation] [LE:22317] [RE:26477] [DI:complement]

| ORF Name | NTID | AAID | NT Length | AA Length | score | probability |
|---|---|---|---|---|---|---|
| AI7503001001_23439005_f1_6 | 3417 | 7189 | 141 | 46 | | |

Description
NO-HIT

| ORF Name | NTID | AAID | NT Length | AA Length | score | probability |
|---|---|---|---|---|---|---|
| AI7503001001_23439061_c1_984 | 3418 | 7190 | 531 | 176 | 258 | 3.4e-22 |

Description
pir:[LN:F69927] [AC:F69927 ] [PN:hypothetical protein yosT] [GN:yosT ] [OR:Bacillus subtilis] [DB:pir2] >gp:[GI:e1185472:g2634393] [LN:BSUB0011] [AC:Z99114:AL009126]
[GN:yosT] [PN:unknown] [OR:Bacillus subtilis] [DB:genpept-bct1] [DE:Bacillus subtilis complete genome (section 11 of 21): from 2000171to 2207900.] [LE:157797] [RE:158246]
[DI:complement] >gp:[GI:g3025644] [LN:AF020713] [AC:AF020713] [PN:unknown] [GN:yosT]
[OR:Bacteriophage SPBc2] [DB:genpept-phg] [DE:Bacteriophage SPBc2 complete genome.]
[LE:127274] [RE:127723] [DI:direct] >gp:[GI:g2522410] [LN:AF012906]
[AC:AF012906:U80600] [PN:unknown] [GN:yojV] [OR:Bacillus subtilis] [DB:genpept-bct2]
[DE:Bacillus subtilis yojP gene, partial cds; yojQ/S, yojR, yojT,yojU, yojV, yojW, yojX, yojY, yojZ, and yokA genes, complete cds.] [LE:4921] [RE:5370] [DI:direct]

| ORF Name | NTID | AAID | NT Length | AA Length | score | probability |
|---|---|---|---|---|---|---|
| AI7503001001_23444838_c2_1267 | 3419 | 7191 | 264 | 87 | 373 | 2.2e-34 |

Description
gp:[GI:e1387399:g4379428] [LN:SAAJ3781] [AC:AJ223781] [PN:thioredoxin reductase]
[GN:trxB] [OR:Staphylococcus aureus] [DB:genpept-bct1] [EC:1.6.4.5] [DE:Staphylococcus aureus trxB gene.] [LE:1262] [RE:2197] [DI:direct]

| ORF Name | NTID | AAID | NT Length | AA Length | score | probability |
|---|---|---|---|---|---|---|
| AI7503001001_23445175_f3_674 | 3420 | 7192 | 135 | 44 | | |

Description
NO-HIT

| ORF Name | NTID | AAID | NT Length | AA Length | score | probability |
|---|---|---|---|---|---|---|
| AI7503001001_23445890_c2_1177 | 3421 | 7193 | 492 | 163 | 333 | 3.8e-30 |

Description
pir:[LN:S74709] [AC:S74709 ] [PN:hypothetical protein sll1188] [OR:Synechocystis sp.]
[SR:PCC 6803, , PCC 6803] [SR:PCC 6803, ] [DB:pir2] >gp:[GI:d1017593:g1651934]
[LN:D90901] [AC:D90901:AB001339] [PN:hypothetical protein] [OR:Synechocystis sp.]
[SR:Synechocystis sp. (strain:PCC6803) DNA] [DB:genpept-bct1] [DE:Synechocystis sp.
PCC6803 complete genome, 3/27, 271600-402289.] [NT:ORF_ID:sll1188] [LE:42106]
[RE:42600] [DI:complement]

| ORF Name | NTID | AAID | NT Length | AA Length | score | probability |
|---|---|---|---|---|---|---|
| AI7503001001_23446912_f2_597 | 3422 | 7194 | 123 | 40 | | |

Description
NO-HIT

| ORF Name | NTID | AAID | NT Length | AA Length | score | probability |
|---|---|---|---|---|---|---|
| AI7503001001_2345062_f3_639 | 3423 | 7195 | 171 | 56 | | |

Description
NO-HIT

| ORF Name | NTID | AAID | NT Length | AA Length | score | probability |
|---|---|---|---|---|---|---|
| AI7503001001_23450_c3_1490 | 3424 | 7196 | 189 | 62 | | |

Description
NO-HIT

| ORF Name | NTID | AAID | NT Length | AA Length | score | probability |
|---|---|---|---|---|---|---|
| AI7503001001_23469552_c1_923 | 3425 | 7197 | 207 | 68 | | |

Description
NO-HIT

| ORF Name | NTID | AAID | NT Length | AA Length | score | probability |
|---|---|---|---|---|---|---|
| AI7503001001_23475892_c1_1121 | 3426 | 7198 | 1362 | 453 | 707 | 9.0e-70 |

Description
pir:[LN:G70015] [AC:G70015 ] [PN:conserved hypothetical protein yunD] [GN:yunD ]
[OR:Bacillus subtilis] [DB:pir2] >gp:[GI:e1184316:g2635734] [LN:BSUB0017]
[AC:Z99120:AL009126] [GN:yunD] [FN:unknown] [OR:Bacillus subtilis] [DB:genpept-bct1]
[DE:Bacillus subtilis complete genome (section 17 of 21): from 3197001to 3414420.]
[NT:similar to hypothetical proteins] [LE:125728] [RE:127116] [DI:complement]

| ORF Name | NTID | AAID | NT Length | AA Length | score | probability |
|---|---|---|---|---|---|---|
| AI7503001001_23476517_c2_1259 | 3427 | 7199 | 1296 | 431 | 638 | 1.8e-62 |

Description
sp:[LN:CMF1_BACSU] [AC:P39145] [GN:COMFA:COMF1] [OR:BACILLUS SUBTILIS] [DE:COMF OPERON PROTEIN 1] [SP:P39145] [DB:swissprot] >pir:[LN:G69602] [AC:G69602:S77620:S35011:I40387:S28597 ] [PN:late competence protein required for DNA uptake comFA:ATP-dependent DNA helicase/translocase comF1] [GN:comFA:comF1 ] [CL:DEAD/H box helicase homology] [OR:Bacillus subtilis] [DB:pir2] >gp:[GI:g580841] [LN:BSCOMFG] [AC:Z18629] [PN:F1] [GN:comForf1] [OR:Bacillus subtilis] [DB:genpept-bct1] [DE:B.subtilis comF gene.] [SP:P39145] [LE:952] [RE:2343] [DI:direct] >gp:[GI:e1184453:g2636073] [LN:BSUB0019] [AC:Z99122:AL009126] [PN:late competence protein] [GN:comFA] [FN:required for DNA uptake (competence)] [OR:Bacillus subtilis] [DB:genpept-bct1] [DE:Bacillus subtilis complete genome (section 19 of 21): from 3597091to 3809700.] [SP:P39145] [LE:44137] [RE:45528] [DI:complement] >gp:[GI:g1762332] [LN:BSU56901] [AC:U56901] [GN:comFA] [OR:Bacillus subtilis] [DB:genpept-bct2] [DE:Bacillus subtilis putative transcriptional regulator (yvhJ),Ycr59c/YigZ homolog (yvhK), histidine kinase (degS),transcriptionalregulator of degradation enzyme (degU), (degV), (comFA), (comFB),(comFC), flagellar protein (yviB), negative regulator of flagellin(flgM), flagellar protein (yviC), flagellar-hook associated protein1 (flgK), flagellar-hook associated protein 3 (flgL), (yviE),transmembrane protein (yviF), (csrA), flagellin (hag), flagellarprotein (yviH), flagellar hook-associated protein 2 (fliD),flagellar protein (fliS), flagellar protein (fliT), sigma-54modulator homolog (yviI), and (secA) genes, complete cds.] [NT:involved in transformation] [LE:5065] [RE:6456] [DI:direct] >gp:[GI:e1184453:g2636073] [LN:BSUB0019] [AC:Z99122:AL009126] [PN:late competence protein] [GN:comFA] [FN:required for DNA uptake (competence)] [OR:Bacillus subtilis] [DB:genpept] [DE:Bacillus subtilis complete genome (section 19 of 21): from 3597091to 3809700.] [SP:P39145] [LE:44137] [RE:45528] [DI:complement]

| ORF Name | NTID | AAID | NT Length | AA Length | score | probability |
|---|---|---|---|---|---|---|
| AI7503001001_23492127_f2_368 | 3428 | 7200 | 453 | 150 | | |

Description
NO-HIT

| ORF Name | NTID | AAID | NT Length | AA Length | score | probability |
|---|---|---|---|---|---|---|
| AI7503001001_23494051_f2_444 | 3429 | 7201 | 1101 | 366 | 336 | 1.8e-30 |

Description
sp:[LN:YHCK_BACSU] [AC:P54595] [GN:YHCK] [OR:BACILLUS SUBTILIS] [DE:HYPOTHETICAL 40.7 KD PROTEIN IN CSPB-GLPP INTERGENIC REGION] [SP:P54595] [DB:swissprot] >pir:[LN:G69822] [AC:G69822 ] [PN:conserved hypothetical protein yhcK] [GN:yhcK ] [OR:Bacillus subtilis] [DB:pir2] >gp:[GI:e233892:g1239987] [LN:BS75DGREG] [AC:X96983] [PN:hypothetical protein] [GN:yhcK] [OR:Bacillus subtilis] [DB:genpept-bct1] [DE:B.subtilis chromosomal DNA (region 75 degrees: cspB upstream ofglpPFKD operon).] [NT:similarity to hypothetical proteins from] [SP:P54595] [LE:6616] [RE:7695] [DI:complement] >gp:[GI:e1182901:g2633235] [LN:BSUB0005] [AC:Z99108:AL009126] [GN:yhcK] [FN:unknown] [OR:Bacillus subtilis] [DB:genpept-bct1] [DE:Bacillus subtilis complete genome (section 5 of 21): from 802821 to1011250.] [NT:similar to hypothetical proteins] [SP:P54595] [LE:182422] [RE:183501] [DI:complement]

| ORF Name | NTID | AAID | NT Length | AA Length | score | probability |
|---|---|---|---|---|---|---|
| AI7503001001_235042_c1_1064 | 3430 | 7202 | 141 | 46 | | |

Description
NO-HIT

| ORF Name | NTID | AAID | NT Length | AA Length | score | probability |
|---|---|---|---|---|---|---|
| AI7503001001_2352140_f3_902 | 3431 | 7203 | 156 | 51 | | |

Description
NO-HIT

| ORF Name | NTID | AAID | NT Length | AA Length | score | probability |
|---|---|---|---|---|---|---|
| AI7503001001_23523326_c3_1385 | 3432 | 7204 | 1242 | 413 | 416 | 6.1e-39 |

Description
sp:[LN:YICK_ECOLI] [AC:P31436] [GN:YICK] [OR:ESCHERICHIA COLI] [DE:HYPOTHETICAL 43.5 KD PROTEIN IN SELC-NLPA INTERGENIC REGION] [SP:P31436] [DB:swissprot] >pir:[LN:D65167] [AC:D65167 ] [PN:probable membrane protein yicK] [GN:yicK ] [OR:Escherichia coli] [DB:pir2] >gp:[GI:g290508] [LN:ECOUW82] [AC:L10328] [GN:o394] [FN:unknown] [OR:Escherichia coli] [SR:Escherichia coli K12 strain MG1655; lambda clones EC14-52] [DB:genpept-bct1] [DE:E. coli; the region from 81.5 to 84.5 minutes.] [NT:similar to unidentified ORF near 47 minutes] [LE:26345] [RE:27529] [DI:direct] >gp:[GI:g1790091] [LN:AE000443] [AC:AE000443:U00096] [PN:two-module transport protein] [GN:yicK] [FN:putative transport; Not classified] [OR:Escherichia coli] [DB:genpept-bct2] [DE:Escherichia coli K-12 MG1655 section 333 of 400 of the completegenome.] [NT:o394; 100 pct identical to YICK_ECOLI SW:] [LE:8286] [RE:9470] [DI:direct]

| ORF Name | NTID | AAID | NT Length | AA Length | score | probability |
|---|---|---|---|---|---|---|
| AI7503001001_23572177_c3_1482 | 3433 | 7205 | 1194 | 397 | 1792 | 9.5e-185 |

Description
gp:[GI:e1393155:g4490614] [LN:SAU133520] [AC:AJ133520] [PN:phosphoglycerate kinase] [GN:pgk] [OR:Staphylococcus aureus] [DB:genpept-bct1] [DE:Staphylococcus aureus gap operon (gapR, gap, pgk and tpi genes).] [LE:2995] [RE:4185] [DI:direct]

| ORF Name | NTID | AAID | NT Length | AA Length | score | probability |
|---|---|---|---|---|---|---|
| AI7503001001_23600175_f2_616 | 3434 | 7206 | 123 | 40 | | |

Description
NO-HIT

| ORF Name | NTID | AAID | NT Length | AA Length | score | probability |
|---|---|---|---|---|---|---|
| AI7503001001_23617338_f1_66 | 3435 | 7207 | 528 | 175 | 215 | 1.2e-24 |

Description
sp:[LN:YAGU_ECOLI] [AC:P77262] [GN:YAGU] [OR:ESCHERICHIA COLI] [DE:HYPOTHETICAL 23.0 KD PROTEIN IN INTF-EAEH INTERGENIC REGION] [SP:P77262] [DB:swissprot] >pir:[LN:G64754] [AC:G64754 ] [PN:probable membrane protein yagU] [GN:yagU ] [OR:Escherichia coli] [DB:pir2] >gp:[GI:g1657488] [LN:ECU73857] [AC:U73857] [OR:Escherichia coli] [DB:genpept-bct1] [DE:Escherichia coli chromosome minutes 6-8.] [NT:hypothetical protein] [LE:10789] [RE:11403] [DI:direct] >gp:[GI:g1786481] [LN:AE000136] [AC:AE000136:U00096] [PN:orf, hypothetical protein] [GN:yagU] [FN:orf; Unknown] [OR:Escherichia coli] [DB:genpept-bct2] [DE:Escherichia coli K-12 MG1655 section 26 of 400 of the completegenome.] [NT:o204; 26 pct identical to 46 residues of approx.] [LE:7372] [RE:7986] [DI:direct]

| ORF Name | NTID | AAID | NT Length | AA Length | score | probability |
|---|---|---|---|---|---|---|
| AI7503001001_23621010_c1_971 | 3436 | 7208 | 843 | 280 | 167 | 1.5e-10 |

Description pir:[LN:E69777] [AC:E69777 ] [PN:transcription regulator AraC/XylS family homolog ydeC] [GN:ydeC ] [OR:Bacillus subtilis] [DB:pir2] >gp:[GI:d1020103:g1881323] [LN:AB001488] [AC:AB001488] [GN:ydeC] [OR:Bacillus subtilis] [SR:Bacillus subtilis (strain:168) DNA] [DB:genpept-bct1] [DE:Bacillus subtilis genome sequence, 148 kb sequence of the regionbetween 35 and 47 degree.] [NT:PROBABLE HTH_ARAC_FAMILY OF TRANSCRIPTIONAL] [LE:94733] [RE:95608] [DI:complement] >gp:[GI:e1182481:g2632815] [LN:BSUB0003] [AC:Z99106:AL009126] [GN:ydeC] [FN:unknown] [OR:Bacillus subtilis] [DB:genpept-bct1] [DE:Bacillus subtilis complete genome (section 3 of 21): from 402751 to611850.] [NT:similar to transcriptional regulator (AraC/XylS] [LE:158478] [RE:159353] [DI:complement]

| ORF Name | NTID | AAID | NT Length | AA Length | score | probability |
|---|---|---|---|---|---|---|
| AI7503001001_23626000_f2_582 | 3437 | 7209 | 168 | 55 | | |

Description

NO-HIT

| ORF Name | NTID | AAID | NT Length | AA Length | score | probability |
|---|---|---|---|---|---|---|
| AI7503001001_23629040_c2_1318 | 3438 | 7210 | 132 | 43 | | |

Description

NO-HIT

| ORF Name | NTID | AAID | NT Length | AA Length | score | probability |
|---|---|---|---|---|---|---|
| AI7503001001_23631928_f2_520 | 3439 | 7211 | 228 | 75 | | |

Description

NO-HIT

| ORF Name | NTID | AAID | NT Length | AA Length | score | probability |
|---|---|---|---|---|---|---|
| AI7503001001_23634651_c1_964 | 3440 | 7212 | 1044 | 347 | 549 | 5.0e-53 |

Description pir:[LN:H70000] [AC:H70000 ] [PN:two-component sensor histidine kinase homolog ytsB] [GN:ytsB ] [OR:Bacillus subtilis] [DB:pir2] >gp:[GI:e1185912:g2635523] [LN:BSUB0016] [AC:Z99119:AL009126] [GN:ytsB] [FN:unknown] [OR:Bacillus subtilis] [DB:genpept-bct1] [DE:Bacillus subtilis complete genome (section 16 of 21): from 2997771to 3213410.] [NT:similar to two-component sensor histidine kinase] [LE:113501] [RE:114505] [DI:complement] >gp:[GI:g2293176] [LN:AF008220] [AC:AF008220] [PN:signal transduction protein kinase] [GN:ytsB] [OR:Bacillus subtilis] [DB:genpept-bct2] [DE:Bacillus subtilis rrnB-dnaB genomic region.] [LE:65922] [RE:66926] [DI:direct]

| ORF Name | NTID | AAID | NT Length | AA Length | score | probability |
|---|---|---|---|---|---|---|
| AI7503001001_23672137_c2_1196 | 3441 | 7213 | 957 | 318 | 260 | 6.6e-32 |

Description pir:[LN:S76964] [AC:S76964 ] [PN:hypothetical protein] [OR:Synechocystis sp.] [SR:PCC 6803, , PCC 6803] [SR:PCC 6803, ] [DB:pir2] >gp:[GI:d1019609:g1653966] [LN:D90917] [AC:D90917:AB001339] [PN:47 kD protein] [OR:Synechocystis sp.] [SR:Synechocystis sp. (strain:PCC6803) DNA] [DB:genpept-bct1] [DE:Synechocystis sp. PCC6803 complete genome, 27/27, 3418852-3573470.] [NT:ORF_ID:slr0609] [LE:151573] [RE:152724] [DI:direct]

| ORF Name | NTID | AAID | NT Length | AA Length | score | probability |
|---|---|---|---|---|---|---|
| AI7503001001_23672562_c1_924 | 3442 | 7214 | 297 | 98 | 86 | 0.0034 |

Description
gp:[GI:e8900:g1335718] [LN:PFRESAR1] [AC:X05182] [PN:ring-infected eryrthrocyte surface antigen] [GN:RESA] [OR:Plasmodium falciparum] [SR:malaria parasite P. falciparum] [DB:genpept-invl] [DE:P.falciparum FC27 Ag46 RESA mRNA for ring-infected eryrthrocytesurface antigen.] [SP:P13830] [LE:<1] [RE:>955] [DI:direct]

| ORF Name | NTID | AAID | NT Length | AA Length | score | probability |
|---|---|---|---|---|---|---|
| AI7503001001_23703750_c1_1095 | 3443 | 7215 | 639 | 212 | | |

Description
NO-HIT

| ORF Name | NTID | AAID | NT Length | AA Length | score | probability |
|---|---|---|---|---|---|---|
| AI7503001001_23728412_c3_1509 | 3444 | 7216 | 699 | 232 | 726 | 8.7e-72 |

Description
pir:[LN:C70020] [AC:C70020.] [PN:conserved hypothetical protein yusB] [GN:yusB ]
[CL:probable transport protein yaeE] [OR:Bacillus subtilis] [DB:pir2]
>gp:[GI:e1184352:g2635770] [LN:BSUB0017] [AC:Z99120:AL009126] [GN:yusB] [FN:unknown]
[OR:Bacillus subtilis] [DB:genpept-bct1] [DE:Bacillus subtilis complete genome (section
17 of 21): from 3197001to 3414420.] [NT:similar to hypothetical proteins] [LE:164664]
[RE:165332] [DI:complement]

| ORF Name | NTID | AAID | NT Length | AA Length | score | probability |
|---|---|---|---|---|---|---|
| AI7503001001_23844575_c2_1274 | 3445 | 7217 | 1062 | 353 | 1442 | 1.2e-147 |

Description
gp:[GI:e1393153:g4490612] [LN:SAU133520] [AC:AJ133520] [PN:gap regulator] [GN:gapR]
[OR:Staphylococcus aureus] [DB:genpept-bct1] [DE:Staphylococcus aureus gap operon
(gapR, gap, pgk and tpi genes).] [LE:779] [RE:1792] [DI:direct]

| ORF Name | NTID | AAID | NT Length | AA Length | score | probability |
|---|---|---|---|---|---|---|
| AI7503001001_23984775_f1_83 | 3446 | 7218 | 153 | 50 | | |

Description
NO-HIT

| ORF Name | NTID | AAID | NT Length | AA Length | score | probability |
|---|---|---|---|---|---|---|
| AI7503001001_23989061_f2_399 | 3447 | 7219 | 138 | 45 | | |

Description
NO-HIT

| ORF Name | NTID | AAID | NT Length | AA Length | score | probability |
|---|---|---|---|---|---|---|
| AI7503001001_2401430_c3_1473 | 3448 | 7220 | 762 | 253 | 1076 | 7.1e-109 |

Description
gp:[GI:e1387399:g4379428] [LN:SAAJ3781] [AC:AJ223781] [PN:thioredoxin reductase]
[GN:trxB] [OR:Staphylococcus aureus] [DB:genpept-bct1] [EC:1.6.4.5] [DE:Staphylococcus
aureus trxB gene.] [LE:1262] [RE:2197] [DI:direct]

| ORF Name | NTID | AAID | NT Length | AA Length | score | probability |
|---|---|---|---|---|---|---|
| AI7503001001_24022582_f2_316 | 3449 | 7221 | 150 | 49 | | |

Description
NO-HIT

| ORF Name | NTID | AAID | NT Length | AA Length | score | probability |
|---|---|---|---|---|---|---|
| AI7503001001_24033567_c2_1316 | 3450 | 7222 | 450 | 149 | 207 | 8.6e-17 |

Description
pir:[LN:G70023] [AC:G70023 ] [PN:hypothetical protein yutE] [GN:yutE ] [OR:Bacillus subtilis] [DB:pir2] >gp:[GI:e1184309:g2635727] [LN:BSUB0017] [AC:Z99120:AL009126] [GN:yutE] [FN:unknown] [OR:Bacillus subtilis] [DB:genpept-bct1] [DE:Bacillus subtilis complete genome (section 17 of 21): from 3197001to 3414420.] [LE:120886] [RE:121320] [DI:complement]

| ORF Name | NTID | AAID | NT Length | AA Length | score | probability |
|---|---|---|---|---|---|---|
| AI7503001001_24218785_c2_1275 | 3451 | 7223 | 1047 | 348 | 1597 | 4.4e-164 |

Description
gp:[GI:e1393154:g4490613] [LN:SAU133520] [AC:AJ133520] [PN:glyceraldehyde-3-phosphate dehydrogenase] [GN:gap] [FN:transferrin binding protein] [OR:Staphylococcus aureus] [DB:genpept-bct1] [DE:Staphylococcus aureus gap operon (gapR, gap, pgk and tpi genes).] [NT:putative] [LE:1845] [RE:2855] [DI:direct]

| ORF Name | NTID | AAID | NT Length | AA Length | score | probability |
|---|---|---|---|---|---|---|
| AI7503001001_24230001_f2_362 | 3452 | 7224 | 258 | 85 | | |

Description
NO-HIT

| ORF Name | NTID | AAID | NT Length | AA Length | score | probability |
|---|---|---|---|---|---|---|
| AI7503001001_24240888_f1_281 | 3453 | 7225 | 129 | 42 | | |

Description
NO-HIT

| ORF Name | NTID | AAID | NT Length | AA Length | score | probability |
|---|---|---|---|---|---|---|
| AI7503001001_24242285_c3_1516 | 3454 | 7226 | 1056 | 351 | 439 | 2.2e-41 |

Description
gp:[GI:g4981378] [LN:AE001751] [AC:AE001751:AE000512] [PN:hemolysin-related protein] [GN:TM0845] [OR:Thermotoga maritima] [DB:genpept-bct2] [DE:Thermotoga maritima section 63 of 136 of the complete genome.] [NT:similar to GB:AE000783 percent identity: 61.61;] [LE:5310] [RE:6677] [DI:direct]

| ORF Name | NTID | AAID | NT Length | AA Length | score | probability |
|---|---|---|---|---|---|---|
| AI7503001001_24251500_f2_416 | 3455 | 7227 | 135 | 44 | | |

Description
NO-HIT

| ORF Name | NTID | AAID | NT Length | AA Length | score | probability |
|---|---|---|---|---|---|---|
| AI7503001001_24253153_f1_150 | 3456 | 7228 | 129 | 42 | | |

Description
NO-HIT

| ORF_Name | NTID | AAID | NT Length | AA Length | score | probability |
|---|---|---|---|---|---|---|
| AI7503001001_24256287_c2_1260 | 3457 | 7229 | 141 | 46 | | |

Description
NO-HIT

| ORF_Name | NTID | AAID | NT Length | AA Length | score | probability |
|---|---|---|---|---|---|---|
| AI7503001001_24258388_c3_1405 | 3458 | 7230 | 507 | 168 | 102 | 0.0053 |

Description
gp:[GI:e1407794:g4493938] [LN:PFMAL3P5] [AC:AL034556] [GN:MAL3P5.10] [OR:Plasmodium falciparum] [SR:malaria parasite P. falciparum] [DB:genpept-inv1] [DE:Plasmodium falciparum MAL3P5, complete sequence.] [NT:predicted using hexExon; MAL3P5.10 (PFC0620w),] [LE:46925] [RE:48919] [DI:direct]

| ORF_Name | NTID | AAID | NT Length | AA Length | score | probability |
|---|---|---|---|---|---|---|
| AI7503001001_24259762_f3_679 | 3459 | 7231 | 132 | 43 | | |

Description
NO-HIT

| ORF_Name | NTID | AAID | NT Length | AA Length | score | probability |
|---|---|---|---|---|---|---|
| AI7503001001_24266888_c3_1413 | 3460 | 7232 | 123 | 40 | | |

Description
NO-HIT

| ORF_Name | NTID | AAID | NT Length | AA Length | score | probability |
|---|---|---|---|---|---|---|
| AI7503001001_24272125_c2_1292 | 3461 | 7233 | 261 | 86 | 72 | 0.024 |

Description
gp:[GI:g942589] [LN:MIU29676] [AC:U29676:X55271] [PN:unknown] [OR:Mycoplasma iowae] [DB:genpept-bct2] [DE:Mycoplasma iowae 16S rRNA gene, complete sequence, and 23S rRNAgene, partial sequence.] [LE:<1] [RE:438] [DI:direct]

| ORF_Name | NTID | AAID | NT Length | AA Length | score | probability |
|---|---|---|---|---|---|---|
| AI7503001001_24297000_f2_548 | 3462 | 7234 | 225 | 74 | | |

Description
NO-HIT

| ORF_Name | NTID | AAID | NT Length | AA Length | score | probability |
|---|---|---|---|---|---|---|
| AI7503001001_24329053_c1_979 | 3463 | 7235 | 444 | 147 | 142 | 2.8e-09 |

Description
gp:[GI:g3329623] [LN:CELF36H12] [AC:AF078790] [GN:F36H12.3] [OR:Caenorhabditis elegans] [DB:genpept-inv2] [DE:Caenorhabditis elegans cosmid F36H12.] [NT:coded for by C. elegans cDNA CEMSF30F] [LE:21606:21872:22500:22677] [RE:21701:22454:22629:22875] [DI:directJoin]

| ORF_Name | NTID | AAID | NT Length | AA Length | score | probability |
|---|---|---|---|---|---|---|
| AI7503001001_24335801_c2_1326 | 3464 | 7236 | 138 | 45 | | |

Description
NO-HIT

| ORF Name | NTID | AAID | NT Length | AA Length | score | probability |
|---|---|---|---|---|---|---|
| AI7503001001_24345257_f3_652 | 3465 | 7237 | 168 | 55 | | |

Description
NO-HIT

| ORF Name | NTID | AAID | NT Length | AA Length | score | probability |
|---|---|---|---|---|---|---|
| AI7503001001_24347175_c3_1416 | 3466 | 7238 | 165 | 54 | | |

Description
NO-HIT

| ORF Name | NTID | AAID | NT Length | AA Length | score | probability |
|---|---|---|---|---|---|---|
| AI7503001001_24391937_c1_1068 | 3467 | 7239 | 759 | 252 | 105 | 0.0062 |

Description
pir:[LN:E70031] [AC:E70031 ] [PN:hypothetical protein yvcD] [GN:yvcD ]
[CL:tetratricopeptide repeat homology] [OR:Bacillus subtilis] [DB:pir2]
>gp:[GI:e1186169:g2635994] [LN:BSUB0018] [AC:Z99121:AL009126] [GN:yvcD] [FN:unknown]
[OR:Bacillus subtilis] [DB:genpept-bct1] [DE:Bacillus subtilis complete genome (section
18 of 21): from 3399551to 3609060.] [LE:175675] [RE:177129] [DI:complement]
>gp:[GI:e313021:g1945645] [LN:BSZ94043] [AC:Z94043] [PN:hypothetical protein] [GN:yvcD]
[OR:Bacillus subtilis] [DB:genpept-bct1] [DE:B.subtilis genomic DNA fragment (88 kb).]
[LE:4542] [RE:5996] [DI:direct]

| ORF Name | NTID | AAID | NT Length | AA Length | score | probability |
|---|---|---|---|---|---|---|
| AI7503001001_24397952_c1_1067 | 3468 | 7240 | 681 | 226 | 119 | 0.00011 |

Description
pir:[LN:E70031] [AC:E70031 ] [PN:hypothetical protein yvcD] [GN:yvcD ]
[CL:tetratricopeptide repeat homology] [OR:Bacillus subtilis] [DB:pir2]
>gp:[GI:e1186169:g2635994] [LN:BSUB0018] [AC:Z99121:AL009126] [GN:yvcD] [FN:unknown]
[OR:Bacillus subtilis] [DB:genpept-bct1] [DE:Bacillus subtilis complete genome (section
18 of 21): from 3399551to 3609060.] [LE:175675] [RE:177129] [DI:complement]
>gp:[GI:e313021:g1945645] [LN:BSZ94043] [AC:Z94043] [PN:hypothetical protein] [GN:yvcD]
[OR:Bacillus subtilis] [DB:genpept-bct1] [DE:B.subtilis genomic DNA fragment (88 kb).]
[LE:4542] [RE:5996] [DI:direct]

| ORF Name | NTID | AAID | NT Length | AA Length | score | probability |
|---|---|---|---|---|---|---|
| AI7503001001_24406577_c3_1415 | 3469 | 7241 | 390 | 129 | | |

Description
NO-HIT

| ORF Name | NTID | AAID | NT Length | AA Length | score | probability |
|---|---|---|---|---|---|---|
| AI7503001001_24407637_f1_57 | 3470 | 7242 | 243 | 80 | | |

Description
NO-HIT

| ORF Name | NTID | AAID | NT Length | AA Length | score | probability |
|---|---|---|---|---|---|---|
| AI7503001001_24415930_f2_310 | 3471 | 7243 | 1068 | 355 | 977 | 2.2e-98 |

Description
pir:[LN:D70024] [AC:D70024 ] [PN:NADH dehydrogenase homolog yutJ] [GN:yutJ ]
[OR:Bacillus subtilis] [DB:pir2] >gp:[GI:e1184299:g2635717] [LN:BSUB0017]
[AC:Z99120:AL009126] [GN:yutJ] [FN:unknown] [OR:Bacillus subtilis] [DB:genpept-bct1]
[DE:Bacillus subtilis complete genome (section 17 of 21): from 3197001to 3414420.]
[NT:similar to NADH dehydrogenase] [LE:110924] [RE:111916] [DI:direct]

| ORF Name | NTID | AAID | NT Length | AA Length | score | probability |
|---|---|---|---|---|---|---|
| AI7503001001_24429650_c3_1408 | 3472 | 7244 | 1197 | 398 | 848 | 1.0e-84 |

Description
sp:[LN:NAGA_BACSU] [AC:O34450] [GN:NAGA] [OR:BACILLUS SUBTILIS] [EC:3.5.1.25]
[DE:DEACETYLASE)] [SP:O34450] [DB:swissprot] >pir:[LN:A69664] [AC:A69664 ]
[PN:N-acetylglucosamine-6-phosphate deacetylase nagA] [GN:nagA ] [OR:Bacillus subtilis]
[DB:pir2] >gp:[GI:e1186189:g2636014] [LN:BSUB0018] [AC:Z99121:AL009126]
[PN:N-acetylglucosamine-6-phosphate deacetylase] [GN:nagA] [FN:N-acetyl glucosamine
utilization] [OR:Bacillus subtilis] [DB:genpept-bct1] [EC:3.5.1.25] [DE:Bacillus
subtilis complete genome (section 18 of 21): from 3399551to 3609060.] [SP:O34450]
[LE:194866] [RE:196056] [DI:direct] >gp:[GI:g2618856] [LN:AF017113] [AC:AF017113]
[PN:N-acetylglucosamine 6-P deacetylase] [GN:nagA] [OR:Bacillus subtilis]
[DB:genpept-bct2] [DE:Bacillus subtilis 300-304 degree genomic sequence.] [LE:31777]
[RE:32967] [DI:complement]

| ORF Name | NTID | AAID | NT Length | AA Length | score | probability |
|---|---|---|---|---|---|---|
| AI7503001001_24479842_c1_1106 | 3473 | 7245 | 558 | 185 | 256 | 5.5e-22 |

Description
pir:[LN:D69800] [AC:D69800 ] [PN:conserved hypothetical protein yfhC] [GN:yfhC ]
[OR:Bacillus subtilis] [DB:pir2] >gp:[GI:e1182838:g2633172] [LN:BSUB0005]
[AC:Z99108:AL009126] [GN:yfhC] [FN:unknown] [OR:Bacillus subtilis] [DB:genpept-bct1]
[DE:Bacillus subtilis complete genome (section 5 of 21): from 802821 to1011250.]
[NT:similar to hypothetical proteins] [LE:120274] [RE:120858] [DI:direct]
>gp:[GI:d1025385:g2804533] [LN:D85082] [AC:D85082] [PN:YfhC] [OR:Bacillus subtilis]
[SR:Bacillus subtilis DNA] [DB:genpept-bct1] [DE:Bacillus subtilis DNA, genome
sequence, 79 to 81 degree region.] [LE:13165] [RE:13749] [DI:direct]

| ORF Name | NTID | AAID | NT Length | AA Length | score | probability |
|---|---|---|---|---|---|---|
| AI7503001001_24490676_c2_1179 | 3474 | 7246 | 141 | 46 | | |

Description
NO-HIT

| ORF Name | NTID | AAID | NT Length | AA Length | score | probability |
|---|---|---|---|---|---|---|
| AI7503001001_24506712_c2_1240 | 3475 | 7247 | 975 | 324 | 879 | 5.3e-88 |

Description
gp:[GI:e1330453:g3724156] [LN:SAA005352] [AC:AJ005352] [PN:membrane protein] [GN:sstB]
[FN:iron transport] [OR:Staphylococcus aureus] [DB:genpept-bct1] [DE:Staphylococcus
aureus, Sst putative iron transport operon.] [LE:1451] [RE:2132] [DI:direct]

| ORF_Name | NTID | AAID | NT Length | AA Length | score | probability |
|---|---|---|---|---|---|---|
| AI7503001001_24507932_c1_1027 | 3476 | 7248 | 600 | 199 | 322 | 5.6e-29 |

Description
pir:[LN:D69924] [AC:D69924 ] [PN:hypothetical protein yorS] [GN:yorS ] [OR:Bacillus subtilis] [DB:pir2] >gp:[GI:e1185499:g2634420] [LN:BSUB0011] [AC:Z99114:AL009126] [GN:yorS] [FN:unknown] [OR:Bacillus subtilis] [DB:genpept-bct1] [DE:Bacillus subtilis complete genome (section 11 of 21): from 2000171to 2207900.] [LE:172005] [RE:172523] [DI:complement] >gp:[GI:g3025618] [LN:AF020713] [AC:AF020713] [PN:unknown] [GN:yorS] [OR:Bacteriophage SPBc2] [DB:genpept-phg] [DE:Bacteriophage SPBc2 complete genome.] [LE:112997] [RE:113515] [DI:direct]

| ORF_Name | NTID | AAID | NT Length | AA Length | score | probability |
|---|---|---|---|---|---|---|
| AI7503001001_24611512_c2_1139 | 3477 | 7249 | 129 | 42 | | |

Description
NO-HIT

| ORF_Name | NTID | AAID | NT Length | AA Length | score | probability |
|---|---|---|---|---|---|---|
| AI7503001001_24616050_f2_445 | 3478 | 7250 | 150 | 49 | | |

Description
NO-HIT

| ORF_Name | NTID | AAID | NT Length | AA Length | score | probability |
|---|---|---|---|---|---|---|
| AI7503001001_24640828_c2_1138 | 3479 | 7251 | 516 | 171 | | |

Description
NO-HIT

| ORF_Name | NTID | AAID | NT Length | AA Length | score | probability |
|---|---|---|---|---|---|---|
| AI7503001001_24642632_f3_765 | 3480 | 7252 | 1245 | 414 | 1245 | 8.7e-127 |

Description
sp:[LN:PEPT_BACSU] [AC:P55179] [GN:PEPT] [OR:BACILLUS SUBTILIS] [EC:3.4.11.-] [DE:PEPTIDASE T, (AMINOTRIPEPTIDASE) (TRIPEPTIDASE)] [SP:P55179] [DB:swissprot] >pir:[LN:H69674] [AC:H69674] [PN:aminotripeptidase,:peptidase T] [GN:pepT ] [OR:Bacillus subtilis] [EC:3.4.11.-] [DB:pir2] >gp:[GI:e254163:g1429259] [LN:BSGALE] [AC:X99339] [GN:pepT] [FN:unknown] [OR:Bacillus subtilis] [DB:genpept-bct1] [DE:B.subtilis orfs 1,2,3,4, pepT and galE genes.] [SP:P55179] [LE:5267] [RE:6499] [DI:direct] >gp:[GI:e1186391:g2636427] [LN:BSUB0020] [AC:Z99123:AL009126] [PN:peptidase T (tripeptidase)] [GN:pepT] [OR:Bacillus subtilis] [DB:genpept-bct1] [EC:3.4.11.-] [DE:Bacillus subtilis complete genome (section 20 of 21): from 3798401to 4010550.] [SP:P55179] [LE:195467] [RE:196699] [DI:direct] >gp:[GI:d1012379:g1783235] [LN:D83026] [AC:D83026:D45911] [GN:pepT] [OR:Bacillus subtilis] [SR:Bacillus subtilis (strain:BGSC 1A1) DNA] [DB:genpept-bct1] [DE:Bacillus subtilis genome sequence covering lic-cel region.] [NT:highly homologous to tripeptidases (peptidase T)] [LE:27766] [RE:28998] [DI:complement]

| ORF Name | NTID | AAID | NT Length | AA Length | score | probability |
|---|---|---|---|---|---|---|
| AI7503001001_24650427_f2_349 | 3481 | 7253 | 330 | 109 | 331 | 6.2e-30 |

Description
pir:[LN:C69772] [AC:C69772 ] [PN:thioredoxin homolog ydbP] [GN:ydbP ]
[CL:thioredoxin:thioredoxin homology] [OR:Bacillus subtilis] [DB:pir2]
>gp:[GI:d1020045:g1881265] [LN:AB001488] [AC:AB001488] [GN:ydbP] [OR:Bacillus subtilis]
[SR:Bacillus subtilis (strain:168) DNA] [DB:genpept-bct1] [DE:Bacillus subtilis genome
sequence, 148 kb sequence of the regionbetween 35 and 47 degree.] [NT:PROBABLE
THIOREDOXIN.] [LE:40816] [RE:41136] [DI:complement] >gp:[GI:e1182421:g2632755]
[LN:BSUB0003] [AC:Z99106:AL009126] [GN:ydbP] [FN:unknown] [OR:Bacillus subtilis]
[DB:genpept-bct1] [DE:Bacillus subtilis complete genome (section 3 of 21): from 402751
to611850.] [NT:similar to thioredoxin] [LE:104560] [RE:104880] [DI:complement]

| ORF Name | NTID | AAID | NT Length | AA Length | score | probability |
|---|---|---|---|---|---|---|
| AI7503001001_24650462_c1_944 | 3482 | 7254 | 1515 | 504 | 848 | 1.0e-84 |

Description
pir:[LN:G70008] [AC:G70008 ] [PN:NADH dehydrogenase (ubiquinone) homolog yufD] [GN:yufD
] [OR:Bacillus subtilis] [DB:pir2] >gp:[GI:e1184241:g2635659] [LN:BSUB0017]
[AC:Z99120:AL009126] [GN:yufD] [FN:unknown] [OR:Bacillus subtilis] [DB:genpept-bct1]
[DE:Bacillus subtilis complete genome (section 17 of 21): from 3197001to 3414420.]
[NT:similar to NADH dehydrogenase (ubiquinone)] [LE:51840] [RE:53282] [DI:direct]

| ORF Name | NTID | AAID | NT Length | AA Length | score | probability |
|---|---|---|---|---|---|---|
| AI7503001001_24664840_c2_1203 | 3483 | 7255 | 1968 | 655 | 1694 | 2.3e-174 |

Description
pir:[LN:H69626] [AC:H69626 ] [PN:PTS fructose-specific enzyme IIBC component fruA]
[GN:fruA ] [CL:phosphotransferase system enzyme II,
fructose-specific:phosphotransferase system mannitol-specific enzyme II factor III
homology] [OR:Bacillus subtilis] [DB:pir2] >gp:[GI:e1185030:g2633811] [LN:BSUB0008]
[AC:Z99111:AL009126] [PN:phosphotransferase system (PTS)] [GN:fruA] [OR:Bacillus
subtilis] [DB:genpept-bct1] [DE:Bacillus subtilis complete genome (section 8 of 21):
from 1394791to 1603020.] [LE:113871] [RE:115778] [DI:direct] >gp:[GI:g3282125]
[LN:AF012285] [AC:AF012285:AF012284:U51911] [PN:fructose PTS IIABC] [GN:fruA]
[OR:Bacillus subtilis] [DB:genpept-bct2] [DE:Bacillus subtilis mobA-nprE gene region.]
[NT:similar to fructose-specific PTS system IIBC] [LE:14359] [RE:16266] [DI:direct]

| ORF Name | NTID | AAID | NT Length | AA Length | score | probability |
|---|---|---|---|---|---|---|
| AI7503001001_24796927_f1_61 | 3484 | 7256 | 789 | 262 | 325 | 2.7e-29 |

Description
pir:[LN:E69883] [AC:E69883 ] [PN:phage-related replication protein homolog ymaC]
[GN:ymaC ] [CL:phage-related replication protein] [OR:Bacillus subtilis] [DB:pir2]
>gp:[GI:e1183386:g2634111] [LN:BSUB0010] [AC:Z99113:AL009126] [GN:ymaC] [FN:unknown]
[OR:Bacillus subtilis] [DB:genpept-bct1] [DE:Bacillus subtilis complete genome (section
10 of 21): from 1781201to 2014980.] [NT:similar to phage-related protein] [LE:81490]
[RE:82197] [DI:direct]

| ORF Name | NTID | AAID | NT Length | AA Length | score | probability |
|---|---|---|---|---|---|---|
| AI7503001001_24803125_c1_993 | 3485 | 7257 | 978 | 325 | 982 | 6.5e-99 |

Description
sp:[LN:MDH_BACIS] [AC:Q59202] [GN:MDH] [OR:BACILLUS ISRAELI] [EC:1.1.1.37] [DE:MALATE DEHYDROGENASE,] [SP:Q59202] [DB:swissprot] >pir:[LN:S61213] [AC:S61213 ] [PN:malate dehydrogenase,] [CL:L-lactate dehydrogenase] [OR:Bacillus israeli] [EC:1.1.1.37] [DB:pir2] >gp:[GI:g963019] [LN:BIDNAMD] [AC:X90527] [PN:malate dehydrogenase] [OR:Bacillus israeli] [DB:genpept-bct1] [EC:1.1.1.37] [DE:B.israeli DNA for malate dehydrogenase gene.] [SP:Q59202] [LE:291] [RE:1229] [DI:direct]

| ORF Name | NTID | AAID | NT Length | AA Length | score | probability |
|---|---|---|---|---|---|---|
| AI7503001001_24803332_c2_1305 | 3486 | 7258 | 840 | 279 | 712 | 2.6e-70 |

Description
pir:[LN:B70020] [AC:B70020 ] [PN:conserved hypothetical protein yusA] [GN:yusA ] [CL:lipoprotein-28] [OR:Bacillus subtilis] [DB:pir2] >gp:[GI:e1184351:g2635769] [LN:BSUB0017] [AC:Z99120:AL009126] [GN:yusA] [FN:unknown] [OR:Bacillus subtilis] [DB:genpept-bct1] [DE:Bacillus subtilis complete genome (section 17 of 21): from 3197001to 3414420.] [NT:similar to hypothetical proteins] [LE:163826] [RE:164650] [DI:complement]

| ORF Name | NTID | AAID | NT Length | AA Length | score | probability |
|---|---|---|---|---|---|---|
| AI7503001001_2531500_c3_1360 | 3487 | 7259 | 177 | 58 | | |

Description
NO-HIT

| ORF Name | NTID | AAID | NT Length | AA Length | score | probability |
|---|---|---|---|---|---|---|
| AI7503001001_25401377_c1_1045 | 3488 | 7260 | 852 | 283 | 939 | 2.3e-94 |

Description
gp:[GI:e1330454:g3724157] [LN:SAA005352] [AC:AJ005352] [PN:ATP binding protein] [GN:SstC] [FN:iron transport] [OR:Staphylococcus aureus] [DB:genpept-bct1] [DE:Staphylococcus aureus, Sst putative iron transport operon.] [LE:2186] [RE:2947] [DI:direct]

| ORF Name | NTID | AAID | NT Length | AA Length | score | probability |
|---|---|---|---|---|---|---|
| AI7503001001_25401675_c2_1319 | 3489 | 7261 | 174 | 57 | | |

Description
NO-HIT

| ORF Name | NTID | AAID | NT Length | AA Length | score | probability |
|---|---|---|---|---|---|---|
| AI7503001001_25415802_c1_1102 | 3490 | 7262 | 126 | 41 | | |

Description
NO-HIT

| ORF Name | NTID | AAID | NT Length | AA Length | score | probability |
|---|---|---|---|---|---|---|
| AI7503001001_25473782_c3_1498 | 3491 | 7263 | 186 | 61 | | |

Description
NO-HIT

| ORF Name | NTID | AAID | NT Length | AA Length | score | probability |
|---|---|---|---|---|---|---|
| AI7503001001_25492312_f1_302 | 3492 | 7264 | 126 | 41 | | |

Description
NO-HIT

| ORF Name | NTID | AAID | NT Length | AA Length | score | probability |
|---|---|---|---|---|---|---|
| AI7503001001_25572180_c1_956 | 3493 | 7265 | 1272 | 423 | 895 | 1.1e-89 |

Description
sp:[LN:YXJA_BACSU] [AC:P42312] [GN:YXJA:N15HR] [OR:BACILLUS SUBTILIS] [DE:HYPOTHETICAL 43.7 KD PROTEIN IN KATB 3'REGION] [SP:P42312] [DB:swissprot] >pir:[LN:G70078] [AC:G70078 ] [PN:pyrimidine nucleoside transport homolog yxjA] [GN:yxjA ] [CL:pyrimidine nucleoside transport protein nupC] [OR:Bacillus subtilis] [DB:pir2] >gp:[GI:e1186401:g2636437] [LN:BSUB0020] [AC:Z99123:AL009126] [GN:yxjA] [FN:unknown] [OR:Bacillus subtilis] [DB:genpept-bct1] [DE:Bacillus subtilis complete genome (section 20 of 21): from 3798401to 4010550.] [NT:similar to pyrimidine nucleoside transport] [SP:P42312] [LE:206141] [RE:207334] [DI:direct] >gp:[GI:e1184627:g2636448] [LN:BSUB0021] [AC:Z99124:AL009126] [GN:yxjA] [FN:unknown] [OR:Bacillus subtilis] [DB:genpept-bct1] [DE:Bacillus subtilis complete genome (section 21 of 21): from 3999281to 4214814.] [NT:similar to pyrimidine nucleoside transport] [SP:P42312] [LE:5261] [RE:6454] [DI:direct] >gp:[GI:d1012369:g665999] [LN:D83026] [AC:D83026:D45911] [GN:yxjA] [OR:Bacillus subtilis] [SR:Bacillus subtilis (strain:BGSC 1A1) DNA] [DB:genpept-bct1] [DE:Bacillus subtilis genome sequence covering lic-cel region.] [NT:homologous to pyrimidine nucleoside transport] [LE:17131] [RE:18324] [DI:complement]

| ORF Name | NTID | AAID | NT Length | AA Length | score | probability |
|---|---|---|---|---|---|---|
| AI7503001001_25585891_c2_1218 | 3494 | 7266 | 1980 | 659 | 1949 | 2.2e-201 |

Description
pir:[LN:D69815] [AC:D69815 ] [PN:conserved hypothetical protein yfnI] [GN:yfnI ] [CL:Bacillus subtilis probable anion-binding protein yflE] [OR:Bacillus subtilis] [DB:pir2] >gp:[GI:e1182705:g2633039] [LN:BSUB0004] [AC:Z99107:AL009126] [GN:yfnI] [FN:unknown] [OR:Bacillus subtilis] [DB:genpept-bct1] [DE:Bacillus subtilis complete genome (section 4 of 21): from 600701 to813890.] [NT:alternate gene name: yetP; similar to hypothetical] [LE:195080] [RE:197041] [DI:direct] >gp:[GI:d1020933:g2116767] [LN:D86418] [AC:D86418] [PN:YfnI] [OR:Bacillus subtilis] [SR:Bacillus subtilis (strain:AC327) DNA] [DB:genpept-bct1] [DE:Bacillus subtilis genomic DNA 69-70 degree region, partialsequence.] [LE:16150] [RE:18111] [DI:complement]

| ORF Name | NTID | AAID | NT Length | AA Length | score | probability |
|---|---|---|---|---|---|---|
| AI7503001001_25806300_f1_275 | 3495 | 7267 | 750 | 249 | 1270 | 2.0e-129 |

Description
gp:[GI:e255626:g1617428] [LN:SEABCTS] [AC:X99127] [PN:ATP binding protein] [FN:iron repressible ABC transport system] [OR:Staphylococcus epidermidis] [DB:genpept-bct1] [DE:S.epidermidis gene encoding ABC transport system.] [LE:41] [RE:787] [DI:direct]

| ORF_Name | NTID | AAID | NT Length | AA Length | score | probability |
|---|---|---|---|---|---|---|
| AI7503001001_26171927_c2_1246 | 3496 | 7268 | 342 | 113 | 221 | 2.8e-18 |

Description
sp:[LN:YTXJ_BACSU] [AC:P39914] [GN:YTXJ] [OR:BACILLUS SUBTILIS] [DE:(ORF3)] [SP:P39914] [DB:swissprot] >pir:[LN:S21420] [AC:S21420:F70003:S71003 ] [PN:general stress protein homolog ytxJ] [GN:ytxJ ] [OR:Bacillus subtilis] [DB:pir2] >gp:[GI:g39815] [LN:BSAROAG] [AC:X65945] [GN:orf 2] [OR:Bacillus subtilis] [DB:genpept-bct1] [DE:B.subtilis aroA-aroG gene.] [SP:P39914] [LE:105] [RE:431] [DI:direct] >gp:[GI:e1185849:g2635460] [LN:BSUB0016] [AC:Z99119:AL009126] [GN:ytxJ] [FN:unknown] [OR:Bacillus subtilis] [DB:genpept-bct1] [DE:Bacillus subtilis complete genome (section 16 of 21): from 2997771to 3213410.] [NT:alternate gene name: csb40; similar to general] [SP:P39914] [LE:48061] [RE:48387] [DI:complement] >gp:[GI:g2293219] [LN:AF008220] [AC:AF008220] [PN:YtxJ] [GN:ytxJ] [OR:Bacillus subtilis] [DB:genpept-bct2] [DE:Bacillus subtilis rrnB-dnaB genomic region.] [LE:132039] [RE:132365] [DI:direct]

| ORF_Name | NTID | AAID | NT Length | AA Length | score | probability |
|---|---|---|---|---|---|---|
| AI7503001001_26176693_f2_482 | 3497 | 7269 | 828 | 275 | 685 | 1.9e-67 |

Description
pir:[LN:A69162] [AC:A69162 ] [PN:gufA protein homolog MTH473] [GN:MTH473 ] [CL:gufA protein] [OR:Methanobacterium thermoautotrophicum] [DB:pir2] >gp:[GI:g2621542] [LN:AE000831] [AC:AE000831:AE000666] [PN:conserved protein] [GN:MTH473] [OR:Methanobacterium thermoautotrophicum] [DB:genpept-bct1] [DE:Methanobacterium thermoautotrophicum from bases 404817 to 415582(section 37 of 148) of the complete genome.] [NT:Function Code:14.01 - Unknown, Conserved protein;] [LE:9769] [RE:10548] [DI:direct]

| ORF_Name | NTID | AAID | NT Length | AA Length | score | probability |
|---|---|---|---|---|---|---|
| AI7503001001_2618827_c1_1042 | 3498 | 7270 | 288 | 95 | 75 | 0.023 |

Description
sp:[LN:LUXY_VIBFI] [AC:P21578] [GN:LUXY] [OR:VIBRIO FISCHERI] [DE:YELLOW FLUORESCENT PROTEIN (YFP)] [SP:P21578] [DB:swissprot] >pir:[LN:A36037] [AC:A36037:A39946 ] [PN:yellow fluorescent protein:luxY protein] [GN:luxY ] [CL:riboflavin synthase alpha chain] [OR:Vibrio fischeri] [DB:pir2] >gp:[GI:g155235] [LN:VIBLUXY] [AC:M60852] [PN:yellow fluorescent protein] [GN:luxY] [OR:Vibrio fischeri] [SR:V.fischeri (strain Y-1) DNA] [DB:genpept-bct1] [DE:Vibrio fischeri yellow fluorescent protein (luxY) gene, completecds.] [LE:45] [RE:629] [DI:direct]

| ORF_Name | NTID | AAID | NT Length | AA Length | score | probability |
|---|---|---|---|---|---|---|
| AI7503001001_26190785_c2_1306 | 3499 | 7271 | 1287 | 428 | 1408 | 4.7e-144 |

Description
pir:[LN:F70019] [AC:F70019 ] [PN:NifS protein homolog homolog yurW] [GN:yurW ] [CL:nifS protein] [OR:Bacillus subtilis] [DB:pir2] >gp:[GI:e1184347:g2635765] [LN:BSUB0017] [AC:Z99120:AL009126] [GN:yurW] [FN:unknown] [OR:Bacillus subtilis] [DB:genpept-bct1] [DE:Bacillus subtilis complete genome (section 17 of 21): from 3197001to 3414420.] [NT:similar to NifS protein homolog] [LE:159503] [RE:160723] [DI:complement]

| ORF_Name | NTID | AAID | NT Length | AA Length | score | probability |
|---|---|---|---|---|---|---|
| AI7503001001_26204837_f1_69 | 3500 | 7272 | 159 | 52 | | |

Description
NO-HIT

| ORF Name | NTID | AAID | NT Length | AA Length | score | probability |
|---|---|---|---|---|---|---|
| AI7503001001_26211552_c2_1270 | 3501 | 7273 | 984 | 327 | 1034 | 2.0e-104 |

Description pir:[LN:B70032] [AC:B70032 ] [PN:conserved hypothetical protein yvcL] [GN:yvcL ]
[OR:Bacillus subtilis] [DB:pir2] >gp:[GI:e1186163:g2635988] [LN:BSUB0018]
[AC:Z99121:AL009126] [GN:yvcL] [FN:unknown] [OR:Bacillus subtilis] [DB:genpept-bct1]
[DE:Bacillus subtilis complete genome (section 18 of 21): from 3399551to 3609060.]
[NT:similar to hypothetical proteins] [LE:169083] [RE:170033] [DI:complement]
>gp:[GI:e313028:g1945652] [LN:BSZ94043] [AC:Z94043] [PN:hypothetical protein] [GN:yvcL]
[OR:Bacillus subtilis] [DB:genpept-bct1] [DE:B.subtilis genomic DNA fragment (88 kb).]
[NT:similar to Y103_MYCGE hypothetical protein mg103] [LE:11638] [RE:12588] [DI:direct]

| ORF Name | NTID | AAID | NT Length | AA Length | score | probability |
|---|---|---|---|---|---|---|
| AI7503001001_26259638_f1_134 | 3502 | 7274 | 765 | 254 | 176 | 2.2e-11 |

Description pir:[LN:B70798] [AC:B70798 ] [PN:probable membrane protein] [GN:Rv3737 ]
[OR:Mycobacterium tuberculosis] [DB:pir2] >gp:[GI:e1264597:g2960161] [LN:MTV025]
[AC:AL022121:AL123456] [PN:hypothetical protein Rv3737] [GN:Rv3737] [OR:Mycobacterium
tuberculosis] [DB:genpept-bct1] [DE:Mycobacterium tuberculosis H37Rv complete genome;
segment 155/162.] [NT:Rv3737, (MTV025.085), len: 529. Probable membrane] [LE:94796]
[RE:96385] [DI:direct] >gp:[GI:e1264597:g2960161] [LN:MTV025] [AC:AL022121:AL123456]
[PN:hypothetical protein Rv3737] [GN:Rv3737] [OR:Mycobacterium tuberculosis]
[DB:genpept] [DE:Mycobacterium tuberculosis H37Rv complete genome; segment 155/162.]
[NT:Rv3737, (MTV025.085), len: 529. Probable membrane] [LE:94796] [RE:96385]
[DI:direct]

| ORF Name | NTID | AAID | NT Length | AA Length | score | probability |
|---|---|---|---|---|---|---|
| AI7503001001_26359805_f1_11 | 3503 | 7275 | 168 | 55 | | |

Description

NO-HIT

| ORF Name | NTID | AAID | NT Length | AA Length | score | probability |
|---|---|---|---|---|---|---|
| AI7503001001_26360663_c3_1530 | 3504 | 7276 | 1308 | 435 | 1039 | 5.9e-105 |

Description pir:[LN:A70015] [AC:A70015 ] [PN:NADH dehydrogenase homolog yumB] [GN:yumB ] [CL:NADH
dehydrogenase] [OR:Bacillus subtilis] [DB:pir2] >gp:[GI:e1184289:g2635707]
[LN:BSUB0017] [AC:Z99120:AL009126] [GN:yumB] [FN:unknown] [OR:Bacillus subtilis]
[DB:genpept-bct1] [DE:Bacillus subtilis complete genome (section 17 of 21): from
3197001to 3414420.] [NT:similar to NADH dehydrogenase] [LE:102091] [RE:103311]
[DI:complement] >gp:[GI:e311467:g1934829] [LN:BSZ93939] [AC:Z93939] [PN:NADH
dehydrogenase] [GN:yumB] [OR:Bacillus subtilis] [DB:genpept-bct1] [DE:B.subtilis
genomic DNA fragment from yumA to yulF.] [NT:putative; unknown] [LE:528] [RE:1748]
[DI:complement]

| ORF Name | NTID | AAID | NT Length | AA Length | score | probability |
|---|---|---|---|---|---|---|
| AI7503001001_26367175_c3_1476 | 3505 | 7277 | 123 | 40 | | |

Description

NO-HIT

| ORF Name | NTID | AAID | NT Length | AA Length | score | probability |
|---|---|---|---|---|---|---|
| AI7503001001_26376077_c1_1113 | 3506 | 7278 | 192 | 63 | 101 | 1.5e-05 |

Description
pir:[LN:C70063] [AC:C70063 ] [PN:hypothetical protein ywmG] [GN:ywmG ] [OR:Bacillus subtilis] [DB:pir2] >gp:[GI:e276829:g1648859] [LN:BSATPC] [AC:Z81356] [PN:unknown] [GN:ywmH] [OR:Bacillus subtilis] [DB:genpept-bct1] [DE:B.subtilis atpC gene.] [LE:10910] [RE:11098] [DI:direct] >gp:[GI:e1184573:g2636192] [LN:BSUB0019] [AC:Z99122:AL009126] [GN:ywmG] [FN:unknown] [OR:Bacillus subtilis] [DB:genpept-bct1] [DE:Bacillus subtilis complete genome (section 19 of 21): from 3597091to 3809700.] [LE:172069] [RE:172257] [DI:complement] >gp:[GI:e1184573:g2636192] [LN:BSUB0019] [AC:Z99122:AL009126] [GN:ywmG] [FN:unknown] [OR:Bacillus subtilis] [DB:genpept] [DE:Bacillus subtilis complete genome (section 19 of 21): from 3597091to 3809700.] [LE:172069] [RE:172257] [DI:complement]

| ORF Name | NTID | AAID | NT Length | AA Length | score | probability |
|---|---|---|---|---|---|---|
| AI7503001001_26464707_c3_1493 | 3507 | 7279 | 141 | 46 | 43 | 0.039 |

Description
pir:[LN:S58357] [AC:S66652:S58357 ] [PN:pepI protein] [GN:pepI ] [OR:Staphylococcus epidermidis] [DB:pir2] >gp:[GI:g945016] [LN:SEPEPGNS] [AC:Z49865] [PN:PepI] [GN:pepI] [OR:Staphylococcus epidermidis] [DB:genpept-bct1] [DE:S.epidermidis pepA, pepB, pepC, pepI, pepP and pepT genes.] [LE:2028] [RE:2237] [DI:direct] >gp:[GI:g398082] [LN:STAPEPA] [AC:L23967] [PN:immunity protein] [GN:pepI] [OR:Staphylococcus epidermidis] [SR:Staphylococcus epidermidis DNA] [DB:genpept-bct1] [DE:Staphylococcus epidermidis lantibiotic (pepA) and immunity protein(pepI) gene, complete cds.] [LE:377] [RE:586] [DI:direct]

| ORF Name | NTID | AAID | NT Length | AA Length | score | probability |
|---|---|---|---|---|---|---|
| AI7503001001_26578577_c1_1065 | 3508 | 7280 | 1791 | 596 | 2276 | 1.8e-238 |

Description
sp:[LN:UVRA_BACSU] [AC:O34863] [GN:UVRA] [OR:BACILLUS SUBTILIS] [DE:EXCINUCLEASE ABC SUBUNIT A] [SP:O34863] [DB:swissprot] >pir:[LN:F69729] [AC:F69729 ] [PN:excinuclease ABC chain A:excision endonuclease ABC,, chain A:uvrA protein] [GN:uvrA ] [CL:excinuclease ABC chain A:ATP-binding cassette homology] [OR:Bacillus subtilis] [EC:3.1.-.-] [DB:pir2] >gp:[GI:e1184422:g2636042] [LN:BSUB0019] [AC:Z99122:AL009126] [PN:excinuclease ABC (subunit A)] [GN:uvrA] [FN:excision of ultraviolet light-induced] [OR:Bacillus subtilis] [DB:genpept-bct1] [DE:Bacillus subtilis complete genome (section 19 of 21): from 3597091to 3809700.] [SP:O34863] [LE:12034] [RE:14907] [DI:complement] >gp:[GI:g2618842] [LN:AF017113] [AC:AF017113] [PN:excinuclease ABC subunit A] [GN:uvrA] [OR:Bacillus subtilis] [DB:genpept-bct2] [DE:Bacillus subtilis 300-304 degree genomic sequence.] [LE:15386] [RE:18259] [DI:direct] >gp:[GI:e1184422:g2636042] [LN:BSUB0019] [AC:Z99122:AL009126] [PN:excinuclease ABC (subunit A)] [GN:uvrA] [FN:excision of ultraviolet light-induced] [OR:Bacillus subtilis] [DB:genpept] [DE:Bacillus subtilis complete genome (section 19 of 21): from 3597091to 3809700.] [SP:O34863] [LE:12034] [RE:14907] [DI:complement]

| ORF Name | NTID | AAID | NT Length | AA Length | score | probability |
|---|---|---|---|---|---|---|
| AI7503001001_26594050_c3_1524 | 3509 | 7281 | 243 | 80 | 378 | 6.5e-35 |

Description
gp:[GI:d1013748:g1405337] [LN:D86240] [AC:D86240] [PN:D-alanyl carrier protein]
[GN:dltC] [OR:Staphylococcus aureus] [SR:Staphylococcus aureus (isolate:KAN96) DNA]
[DB:genpept-bct1] [DE:Staphylococcus aureus gene for unkown function and dlt operon
dltA,dltB, dltC and dltD genes,complete cds.] [NT:Sequence homologous to the dltC genes
of] [LE:5303] [RE:5539] [DI:direct] >gp:[GI:g4530243] [LN:AF101234] [AC:AF101234]
[PN:D-alanine carrier protein DltC] [GN:dltC] [OR:Staphylococcus aureus]
[DB:genpept-bct2] [DE:Staphylococcus aureus dltABCD operon, complete sequence;
andunknown gene.] [LE:4276] [RE:4512] [DI:direct]

| ORF Name | NTID | AAID | NT Length | AA Length | score | probability |
|---|---|---|---|---|---|---|
| AI7503001001_26735877_c3_1508 | 3510 | 7282 | 402 | 133 | 446 | 4.1e-42 |

Description
pir:[LN:A70021] [AC:A70021 ] [PN:glycine cleavage system protein H homolog yusH]
[GN:yusH] [CL:glycine cleavage system protein H: lipoyl/biotin-binding homology]
[OR:Bacillus subtilis] [DB:pir2] >gp:[GI:e1184358:g2635776] [LN:BSUB0017]
[AC:Z99120:AL009126] [GN:yusH] [FN:unknown] [OR:Bacillus subtilis] [DB:genpept-bct1]
[DE:Bacillus subtilis complete genome (section 17 of 21): from 3197001to 3414420.]
[NT:similar to glycine cleavage system protein H] [LE:168182] [RE:168565]
[DI:complement]

| ORF Name | NTID | AAID | NT Length | AA Length | score | probability |
|---|---|---|---|---|---|---|
| AI7503001001_26753150_f1_147 | 3511 | 7283 | 336 | 111 | 295 | 4.1e-26 |

Description
sp:[LN:YKI4_YEAST] [AC:P36078] [GN:YKL084W] [OR:SACCHAROMYCES CEREVISIAE] [SR:,BAKER'S
YEAST] [DE:HYPOTHETICAL 13.6 KD PROTEIN IN MDH1-VMA5 INTERGENIC REGION] [SP:P36078]
[DB:swissprot] >pir:[LN:S37909] [AC:S37909 ] [PN:hypothetical protein YKL084w]
[OR:Saccharomyces cerevisiae] [DB:pir2] [MP:11L ] >gp:[GI:g486123] [LN:SCYKL084W]
[AC:Z28084:Y13137] [OR:Saccharomyces cerevisiae] [SR:baker's yeast] [DB:genpept-pln1]
[DE:S.cerevisiae chromosome XI reading frame ORF YKL084w.] [NT:ORF YKL084w] [SP:P36078]
[LE:382] [RE:732] [DI:direct]

| ORF Name | NTID | AAID | NT Length | AA Length | score | probability |
|---|---|---|---|---|---|---|
| AI7503001001_26757807_f2_578 | 3512 | 7284 | 951 | 316 | 1619 | 2.0e-166 |

Description
gp:[GI:e255529:g1617430] [LN:SEABCTS] [AC:X99127] [PN:lipoprotein] [FN:iron repressible
ABC transport system] [OR:Staphylococcus epidermidis] [DB:genpept-bct1]
[DE:S.epidermidis gene encoding ABC transport system.] [LE:1621] [RE:2550] [DI:direct]

| ORF Name | NTID | AAID | NT Length | AA Length | score | probability |
|---|---|---|---|---|---|---|
| AI7503001001_26834387_f1_234 | 3513 | 7285 | 711 | 236 | 115 | 1.2e-06 |

Description
gp:[GI:g3043880] [LN:LLU95841] [AC:U95841] [PN:transmembrane protein Tmp6]
[OR:Lactococcus lactis] [DB:genpept-bct2] [DE:Lactococcus lactis transmembrane protein
Tmp6 gene, partial cds.] [NT:identified as a fusion to a signal peptide-less] [LE:<1]
[RE:354] [DI:complement]

| ORF Name | NTID | AAID | NT Length | AA Length | score | probability |
|---|---|---|---|---|---|---|
| AI7503001001_26839462_c3_1474 | 3514 | 7286 | 1011 | 336 | 817 | 2.0e-81 |

Description
sp:[LN:YVCK_BACSU] [AC:O06974] [GN:YVCK] [OR:BACILLUS SUBTILIS] [DE:HYPOTHETICAL 34.7 KD PROTEIN IN CRH-TRXB INTERGENIC REGION] [SP:O06974] [DB:swissprot] >gp:[GI:e313027:g1945651] [LN:BSZ94043] [AC:Z94043] [PN:hypothetical protein] [GN:yvcK] [OR:Bacillus subtilis] [DB:genpept-bct1] [DE:B.subtilis genomic DNA fragment (88 kb).] [NT:similar to hypothetical SYCSLRA] [SP:O06974] [LE:10662] [RE:11615] [DI:direct]

| ORF Name | NTID | AAID | NT Length | AA Length | score | probability |
|---|---|---|---|---|---|---|
| AI7503001001_2752262_c3_1426 | 3515 | 7287 | 1014 | 337 | 652 | 6.0e-64 |

Description
pir:[LN:G69669] [AC:G69669 ] [PN:choline ABC transporter (ATP-binding protein) opuBA] [GN:opuBA ] [CL:glycine betaine/proline transport protein proV: ATP-binding cassette homology:CBS homology] [OR:Bacillus subtilis] [DB:pir2] >gp:[GI:e1186061:g2635886] [LN:BSUB0018] [AC:Z99121:AL009126] [PN:choline ABC transporter (ATP-binding protein)] [GN:opuBA] [FN:high affinity transport of choline] [OR:Bacillus subtilis] [DB:genpept-bct1] [DE:Bacillus subtilis complete genome (section 18 of 21): from 3399551to 3609060.] [NT:alternate gene name: proV] [LE:61618] [RE:62763] [DI:complement] >gp:[GI:g2293447] [LN:AF008930] [AC:AF008930] [PN:ATPase] [GN:opuBA] [OR:Bacillus subtilis] [DB:genpept-bct2] [DE:Bacillus subtilis choline transport system including ATPase(opuBA), transmembrane protein (opuBB), choline binding proteinprecursor (opuBC) and transmembrane protein (opuBD) genes, completecds; and unknown gene.] [NT:OpuBA; part of choline uptake system] [LE:881] [RE:2026] [DI:direct]

| ORF Name | NTID | AAID | NT Length | AA Length | score | probability |
|---|---|---|---|---|---|---|
| AI7503001001_275268_c2_1225 | 3516 | 7288 | 1125 | 374 | 766 | 5.0e-76 |

Description
sp:[LN:HIS8_BACSU] [AC:P17731:O32008] [GN:HISC:HISH] [OR:BACILLUS SUBTILIS] [EC:2.6.1.9] [DE:PHOSPHATE TRANSAMINASE)] [SP:P17731:O32008] [DB:swissprot] >pir:[LN:A26532] [AC:A26532:G22794:H69640 ] [PN:histidinol-phosphate transaminase, / tyrosine and phenylalanine aminotransferase hisC:histidinol-phosphate aminotransferase] [GN:hisC:hisH ] [CL:probable histidinol-phosphate transaminase] [OR:Bacillus subtilis] [EC:2.6.1.9] [DB:pir2] [MP:205 (degrees) ] >gp:[GI:g143814] [LN:BACVARGNS] [AC:M80245:M15409] [PN:HisH] [GN:hisH] [OR:Bacillus subtilis] [SR:Bacillus subtilis DNA] [DB:genpept-bct1] [DE:B.subtilis dbpA, mtr(A,B), gerC(1-3), ndk, cheR, aro(B,E,F,H),trp(A-F), hisH, and tyrA genes, complete cds.] [LE:14250] [RE:15332] [DI:direct] >gp:[GI:e1183707:g2634680] [LN:BSUB0012] [AC:Z99115:AL009126] [PN:tyrosine/phenylalanine aminotransferase] [GN:hisC] [FN:histidine biosynthesis] [OR:Bacillus subtilis] [DB:genpept-bct1] [EC:2.6.1.9:2.6.1.5] [DE:Bacillus subtilis complete genome (section 12 of 21): from 2195541to 2409220.] [NT:alternate gene name: aroJ; histidinol-phosphate] [SP:P17731] [LE:174116] [RE:175198] [DI:complement]

| ORF Name | NTID | AAID | NT Length | AA Length | score | probability |
|---|---|---|---|---|---|---|
| AI7503001001_2917200_f1_277 | 3517 | 7289 | 192 | 63 | | |

Description
NO-HIT

| ORF Name | NTID | AAID | NT Length | AA Length | score | probability |
|---|---|---|---|---|---|---|
| AI7503001001_2926425_f2_465 | 3518 | 7290 | 960 | 319 | 456 | 3.5e-43 |

Description sp:[LN:BMRU_BACSU] [AC:P39074] [GN:BMRU] [OR:BACILLUS SUBTILIS] [DE:BMRU PROTEIN]
[SP:P39074] [DB:swissprot] >pir:[LN:F69595] [AC:F69595 ] [PN:multidrug resistance
protein cotranscribed with bmr bmrU] [GN:bmrU ] [OR:Bacillus subtilis] [DB:pir2]
>gp:[GI:g409286] [LN:BACBMRURBE] [AC:L25604] [GN:bmrU] [FN:unknown, but cotranscribed
with bmr] [OR:Bacillus subtilis] [DB:genpept-bct1] [DE:Bacillus subtilis bmrU,
multidrug efflux transporter (bmr) and itsregulator (bmrR) genes, complete cds, and
branched-chain 2-oxo aciddehydrogenase (bfmB) gene, 3' end.] [LE:227] [RE:1120]
[DI:direct] >gp:[GI:d1013282:g1303947] [LN:BACJH642] [AC:D84432:D82370] [PN:BmrU]
[OR:Bacillus subtilis] [SR:Bacillus subtilis (strain:JH642(trpC2 PheA1)) DNA]
[DB:genpept-bct1] [DE:Bacillus subtilis DNA, 283 Kb region containing skin element.]
[LE:225092] [RE:225985] [DI:complement] >gp:[GI:e1185668:g2634834] [LN:BSUB0013]
[AC:Z99116:AL009126] [PN:multidrug resistance protein] [GN:bmrU] [OR:Bacillus subtilis]
[DB:genpept-bct1] [DE:Bacillus subtilis complete genome (section 13 of 21): from
2395261to 2613730.] [SP:P39074] [LE:97634] [RE:98527] [DI:direct]

| ORF Name | NTID | AAID | NT Length | AA Length | score | probability |
|---|---|---|---|---|---|---|
| AI7503001001_2929517_c3_1399 | 3519 | 7291 | 126 | 41 | | |

Description
NO-HIT

| ORF Name | NTID | AAID | NT Length | AA Length | score | probability |
|---|---|---|---|---|---|---|
| AI7503001001_29376503_f2_504 | 3520 | 7292 | 246 | 81 | | |

Description
NO-HIT

| ORF Name | NTID | AAID | NT Length | AA Length | score | probability |
|---|---|---|---|---|---|---|
| AI7503001001_29378425_f3_790 | 3521 | 7293 | 132 | 43 | | |

Description
NO-HIT

| ORF Name | NTID | AAID | NT Length | AA Length | score | probability |
|---|---|---|---|---|---|---|
| AI7503001001_29501510_c1_950 | 3522 | 7294 | 1125 | 374 | 432 | 1.2e-40 |

Description sp:[LN:TAGB_BACSU] [AC:P27621] [GN:TAGB] [OR:BACILLUS SUBTILIS] [DE:TEICHOIC ACID
BIOSYNTHESIS PROTEIN B PRECURSOR] [SP:P27621] [DB:swissprot] >pir:[LN:C49757]
[AC:C49757:C69720 ] [PN:polyglycerol phosphate techoic acid biosynthesis protein tagB ]
[GN:tagB ] [OR:Bacillus subtilis] [DB:pir2] >gp:[GI:g143725] [LN:BACTAGABCD]
[AC:M57497] [GN:tagB] [OR:Bacillus subtilis] [SR:B.subtilis (strain 168) DNA]
[DB:genpept-bct1] [DE:B.subtilis tagA, tagB, tagC and tagD genes, complete cds.]
[NT:putative] [LE:1603] [RE:2748] [DI:direct] >gp:[GI:e1184482:g2636102] [LN:BSUB0019]
[AC:Z99122:AL009126] [GN:tagB] [FN:polyglycerol phosphate assembly and export]
[OR:Bacillus subtilis] [DB:genpept-bct1] [DE:Bacillus subtilis complete genome (section
19 of 21): from 3597091to 3809700.] [SP:P27621] [LE:84143] [RE:85288] [DI:direct]
>gp:[GI:e1184482:g2636102] [LN:BSUB0019] [AC:Z99122:AL009126] [GN:tagB]
[FN:polyglycerol phosphate assembly and export] [OR:Bacillus subtilis] [DB:genpept]
[DE:Bacillus subtilis complete genome (section 19 of 21): from 3597091to 3809700.]
[SP:P27621] [LE:84143] [RE:85288] [DI:direct]

| ORF_Name | NTID | AAID | NT Length | AA Length | score | probability |
|---|---|---|---|---|---|---|
| AI7503001001_29570877_c3_1414 | 3523 | 7295 | 153 | 50 | | |

Description
NO-HIT

| ORF_Name | NTID | AAID | NT Length | AA Length | score | probability |
|---|---|---|---|---|---|---|
| AI7503001001_3001313_c2_1262 | 3524 | 7296 | 681 | 226 | 154 | 3.6e-11 |

Description
pir:[LN:A65001] [AC:A65001 ] [PN:hypothetical protein b2291] [OR:Escherichia coli]
[DB:pir2] >gp:[GI:g1788628] [LN:AE000318] [AC:AE000318:U00096] [PN:putative alpha helix
protein] [GN:b2291] [FN:phenotype; Not classified] [OR:Escherichia coli]
[DB:genpept-bct2] [DE:Escherichia coli K-12 MG1655 section 208 of 400 of the
completegenome.] [NT:o199] [LE:4988] [RE:5587] [DI:direct]

| ORF_Name | NTID | AAID | NT Length | AA Length | score | probability |
|---|---|---|---|---|---|---|
| AI7503001001_30198587_f3_629 | 3525 | 7297 | 258 | 85 | 306 | 2.8e-27 |

Description
pir:[LN:C70024] [AC:C70024 ] [PN:NifU protein homolog homolog yutI] [GN:yutI ]
[CL:conserved hypothetical nifU-like protein HP1492] [OR:Bacillus subtilis] [DB:pir2]
>gp:[GI:e1184301:g2635719] [LN:BSUB0017] [AC:Z99120:AL009126] [GN:yutI] [FN:unknown]
[OR:Bacillus subtilis] [DB:genpept-bct1] [DE:Bacillus subtilis complete genome (section
17 of 21): from 3197001to 3414420.] [NT:similar to NifU protein homolog] [LE:112444]
[RE:112779] [DI:direct]

| ORF_Name | NTID | AAID | NT Length | AA Length | score | probability |
|---|---|---|---|---|---|---|
| AI7503001001_30265692_c3_1521 | 3526 | 7298 | 1050 | 349 | 1070 | 3.1e-108 |

Description
gp:[GI:g4530240] [LN:AF101234] [AC:AF101234] [PN:unknown] [OR:Staphylococcus aureus]
[DB:genpept-bct2] [DE:Staphylococcus aureus dltABCD operon, complete sequence;
andunknown gene.] [NT:Orf1; similar to hydroxyacid dehydrogenases] [LE:51] [RE:1010]
[DI:direct]

| ORF_Name | NTID | AAID | NT Length | AA Length | score | probability |
|---|---|---|---|---|---|---|
| AI7503001001_30272661_f1_265 | 3527 | 7299 | 174 | 57 | | |

Description
NO-HIT

| ORF_Name | NTID | AAID | NT Length | AA Length | score | probability |
|---|---|---|---|---|---|---|
| AI7503001001_30491275_c1_961 | 3528 | 7300 | 1104 | 367 | 391 | 2.7e-36 |

Description
pir:[LN:H69867] [AC:H69867 ] [PN:conserved hypothetical protein ykvI] [GN:ykvI ]
[OR:Bacillus subtilis] [DB:pir2] >gp:[GI:e1184961:g2633742] [LN:BSUB0008]
[AC:Z99111:AL009126] [GN:ykvI] [FN:unknown] [OR:Bacillus subtilis] [DB:genpept-bct1]
[DE:Bacillus subtilis complete genome (section 8 of 21): from 1394791to 1603020.]
[NT:similar to hypothetical proteins from B. subtilis] [LE:42768] [RE:43811]
[DI:direct]

| ORF Name | NTID | AAID | NT Length | AA Length | score | probability |
|---|---|---|---|---|---|---|
| AI7503001001_30601588_c3_1356 | 3529 | 7301 | 834 | 277 | 561 | 2.6e-54 |

Description sp:[LN:TAGG_BACSU] [AC:P42953] [GN:TAGG] [OR:BACILLUS SUBTILIS] [DE:TEICHOIC ACID TRANSLOCATION PERMEASE PROTEIN TAGG] [SP:P42953] [DB:swissprot] >pir:[LN:S69202] [AC:S69202:H69720 ] [PN:teichoic acid permease tagG:integral membrane protein tagG] [GN:tagG ] [OR:Bacillus subtilis] [DB:pir2] >gp:[GI:g755152] [LN:BSU13832] [AC:U13832] [PN:highly hydrophobic integral membrane protein] [GN:tagG] [FN:teichoic acid translocation] [OR:Bacillus subtilis] [DB:genpept-bct1] [DE:Bacillus subtilis 168 highly hydrophobic integral membrane protein(tagG) gene and ATP-binding protein (tagH) gene, complete cds.] [LE:287] [RE:1114] [DI:direct] >gp:[GI:e1184477:g2636097] [LN:BSUB0019] [AC:Z99122:AL009126] [PN:permease] [GN:tagG] [FN:teichoic acid translocation] [OR:Bacillus subtilis] [DB:genpept-bct1] [DE:Bacillus subtilis complete genome (section 19 of 21): from 3597091to 3809700.] [SP:P42953] [LE:77137] [RE:77964] [DI:complement] >gp:[GI:e1184477:g2636097] [LN:BSUB0019] [AC:Z99122:AL009126] [PN:permease] [GN:tagG] [FN:teichoic acid translocation] [OR:Bacillus subtilis] [DB:genpept] [DE:Bacillus subtilis complete genome (section 19 of 21): from 3597091to 3809700.] [SP:P42953] [LE:77137] [RE:77964] [DI:complement]

| ORF Name | NTID | AAID | NT Length | AA Length | score | probability |
|---|---|---|---|---|---|---|
| AI7503001001_30661260_c1_1080 | 3530 | 7302 | 132 | 43 | | |

Description

NO-HIT

| ORF Name | NTID | AAID | NT Length | AA Length | score | probability |
|---|---|---|---|---|---|---|
| AI7503001001_30745328_c1_1103 | 3531 | 7303 | 606 | 201 | 200 | 4.8e-16 |

Description pir:[LN:S56619] [AC:S56619:B65255 ] [PN:gpmB protein:hypothetical protein o215b] [GN:gpmB ] [CL:phosphoglycerate mutase homology] [OR:Escherichia coli] [DB:pir2] >gp:[GI:g537235] [LN:ECOUW93] [AC:U14003] [OR:Escherichia coli] [DB:genpept-bct1] [DE:Escherichia coli K-12 chromosomal region from 92.8 to 00.1 minutes.] [NT:Kenn Rudd identifies as gpmB] [LE:324630] [RE:325277] [DI:direct] >gp:[GI:g1790856] [LN:AE000509] [AC:AE000509:U00096] [PN:phosphoglyceromutase 2] [GN:gpmB] [FN:enzyme; Energy metabolism, carbon: Glycolysis] [OR:Escherichia coli] [DB:genpept-bct2] [DE:Escherichia coli K-12 MG1655 section 399 of 400 of the completegenome.] [LE:8985] [RE:9632] [DI:direct]

| ORF Name | NTID | AAID | NT Length | AA Length | score | probability |
|---|---|---|---|---|---|---|
| AI7503001001_31257943_c2_1156 | 3532 | 7304 | 414 | 137 | 669 | 9.5e-66 |

Description gp:[GI:g1913907] [LN:SAU91741] [AC:U91741] [PN:TagD] [GN:tagD] [FN:teichoic acid biosynthesis] [OR:Staphylococcus aureus] [DB:genpept-bct1] [DE:Staphylococcus aureus teichoic acid biosynthesis TagB gene, partialcds and TagX and TagD genes, complete cds.] [NT:similar to Bacillus subtilis TagD] [LE:1534] [RE:1932] [DI:direct]

| ORF Name | NTID | AAID | NT Length | AA Length | score | probability |
|---|---|---|---|---|---|---|
| AI7503001001_31267503_c2_1168 | 3533 | 7305 | 813 | 270 | 784 | 6.2e-78 |

Description pir:[LN:A70001] [AC:A70001 ] [PN:ABC transporter (ATP-binding protein) homolog ytsC] [GN:ytsC ] [CL:ATP-binding cassette homology] [OR:Bacillus subtilis] [DB:pir2] >gp:[GI:e1185911:g2635522] [LN:BSUB0016] [AC:Z99119:AL009126] [GN:ytsC] [FN:unknown] [OR:Bacillus subtilis] [DB:genpept-bct1] [DE:Bacillus subtilis complete genome (section 16 of 21): from 2997771to 3213410.] [NT:similar to ABC transporter (ATP-binding protein)] [LE:112638] [RE:113399] [DI:complement] >gp:[GI:g2293177] [LN:AF008220] [AC:AF008220] [PN:transporter] [GN:ytsC] [OR:Bacillus subtilis] [DB:genpept-bct2] [DE:Bacillus subtilis rrnB-dnaB genomic region.] [LE:67028] [RE:67789] [DI:direct]

| ORF Name | NTID | AAID | NT Length | AA Length | score | probability |
|---|---|---|---|---|---|---|
| AI7503001001_31289687_c1_1051 | 3534 | 7306 | 681 | 226 | 132 | 5.1e-06 |

Description gp:[GI:g4894306] [LN:AF065404] [AC:AF065404] [PN:pXO1-90] [OR:Bacillus anthracis] [DB:genpept-bct2] [DE:Bacillus anthracis virulence plasmid PX01, complete sequence.] [LE:106772] [RE:108730] [DI:direct]

| ORF Name | NTID | AAID | NT Length | AA Length | score | probability |
|---|---|---|---|---|---|---|
| AI7503001001_31428188_f2_401 | 3535 | 7307 | 222 | 73 | | |

Description

NO-HIT

| ORF Name | NTID | AAID | NT Length | AA Length | score | probability |
|---|---|---|---|---|---|---|
| AI7503001001_31578_c2_1265 | 3536 | 7308 | 537 | 178 | 463 | 6.4e-44 |

Description pir:[LN:H70044] [AC:H70044 ] [PN:O-acetyltransferase homolog yvoF] [GN:yvoF ] [OR:Bacillus subtilis] [DB:pir2] >gp:[GI:e1186184:g2636009] [LN:BSUB0018] [AC:Z99121:AL009126] [GN:yvoF] [FN:unknown] [OR:Bacillus subtilis] [DB:genpept-bct1] [DE:Bacillus subtilis complete genome (section 18 of 21): from 3399551to 3609060.] [NT:similar to O-acetyltransferase] [LE:190798] [RE:191316] [DI:complement] >gp:[GI:g2618861] [LN:AF017113] [AC:AF017113] [PN:putative acetyltransferase] [GN:yvoF] [OR:Bacillus subtilis] [DB:genpept-bct2] [DE:Bacillus subtilis 300-304 degree genomic sequence.] [LE:36517] [RE:37035] [DI:direct]

| ORF Name | NTID | AAID | NT Length | AA Length | score | probability |
|---|---|---|---|---|---|---|
| AI7503001001_31803377_f3_884 | 3537 | 7309 | 612 | 203 | | |

Description

NO-HIT

| ORF Name | NTID | AAID | NT Length | AA Length | score | probability |
|---|---|---|---|---|---|---|
| AI7503001001_31876563_c1_1124 | 3538 | 7310 | 1239 | 412 | 1924 | 9.7e-199 |

Description
gp:[GI:d1013747:g1405336] [LN:D86240] [AC:D86240] [PN:hypothethecal membrane transporter] [GN:dltB] [OR:Staphylococcus aureus] [SR:Staphylococcus aureus (isolate:KAN96) DNA] [DB:genpept-bct1] [DE:Staphylococcus aureus gene for unkown function and dlt operon dltA,dltB, dltC and dltD genes,complete cds.] [NT:Sequence homologous to the dltB genes of] [LE:4071] [RE:5285] [DI:direct] >gp:[GI:g4530242] [LN:AF101234] [AC:AF101234] [PN:putative membrane protein DltB] [GN:dltB] [FN:involved in D-alanine transfer into teichoic] [OR:Staphylococcus aureus] [DB:genpept-bct2] [DE:Staphylococcus aureus dltABCD operon, complete sequence; andunknown gene.] [LE:3044] [RE:4258] [DI:direct]

| ORF Name | NTID | AAID | NT Length | AA Length | score | probability |
|---|---|---|---|---|---|---|
| AI7503001001_32062553_c1_943 | 3539 | 7311 | 468 | 155 | 354 | 2.3e-32 |

Description
pir:[LN:S61393] [AC:S61393 ] [PN:hypothetical protein 2] [OR:Bacillus sp.] [SR:strain C-125, , strain C-125] [SR:strain C-125, ] [DB:pir2] >gp:[GI:d1007182:g854656] [LN:BACAPS] [AC:D31823] [PN:ORF2] [OR:Bacillus sp.] [SR:Bacillus sp. (strain:C-125) DNA] [DB:genpept-bct1] [DE:Bacillus sp. Na+/H+ antiporter system responsible genes.] [NT:Na+/H+ antiporter system responsible gene] [LE:2669] [RE:3109] [DI:direct]

| ORF Name | NTID | AAID | NT Length | AA Length | score | probability |
|---|---|---|---|---|---|---|
| AI7503001001_32070827_f3_789 | 3540 | 7312 | 168 | 55 | | |

Description
NO-HIT

| ORF Name | NTID | AAID | NT Length | AA Length | score | probability |
|---|---|---|---|---|---|---|
| AI7503001001_32212902_c2_1135 | 3541 | 7313 | 1035 | 344 | 468 | 1.9e-44 |

Description
pir:[LN:F70046] [AC:F70046 ] [PN:iron permease homolog yvrB] [GN:yvrB ] [OR:Bacillus subtilis] [DB:pir2] >gp:[GI:e1249808:g2832812] [LN:BS43KBDNA] [AC:AJ223978] [PN:putative hemin permease, YvrB] [GN:yvrB] [OR:Bacillus subtilis] [DB:genpept-bct1] [DE:Bacillus subtilis 42.7kB DNA fragment from yvsA to yvqA.] [LE:24699] [RE:25760] [DI:direct] >gp:[GI:e1184396:g2635814] [LN:BSUB0017] [AC:Z99120:AL009126] [GN:yvrB] [FN:unknown] [OR:Bacillus subtilis] [DB:genpept-bct1] [DE:Bacillus subtilis complete genome (section 17 of 21): from 3197001to 3414420.] [NT:similar to iron permease] [LE:204527] [RE:205588] [DI:complement] >gp:[GI:e1186005:g2635830] [LN:BSUB0018] [AC:Z99121:AL009126] [GN:yvrB] [FN:unknown] [OR:Bacillus subtilis] [DB:genpept-bct1] [DE:Bacillus subtilis complete genome (section 18 of 21): from 3399551to 3609060.] [NT:similar to iron permease] [LE:1977] [RE:3038] [DI:complement]

| ORF Name | NTID | AAID | NT Length | AA Length | score | probability |
|---|---|---|---|---|---|---|
| AI7503001001_32225012_f1_54 | 3542 | 7314 | 498 | 165 | 276 | 4.2e-24 |

Description pir:[LN:F69870] [AC:F69870 ] [PN:general stress protein homolog ykzA] [GN:ykzA ] [CL:hypothetical protein yklA] [OR:Bacillus subtilis] [DB:pir2] >gp:[GI:e1181516:g2632036] [LN:BSAJ2571] [AC:AJ002571] [PN:YknA] [GN:yknA] [FN:unknown] [OR:Bacillus subtilis] [DB:genpept-bct1] [DE:Bacillus subtilis 168 56 kb DNA fragment between xlyA and ykoR.] [NT:homologous to OsmC from Escherichia coli] [LE:34145] [RE:34555] [DI:direct] >gp:[GI:e1183336:g2633670] [LN:BSUB0007] [AC:Z99110:AL009126] [GN:ykzA] [FN:unknown] [OR:Bacillus subtilis] [DB:genpept-bct1] [DE:Bacillus subtilis complete genome (section 7 of 21): from 1194391to 1411140.] [NT:alternate gene name: yzzE; similar to general] [LE:187094] [RE:187504] [DI:direct]

| ORF Name | NTID | AAID | NT Length | AA Length | score | probability |
|---|---|---|---|---|---|---|
| AI7503001001_32475037_f3_651 | 3543 | 7315 | 123 | 40 | | |

Description

NO-HIT

| ORF Name | NTID | AAID | NT Length | AA Length | score | probability |
|---|---|---|---|---|---|---|
| AI7503001001_32611068_c1_927 | 3544 | 7316 | 1674 | 557 | 1694 | 2.3e-174 |

Description sp:[LN:SYR_BACSU] [AC:P46906] [GN:ARGS] [OR:BACILLUS SUBTILIS] [EC:6.1.1.19] [DE:ARGINYL-TRNA SYNTHETASE, (ARGININE--TRNA LIGASE) (ARGRS)] [SP:P46906] [DB:swissprot] >pir:[LN:E69589] [AC:E69589:S60082 ] [PN:arginine--tRNA ligase, argS:arginyl-tRNA synthetase] [GN:argS ] [CL:Bacillus arginine--tRNA ligase] [OR:Bacillus subtilis] [EC:6.1.1.19] [DB:pir2] >gp:[GI:e1186234:g2636270] [LN:BSUB0020] [AC:Z99123:AL009126] [PN:arginyl-tRNA synthetase] [GN:argS] [OR:Bacillus subtilis] [DB:genpept-bct1] [EC:6.1.1.19] [DE:Bacillus subtilis complete genome (section 20 of 21): from 3798401to 4010550.] [SP:P46906] [LE:34303] [RE:35973] [DI:complement] >gp:[GI:e324388:g2224756] [LN:BSZ97024] [AC:Z97024] [PN:arginyl tRNA synthetase] [GN:argS] [OR:Bacillus subtilis] [DB:genpept-bct1] [DE:Bacillus subtilis ywiA, sbo, ywiB, argS and narK genes.] [SP:P46906] [LE:1680] [RE:3350] [DI:direct]

| ORF Name | NTID | AAID | NT Length | AA Length | score | probability |
|---|---|---|---|---|---|---|
| AI7503001001_33210952_f2_370 | 3545 | 7317 | 234 | 77 | 93 | 0.0025 |

Description gp:[GI:g3859891] [LN:AF072678] [AC:AF072678] [PN:alpha-actinin] [GN:AACTI] [OR:Trichomonas vaginalis] [DB:genpept-inv2] [DE:Trichomonas vaginalis alpha-actinin (AACTI) mRNA, complete cds.] [NT:actin binding protein] [LE:247] [RE:3042] [DI:direct]

| ORF Name | NTID | AAID | NT Length | AA Length | score | probability |
|---|---|---|---|---|---|---|
| AI7503001001_33239001_f2_356 | 3546 | 7318 | 276 | 91 | | |

Description

NO-HIT

| ORF Name | NTID | AAID | NT Length | AA Length | score | probability |
|---|---|---|---|---|---|---|
| AI7503001001_33304063_f1_151 | 3547 | 7319 | 159 | 52 | | |

Description

NO-HIT

| ORF Name | NTID | AAID | NT Length | AA Length | score | probability |
|---|---|---|---|---|---|---|
| AI7503001001_33414143_c3_1395 | 3548 | 7320 | 1710 | 569 | 619 | 1.9e-60 |

Description
gp:[GI:g2773332] [LN:AF040718] [AC:AF040718] [PN:ABC transporter CydC] [GN:cydC] [OR:Shigella flexneri] [DB:genpept-bct2] [DE:Shigella flexneri ABC transporter CydC (cydC) gene, complete cds.] [NT:similar to E. coli CydC] [LE:1648] [RE:3369] [DI:direct]

| ORF Name | NTID | AAID | NT Length | AA Length | score | probability |
|---|---|---|---|---|---|---|
| AI7503001001_33628441_f3_645 | 3549 | 7321 | 255 | 84 | | |

Description
NO-HIT

| ORF Name | NTID | AAID | NT Length | AA Length | score | probability |
|---|---|---|---|---|---|---|
| AI7503001001_33645967_f1_18 | 3550 | 7322 | 282 | 93 | 73 | 0.019 |

Description
gp:[GI:g2444074] [LN:CPU88070] [AC:U88070] [GN:scc1] [FN:putative chaperone of type III secretory] [OR:Chlamydophila caviae] [DB:genpept-bct2] [DE:Chlamydophila caviae cds1, cds2, copN and scc1 genes, complete cds.] [NT:similar to SycE of Yersinia] [LE:4766] [RE:5206] [DI:direct]

| ORF Name | NTID | AAID | NT Length | AA Length | score | probability |
|---|---|---|---|---|---|---|
| AI7503001001_34069680_c1_1125 | 3551 | 7323 | 213 | 70 | | |

Description
NO-HIT

| ORF Name | NTID | AAID | NT Length | AA Length | score | probability |
|---|---|---|---|---|---|---|
| AI7503001001_34160625_c3_1368 | 3552 | 7324 | 438 | 145 | | |

Description
NO-HIT

| ORF Name | NTID | AAID | NT Length | AA Length | score | probability |
|---|---|---|---|---|---|---|
| AI7503001001_34173262_c3_1497 | 3553 | 7325 | 141 | 46 | | |

Description
NO-HIT

| ORF Name | NTID | AAID | NT Length | AA Length | score | probability |
|---|---|---|---|---|---|---|
| AI7503001001_34173385_c1_975 | 3554 | 7326 | 621 | 206 | 151 | 7.4e-11 |

Description
pir:[LN:E71040] [AC:E71040 ] [PN:hypothetical protein PH1613] [GN:PH1613 ] [OR:Pyrococcus horikoshii] [DB:pir2] >gp:[GI:d1031668:g3258042] [LN:AP000006] [AC:AP000006:AB005215:AB009510:AB009511:AB009512:AB009513:AB009514] [PN:166aa long hypothetical protein] [GN:PH1613] [OR:Pyrococcus horikoshii] [SR:Pyrococcus horikoshii (strain:OT3) DNA, clone:Pyrococcus horikoshi] [DB:genpept-bct1] [DE:Pyrococcus horikoshii OT3 genomic DNA, 1166001-1485000 nt. position(6/7).] [LE:263709] [RE:264209] [DI:complement]

| ORF Name | NTID | AAID | NT Length | AA Length | score | probability |
|---|---|---|---|---|---|---|
| AI7503001001_34173750_c3_1485 | 3555 | 7327 | 480 | 159 | | |

Description
NO-HIT

| ORF Name | NTID | AAID | NT Length | AA Length | score | probability |
|---|---|---|---|---|---|---|
| AI7503001001_34176550_f1_24 | 3556 | 7328 | 132 | 43 | | |

Description
NO-HIT

| ORF Name | NTID | AAID | NT Length | AA Length | score | probability |
|---|---|---|---|---|---|---|
| AI7503001001_34189817_c1_945 | 3557 | 7329 | 2052 | 683 | 888 | 5.9e-89 |

Description
pir:[LN:E70040] [AC:E70040 ] [PN:conserved hypothetical protein yvgP] [GN:yvgP ]
[CL:hypothetical protein yvgP] [OR:Bacillus subtilis] [DB:pir2]
>gp:[GI:e1186030:g2635855] [LN:BSUB0018] [AC:Z99121:AL009126] [GN:yvgP] [FN:unknown]
[OR:Bacillus subtilis] [DB:genpept-bct1] [DE:Bacillus subtilis complete genome (section
18 of 21): from 3399551to 3609060.] [NT:similar to hypothetical proteins] [LE:27843]
[RE:29855] [DI:complement]

| ORF Name | NTID | AAID | NT Length | AA Length | score | probability |
|---|---|---|---|---|---|---|
| AI7503001001_34242162_c3_1511 | 3558 | 7330 | 489 | 162 | 529 | 6.5e-51 |

Description
pir:[LN:E70019] [AC:E70019 ] [PN:NifU protein homolog homolog yurV] [GN:yurV ]
[CL:Yeast nitrogen fixation protein:nitrogen fixation protein homology] [OR:Bacillus
subtilis] [DB:pir2] >gp:[GI:e1184346:g2635764] [LN:BSUB0017] [AC:Z99120:AL009126]
[GN:yurV] [FN:unknown] [OR:Bacillus subtilis] [DB:genpept-bct1] [DE:Bacillus subtilis
complete genome (section 17 of 21): from 3197001to 3414420.] [NT:similar to NifU
protein homolog] [LE:159070] [RE:159513] [DI:complement]

| ORF Name | NTID | AAID | NT Length | AA Length | score | probability |
|---|---|---|---|---|---|---|
| AI7503001001_34251887_c2_1322 | 3559 | 7331 | 1266 | 421 | 1649 | 1.3e-169 |

Description
gp:[GI:g4530244] [LN:AF101234] [AC:AF101234] [PN:putative exoprotein DltD] [GN:dltD]
[FN:involved in D-alanine transfer into teichoic] [OR:Staphylococcus aureus]
[DB:genpept-bct2] [DE:Staphylococcus aureus dltABCD operon, complete sequence;
andunknown gene.] [LE:4509] [RE:5684] [DI:direct]

| ORF Name | NTID | AAID | NT Length | AA Length | score | probability |
|---|---|---|---|---|---|---|
| AI7503001001_34254581_c1_954 | 3560 | 7332 | 147 | 48 | | |

Description
NO-HIT

| ORF Name | NTID | AAID | NT Length | AA Length | score | probability |
|---|---|---|---|---|---|---|
| AI7503001001_34261088_c3_1387 | 3561 | 7333 | 312 | 103 | 75 | 0.018 |

Description
gp:[GI:g488925] [LN:A13473] [AC:A13473] [PN:41kd antigen] [OR:Plasmodium falciparum]
[SR:malaria parasite P. falciparum] [DB:genpept-pat] [DE:P.falciparum gene for 41kd
antigen, clone 41-14.] [LE:<1] [RE:>532] [DI:direct]

| ORF_Name | NTID | AAID | NT Length | AA Length | score | probability |
|---|---|---|---|---|---|---|
| AI7503001001_34562762_c3_1336 | 3562 | 7334 | 750 | 249 | 230 | 3.2e-19 |

Description pir:[LN:D71157] [AC:D71157 ] [PN:hypothetical protein PH0459] [GN:PH0459 ] [OR:Pyrococcus horikoshii] [DB:pir2] >gp:[GI:d1030488:g3256862] [LN:AP000002] [AC:AP000002:AB009475:AB009476:AB009477:AB009478:AB009479:AB009480] [PN:232aa long hypothetical protein] [GN:PH0459] [OR:Pyrococcus horikoshii] [SR:Pyrococcus horikoshii (strain:OT3) DNA] [DB:genpept-bct1] [DE:Pyrococcus horikoshii OT3 genomic DNA, 287001-544000 nt. position(2/7).] [LE:132975] [RE:133673] [DI:direct]

| ORF_Name | NTID | AAID | NT Length | AA Length | score | probability |
|---|---|---|---|---|---|---|
| AI7503001001_34571000_f1_163 | 3563 | 7335 | 537 | 178 | 393 | 1.7e-35 |

Description sp:[LN:ADH2_ENTHI] [AC:Q24803:Q27649] [GN:ADH2] [OR:ENTAMOEBA HISTOLYTICA] [EC:1.1.1.1:1.2.1.10] [DE:DEHYDROGENASE, (ACDH)] [SP:Q24803:Q27649] [DB:swissprot] >gp:[GI:g488430] [LN:EHU04863] [AC:U04863] [PN:alcohol dehydrogenase 2] [OR:Entamoeba histolytica] [DB:genpept-inv1] [DE:Entamoeba histolytica HM1:IMSS alcohol dehydrogenase 2 (EhADH2)mRNA, complete cds.] [NT:The derived amino acid sequence of EhADH2 is] [LE:3] [RE:2615] [DI:direct]

| ORF_Name | NTID | AAID | NT Length | AA Length | score | probability |
|---|---|---|---|---|---|---|
| AI7503001001_34589027_c2_1197 | 3564 | 7336 | 315 | 104 | 98 | 0.00023 |

Description sp:[LN:Y420_METJA] [AC:Q57863] [GN:MJ0420] [OR:METHANOCOCCUS JANNASCHII] [DE:HYPOTHETICAL PROTEIN MJ0420] [SP:Q57863] [DB:swissprot] >pir:[LN:D64352] [AC:D64352 ] [PN:hypothetical protein MJ0420] [OR:Methanococcus jannaschii] [DB:pir2] [MP:FOR378394-379536 ] >gp:[GI:g1591123] [LN:U67494] [AC:U67494:L77117] [PN:O-antigen polymerase isolog] [GN:MJ0420] [OR:Methanococcus jannaschii] [DB:genpept-bct2] [DE:Methanococcus jannaschii section 36 of 150 of the complete genome.] [NT:similar to GB:M60066 SP:P26479 PID:154343 percent] [LE:1855] [RE:2997] [DI:direct]

| ORF_Name | NTID | AAID | NT Length | AA Length | score | probability |
|---|---|---|---|---|---|---|
| AI7503001001_34612887_f2_512 | 3565 | 7337 | 465 | 154 | 260 | 2.1e-22 |

Description pir:[LN:E69857] [AC:E69857 ] [PN:conserved hypothetical protein ykmA] [GN:ykmA ] [OR:Bacillus subtilis] [DB:pir2] >gp:[GI:e1181515:g2632035] [LN:BSAJ2571] [AC:AJ002571] [PN:YkmA] [GN:ykmA] [FN:unknown] [OR:Bacillus subtilis] [DB:genpept-bct1] [DE:Bacillus subtilis 168 56 kb DNA fragment between xlyA and ykoR.] [LE:33559] [RE:34002] [DI:complement] >gp:[GI:e1183335:g2633669] [LN:BSUB0007] [AC:Z99110:AL009126] [GN:ykmA] [FN:unknown] [OR:Bacillus subtilis] [DB:genpept-bct1] [DE:Bacillus subtilis complete genome (section 7 of 21): from 1194391to 1411140.] [NT:similar to hypothetical proteins] [LE:186508] [RE:186951] [DI:complement]

| ORF_Name | NTID | AAID | NT Length | AA Length | score | probability |
|---|---|---|---|---|---|---|
| AI7503001001_34627136_f3_681 | 3566 | 7338 | 306 | 101 | 73 | 0.014 |

Description pir:[LN:S36690] [AC:S36690 ] [PN:hypothetical protein] [OR:Autographa californica nuclear polyhedrosis virus:AcMNPV] [DB:pir2] >gp:[GI:g296321] [LN:ACNPVDNA] [AC:X71415] [GN:ORF 339] [OR:Autographa californica nucleopolyhedrovirus] [DB:genpept-vrl] [DE:Autographa californica nuclear polyhedrosis virus DNA.] [SP:Q06669] [LE:<1] [RE:339] [DI:complement]

| ORF Name | NTID | AAID | NT Length | AA Length | score | probability |
|---|---|---|---|---|---|---|
| AI7503001001_34641875_c3_1406 | 3567 | 7339 | 939 | 312 | 704 | 1.9e-69 |

Description
pir:[LN:A69627] [AC:A69627 ] [PN:fructose 1-phosphate kinase fruB] [GN:fruB ]
[CL:6-phosphofructokinase 2] [OR:Bacillus subtilis] [DB:pir2]
>gp:[GI:e1185029:g2633810] [LN:BSUB0008] [AC:Z99111:AL009126] [PN:fructose-1-phosphate
kinase] [GN:fruB] [OR:Bacillus subtilis] [DB:genpept-bct1] [EC:2.7.1.56] [DE:Bacillus
subtilis complete genome (section 8 of 21): from 1394791to 1603020.] [LE:112945]
[RE:113856] [DI:direct] >gp:[GI:g3282124] [LN:AF012285] [AC:AF012285:AF012284:U51911]
[PN:fructose-1-phosphate kinase] [GN:fruB] [OR:Bacillus subtilis] [DB:genpept-bct2]
[DE:Bacillus subtilis mobA-nprE gene region.] [NT:similar to L. lactis
tagatose-6-phosphate kinase,] [LE:13433] [RE:14344] [DI:direct]

| ORF Name | NTID | AAID | NT Length | AA Length | score | probability |
|---|---|---|---|---|---|---|
| AI7503001001_34642567_c1_1089 | 3568 | 7340 | 2406 | 801 | 2175 | 1.0e-228 |

Description
pir:[LN:G70027] [AC:G70027 ] [PN:conserved hypothetical protein yvaJ] [GN:yvaJ ]
[CL:virulence-associated protein vacB homolog] [OR:Bacillus subtilis] [DB:pir2]
>gp:[GI:e1186049:g2635874] [LN:BSUB0018] [AC:Z99121:AL009126] [GN:yvaJ] [FN:unknown]
[OR:Bacillus subtilis] [DB:genpept-bct1] [DE:Bacillus subtilis complete genome (section
18 of 21): from 3399551to 3609060.] [NT:similar to hypothetical proteins] [LE:51375]
[RE:53714] [DI:complement]

| ORF Name | NTID | AAID | NT Length | AA Length | score | probability |
|---|---|---|---|---|---|---|
| AI7503001001_34645311_f3_867 | 3569 | 7341 | 525 | 174 | 186 | 1.4e-14 |

Description
gp:[GI:g4981094] [LN:AE001732] [AC:AE001732:AE000512] [PN:conserved hypothetical
protein] [GN:TM0577] [OR:Thermotoga maritima] [DB:genpept-bct2] [DE:Thermotoga maritima
section 44 of 136 of the complete genome.] [NT:similar to SP:P46854 PID:606376
GB:U00096] [LE:9820] [RE:10359] [DI:complement]

| ORF Name | NTID | AAID | NT Length | AA Length | score | probability |
|---|---|---|---|---|---|---|
| AI7503001001_3518_f2_375 | 3570 | 7342 | 159 | 52 | | |

Description
NO-HIT

| ORF Name | NTID | AAID | NT Length | AA Length | score | probability |
|---|---|---|---|---|---|---|
| AI7503001001_35422880_c2_1228 | 3571 | 7343 | 129 | 42 | | |

Description
NO-HIT

| ORF Name | NTID | AAID | NT Length | AA Length | score | probability |
|---|---|---|---|---|---|---|
| AI7503001001_35444127_f2_443 | 3572 | 7344 | 663 | 220 | 514 | 2.5e-49 |

Description
sp:[LN:YVYE_BACSU] [AC:P32437:P96500] [GN:YVYE:YVHK] [OR:BACILLUS SUBTILIS] [DE:HYPOTHETICAL 24.8 KD PROTEIN IN DEGS-TAGO INTERGENIC REGION] [SP:P32437:P96500] [DB:swissprot] >pir:[LN:A70049] [AC:A70049:A30191 ] [PN:conserved hypothetical protein yvyE] [GN:yvyE ] [CL:hypothetical protein HI0722] [OR:Bacillus subtilis] [DB:pir2] >gp:[GI:e1184457:g2636077] [LN:BSUB0019] [AC:Z99122:AL009126] [GN:yvyE] [FN:unknown] [OR:Bacillus subtilis] [DB:genpept-bct1] [DE:Bacillus subtilis complete genome (section 19 of 21): from 3597091to 3809700.] [NT:alternate gene name: yvhK; similar to hypothetical] [SP:P32437] [LE:48723] [RE:49376] [DI:direct] >gp:[GI:g1762328] [LN:BSU56901] [AC:U56901] [PN:Ycr59c/YigZ homolog] [GN:yvhK] [OR:Bacillus subtilis] [DB:genpept-bct2] [DE:Bacillus subtilis putative transcriptional regulator (yvhJ),Ycr59c/YigZ homolog (yvhK), histidine kinase (degS),transcriptionalregulator of degradation enzyme (degU), (degV), (comFA), (comFB),(comFC), flagellar protein (yviB), negative regulator of flagellin(flgM), flagellar protein (yviC), flagellar-hook associated protein1 (flgK), flagellar-hook associated protein 3 (flgL), (yviE),transmembrane protein (yviF), (csrA), flagellin (hag), flagellarprotein (yviH), flagellar hook-associated protein 2 (fliD),flagellar protein (fliS), flagellar protein (fliT), sigma-54modulator homolog (yviI), and (secA) genes, complete cds.] [LE:1217] [RE:1870] [DI:complement] >gp:[GI:e1184457:g2636077] [LN:BSUB0019] [AC:Z99122:AL009126] [GN:yvyE] [FN:unknown] [OR:Bacillus subtilis] [DB:genpept] [DE:Bacillus subtilis complete genome (section 19 of 21): from 3597091to 3809700.] [NT:alternate gene name: yvhK; similar to hypothetical] [SP:P32437] [LE:48723] [RE:49376] [DI:direct]

| ORF Name | NTID | AAID | NT Length | AA Length | score | probability |
|---|---|---|---|---|---|---|
| AI7503001001_35945277_c3_1463 | 3573 | 7345 | 1065 | 354 | 1275 | 5.8e-130 |

Description
sp:[LN:RF2_BACSU] [AC:P28367:O34444] [GN:PRFB] [OR:BACILLUS SUBTILIS] [DE:PEPTIDE CHAIN RELEASE FACTOR 2 (RF-2)] [SP:P28367:O34444] [DB:swissprot] >pir:[LN:JN0146] [AC:H69681:JN0146 ] [PN:translation releasing factor RF-2:peptide chain release factor 2:prfB] [GN:prfB ] [CL:translation releasing factor] [OR:Bacillus subtilis] [DB:pir1] >gp:[GI:e1184435:g2636055] [LN:BSUB0019] [AC:Z99122:AL009126] [PN:peptide chain release factor 2] [GN:prfB] [OR:Bacillus subtilis] [DB:genpept-bct1] [DE:Bacillus subtilis complete genome (section 19 of 21): from 3597091to 3809700.] [SP:P28367] [LE:29109:30139] [RE:30137:30210] [DI:complementJoin] >gp:[GI:g2331287] [LN:AF013188] [AC:AF013188] [PN:release factor 2] [GN:prfB] [OR:Bacillus subtilis] [DB:genpept-bct2] [DE:Bacillus subtilis release factor 2 (prfB) gene, complete cds.] [NT:orf3; naturally occurring frame-shift] [LE:75:148] [RE:146:1176] [DI:directJoin] >gp:[GI:g2618874] [LN:AF017113] [AC:AF017113] [PN:putative peptide chain release factor RF-2] [GN:prfB] [OR:Bacillus subtilis] [DB:genpept-bct2] [DE:Bacillus subtilis 300-304 degree genomic sequence.] [LE:83:156] [RE:154:1184] [DI:directJoin] >gp:[GI:e1184435:g2636055] [LN:BSUB0019] [AC:Z99122:AL009126] [PN:peptide chain release factor 2] [GN:prfB] [OR:Bacillus subtilis] [DB:genpept] [DE:Bacillus subtilis complete genome (section 19 of 21): from 3597091to 3809700.] [SP:P28367] [LE:29109:30139] [RE:30137:30210] [DI:complementJoin]

| ORF Name | NTID | AAID | NT Length | AA Length | score | probability |
|---|---|---|---|---|---|---|
| AI7503001001_35988961_f2_376 | 3574 | 7346 | 129 | 42 | | |

Description
NO-HIT

| ORF Name | NTID | AAID | NT Length | AA Length | score | probability |
|---|---|---|---|---|---|---|
| AI7503001001_36131311_c3_1455 | 3575 | 7347 | 696 | 231 | 194 | 2.1e-15 |

Description
gp:[GI:g451867] [LN:BACFLGMK] [AC:L14437] [OR:Bacillus subtilis
(strain W168) (library: lambda gtWES library] [DB:genpept-bct1] [DE:Bacillus subtilis
(clones pDM116 and pDM113) flagellin synthesisregulatory protein (flgM) and flagellar
hook-filament junctionprotein (flgK) genes and orf139, orf160, orfX, complete cds's.]
[NT:in Z18629, ORFX is called comForf3; ORFX; putative] [LE:<1] [RE:754] [DI:direct]

| ORF Name | NTID | AAID | NT Length | AA Length | score | probability |
|---|---|---|---|---|---|---|
| AI7503001001_36133385_c3_1377 | 3576 | 7348 | 681 | 226 | 203 | 2.3e-16 |

Description
pir:[LN:G69798] [AC:G69798 ] [PN:hypothetical protein yetJ] [GN:yetJ ] [CL:hypothetical
protein yetJ] [OR:Bacillus subtilis] [DB:pir2] >gp:[GI:e1182699:g2633033] [LN:BSUB0004]
[AC:Z99107:AL009126] [GN:yetJ] [FN:unknown] [OR:Bacillus subtilis] [DB:genpept-bct1]
[DE:Bacillus subtilis complete genome (section 4 of 21): from 600701 to813890.]
[LE:186800] [RE:187444] [DI:direct]

| ORF Name | NTID | AAID | NT Length | AA Length | score | probability |
|---|---|---|---|---|---|---|
| AI7503001001_36229676_c1_936 | 3577 | 7349 | 795 | 264 | 238 | 4.5e-20 |

Description
gp:[GI:g3172115] [LN:ACCPCAOP] [AC:L05770:U04359:M33798:U20284:U11554:L13114:L03407]
[PN:beta-ketoadipate enol-lactone hydrolase] [GN:pcaD] [OR:Acinetobacter sp. ADP1]
[DB:genpept-bct2] [EC:3.1.1.24] [DE:Acinetobacter sp. ADP1 pca-qui-pob supraoperonic
cluster, completesequence.] [NT:ELH] [LE:6843] [RE:7643] [DI:direct]

| ORF Name | NTID | AAID | NT Length | AA Length | score | probability |
|---|---|---|---|---|---|---|
| AI7503001001_36230252_c1_1000 | 3578 | 7350 | 777 | 258 | 480 | 1.0e-45 |

Description
pir:[LN:B69627] [AC:B69627 ] [PN:transcription repressor of fructose operon fruR]
[GN:fruR ] [CL:regulatory protein gutR] [OR:Bacillus subtilis] [DB:pir2]
>gp:[GI:e1185028:g2633809] [LN:BSUB0008] [AC:Z99111:AL009126] [PN:transcriptional
regulator (DeoR family)] [GN:fruR] [FN:negative regulation of the fructose operon]
[OR:Bacillus subtilis] [DB:genpept-bct1] [DE:Bacillus subtilis complete genome (section
8 of 21): from 1394791to 1603020.] [LE:112193] [RE:112948] [DI:direct]
>gp:[GI:g3282123] [LN:AF012285] [AC:AF012285:AF012284:U51911] [PN:FruR] [GN:fruR]
[OR:Bacillus subtilis] [DB:genpept-bct2] [DE:Bacillus subtilis mobA-nprE gene region.]
[NT:similar to L. lactis lactose PTS system repressor,] [LE:12681] [RE:13436]
[DI:direct]

| ORF Name | NTID | AAID | NT Length | AA Length | score | probability |
|---|---|---|---|---|---|---|
| AI7503001001_36367302_c3_1330 | 3579 | 7351 | 564 | 187 | 122 | 2.7e-06 |

Description
sp:[LN:Y359_METJA] [AC:Q57805] [GN:MJ0359] [OR:METHANOCOCCUS JANNASCHII]
[DE:HYPOTHETICAL PROTEIN MJ0359] [SP:Q57805] [DB:swissprot] >pir:[LN:G64344] [AC:G64344
] [PN:hypothetical protein MJ0359] [OR:Methanococcus jannaschii] [DB:pir2]
[MP:REV327449-326805 ] >gp:[GI:g1591068] [LN:U67489] [AC:U67489:L77117] [PN:M.
jannaschii predicted coding region MJ0359] [GN:MJ0359] [OR:Methanococcus jannaschii]
[DB:genpept-bct2] [DE:Methanococcus jannaschii section 31 of 150 of the complete
genome.] [NT:hypothetical protein; identified by GeneMark;] [LE:2497] [RE:3141]
[DI:complement]

| ORF Name | NTID | AAID | NT Length | AA Length | score | probability |
|---|---|---|---|---|---|---|
| AI7503001001_36563_c2_1302 | 3580 | 7352 | 1074 | 357 | 908 | 4.5e-91 |

Description pir:[LN:D70020] [AC:D70020 ] [PN:ABC transporter (ATP-binding protein) homolog yusC] [GN:yusC ] [CL:ATP-binding cassette homology] [OR:Bacillus subtilis] [DB:pir2] >gp:[GI:e1184353:g2635771] [LN:BSUB0017] [AC:Z99120:AL009126] [GN:yusC] [FN:unknown] [OR:Bacillus subtilis] [DB:genpept-bct1] [DE:Bacillus subtilis complete genome (section 17 of 21): from 3197001to 3414420.] [NT:similar to ABC transporter (ATP-binding protein)] [LE:165325] [RE:166350] [DI:complement]

| ORF Name | NTID | AAID | NT Length | AA Length | score | probability |
|---|---|---|---|---|---|---|
| AI7503001001_36601562_c3_1403 | 3581 | 7353 | 1182 | 393 | 1669 | 1.0e-171 |

Description sp:[LN:NORA_STAAU] [AC:P21191] [GN:NORA] [OR:STAPHYLOCOCCUS AUREUS] [DE:QUINOLONE RESISTANCE NORA PROTEIN] [SP:P21191] [DB:swissprot] >pir:[LN:A37838] [AC:A37838 ] [PN:norA protein] [OR:Staphylococcus aureus] [DB:pir2] >gp:[GI:d1014850:g216975] [LN:STANORA] [AC:D90119] [PN:ORF for norA] [GN:norA] [OR:Staphylococcus aureus] [SR:Staphylococcus aureus (strain TK2566) genomic DNA] [DB:genpept-bct1] [DE:S. aureus norA gene.] [LE:478] [RE:1644] [DI:direct]

| ORF Name | NTID | AAID | NT Length | AA Length | score | probability |
|---|---|---|---|---|---|---|
| AI7503001001_37927_f1_282 | 3582 | 7354 | 123 | 40 | | |

Description

NO-HIT

| ORF Name | NTID | AAID | NT Length | AA Length | score | probability |
|---|---|---|---|---|---|---|
| AI7503001001_391527_f3_880 | 3583 | 7355 | 930 | 309 | 700 | 4.9e-69 |

Description sp:[LN:TAGH_BACSU] [AC:P42954] [GN:TAGH] [OR:BACILLUS SUBTILIS] [DE:TEICHOIC ACID TRANSLOCATION ATP-BINDING PROTEIN TAGH] [SP:P42954] [DB:swissprot] >pir:[LN:S69203] [AC:S69203:A69721 ] [PN:teichoic acid translocation ATP-binding protein tagH] [GN:tagH ] [CL:ATP-binding cassette homology] [OR:Bacillus subtilis] [DB:pir2] >gp:[GI:g755153] [LN:BSU13832] [AC:U13832] [PN:ATP-binding protein] [GN:tagH] [FN:teichoic acid translocation] [OR:Bacillus subtilis] [DB:genpept-bct1] [DE:Bacillus subtilis 168 highly hydrophobic integral membrane protein(tagG) gene and ATP-binding protein (tagH) gene, complete cds.] [LE:1134] [RE:2717] [DI:direct] >gp:[GI:e1184476:g2636096] [LN:BSUB0019] [AC:Z99122:AL009126] [PN:ATP-binding protein] [GN:tagH] [FN:teichoic acid translocation] [OR:Bacillus subtilis] [DB:genpept-bct1] [DE:Bacillus subtilis complete genome (section 19 of 21): from 3597091to 3809700.] [SP:P42954] [LE:75534] [RE:77117] [DI:complement] >gp:[GI:e1184476:g2636096] [LN:BSUB0019] [AC:Z99122:AL009126] [PN:ATP-binding protein] [GN:tagH] [FN:teichoic acid translocation] [OR:Bacillus subtilis] [DB:genpept] [DE:Bacillus subtilis complete genome (section 19 of 21): from 3597091to 3809700.] [SP:P42954] [LE:75534] [RE:77117] [DI:complement]

| ORF Name | NTID | AAID | NT Length | AA Length | score | probability |
|---|---|---|---|---|---|---|
| AI7503001001_3922550_f1_67 | 3584 | 7356 | 138 | 45 | | |

Description

NO-HIT

| ORF Name | NTID | AAID | NT Length | AA Length | score | probability |
|---|---|---|---|---|---|---|
| AI7503001001_3928762_f2_369 | 3585 | 7357 | 1368 | 455 | 839 | 9.2e-84 |

Description pir:[LN:B70007] [AC:B70007 ] [PN:Na+-transporting ATP synthase homolog yubG] [GN:yubG ] [CL:Na+-ATP synthase chain J] [OR:Bacillus subtilis] [DB:pir2] >gp:[GI:e1185983:g2635594] [LN:BSUB0016] [AC:Z99119:AL009126] [GN:yubG] [FN:unknown] [OR:Bacillus subtilis] [DB:genpept-bct1] [DE:Bacillus subtilis complete genome (section 16 of 21): from 2997771to 3213410.] [NT:similar to Na+-transporting ATP synthase] [LE:190389] [RE:191726] [DI:direct]

| ORF Name | NTID | AAID | NT Length | AA Length | score | probability |
|---|---|---|---|---|---|---|
| AI7503001001_3939218_c1_922 | 3586 | 7358 | 135 | 44 | | |

Description

NO-HIT

| ORF Name | NTID | AAID | NT Length | AA Length | score | probability |
|---|---|---|---|---|---|---|
| AI7503001001_3942263_c3_1381 | 3587 | 7359 | 726 | 241 | 913 | 1.3e-91 |

Description pir:[LN:C69793] [AC:C69793 ] [PN:conserved hypothetical protein yeeI] [GN:yeeI ] [CL:hypothetical protein MG332] [OR:Bacillus subtilis] [DB:pir2] >gp:[GI:e1182664:g2632998] [LN:BSUB0004] [AC:Z99107:AL009126] [GN:yeeI] [FN:unknown] [OR:Bacillus subtilis] [DB:genpept-bct1] [DE:Bacillus subtilis complete genome (section 4 of 21): from 600701 to813890.] [NT:similar to hypothetical proteins] [LE:151216] [RE:151938] [DI:direct]

| ORF Name | NTID | AAID | NT Length | AA Length | score | probability |
|---|---|---|---|---|---|---|
| AI7503001001_3944001_c1_1130 | 3588 | 7360 | 1524 | 507 | 684 | 2.4e-67 |

Description pir:[LN:F70012] [AC:F70012 ] [PN:leucyl aminopeptidase homolog yuiE] [GN:yuiE ] [CL:cytosol aminopeptidase] [OR:Bacillus subtilis] [DB:pir2] >gp:[GI:e1184284:g2635702] [LN:BSUB0017] [AC:Z99120:AL009126] [GN:yuiE] [FN:unknown] [OR:Bacillus subtilis] [DB:genpept-bct1] [DE:Bacillus subtilis complete genome (section 17 of 21): from 3197001to 3414420.] [NT:similar to leucyl aminopeptidase] [LE:98474] [RE:99976] [DI:complement]

| ORF Name | NTID | AAID | NT Length | AA Length | score | probability |
|---|---|---|---|---|---|---|
| AI7503001001_3948587_f2_340 | 3589 | 7361 | 873 | 290 | 378 | 6.5e-35 |

Description gp:[GI:g4980658] [LN:AE001701] [AC:AE001701:AE000512] [PN:conserved hypothetical protein] [GN:TM0164] [OR:Thermotoga maritima] [DB:genpept-bct2] [DE:Thermotoga maritima section 13 of 136 of the complete genome.] [NT:similar to GB:AE000666 percent identity: 61.11;] [LE:9393] [RE:10187] [DI:direct]

| ORF Name | NTID | AAID | NT Length | AA Length | score | probability |
|---|---|---|---|---|---|---|
| AI7503001001_3953452_c2_1201 | 3590 | 7362 | 507 | 168 | 328 | 1.3e-29 |

Description pir:[LN:D69849] [AC:D69849 ] [PN:transcription regulation homolog yjdI] [GN:yjdI ] [CL:conserved hypothetical protein HI1434] [OR:Bacillus subtilis] [DB:pir2] >gp:[GI:e1183226:g2633560] [LN:BSUB0007] [AC:Z99110:AL009126] [GN:yjdI] [FN:unknown] [OR:Bacillus subtilis] [DB:genpept-bct1] [DE:Bacillus subtilis complete genome (section 7 of 21): from 1194391to 1411140.] [NT:similar to transcription regulation] [LE:82766] [RE:83245] [DI:direct]

| ORF_Name | NTID | AAID | NT Length | AA Length | score | probability |
|---|---|---|---|---|---|---|
| AI7503001001_3955067_c2_1278 | 3591 | 7363 | 126 | 41 | | |

Description
NO-HIT

| ORF_Name | NTID | AAID | NT Length | AA Length | score | probability |
|---|---|---|---|---|---|---|
| AI7503001001_3959377_f3_886 | 3592 | 7364 | 126 | 41 | 149 | 1.7e-10 |

Description
gp:[GI:e255528:g1617429] [LN:SEABCTS] [AC:X99127] [PN:membrane protein] [FN:iron repressible ABC transport system] [OR:Staphylococcus epidermidis] [DB:genpept-bct1] [DE:S.epidermidis gene encoding ABC transport system.] [LE:878] [RE:1624] [DI:direct]

| ORF_Name | NTID | AAID | NT Length | AA Length | score | probability |
|---|---|---|---|---|---|---|
| AI7503001001_3962915_f2_507 | 3593 | 7365 | 627 | 208 | 139 | 1.1e-08 |

Description
pir:[LN:C71375] [AC:C71375 ] [PN:conserved hypothetical integral membrane protein TP0033] [GN:TP0033 ] [OR:Treponema pallidum subsp. pallidum] [SR:, syphilis spirochete] [DB:pir2] >gp:[GI:g3322288] [LN:AE001188] [AC:AE001188:AE000520] [PN:conserved hypothetical integral membrane] [GN:TP0033] [OR:Treponema pallidum] [DB:genpept-bct2] [DE:Treponema pallidum section 4 of 87 of the complete genome.] [NT:similar to PID:1001613 PID:1001643 percent] [LE:7016] [RE:7627] [DI:complement]

| ORF_Name | NTID | AAID | NT Length | AA Length | score | probability |
|---|---|---|---|---|---|---|
| AI7503001001_39818_f2_530 | 3594 | 7366 | 240 | 79 | 234 | 1.2e-19 |

Description
gp:[GI:g1575061] [LN:SAU57060] [AC:U57060] [PN:ScdA] [GN:scdA] [OR:Staphylococcus aureus] [DB:genpept-bct1] [DE:Staphylococcus aureus scdA gene, complete cds.] [NT:S. aureus cells containing a scdA disruption have] [LE:361] [RE:1035] [DI:direct]

| ORF_Name | NTID | AAID | NT Length | AA Length | score | probability |
|---|---|---|---|---|---|---|
| AI7503001001_3994027_f1_193 | 3595 | 7367 | 141 | 46 | | |

Description
NO-HIT

| ORF_Name | NTID | AAID | NT Length | AA Length | score | probability |
|---|---|---|---|---|---|---|
| AI7503001001_4023518_f2_400 | 3596 | 7368 | 909 | 302 | 579 | 3.3e-56 |

Description
pir:[LN:G69800] [AC:G69800 ] [PN:cell-division inhibitor homolog yfhF] [GN:yfhF ] [CL:cell division inhibitor yfhF] [OR:Bacillus subtilis] [DB:pir2]
>gp:[GI:e1182841:g2633175] [LN:BSUB0005] [AC:Z99108:AL009126] [GN:yfhF] [FN:unknown] [OR:Bacillus subtilis] [DB:genpept-bct1] [DE:Bacillus subtilis complete genome (section 5 of 21): from 802821 to1011250.] [NT:similar to cell-division inhibitor] [LE:121320] [RE:122231] [DI:complement] >gp:[GI:d1025388:g2804536] [LN:D85082] [AC:D85082] [PN:YfhF] [OR:Bacillus subtilis] [SR:Bacillus subtilis DNA] [DB:genpept-bct1] [DE:Bacillus subtilis DNA, genome sequence, 79 to 81 degree region.] [LE:14211] [RE:15122] [DI:complement]

| ORF Name | NTID | AAID | NT Length | AA Length | score | probability |
|---|---|---|---|---|---|---|
| AI7503001001_4036093_c3_1384 | 3597 | 7369 | 864 | 287 | 461 | 1.0e-43 |

Description
pir:[LN:B69866] [AC:B69866 ] [PN:transcription regulator LysR family homolog ykuM]
[GN:ykuM ] [OR:Bacillus subtilis] [DB:pir2] >gp:[GI:e1181918:g2632234] [LN:BS16829KB]
[AC:AJ222587] [PN:YkuM protein] [GN:ykuM] [OR:Bacillus subtilis] [DB:genpept-bct1]
[DE:Bacillus subtilis 29kB DNA fragment from ykwC gene to cse15 gene.] [NT:homologous
to LysR type transcriptional regulators] [LE:20403] [RE:21284] [DI:direct]
>gp:[GI:e1185004:g2633785] [LN:BSUB0008] [AC:Z99111:AL009126] [GN:ykuM] [FN:unknown]
[OR:Bacillus subtilis] [DB:genpept-bct1] [DE:Bacillus subtilis complete genome (section
8 of 21): from 1394791to 1603020.] [NT:similar to transcriptional regulator (LysR
family)] [LE:90659] [RE:91540] [DI:direct]

| ORF Name | NTID | AAID | NT Length | AA Length | score | probability |
|---|---|---|---|---|---|---|
| AI7503001001_4072006_f3_845 | 3598 | 7370 | 201 | 66 | | |

Description
NO-HIT

| ORF Name | NTID | AAID | NT Length | AA Length | score | probability |
|---|---|---|---|---|---|---|
| AI7503001001_4095055_f2_463 | 3599 | 7371 | 894 | 297 | 512 | 4.1e-49 |

Description
pir:[LN:B71256] [AC:B71256 ] [PN:conserved hypothetical integral membrane protein
TP0986] [GN:TP0986 ] [OR:Treponema pallidum subsp. pallidum] [SR:, syphilis spirochete]
[DB:pir2] >gp:[GI:g3323311] [LN:AE001266] [AC:AE001266:AE000520] [PN:conserved
hypothetical integral membrane] [GN:TP0986] [OR:Treponema pallidum] [DB:genpept-bct2]
[DE:Treponema pallidum section 82 of 87 of the complete genome.] [NT:similar to
GB:AE000511 PID:2314395 percent] [LE:1967] [RE:2851] [DI:direct]

| ORF Name | NTID | AAID | NT Length | AA Length | score | probability |
|---|---|---|---|---|---|---|
| AI7503001001_4096093_c3_1496 | 3600 | 7372 | 354 | 117 | 155 | 2.8e-11 |

Description
pir:[LN:B42573] [AC:B42573 ] [PN:urf120] [OR:Paracoccus denitrificans] [DB:pir2]

| ORF Name | NTID | AAID | NT Length | AA Length | score | probability |
|---|---|---|---|---|---|---|
| AI7503001001_4100093_c3_1419 | 3601 | 7373 | 1161 | 386 | 489 | 1.1e-46 |

Description
pir:[LN:E64556] [AC:E64556 ] [PN:para-aminobenzoate synthetase] [OR:Helicobacter
pylori] [DB:pir2] >gp:[GI:g2313385] [LN:AE000547] [AC:AE000547:AE000511]
[PN:para-aminobenzoate synthetase (pabB)] [GN:HP0293] [OR:Helicobacter pylori 26695]
[DB:genpept-bct2] [DE:Helicobacter pylori 26695 section 25 of 134 of the complete
genome.] [NT:similar to GB:K02673 SP:P05041 GB:U07748 GB:U07749] [LE:20379] [RE:22058]
[DI:direct]

| ORF Name | NTID | AAID | NT Length | AA Length | score | probability |
|---|---|---|---|---|---|---|
| AI7503001001_4101643_c2_1314 | 3602 | 7374 | 399 | 132 | 304 | 4.5e-27 |

Description
pir:[LN:F70023] [AC:F70023 ] [PN:hypothetical protein yutD] [GN:yutD ] [OR:Bacillus
subtilis] [DB:pir2] >gp:[GI:e1184310:g2635728] [LN:BSUB0017] [AC:Z99120:AL009126]
[GN:yutD] [FN:unknown] [OR:Bacillus subtilis] [DB:genpept-bct1] [DE:Bacillus subtilis
complete genome (section 17 of 21): from 3197001to 3414420.] [LE:121344] [RE:121652]
[DI:complement]

| ORF_Name | NTID | AAID | NT Length | AA Length | score | probability |
|---|---|---|---|---|---|---|
| AI7503001001_4103393_c2_1215 | 3603 | 7375 | 597 | 198 | 436 | 4.7e-41 |

Description sp:[LN:PABA_SALTY] [AC:P06193] [GN:PABA] [OR:SALMONELLA TYPHIMURIUM] [EC:4.1.3.-] [DE:(EC 4.1.3.-) (ADC SYNTHASE)] [SP:P06193] [DB:swissprot] >pir:[LN:S09636] [AC:S09636] [PN:pabA protein] [GN:pabA ] [CL:glutamine amidotransferase:trpG homology] [OR:Salmonella typhimurium] [DB:pir2] >gp:[GI:g47816] [LN:STPABA] [AC:X02603] [OR:Salmonella typhimurium] [DB:genpept-bct1] [DE:Salmonella typhimurium pabA gene for para-aminobenzoate synthaseglutamine amidotransferase.] [NT:pabA gene product (aa 1-187)] [SP:P06193] [LE:1] [RE:564] [DI:direct] >gp:[GI:g154228] [LN:STYPABAA] [AC:M32355] [OR:Salmonella typhimurium] [SR:S.typhimurium DNA, clone pSZD3] [DB:genpept-bct1] [DE:S.typhimurium glutamine amidotransferase subunit ofpara-aminobenzoate synthase (pabA) and pot. cell division proteinfic) genes, complete cds.] [NT:glutamine amidotransferase] [LE:970] [RE:1533] [DI:direct]

| ORF_Name | NTID | AAID | NT Length | AA Length | score | probability |
|---|---|---|---|---|---|---|
| AI7503001001_4110888_c3_1380 | 3604 | 7376 | 405 | 134 | 93 | 0.00010 |

Description gp:[GI:g3283053] [LN:AF054173] [AC:AF054173] [PN:staphylococcal accessory regulator A homolog] [GN:sarA] [OR:Staphylococcus epidermidis] [DB:genpept-bct2] [DE:Staphylococcus epidermidis staphylococcal accessory regulator Ahomolog (sarA) gene, complete cds.] [LE:887] [RE:1261] [DI:direct]

| ORF_Name | NTID | AAID | NT Length | AA Length | score | probability |
|---|---|---|---|---|---|---|
| AI7503001001_4111691_c1_1018 | 3605 | 7377 | 744 | 247 | 351 | 1.5e-31 |

Description sp:[LN:YCSJ_BACSU] [AC:P42967] [GN:YCSJ] [OR:BACILLUS SUBTILIS] [DE:HYPOTHETICAL 63.8 KD PROTEIN IN SIPU-PBPC INTERGENIC REGION] [SP:P42967] [DB:swissprot] >pir:[LN:G69765] [AC:G69765:I39898 ] [PN:allophanate hydrolase homolog ycsJ:probable urea amidolyase] [GN:ycsJ ] [OR:Bacillus subtilis] [DB:pir2] >gp:[GI:d1007939:g790943] [LN:BAC39R] [AC:D38161] [PN:urea amidolyase] [OR:Bacillus subtilis] [SR:Bacillus subtilis (strain:168TrpC2) DNA] [DB:genpept-bct1] [DE:Bacillus subtilis genome around 39 degrees region encoding 17 ORFs,complete cds.] [LE:10358] [RE:12094] [DI:direct] >gp:[GI:e1182375:g2632709] [LN:BSUB0003] [AC:Z99106:AL009126] [GN:ycsJ] [FN:unknown] [OR:Bacillus subtilis] [DB:genpept-bct1] [DE:Bacillus subtilis complete genome (section 3 of 21): from 402751 to611850.] [NT:similar to allophanate hydrolase] [SP:P42967] [LE:56667] [RE:58403] [DI:direct] >gp:[GI:d1009674:g1805477] [LN:D50453] [AC:D50453] [PN:homologues to hypothetical protein HI1731 of H.] [GN:ycsJ] [OR:Bacillus subtilis] [SR:Bacillus subtilis (strain:168 trpC2) DNA] [DB:genpept-bct1] [DE:Bacillus subtilis DNA for 25-36 degree region containing theamyE-srfA region, complete cds.] [LE:139065] [RE:140801] [DI:direct]

| ORF_Name | NTID | AAID | NT Length | AA Length | score | probability |
|---|---|---|---|---|---|---|
| AI7503001001_4195817_c1_955 | 3606 | 7378 | 1743 | 580 | 2597 | 4.7e-270 |

Description gp:[GI:e264711:g1262136] [LN:SAPBP4GEN] [AC:X91786] [PN:ATP-binding cassette transporter A] [GN:abcA] [OR:Staphylococcus aureus] [DB:genpept-bct1] [DE:S.aureus abcA, pbp4, and tagD genes.] [LE:311] [RE:2038] [DI:complement]

| ORF Name | NTID | AAID | NT Length | AA Length | score | probability |
|---|---|---|---|---|---|---|
| AI7503001001_42167_c1_959 | 3607 | 7379 | 834 | 277 | 1083 | 1.3e-109 |

Description
gp:[GI:g4928292] [LN:AF132117] [AC:AF132117] [PN:FhuA] [GN:fhuA] [OR:Staphylococcus aureus] [DB:genpept-bct2] [DE:Staphylococcus aureus ferrichrome uptake operon, complete sequenceand unknown genes.] [NT:ATP binding protein.] [LE:2780] [RE:3514] [DI:complement]

| ORF Name | NTID | AAID | NT Length | AA Length | score | probability |
|---|---|---|---|---|---|---|
| AI7503001001_422162_f3_795 | 3608 | 7380 | 456 | 151 | 439 | 2.2e-41 |

Description
pir:[LN:B69868] [AC:B69868 ] [PN:6-pyruvoyl tetrahydrobiopterin synthase homolog ykvK] [GN:ykvK ] [OR:Bacillus subtilis] [DB:pir2] >gp:[GI:e1184963:g2633744] [LN:BSUB0008] [AC:Z99111:AL009126] [GN:ykvK] [FN:unknown] [OR:Bacillus subtilis] [DB:genpept-bct1] [DE:Bacillus subtilis complete genome (section 8 of 21): from 1394791to 1603020.] [NT:similar to 6-pyruvoyl tetrahydrobiopterin synthase] [LE:44776] [RE:45225] [DI:direct]

| ORF Name | NTID | AAID | NT Length | AA Length | score | probability |
|---|---|---|---|---|---|---|
| AI7503001001_422800_f3_903 | 3609 | 7381 | 447 | 148 | 627 | 2.7e-61 |

Description
gp:[GI:g3283053] [LN:AF054173] [AC:AF054173] [PN:staphylococcal accessory regulator A homolog] [GN:sarA] [OR:Staphylococcus epidermidis] [DB:genpept-bct2] [DE:Staphylococcus epidermidis staphylococcal accessory regulator Ahomolog (sarA) gene, complete cds.] [LE:887] [RE:1261] [DI:direct]

| ORF Name | NTID | AAID | NT Length | AA Length | score | probability |
|---|---|---|---|---|---|---|
| AI7503001001_425927_f1_232 | 3610 | 7382 | 144 | 47 | | |

Description
NO-HIT

| ORF Name | NTID | AAID | NT Length | AA Length | score | probability |
|---|---|---|---|---|---|---|
| AI7503001001_429675_f2_558 | 3611 | 7383 | 216 | 71 | | |

Description
NO-HIT

| ORF Name | NTID | AAID | NT Length | AA Length | score | probability |
|---|---|---|---|---|---|---|
| AI7503001001_4330390_c3_1517 | 3612 | 7384 | 876 | 291 | 787 | 3.0e-78 |

Description
pir:[LN:A70016] [AC:A70016 ] [PN:hypothetical protein yunF] [GN:yunF ] [OR:Bacillus subtilis] [DB:pir2] >gp:[GI:e1184318:g2635736] [LN:BSUB0017] [AC:Z99120:AL009126] [GN:yunF] [FN:unknown] [OR:Bacillus subtilis] [DB:genpept-bct1] [DE:Bacillus subtilis complete genome (section 17 of 21): from 3197001to 3414420.] [LE:127975] [RE:128829] [DI:complement]

| ORF Name | NTID | AAID | NT Length | AA Length | score | probability |
|---|---|---|---|---|---|---|
| AI7503001001_4351465_c2_1159 | 3613 | 7385 | 129 | 42 | | |

Description
NO-HIT

| ORF Name | NTID | AAID | NT Length | AA Length | score | probability |
|---|---|---|---|---|---|---|
| AI7503001001_4461693_f2_596 | 3614 | 7386 | 240 | 79 | | |

Description
NO-HIT

| ORF Name | NTID | AAID | NT Length | AA Length | score | probability |
|---|---|---|---|---|---|---|
| AI7503001001_4487588_f3_797 | 3615 | 7387 | 609 | 202 | 81 | 0.00094 |

Description
pir:[LN:B69478] [AC:B69478 ] [PN:NADH dehydrogenase (ubiquinone),, 43.2 kDa subunit homolog] [OR:Archaeoglobus fulgidus] [EC:1.6.5.3] [DB:pir2] >gp:[GI:g2648717] [LN:AE000976] [AC:AE000976:AE000782] [PN:F420H2:quinone oxidoreductase, 43.2 kDa subunit,] [GN:AF1827] [OR:Archaeoglobus fulgidus] [DB:genpept-bct2] [DE:Archaeoglobus fulgidus section 131 of 172 of the complete genome.] [NT:similar to PID:882405 SP:P50973 percent identity:] [LE:4241] [RE:5455] [DI:direct]

| ORF Name | NTID | AAID | NT Length | AA Length | score | probability |
|---|---|---|---|---|---|---|
| AI7503001001_4501250_c1_1097 | 3616 | 7388 | 1080 | 359 | 871 | 3.7e-87 |

Description
gp:[GI:d1020364:g1944409] [LN:D87026] [AC:D87026:D28136] [PN:membrane protein] [OR:Bacillus stearothermophilus] [SR:Bacillus stearothermophilus (strain:TRBE14) DNA] [DB:genpept-bct1] [DE:Bacillus stearothermophilus glycogen operon genes, complete cds.] [NT:The ORF is similar to the Alkaligenes eutrophus] [LE:144] [RE:1097] [DI:complement]

| ORF Name | NTID | AAID | NT Length | AA Length | score | probability |
|---|---|---|---|---|---|---|
| AI7503001001_4511550_c2_1247 | 3617 | 7389 | 1278 | 425 | 318 | 1.5e-28 |

Description
sp:[LN:YHAD_ECOLI] [AC:P23524] [GN:YHAD] [OR:ESCHERICHIA COLI] [DE:HYPOTHETICAL 39.1 KD PROTEIN IN RNPB-SOHA INTERGENIC REGION (ORF 3)] [SP:P23524] [DB:swissprot]

| ORF Name | NTID | AAID | NT Length | AA Length | score | probability |
|---|---|---|---|---|---|---|
| AI7503001001_4535652_f1_255 | 3618 | 7390 | 225 | 74 | | |

Description
NO-HIT

| ORF Name | NTID | AAID | NT Length | AA Length | score | probability |
|---|---|---|---|---|---|---|
| AI7503001001_4539143_c1_1066 | 3619 | 7391 | 942 | 313 | 970 | 1.2e-97 |

Description
sp:[LN:HPRK_BACSU] [AC:O34483] [GN:PTSK] [OR:BACILLUS SUBTILIS] [EC:2.7.1.-] [DE:HPR(SER) KINASE,] [SP:O34483] [DB:swissprot]

| ORF Name | NTID | AAID | NT Length | AA Length | score | probability |
|---|---|---|---|---|---|---|
| AI7503001001_4578956_f1_101 | 3620 | 7392 | 297 | 98 | 79 | 0.021 |

Description
gp:[GI:e1350598:g3881046] [LN:CEY51A2D] [AC:AL021497] [GN:Y51A2D.12] [OR:Caenorhabditis elegans] [DB:genpept-inv1] [DE:Caenorhabditis elegans cosmid Y51A2D, complete sequence.] [LE:83074:83534:84872] [RE:83208:83768:84978] [DI:complementJoin]

| ORF Name | NTID | AAID | NT Length | AA Length | score | probability |
|---|---|---|---|---|---|---|
| AI7503001001_4687843_c2_1324 | 3621 | 7393 | 330 | 109 | 242 | 1.7e-20 |

Description
pir:[LN:C70026] [AC:C70026 ] [PN:hypothetical protein yuzD] [GN:yuzD ] [OR:Bacillus subtilis] [DB:pir2] >gp:[GI:e1184300:g2635718] [LN:BSUB0017] [AC:Z99120:AL009126] [GN:yuzD] [FN:unknown] [OR:Bacillus subtilis] [DB:genpept-bct1] [DE:Bacillus subtilis complete genome (section 17 of 21): from 3197001to 3414420.] [LE:112018] [RE:112344] [DI:complement]

| ORF Name | NTID | AAID | NT Length | AA Length | score | probability |
|---|---|---|---|---|---|---|
| AI7503001001_4689077_c2_1271 | 3622 | 7394 | 333 | 110 | 466 | 3.1e-44 |

Description
sp:[LN:CLPP_BACSU] [AC:P80244:O08433] [GN:CLPP] [OR:BACILLUS SUBTILIS] [EC:3.4.21.92] [DE:(ENDOPEPTIDASE CLP) (CASEINOLYTIC PROTEASE) (PROTEASE TI)] [SP:P80244:O08433] [DB:swissprot] >pir:[LN:B69601] [AC:B69601:A47683 ] [PN:ATP-dependent clp proteinase, chain P:stress protein G7] [GN:clpP ] [CL:ATP-dependent Clp proteinase chain P] [OR:Bacillus subtilis] [EC:3.4.21.-] [DB:pir2] >gp:[GI:e1186142:g2635967] [LN:BSUB0018] [AC:Z99121:AL009126] [PN:ATP-dependent Clp protease proteolytic subunit] [GN:clpP] [OR:Bacillus subtilis] [DB:genpept-bct1] [EC:3.4.21.92] [DE:Bacillus subtilis complete genome (section 18 of 21): from 3399551to 3609060.] [NT:alternate gene name: yvdN] [SP:P80244] [LE:145744] [RE:146337] [DI:direct] >gp:[GI:e313044:g1945673] [LN:BSZ94043] [AC:Z94043] [PN:hypothetical protein] [GN:yvdN] [OR:Bacillus subtilis] [DB:genpept-bct1] [DE:B.subtilis genomic DNA fragment (88 kb).] [NT:similar to CLPP_ECOLI ATP-dependent clp protease] [SP:P80244] [LE:35334] [RE:35927] [DI:complement] >gp:[GI:g2668494] [LN:BSU59754] [AC:U59754] [PN:ClpP] [GN:clpP] [OR:Bacillus subtilis] [DB:genpept-bct2] [DE:Bacillus subtilis Clp protease proteolytic component (clpP) gene,complete cds.] [NT:proteolytic component of Clp protease] [LE:140] [RE:733] [DI:direct]

| ORF Name | NTID | AAID | NT Length | AA Length | score | probability |
|---|---|---|---|---|---|---|
| AI7503001001_4689130_f2_614 | 3623 | 7395 | 306 | 101 | 81 | 0.029 |

Description
pir:[LN:A58932] [AC:A58932 ] [PN:cytochrome C-type biogenesis protein CCMF] [GN:yejR:ccmF ] [OR:mitochondrion Cyanidioschyzon merolae] [DB:pir2] >gp:[GI:d1037513:g4115789] [LN:D89861] [AC:D89861] [PN:cytochrome C-type biogenesis protein CCMF] [GN:yejR or ccmF] [OR:Mitochondrion Cyanidioschyzon merolae] [SR:Cyanidioschyzon merolae (strain:10D) mitochondrion DNA] [DB:genpept-pln1] [DE:Cyanidioschyzon merolae mitochondrial DNA, complete sequence.] [LE:16296] [RE:18158] [DI:complement]

| ORF Name | NTID | AAID | NT Length | AA Length | score | probability |
|---|---|---|---|---|---|---|
| AI7503001001_4695293_c3_1487 | 3624 | 7396 | 171 | 56 | | |

Description
NO-HIT

| ORF Name | NTID | AAID | NT Length | AA Length | score | probability |
|---|---|---|---|---|---|---|
| AI7503001001_4703180_c1_1041 | 3625 | 7397 | 453 | 150 | 541 | 3.5e-52 |

Description
gp:[GI:e1393149:g4490608] [LN:SAU133495] [AC:AJ133495] [PN:NRD1] [GN:nrd1] [OR:Staphylococcus aureus] [DB:genpept-bct1] [DE:Staphylococcus aureus ribonucleotide reductase operon.] [LE:138] [RE:536] [DI:direct]

| ORF_Name | NTID | AAID | NT Length | AA Length | score | probability |
|---|---|---|---|---|---|---|
| AI7503001001_4709575_c2_1309 | 3626 | 7398 | 354 | 117 | | |

Description
NO-HIT

| ORF_Name | NTID | AAID | NT Length | AA Length | score | probability |
|---|---|---|---|---|---|---|
| AI7503001001_4726462_f2_572 | 3627 | 7399 | 168 | 55 | | |

Description
NO-HIT

| ORF_Name | NTID | AAID | NT Length | AA Length | score | probability |
|---|---|---|---|---|---|---|
| AI7503001001_4726527_f3_774 | 3628 | 7400 | 528 | 175 | 749 | 3.2e-74 |

Description
pir:[LN:D69868] [AC:D69868 ] [PN:conserved hypothetical protein ykvM] [GN:ykvM ]
[CL:hypothetical protein ykvM] [OR:Bacillus subtilis] [DB:pir2]
>gp:[GI:e1184965:g2633746] [LN:BSUB0008] [AC:Z99111:AL009126] [GN:ykvM] [FN:unknown]
[OR:Bacillus subtilis] [DB:genpept-bct1] [DE:Bacillus subtilis complete genome (section
8 of 21): from 1394791to 1603020.] [NT:similar to hypothetical proteins] [LE:45967]
[RE:46464] [DI:direct]

| ORF_Name | NTID | AAID | NT Length | AA Length | score | probability |
|---|---|---|---|---|---|---|
| AI7503001001_4773392_f2_359 | 3629 | 7401 | 288 | 95 | | |

Description
NO-HIT

| ORF_Name | NTID | AAID | NT Length | AA Length | score | probability |
|---|---|---|---|---|---|---|
| AI7503001001_4775287_c3_1420 | 3630 | 7402 | 1008 | 335 | 238 | 1.3e-34 |

Description
sp:[LN:YBGK_ECOLI] [AC:P75745] [GN:YBGK] [OR:ESCHERICHIA COLI] [DE:HYPOTHETICAL 34.4 KD
PROTEIN IN PHRB-NEI INTERGENIC REGION] [SP:P75745] [DB:swissprot] >pir:[LN:G64806]
[AC:G64806 ] [PN:ybgK protein] [GN:ybgK ] [CL:hypothetical protein HI1730]
[OR:Escherichia coli] [DB:pir2] >gp:[GI:d1036362:g4062308] [LN:D90710]
[AC:D90710:AB001340] [PN:Hypothetical protein HI1730] [OR:Escherichia coli]
[SR:Escherichia coli(strain:K12) DNA, clone:Kohara clone #175] [DB:genpept-bct1]
[DE:Escherichia coli genomic DNA. (15.9 - 16.3 min).] [NT:ORF_ID:o175#7; similar to PIR
Accession Number] [LE:6967] [RE:7899] [DI:direct] >gp:[GI:g1786930] [LN:AE000174]
[AC:AE000174:U00096] [PN:putative carboxylase] [GN:ybgK] [FN:putative enzyme; Not
classified] [OR:Escherichia coli] [DB:genpept-bct2] [DE:Escherichia coli K-12 MG1655
section 64 of 400 of the completegenome.] [NT:o310; This 310 aa ORF is 48 pct identical
(1 gap)] [LE:10112] [RE:11044] [DI:direct]

| ORF_Name | NTID | AAID | NT Length | AA Length | score | probability |
|---|---|---|---|---|---|---|
| AI7503001001_47763_f3_814 | 3631 | 7403 | 186 | 61 | | |

Description
NO-HIT

| ORF Name | NTID | AAID | NT Length | AA Length | score | probability |
|---|---|---|---|---|---|---|
| AI7503001001_4804643_f1_90 | 3632 | 7404 | 246 | 81 | 75 | 0.0026 |

Description
gp:[GI:e1332553:g3764009] [LN:PFMAL3P4] [AC:AL008970] [GN:MAL3P4.11] [OR:Plasmodium falciparum] [SR:malaria parasite P. falciparum] [DB:genpept-invl] [DE:Plasmodium falciparum MAL3P4, complete sequence.] [NT:predicted using hexExon; MAL3P4.11 (PFC0510w),] [LE:68636] [RE:71146] [DI:direct]

| ORF Name | NTID | AAID | NT Length | AA Length | score | probability |
|---|---|---|---|---|---|---|
| AI7503001001_4806575_c2_1171 | 3633 | 7405 | 651 | 216 | 503 | 3.7e-48 |

Description
pir:[LN:H69854] [AC:H69854 ] [PN:hypothetical protein ykaA] [GN:ykaA ] [OR:Bacillus subtilis] [DB:pir2] >gp:[GI:e1181486:g2632006] [LN:BSAJ2571] [AC:AJ002571] [PN:YkaA] [GN:ykaA] [FN:unknown] [OR:Bacillus subtilis] [DB:genpept-bctl] [DE:Bacillus subtilis 168 56 kb DNA fragment between xlyA and ykoR.] [LE:2613] [RE:3230] [DI:complement] >gp:[GI:e1183305:g2633639] [LN:BSUB0007] [AC:Z99110:AL009126] [GN:ykaA] [FN:unknown] [OR:Bacillus subtilis] [DB:genpept-bctl] [DE:Bacillus subtilis complete genome (section 7 of 21): from 1194391to 1411140.] [LE:155562] [RE:156179] [DI:complement]

| ORF Name | NTID | AAID | NT Length | AA Length | score | probability |
|---|---|---|---|---|---|---|
| AI7503001001_4876077_f3_796 | 3634 | 7406 | 714 | 237 | 778 | 2.7e-77 |

Description
pir:[LN:C69868] [AC:C69868 ] [PN:coenzyme PQQ synthesis homolog ykvL] [GN:ykvL ] [OR:Bacillus subtilis] [DB:pir2] >gp:[GI:e1184964:g2633745] [LN:BSUB0008] [AC:Z99111:AL009126] [GN:ykvL] [FN:unknown] [OR:Bacillus subtilis] [DB:genpept-bctl] [DE:Bacillus subtilis complete genome (section 8 of 21): from 1394791to 1603020.] [NT:similar to coenzyme PQQ synthesis] [LE:45218] [RE:45949] [DI:direct]

| ORF Name | NTID | AAID | NT Length | AA Length | score | probability |
|---|---|---|---|---|---|---|
| AI7503001001_4885876_c1_1071 | 3635 | 7407 | 918 | 305 | 829 | 1.1e-82 |

Description
sp:[LN:YVCJ_BACSU] [AC:O06973] [GN:YVCJ] [OR:BACILLUS SUBTILIS] [DE:HYPOTHETICAL 33.9 KD PROTEIN IN CRH-TRXB INTERGENIC REGION] [SP:O06973] [DB:swissprot] >pir:[LN:H70031] [AC:H70031 ] [PN:conserved hypothetical protein yvcJ] [GN:yvcJ ] [CL:Bacillus subtilis conserved hypothetical protein yvcJ] [OR:Bacillus subtilis] [DB:pir2] >gp:[GI:e1186165:g2635990] [LN:BSUB0018] [AC:Z99121:AL009126] [GN:yvcJ] [FN:unknown] [OR:Bacillus subtilis] [DB:genpept-bctl] [DE:Bacillus subtilis complete genome (section 18 of 21): from 3399551to 3609060.] [NT:similar to hypothetical proteins] [SP:O06973] [LE:171011] [RE:171898] [DI:complement] >gp:[GI:e13026:g1945650] [LN:BSZ94043] [AC:Z94043] [PN:hypothetical protein] [GN:yvcJ] [OR:Bacillus subtilis] [DB:genpept-bctl] [DE:B.subtilis genomic DNA fragment (88 kb).] [NT:similar to hypothetical MTCY21B4] [SP:O06973] [LE:9773] [RE:10660] [DI:direct]

| ORF Name | NTID | AAID | NT Length | AA Length | score | probability |
|---|---|---|---|---|---|---|
| AI7503001001_4892878_c3_1357 | 3636 | 7408 | 1077 | 358 | 455 | 4.5e-43 |

Description
gp:[GI:g1913906] [LN:SAU91741] [AC:U91741] [PN:TagX] [GN:tagX] [FN:teichoic acid biosynthesis] [OR:Staphylococcus aureus] [DB:genpept-bctl] [DE:Staphylococcus aureus teichoic acid biosynthesis TagB gene, partialcds and TagX and TagD genes, complete cds.] [LE:632] [RE:1471] [DI:direct]

| ORF Name | NTID | AAID | NT Length | AA Length | score | probability |
|---|---|---|---|---|---|---|
| AI7503001001_4898376_f2_574 | 3637 | 7409 | 207 | 68 | 52 | 0.024 |

Description
gp:[GI:g4588017] [LN:AF087657] [AC:AF087657] [PN:NADH-ubiquinone oxidoreductase chain 6] [GN:ND6] [OR:Mitochondrion Agrocybe aegerita] [SR:Agrocybe aegerita] [DB:genpept-pln2] [DE:Agrocybe aegerita NADH-ubiquinone oxidoreductase chain 6 (ND6)gene, mitochondrial gene encoding mitochondrial protein, completecds.] [NT:NADH dehydrogenase] [LE:34] [RE:453] [DI:direct]

| ORF Name | NTID | AAID | NT Length | AA Length | score | probability |
|---|---|---|---|---|---|---|
| AI7503001001_5084652_f3_849 | 3638 | 7410 | 507 | 168 | 536 | 1.2e-51 |

Description
gp:[GI:g1575061] [LN:SAU57060] [AC:U57060] [PN:ScdA] [GN:scdA] [OR:Staphylococcus aureus] [DB:genpept-bct1] [DE:Staphylococcus aureus scdA gene, complete cds.] [NT:S. aureus cells containing a scdA disruption have] [LE:361] [RE:1035] [DI:direct]

| ORF Name | NTID | AAID | NT Length | AA Length | score | probability |
|---|---|---|---|---|---|---|
| AI7503001001_5117793_c3_1531 | 3639 | 7411 | 273 | 91 | 197 | 9.9e-16 |

Description
sp:[LN:YRN3_VIBPA] [AC:P46231] [OR:VIBRIO PARAHAEMOLYTICUS] [DE:HYPOTHETICAL PROTEIN IN RNT 5'REGION (ORF3) (FRAGMENT)] [SP:P46231] [DB:swissprot] >gp:[GI:g497126] [LN:VPU06949] [AC:U06949] [PN:ORF3] [OR:Vibrio parahaemolyticus] [DB:genpept-bct1] [DE:Vibrio parahaemolyticus BB22 RNase T (rnt) gene and flagellar motorcomponent (motY) gene, complete cds.] [LE:<1] [RE:420] [DI:complement]

| ORF Name | NTID | AAID | NT Length | AA Length | score | probability |
|---|---|---|---|---|---|---|
| AI7503001001_5131265_c2_1243 | 3640 | 7412 | 276 | 91 | 80 | 0.0071 |

Description
gp:[GI:g3582235] [LN:AE001272] [AC:AE001272] [PN:L. lactis predicted coding region ORF00014] [GN:ORF00014] [OR:Lactococcus lactis] [DB:genpept-bct2] [DE:Lactococcus lactis DPC3147 plasmid pMRC01, complete plasmidsequence.] [NT:hypothetical protein; identified by GeneMark;] [LE:10983] [RE:11600] [DI:direct]

| ORF Name | NTID | AAID | NT Length | AA Length | score | probability |
|---|---|---|---|---|---|---|
| AI7503001001_5182962_f1_196 | 3641 | 7413 | 1068 | 355 | 295 | 1.3e-30 |

Description
sp:[LN:RESE_BACSU] [AC:P35164] [GN:RESE] [OR:BACILLUS SUBTILIS] [EC:2.7.3.-] [DE:SENSOR PROTEIN RESE,] [SP:P35164] [DB:swissprot] >pir:[LN:H69691] [AC:H69691:S45560 ] [PN:two-component sensor histidine kinase resE] [GN:resE ] [CL:sensor histidine kinase homology] [OR:Bacillus subtilis] [DB:pir2] >gp:[GI:g410142] [LN:BACDIA] [AC:L09228] [OR:Bacillus subtilis] [SR:Bacillus subtilis (strain 168, sub_species Marburg) DNA] [DB:genpept-bct1] [DE:Bacillus subtilis spoVA to serA region.] [NT:ORFX18] [LE:22425] [RE:24194] [DI:direct] >gp:[GI:e1185580:g2634746] [LN:BSUB0013] [AC:Z99116:AL009126] [PN:two-component sensor histidine kinase] [GN:resE] [FN:involved in global regulation of aerobic and] [OR:Bacillus subtilis] [DB:genpept-bct1] [DE:Bacillus subtilis complete genome (section 13 of 21): from 2395261to 2613730.] [NT:alternate gene name: ypxE] [SP:P35164] [LE:19389] [RE:21158] [DI:complement]

| ORF Name | NTID | AAID | NT Length | AA Length | score | probability |
|---|---|---|---|---|---|---|
| AI7503001001_5195393_c3_1352 | 3642 | 7414 | 654 | 217 | 1088 | 3.8e-110 |

Description gp:[GI:e255543:g1617434] [LN:SESIRR] [AC:X99128] [PN:putative iron dependant repressor] [GN:sirR] [OR:Staphylococcus epidermidis] [DB:genpept-bct1] [DE:S.epidermidis sirR gene.] [LE:14] [RE:658] [DI:direct]

| ORF Name | NTID | AAID | NT Length | AA Length | score | probability |
|---|---|---|---|---|---|---|
| AI7503001001_5276677_c1_1026 | 3643 | 7415 | 1566 | 521 | 703 | 2.4e-69 |

Description pir:[LN:B64622] [AC:B64622 ] [PN:osmoprotection protein] [OR:Helicobacter pylori] [DB:pir2] >gp:[GI:g2313949] [LN:AE000593] [AC:AE000593:AE000511] [PN:osmoprotection protein (proWX)] [GN:HP0818] [OR:Helicobacter pylori 26695] [DB:genpept-bct2] [DE:Helicobacter pylori 26695 section 71 of 134 of the complete genome.] [NT:similar to PID:1109685 SP:Q45461 GB:AL009126] [LE:4862] [RE:6523] [DI:direct]

| ORF Name | NTID | AAID | NT Length | AA Length | score | probability |
|---|---|---|---|---|---|---|
| AI7503001001_5283592_f1_215 | 3644 | 7416 | 288 | 95 | 73 | 0.014 |

Description gp:[GI:g1054677] [LN:CCCOX3] [AC:X92734] [PN:cytochrome oxidase] [GN:coxIII] [OR:Mitochondrion Chara corallina] [SR:Chara corallina] [DB:genpept-pln1] [DE:C.corallina mitochondrial cox3 gene.] [NT:subunit III] [LE:<1] [RE:>381] [DI:direct]

| ORF Name | NTID | AAID | NT Length | AA Length | score | probability |
|---|---|---|---|---|---|---|
| AI7503001001_5292175_c3_1484 | 3645 | 7417 | 1323 | 440 | 2112 | 1.2e-218 |

Description gp:[GI:g3152725] [LN:AF065394] [AC:AF065394] [PN:enolase] [GN:eno] [OR:Staphylococcus aureus] [DB:genpept-bct2] [DE:Staphylococcus aureus enolase (eno) gene, complete cds.] [NT:ENO; laminin binding protein] [LE:103] [RE:1407] [DI:direct]

| ORF Name | NTID | AAID | NT Length | AA Length | score | probability |
|---|---|---|---|---|---|---|
| AI7503001001_53552_f2_450 | 3646 | 7418 | 660 | 219 | 179 | 8.0e-14 |

Description sp:[LN:GRPB_BACFI] [AC:Q45133] [GN:GRPB] [OR:BACILLUS FIRMUS] [DE:GLUTAMATE-RICH PROTEIN GRPB] [SP:Q45133] [DB:swissprot] >gp:[GI:g1209681] [LN:BFU39410] [AC:U39410] [PN:glutamate-rich protein] [GN:grpB] [OR:Bacillus firmus] [SR:Bacillus firmus strain=OF4] [DB:genpept-bct1] [DE:Bacillus firmus OrfA, OrfB, glutamate-rich protein (grpA), OrfC,and glutamate-rich protein (grpB) genes, complete cds.] [LE:2695] [RE:3219] [DI:direct]

| ORF Name | NTID | AAID | NT Length | AA Length | score | probability |
|---|---|---|---|---|---|---|
| AI7503001001_5355325_c3_1454 | 3647 | 7419 | 888 | 295 | 526 | 1.4e-50 |

Description sp:[LN:DEGV_BACSU] [AC:P32436] [GN:DEGV] [OR:BACILLUS SUBTILIS] [DE:DEGV PROTEIN] [SP:P32436] [DB:swissprot] >pir:[LN:D30191] [AC:I40386:D30191:A70042:S28596 ] [PN:conserved hypothetical protein yviA] [GN:yviA ] [OR:Bacillus subtilis] [DB:pir2] >gp:[GI:g39848] [LN:BSCOMFG] [AC:Z18629] [PN:U3] [GN:degUorf3] [OR:Bacillus subtilis] [DB:genpept-bct1] [DE:B.subtilis comF gene.] [SP:P32436] [LE:1] [RE:846] [DI:direct] >gp:[GI:e1184454:g2636074] [LN:BSUB0019] [AC:Z99122:AL009126] [GN:yviA] [FN:unknown] [OR:Bacillus subtilis] [DB:genpept-bct1] [DE:Bacillus subtilis complete genome (section 19 of 21): from 3597091to 3809700.] [NT:alternate gene name: degV, sacU; similar to] [LE:45634] [RE:46479] [DI:complement] >gp:[GI:g1762331] [LN:BSU56901] [AC:U56901] [GN:degV] [OR:Bacillus subtilis] [DB:genpept-bct2] [DE:Bacillus subtilis putative transcriptional regulator (yvhJ),Ycr59c/YigZ homolog (yvhK), histidine kinase (degS),transcriptionalregulator of degradation enzyme (degU), (degV), (comFA), (comFB),(comFC), flagellar protein (yviB), negative regulator of flagellin(flgM), flagellar protein (yviC), flagellar-hook associated protein1 (flgK), flagellar-hook associated protein 3 (flgL), (yviE),transmembrane protein (yviF), (csrA), flagellin (hag), flagellarprotein (yviH), flagellar hook-associated protein 2 (fliD),flagellar protein (fliS), flagellar protein (fliT), sigma-54modulator homolog (yviI), and (secA) genes, complete cds.] [LE:4114] [RE:4959] [DI:direct] >gp:[GI:e1184454:g2636074] [LN:BSUB0019] [AC:Z99122:AL009126] [GN:yviA] [FN:unknown] [OR:Bacillus subtilis] [DB:genpept] [DE:Bacillus subtilis complete genome (section 19 of 21): from 3597091to 3809700.] [NT:alternate gene name: degV, sacU; similar to] [SP:P32436] [LE:45634] [RE:46479] [DI:complement]

| ORF Name | NTID | AAID | NT Length | AA Length | score | probability |
|---|---|---|---|---|---|---|
| AI7503001001_5367843_c3_1488 | 3648 | 7420 | 759 | 252 | 791 | 1.1e-78 |

Description sp:[LN:EST_BACST] [AC:Q06174] [GN:EST] [OR:BACILLUS STEAROTHERMOPHILUS] [EC:3.1.1.1] [DE:CARBOXYLESTERASE PRECURSOR,] [SP:Q06174] [DB:swissprot] >pir:[LN:JC1374] [AC:JC1374 ] [PN:carboxylesterase,] [GN:Est ] [OR:Bacillus stearothermophilus] [EC:3.1.1.1] [DB:pir2] >gp:[GI:d1002674:g216314] [LN:BACPBH7] [AC:D12681] [PN:esterase] [OR:Bacillus stearothermophilus] [SR:Bacillus stearothermophilus DNA, clone pBH7] [DB:genpept-bct1] [DE:Bacillus stearothermophilus esterase gene.] [LE:181] [RE:924] [DI:direct]

| ORF Name | NTID | AAID | NT Length | AA Length | score | probability |
|---|---|---|---|---|---|---|
| AI7503001001_57800_c3_1494 | 3649 | 7421 | 147 | 48 | | |

Description

NO-HIT

| ORF Name | NTID | AAID | NT Length | AA Length | score | probability |
|---|---|---|---|---|---|---|
| AI7503001001_5869433_f2_542 | 3650 | 7422 | 129 | 42 | | |

Description

NO-HIT

| ORF_Name | NTID | AAID | NT Length | AA Length | score | probability |
|---|---|---|---|---|---|---|
| AI7503001001_5869702_f2_595 | 3651 | 7423 | 309 | 102 | 87 | 0.015 |

Description
sp:[LN:YMW6_YEAST] [AC:Q04264:Q04780] [GN:YMR076C:YM9582.01C:YM9916.15C]
[OR:SACCHAROMYCES CEREVISIAE] [SR:,BAKER'S YEAST] [DE:HYPOTHETICAL 147.0 KD PROTEIN IN ABF2-CHL12 INTERGENIC REGION] [SP:Q04264:Q04780] [DB:swissprot] >pir:[LN:S54451]
[AC:S54451:S52836 ] [PN:hypothetical protein YMR076c:hypothetical protein YM9582.01c:hypothetical protein YM9916.15c] [GN:PDS5 ] [OR:Saccharomyces cerevisiae]
[DB:pir2] [MP:13R ]

| ORF_Name | NTID | AAID | NT Length | AA Length | score | probability |
|---|---|---|---|---|---|---|
| AI7503001001_5938762_c1_987 | 3652 | 7424 | 1704 | 567 | 566 | 7.8e-55 |

Description
sp:[LN:CYDD_HAEIN] [AC:P45082] [GN:CYDD:HI1157] [OR:HAEMOPHILUS INFLUENZAE]
[DE:TRANSPORT ATP-BINDING PROTEIN CYDD] [SP:P45082] [DB:swissprot] >pir:[LN:F64186]
[AC:F64186 ] [PN:ABC-type transport protein cydD] [GN:cydD ] [CL:unassigned ATP-binding cassette proteins: ATP-binding cassette homology] [OR:Haemophilus influenzae] [DB:pir2]
>gp:[GI:g1574714] [LN:U32795] [AC:U32795:L42023] [PN:ATP-binding protein protein
(cydD)] [GN:HI1157] [OR:Haemophilus influenzae Rd] [DB:genpept-bct2] [DE:Haemophilus influenzae Rd section 110 of 163 of the completegenome.] [NT:similar to GB:L21749
SP:P29018 GB:L25859 PID:146416] [LE:6353] [RE:8113] [DI:complement]

| ORF_Name | NTID | AAID | NT Length | AA Length | score | probability |
|---|---|---|---|---|---|---|
| AI7503001001_6023915_c2_1313 | 3653 | 7425 | 969 | 322 | 1144 | 4.4e-116 |

Description
pir:[LN:D70023] [AC:D70023 ] [PN:lipoic acid synthetase, yutB] [GN:yutB ] [CL:lipoic acid synthase] [OR:Bacillus subtilis] [EC:2.8.1.-] [DB:pir2] >gp:[GI:e1184312:g2635730]
[LN:BSUB0017] [AC:Z99120:AL009126] [GN:yutB] [FN:unknown] [OR:Bacillus subtilis]
[DB:genpept-bct1] [DE:Bacillus subtilis complete genome (section 17 of 21): from
3197001to 3414420.] [NT:similar to lipoic acid synthetase] [LE:122382] [RE:123188]
[DI:complement]

| ORF_Name | NTID | AAID | NT Length | AA Length | score | probability |
|---|---|---|---|---|---|---|
| AI7503001001_6037756_f3_682 | 3654 | 7426 | 150 | 49 | | |

Description
NO-HIT

| ORF_Name | NTID | AAID | NT Length | AA Length | score | probability |
|---|---|---|---|---|---|---|
| AI7503001001_6050010_f1_177 | 3655 | 7427 | 132 | 43 | | |

Description
NO-HIT

| ORF_Name | NTID | AAID | NT Length | AA Length | score | probability |
|---|---|---|---|---|---|---|
| AI7503001001_6051500_c1_972 | 3656 | 7428 | 189 | 62 | | |

Description
NO-HIT

| ORF Name | NTID | AAID | NT Length | AA Length | score | probability |
|---|---|---|---|---|---|---|
| AI7503001001_6051537_c1_1063 | 3657 | 7429 | 276 | 91 | 112 | 1.0e-06 |

Description
sp:[LN:CSBA_BACSU] [AC:P37953] [GN:CSBA] [OR:BACILLUS SUBTILIS] [DE:CSBA PROTEIN]
[SP:P37953] [DB:swissprot] >gp:[GI:g142780] [LN:BACCSBA] [AC:M80473] [GN:csbA]
[OR:Bacillus subtilis] [SR:Bacillus subtilis (strain 168, sub_species Marburg) DNA]
[DB:genpept-bct1] [DE:Bacillus subtilis csbA and uvr/dinA genes, complete cds.]
[NT:putative membrane protein; putative] [LE:380] [RE:610] [DI:direct] >gp:[GI:g142842]
[LN:BACDINA76] [AC:M64048] [PN:DNase inhibitor] [GN:dinA] [OR:Bacillus subtilis]
[SR:Bacillus subtilis DNA] [DB:genpept-bct1] [DE:Bacillus subtilis DNase inhibitor
(dinA76) gene, complete cds andpromoter region.] [LE:64] [RE:294] [DI:direct]
>gp:[GI:e1184424:g2636044] [LN:BSUB0019] [AC:Z99122:AL009126] [PN:putative membrane
protein] [GN:csbA] [FN:unknown] [OR:Bacillus subtilis] [DB:genpept-bct1] [DE:Bacillus
subtilis complete genome (section 19 of 21): from 3597091to 3809700.] [SP:P37953]
[LE:17086] [RE:17316] [DI:complement] >gp:[GI:g2618840] [LN:AF017113] [AC:AF017113]
[PN:CsbA] [GN:csbA] [OR:Bacillus subtilis] [DB:genpept-bct2] [DE:Bacillus subtilis
300-304 degree genomic sequence.] [LE:12977] [RE:13207] [DI:direct]
>gp:[GI:e1184424:g2636044] [LN:BSUB0019] [AC:Z99122:AL009126] [PN:putative membrane
protein] [GN:csbA] [FN:unknown] [OR:Bacillus subtilis] [DB:genpept] [DE:Bacillus
subtilis complete genome (section 19 of 21): from 3597091to 3809700.] [SP:P37953]
[LE:17086] [RE:17316] [DI:complement]

| ORF Name | NTID | AAID | NT Length | AA Length | score | probability |
|---|---|---|---|---|---|---|
| AI7503001001_6053176_f1_195 | 3658 | 7430 | 519 | 172 | | |

Description
NO-HIT

| ORF Name | NTID | AAID | NT Length | AA Length | score | probability |
|---|---|---|---|---|---|---|
| AI7503001001_6056628_c3_1339 | 3659 | 7431 | 150 | 49 | | |

Description
NO-HIT

| ORF Name | NTID | AAID | NT Length | AA Length | score | probability |
|---|---|---|---|---|---|---|
| AI7503001001_6057338_c3_1518 | 3660 | 7432 | 840 | 279 | 622 | 9.1e-61 |

Description
pir:[LN:H70015] [AC:H70015 ] [PN:hypothetical protein yunE] [GN:yunE ] [OR:Bacillus
subtilis] [DB:pir2] >gp:[GI:e1184317:g2635735] [LN:BSUB0017] [AC:Z99120:AL009126]
[GN:yunE] [FN:unknown] [OR:Bacillus subtilis] [DB:genpept-bct1] [DE:Bacillus subtilis
complete genome (section 17 of 21): from 3197001to 3414420.] [LE:127136] [RE:127957]
[DI:complement]

| ORF Name | NTID | AAID | NT Length | AA Length | score | probability |
|---|---|---|---|---|---|---|
| AI7503001001_6094177_c2_1235 | 3661 | 7433 | 123 | 40 | | |

Description
NO-HIT

| ORF Name | NTID | AAID | NT Length | AA Length | score | probability |
|---|---|---|---|---|---|---|
| AI7503001001_6101581_f1_74 | 3662 | 7434 | 180 | 59 | | |

Description
NO-HIT

| ORF Name | NTID | AAID | NT Length | AA Length | score | probability |
|---|---|---|---|---|---|---|
| AI7503001001_6257763_c3_1479 | 3663 | 7435 | 660 | 219 | 189 | 1.7e-13 |

Description gp:[GI:g2246532] [LN:U93872] [AC:U93872] [OR:Kaposi's sarcoma-associated herpesvirus] [SR:Kaposi's sarcoma-associated herpesvirus - Human herpesvirus 8] [DB:genpept-vrl] [DE:Kaposi's sarcoma-associated herpesvirus glycoprotein M, DNAreplication protein, glycoprotein, DNA replication protein, FLICEinhibitory protein and v-cyclin genes, complete cds, and tegumentprotein gene, partial cds.] [NT:ORF 73, contains large complex repeat CR 73] [LE:124324] [RE:127593] [DI:complement]

| ORF Name | NTID | AAID | NT Length | AA Length | score | probability |
|---|---|---|---|---|---|---|
| AI7503001001_626592_c1_935 | 3664 | 7436 | 852 | 283 | 233 | 1.5e-19 |

Description pir:[LN:A69463] [AC:A69463 ] [PN:2-hydroxy-6-oxo-6-phenylhexa-2,4-dienoic acid hydrolase (pcbD) homolog] [OR:Archaeoglobus fulgidus] [DB:pir2] >gp:[GI:g2648849] [LN:AE000986] [AC:AE000986:AE000782] [PN:2-hydroxy-6-oxo-6-phenylhexa-2,4-dienoic acid] [GN:AF1706] [OR:Archaeoglobus fulgidus] [DB:genpept-bct2] [DE:Archaeoglobus fulgidus section 121 of 172 of the complete genome.] [NT:similar to GP:1395174 percent identity: 29.41;] [LE:11775] [RE:12491] [DI:complement]

| ORF Name | NTID | AAID | NT Length | AA Length | score | probability |
|---|---|---|---|---|---|---|
| AI7503001001_6423376_f3_670 | 3665 | 7437 | 261 | 86 | | |

Description

NO-HIT

| ORF Name | NTID | AAID | NT Length | AA Length | score | probability |
|---|---|---|---|---|---|---|
| AI7503001001_6437525_f3_862 | 3666 | 7438 | 294 | 97 | | |

Description

NO-HIT

| ORF Name | NTID | AAID | NT Length | AA Length | score | probability |
|---|---|---|---|---|---|---|
| AI7503001001_6440640_c3_1379 | 3667 | 7439 | 1278 | 425 | 139 | 6.0e-06 |

Description pir:[LN:D71621] [AC:D71621 ] [PN:hypothetical protein PFB0185w] [GN:PFB0185w ] [OR:Plasmodium falciparum] [DB:pir2] >gp:[GI:g3845117] [LN:AE001378] [AC:AE001378:AE001362] [PN:hypothetical protein] [GN:PFB0185w] [OR:Plasmodium falciparum] [SR:malaria parasite P. falciparum] [DB:genpept-inv2] [DE:Plasmodium falciparum chromosome 2, section 15 of 73 of thecomplete sequence.] [NT:predicted by GlimmerM] [LE:6504:8652] [RE:8473:9075] [DI:directJoin]

| ORF Name | NTID | AAID | NT Length | AA Length | score | probability |
|---|---|---|---|---|---|---|
| AI7503001001_6444037_c2_1180 | 3668 | 7440 | 144 | 47 | | |

Description

NO-HIT

| ORF Name | NTID | AAID | NT Length | AA Length | score | probability |
|---|---|---|---|---|---|---|
| AI7503001001_6642827_c3_1342 | 3669 | 7441 | 2403 | 800 | 1527 | 1.1e-156 |

Description pir:[LN:A70010] [AC:A70010 ] [PN:NADH dehydrogenase homolog yufT] [GN:yufT ]
[OR:Bacillus subtilis] [DB:pir2] >gp:[GI:e1184238:g2635656] [LN:BSUB0017]
[AC:Z99120:AL009126] [GN:yufT] [FN:unknown] [OR:Bacillus subtilis] [DB:genpept-bct1]
[DE:Bacillus subtilis complete genome (section 17 of 21): from 3197001to 3414420.]
[NT:similar to NADH dehydrogenase] [LE:48758] [RE:51082] [DI:direct]
>gp:[GI:e311455:g1934817] [LN:BSZ93937] [AC:Z93937] [PN:unknown] [GN:yufT] [OR:Bacillus
subtilis] [DB:genpept-bct1] [DE:B.subtilis genomic DNA fragment from yufK to yufV.]
[NT:potential Na/H antiporter/phaA homologue/NADH] [LE:10546] [RE:12870] [DI:direct]

| ORF Name | NTID | AAID | NT Length | AA Length | score | probability |
|---|---|---|---|---|---|---|
| AI7503001001_6650312_f2_600 | 3670 | 7442 | 141 | 46 | | |

Description

NO-HIT

| ORF Name | NTID | AAID | NT Length | AA Length | score | probability |
|---|---|---|---|---|---|---|
| AI7503001001_6675016_c1_1077 | 3671 | 7443 | 132 | 43 | | |

Description

NO-HIT

| ORF Name | NTID | AAID | NT Length | AA Length | score | probability |
|---|---|---|---|---|---|---|
| AI7503001001_6680312_f2_518 | 3672 | 7444 | 714 | 237 | 211 | 4.7e-17 |

Description gp:[GI:g3329623] [LN:CELF36H12] [AC:AF078790] [GN:F36H12.3] [OR:Caenorhabditis elegans]
[DB:genpept-inv2] [DE:Caenorhabditis elegans cosmid F36H12.] [NT:coded for by C.
elegans cDNA CEMSF30F] [LE:21606:21872:22500:22677] [RE:21701:22454:22629:22875]
[DI:directJoin]

| ORF Name | NTID | AAID | NT Length | AA Length | score | probability |
|---|---|---|---|---|---|---|
| AI7503001001_6681577_c1_1110 | 3673 | 7445 | 432 | 143 | 277 | 3.3e-24 |

Description pir:[LN:G70020] [AC:G70020 ] [PN:hypothetical protein yusF] [GN:yusF ] [OR:Bacillus
subtilis] [DB:pir2] >gp:[GI:e1184356:g2635774] [LN:BSUB0017] [AC:Z99120:AL009126]
[GN:yusF] [FN:unknown] [OR:Bacillus subtilis] [DB:genpept-bct1] [DE:Bacillus subtilis
complete genome (section 17 of 21): from 3197001to 3414420.] [LE:167450] [RE:167890]
[DI:complement]

| ORF Name | NTID | AAID | NT Length | AA Length | score | probability |
|---|---|---|---|---|---|---|
| AI7503001001_6695968_c2_1320 | 3674 | 7446 | 1470 | 489 | 2005 | 2.5e-207 |

Description gp:[GI:g4530241] [LN:AF101234] [AC:AF101234] [PN:D-alanine-D-alanyl carrier protein
ligase DltA] [GN:dltA] [OR:Staphylococcus aureus] [DB:genpept-bct2] [DE:Staphylococcus
aureus dltABCD operon, complete sequence; andunknown gene.] [LE:1590] [RE:3047]
[DI:direct]

| ORF_Name | NTID | AAID | NT Length | AA Length | score | probability |
|---|---|---|---|---|---|---|
| AI7503001001_6822175_c2_1222 | 3675 | 7447 | 1914 | 637 | 1229 | 4.3e-125 |

Description pir:[LN:F69901] [AC:F69901 ] [PN:DNA helicase recQ:ATP-dependent DNA helicase homolog yocI] [GN:yocI ] [CL:recQ protein:DEAD/H box helicase homology:recQ helicase homology] [OR:Bacillus subtilis] [DB:pir2] >gp:[GI:g2619051] [LN:AF027868] [AC:AF027868] [PN:RecQ homolog] [GN:yocI] [OR:Bacillus subtilis] [DB:genpept-bct1] [DE:Bacillus subtilis chromosome region between terC and odhAB.] [NT:similar to E.coli RecQ protein (607 aa)] [LE:74004] [RE:75779] [DI:complement] >gp:[GI:e1185394:g2634315] [LN:BSUB0011] [AC:Z99114:AL009126] [GN:yocI] [FN:unknown] [OR:Bacillus subtilis] [DB:genpept-bct1] [DE:Bacillus subtilis complete genome (section 11 of 21): from 2000171to 2207900.] [NT:similar to ATP-dependent DNA helicase] [LE:93095] [RE:94870] [DI:complement]

| ORF_Name | NTID | AAID | NT Length | AA Length | score | probability |
|---|---|---|---|---|---|---|
| AI7503001001_6823453_c3_1346 | 3676 | 7448 | 483 | 160 | 270 | 1.8e-23 |

Description gp:[GI:d1036085:g4001729] [LN:AB015981] [AC:AB015981] [PN:MnhE] [GN:mnhE] [OR:Staphylococcus aureus] [SR:Staphylococcus aureus (strain:209P) DNA] [DB:genpept-bct1] [DE:Staphylococcus aureus genes for OrfA, MnhA, MnhB, MnhC, MnhD, MnhE,MnhF and MnhG, complete cds.] [LE:5474] [RE:5953] [DI:direct]

| ORF_Name | NTID | AAID | NT Length | AA Length | score | probability |
|---|---|---|---|---|---|---|
| AI7503001001_6829638_c3_1402 | 3677 | 7449 | 186 | 61 | | |

Description

NO-HIT

| ORF_Name | NTID | AAID | NT Length | AA Length | score | probability |
|---|---|---|---|---|---|---|
| AI7503001001_6833313_c3_1371 | 3678 | 7450 | 1920 | 639 | 550 | 3.9e-53 |

Description pir:[LN:B70001] [AC:B70001 ] [PN:ABC transporter (permease) homolog ytsD] [GN:ytsD ] [OR:Bacillus subtilis] [DB:pir2] >gp:[GI:e1185910:g2635521] [LN:BSUB0016] [AC:Z99119:AL009126] [GN:ytsD] [FN:unknown] [OR:Bacillus subtilis] [DB:genpept-bct1] [DE:Bacillus subtilis complete genome (section 16 of 21): from 2997771to 3213410.] [NT:similar to ABC transporter (permease)] [LE:110708] [RE:112648] [DI:complement] >gp:[GI:g2293178] [LN:AF008220] [AC:AF008220] [PN:YtsD] [GN:ytsD] [OR:Bacillus subtilis] [DB:genpept-bct2] [DE:Bacillus subtilis rrnB-dnaB genomic region.] [NT:similarity to NADH dehydrogenase] [LE:67779] [RE:69719] [DI:direct]

| ORF_Name | NTID | AAID | NT Length | AA Length | score | probability |
|---|---|---|---|---|---|---|
| AI7503001001_6836088_c1_1118 | 3679 | 7451 | 1320 | 439 | 1260 | 2.2e-128 |

Description pir:[LN:G70019] [AC:G70019 ] [PN:conserved hypothetical protein yurX] [GN:yurX ] [OR:Bacillus subtilis] [DB:pir2] >gp:[GI:e1184348:g2635766] [LN:BSUB0017] [AC:Z99120:AL009126] [GN:yurX] [FN:unknown] [OR:Bacillus subtilis] [DB:genpept-bct1] [DE:Bacillus subtilis complete genome (section 17 of 21): from 3197001to 3414420.] [NT:similar to hypothetical proteins] [LE:160723] [RE:162036] [DI:complement]

| ORF_Name | NTID | AAID | NT Length | AA Length | score | probability |
|---|---|---|---|---|---|---|
| AI7503001001_6929512_c1_1119 | 3680 | 7452 | 1416 | 471 | 2098 | 3.6e-217 |

Description
pir:[LN:D70019] [AC:D70019 ] [PN:conserved hypothetical protein yurU] [GN:yurU ] [CL:Methanobacterium thermoautotrophicum ABC transporter chain Ycf24] [OR:Bacillus subtilis] [DB:pir2] >gp:[GI:e1184345:g2635763] [LN:BSUB0017] [AC:Z99120:AL009126] [GN:yurU] [FN:unknown] [OR:Bacillus subtilis] [DB:genpept-bct1] [DE:Bacillus subtilis complete genome (section 17 of 21): from 3197001to 3414420.] [NT:similar to hypothetical proteins] [LE:157652] [RE:159049] [DI:complement]

| ORF_Name | NTID | AAID | NT Length | AA Length | score | probability |
|---|---|---|---|---|---|---|
| AI7503001001_7042878_f1_40 | 3681 | 7453 | 177 | 58 | | |

Description
NO-HIT

| ORF_Name | NTID | AAID | NT Length | AA Length | score | probability |
|---|---|---|---|---|---|---|
| AI7503001001_7239188_f2_519 | 3682 | 7454 | 675 | 224 | 491 | 6.9e-47 |

Description
pir:[LN:D70033] [AC:D70033 ] [PN:conserved hypothetical protein yvdD] [GN:yvdD ] [CL:yeast conserved hypothetical protein YJL055w] [OR:Bacillus subtilis] [DB:pir2] >gp:[GI:e1186152:g2635977] [LN:BSUB0018] [AC:Z99121:AL009126] [GN:yvdD] [FN:unknown] [OR:Bacillus subtilis] [DB:genpept-bct1] [DE:Bacillus subtilis complete genome (section 18 of 21): from 3399551to 3609060.] [NT:similar to hypothetical proteins] [LE:158450] [RE:159025] [DI:complement] >gp:[GI:e313036:g1945663] [LN:BSZ94043] [AC:Z94043] [PN:hypothetical protein] [GN:yvdD] [OR:Bacillus subtilis] [DB:genpept-bct1] [DE:B.subtilis genomic DNA fragment (88 kb).] [NT:similar to YJF5_YEAST hypothetical 26.9 kd protein] [LE:22646] [RE:23221] [DI:direct]

| ORF_Name | NTID | AAID | NT Length | AA Length | score | probability |
|---|---|---|---|---|---|---|
| AI7503001001_7800_c1_1093 | 3683 | 7455 | 198 | 65 | 54 | 0.033 |

Description
gp:[GI:g3789915] [LN:AF083442] [AC:AF083442] [PN:G protein-coupled receptor G2A] [OR:Mus musculus] [SR:house mouse] [DB:genpept-rod] [DE:Mus musculus G protein-coupled receptor G2A mRNA, complete cds.] [LE:147] [RE:1295] [DI:direct]

| ORF_Name | NTID | AAID | NT Length | AA Length | score | probability |
|---|---|---|---|---|---|---|
| AI7503001001_781415_c3_1393 | 3684 | 7456 | 165 | 54 | | |

Description
NO-HIT

| ORF_Name | NTID | AAID | NT Length | AA Length | score | probability |
|---|---|---|---|---|---|---|
| AI7503001001_783375_c2_1236 | 3685 | 7457 | 180 | 59 | | |

Description
NO-HIT

| ORF Name | NTID | AAID | NT Length | AA Length | score | probability |
|---|---|---|---|---|---|---|
| AI7503001001_788950_c3_1347 | 3686 | 7458 | 531 | 176 | 219 | 4.6e-18 |

Description
pir:[LN:E70008] [AC:E70008 ] [PN:conserved hypothetical protein yufB] [GN:yufB ]
[OR:Bacillus subtilis] [DB:pir2] >gp:[GI:e1184243:g2635661] [LN:BSUB0017]
[AC:Z99120:AL009126] [GN:yufB] [FN:unknown] [OR:Bacillus subtilis] [DB:genpept-bct1]
[DE:Bacillus subtilis complete genome (section 17 of 21): from 3197001to 3414420.]
[NT:similar to hypothetical proteins] [LE:54068] [RE:54442] [DI:direct]
>gp:[GI:e311512:g1934774] [LN:BSZ93932] [AC:Z93932] [PN:unknown] [GN:yufB] [OR:Bacillus
subtilis] [DB:genpept-bct1] [DE:B.subtilis genomic DNA fragment from yufA to yufE.]
[LE:7086] [RE:7460] [DI:complement]

| ORF Name | NTID | AAID | NT Length | AA Length | score | probability |
|---|---|---|---|---|---|---|
| AI7503001001_821963_c2_1165 | 3687 | 7459 | 546 | 181 | 103 | 0.0018 |

Description
gp:[GI:g4731376] [LN:AF135127] [AC:AF135127:AF047896] [PN:isoflavone reductase homolog
Bet v 5] [GN:BETV5] [OR:Betula pendula] [SR:European white birch] [DB:genpept-pln2]
[DE:Betula pendula isoflavone reductase homolog Bet v 5 (BETV5) mRNA,partial cds.]
[NT:allergen; IgE binding protein] [LE:1] [RE:>900] [DI:direct]

| ORF Name | NTID | AAID | NT Length | AA Length | score | probability |
|---|---|---|---|---|---|---|
| AI7503001001_822777_c3_1397 | 3688 | 7460 | 159 | 52 | | |

Description
NO-HIT

| ORF Name | NTID | AAID | NT Length | AA Length | score | probability |
|---|---|---|---|---|---|---|
| AI7503001001_870300_c1_958 | 3689 | 7461 | 153 | 50 | | |

Description
NO-HIT

| ORF Name | NTID | AAID | NT Length | AA Length | score | probability |
|---|---|---|---|---|---|---|
| AI7503001001_899177_c3_1335 | 3690 | 7462 | 930 | 309 | 596 | 5.2e-58 |

Description
pir:[LN:G70046] [AC:G70046 ] [PN:iron-binding protein homolog yvrC] [GN:yvrC ]
[OR:Bacillus subtilis] [DB:pir2] >gp:[GI:e1249807:g2832811] [LN:BS43KBDNA]
[AC:AJ223978] [PN:putative metal binding protein, YvrC] [GN:yvrC] [OR:Bacillus
subtilis] [DB:genpept-bct1] [DE:Bacillus subtilis 42.7kB DNA fragment from yvsA to
yvqA.] [LE:23792] [RE:24736] [DI:direct] >gp:[GI:e1184397:g2635815] [LN:BSUB0017]
[AC:Z99120:AL009126] [GN:yvrC] [FN:unknown] [OR:Bacillus subtilis] [DB:genpept-bct1]
[DE:Bacillus subtilis complete genome (section 17 of 21): from 3197001to 3414420.]
[NT:similar to iron-binding protein] [LE:205551] [RE:206495] [DI:complement]
>gp:[GI:e1186006:g2635831] [LN:BSUB0018] [AC:Z99121:AL009126] [GN:yvrC] [FN:unknown]
[OR:Bacillus subtilis] [DB:genpept-bct1] [DE:Bacillus subtilis complete genome (section
18 of 21): from 3399551to 3609060.] [NT:similar to iron-binding protein] [LE:3001]
[RE:3945] [DI:complement]

| ORF Name | NTID | AAID | NT Length | AA Length | score | probability |
|---|---|---|---|---|---|---|
| AI7503001001_900256_c1_1017 | 3691 | 7463 | 210 | 69 | | |

Description
NO-HIT

| ORF_Name | NTID | AAID | NT Length | AA Length | score | probability |
|---|---|---|---|---|---|---|
| AI7503001001_959437_c1_965 | 3692 | 7464 | 159 | 52 | | |

Description
NO-HIT

| ORF_Name | NTID | AAID | NT Length | AA Length | score | probability |
|---|---|---|---|---|---|---|
| AI7503001001_9642_f1_227 | 3693 | 7465 | 876 | 291 | 769 | 2.4e-76 |

Description
pir:[LN:E70006] [AC:E70006 ] [PN:probable bacitracin resistance protein (undecapreno) yubB] [GN:yubB ] [CL:Escherichia coli bacitracin resistance protein bacA] [OR:Bacillus subtilis] [DB:pir2] >gp:[GI:e1185988:g2635599] [LN:BSUB0016] [AC:Z99119:AL009126] [GN:yubB] [FN:unknown] [OR:Bacillus subtilis] [DB:genpept-bct1] [DE:Bacillus subtilis complete genome (section 16 of 21): from 2997771to 3213410.] [NT:similar to bacitracin resistance protein] [LE:195935] [RE:196765] [DI:complement]

| ORF_Name | NTID | AAID | NT Length | AA Length | score | probability |
|---|---|---|---|---|---|---|
| AI7503001001_969075_c1_1109 | 3694 | 7466 | 354 | 117 | 359 | 6.7e-33 |

Description
pir:[LN:B70021] [AC:B70021 ] [PN:arsenate reductase homolog yusI] [GN:yusI ] [CL:hypothetical protein yjbD] [OR:Bacillus subtilis] [DB:pir2] >gp:[GI:e1184359:g2635777] [LN:BSUB0017] [AC:Z99120:AL009126] [GN:yusI] [FN:unknown] [OR:Bacillus subtilis] [DB:genpept-bct1] [DE:Bacillus subtilis complete genome (section 17 of 21): from 3197001to 3414420.] [NT:similar to arsenate reductase] [LE:168632] [RE:168988] [DI:complement]

| ORF_Name | NTID | AAID | NT Length | AA Length | score | probability |
|---|---|---|---|---|---|---|
| AI7503001001_969555_f1_218 | 3695 | 7467 | 168 | 55 | | |

Description
NO-HIT

| ORF_Name | NTID | AAID | NT Length | AA Length | score | probability |
|---|---|---|---|---|---|---|
| AI7503001001_969812_f1_63 | 3696 | 7468 | 123 | 40 | | |

Description
NO-HIT

| ORF_Name | NTID | AAID | NT Length | AA Length | score | probability |
|---|---|---|---|---|---|---|
| AI7503001001_970327_c2_1301 | 3697 | 7469 | 297 | 98 | 167 | 1.5e-12 |

Description
pir:[LN:F70020] [AC:F70020 ] [PN:thioredoxin homolog yusE] [GN:yusE ] [OR:Bacillus subtilis] [DB:pir2] >gp:[GI:e1184355:g2635773] [LN:BSUB0017] [AC:Z99120:AL009126] [GN:yusE] [FN:unknown] [OR:Bacillus subtilis] [DB:genpept-bct1] [DE:Bacillus subtilis complete genome (section 17 of 21): from 3197001to 3414420.] [NT:similar to thioredoxin] [LE:167128] [RE:167448] [DI:complement]

| ORF_Name | NTID | AAID | NT Length | AA Length | score | probability |
|---|---|---|---|---|---|---|
| AI7503001001_973400_f3_690 | 3698 | 7470 | 180 | 59 | 43 | 0.013 |

Description
gp:[GI:e1363550:g4127809] [LN:EFAJ3161] [AC:AJ223161] [PN:hypothetical protein] [GN:orf6] [OR:Enterococcus faecalis] [DB:genpept-bct1] [DE:Enterococcus faecalis plasmid pS86, rep86 and mob86 genes.] [LE:4421] [RE:4732] [DI:direct]

| ORF Name | NTID | AAID | NT Length | AA Length | score | probability |
|---|---|---|---|---|---|---|
| AI7503001001_978426_c1_1043 | 3699 | 7471 | 978 | 325 | 1338 | 1.2e-136 |

Description
gp:[GI:e1330452:g3724155] [LN:SAA005352] [AC:AJ005352] [PN:membrane protein] [GN:sstA]
[FN:iron transport protein] [OR:Staphylococcus aureus] [DB:genpept-bct1]
[DE:Staphylococcus aureus, Sst putative iron transport operon.] [LE:273] [RE:1245]
[DI:direct]

| ORF Name | NTID | AAID | NT Length | AA Length | score | probability |
|---|---|---|---|---|---|---|
| AI7503001001_9882950_c2_1204 | 3700 | 7472 | 1350 | 449 | 1090 | 2.3e-110 |

Description
sp:[LN:YHDP_BACSU] [AC:O07585] [GN:YHDP] [OR:BACILLUS SUBTILIS] [DE:HYPOTHETICAL 49.9
KD PROTEIN IN CITA-SSPB INTERGENIC REGION] [SP:O07585] [DB:swissprot] >pir:[LN:F69826]
[AC:F69826 ] [PN:hemolysin homolog yhdP] [GN:yhdP ] [CL:hypothetical protein HI0107]
[OR:Bacillus subtilis] [DB:pir2] >gp:[GI:e1182956:g2633290] [LN:BSUB0006]
[AC:Z99109:AL009126] [GN:yhdP] [FN:unknown] [OR:Bacillus subtilis] [DB:genpept-bct1]
[DE:Bacillus subtilis complete genome (section 6 of 21): from 999501 to1209940.]
[NT:similar to hemolysin] [SP:O07585] [LE:32043] [RE:33377] [DI:complement]
>gp:[GI:e1191881:g2226211] [LN:BSY14082] [AC:Y14082] [PN:hypothetical protein]
[GN:yhdP] [OR:Bacillus subtilis] [DB:genpept-bct1] [DE:Bacillus subtilis chromosomal
DNA, region 72 to 75 degrees: spoVRto sspB.] [NT:Similarity to yhdT, this submission,
and to] [SP:O07585] [LE:18691] [RE:20025] [DI:complement]

| ORF Name | NTID | AAID | NT Length | AA Length | score | probability |
|---|---|---|---|---|---|---|
| AI7503001001_9884625_f2_464 | 3701 | 7473 | 1509 | 502 | 1226 | 9.0e-125 |

Description
sp:[LN:YCLF_BACSU] [AC:P94408] [GN:YCLF] [OR:BACILLUS SUBTILIS] [DE:HYPOTHETICAL 53.3
KD PROTEIN IN SFP-GERKA INTERGENIC REGION] [SP:P94408] [DB:swissprot] >pir:[LN:C69762]
[AC:C69762 ] [PN:di-tripeptide ABC transporter (membrane pr) homolog yclF] [GN:yclF ]
[CL:peptide transporter protein] [OR:Bacillus subtilis] [DB:pir2]
>gp:[GI:e1182334:g2632668] [LN:BSUB0003] [AC:Z99106:AL009126] [GN:yclF] [FN:unknown]
[OR:Bacillus subtilis] [DB:genpept-bct1] [DE:Bacillus subtilis complete genome (section
3 of 21): from 402751 to611850.] [NT:similar to di-tripeptide ABC transporter
(membrane)] [SP:P94408] [LE:13065] [RE:14543] [DI:complement] >gp:[GI:d1009635:g1805438]
[LN:D50453] [AC:D50453] [PN:homologue of Di-tripeptide transporter Dtp of L.] [GN:yclF]
[OR:Bacillus subtilis] [SR:Bacillus subtilis (strain:168 trpC2) DNA] [DB:genpept-bct1]
[DE:Bacillus subtilis DNA for 25-36 degree region containing theamyE-srfA region,
complete cds.] [LE:95468] [RE:96946] [DI:complement]

| ORF Name | NTID | AAID | NT Length | AA Length | score | probability |
|---|---|---|---|---|---|---|
| AI7503001001_989010_c1_1128 | 3702 | 7474 | 408 | 135 | 371 | 3.6e-34 |

Description
pir:[LN:G70024] [AC:G70024 ] [PN:conserved hypothetical protein yutM] [GN:yutM ]
[CL:conserved hypothetical protein HI0376] [OR:Bacillus subtilis] [DB:pir2]
>gp:[GI:e1184295:g2635713] [LN:BSUB0017] [AC:Z99120:AL009126] [GN:yutM] [FN:unknown]
[OR:Bacillus subtilis] [DB:genpept-bct1] [DE:Bacillus subtilis complete genome (section
17 of 21): from 3197001to 3414420.] [NT:similar to hypothetical proteins] [LE:107656]
[RE:108018] [DI:complement]

| ORF Name | NTID | AAID | NT Length | AA Length | score | probability |
|---|---|---|---|---|---|---|
| AI7503012391_11291_c2_183 | 3703 | 7475 | 153 | 50 | | |

Description
NO-HIT

| ORF Name | NTID | AAID | NT Length | AA Length | score | probability |
|---|---|---|---|---|---|---|
| AI7503012391_1369012_c2_207 | 3704 | 7476 | 126 | 41 | | |

Description
NO-HIT

| ORF Name | NTID | AAID | NT Length | AA Length | score | probability |
|---|---|---|---|---|---|---|
| AI7503012391_13790943_c1_161 | 3705 | 7477 | 1644 | 547 | 2797 | 3.0e-291 |

Description
pir:[LN:C56976] [AC:C56976 ] [PN:transfer complex protein TrsK] [GN:trsK ]
[OR:Staphylococcus aureus] [DB:pir2] >gp:[GI:g310618] [LN:STATRSC] [AC:L11998]
[GN:trsK] [OR:Staphylococcus aureus] [SR:Staphylococcus aureus (individual_isolate
pG01) DNA] [DB:genpept-bct1] [DE:Staphylococcus aureus conjugative transfer gene
complex (trs).] [NT:putative] [LE:10475] [RE:12115] [DI:direct] >gp:[GI:g3676445]
[LN:AF051917] [AC:AF051917:L19570] [PN:putative membrane protein TraK] [GN:traK]
[OR:Staphylococcus aureus] [DB:genpept-bct2] [DE:Staphylococcus aureus plasmid pSK41,
complete sequence.] [NT:similar to transfer-associated proteins of] [LE:34078]
[RE:35718] [DI:direct]

| ORF Name | NTID | AAID | NT Length | AA Length | score | probability |
|---|---|---|---|---|---|---|
| AI7503012391_14507827_c3_220 | 3706 | 7478 | 168 | 55 | 273 | 8.7e-24 |

Description
pir:[LN:F56976] [AC:F56976 ] [PN:transfer complex protein TrsO'] [OR:Staphylococcus
aureus] [DB:pir2] >gp:[GI:g3676448] [LN:AF051917] [AC:AF051917:L19570] [PN:unknown]
[OR:Staphylococcus aureus] [DB:genpept-bct2] [DE:Staphylococcus aureus plasmid pSK41,
complete sequence.] [NT:Orf55; possibly truncated by IS257 transposon] [LE:37179]
[RE:37346] [DI:direct]

| ORF Name | NTID | AAID | NT Length | AA Length | score | probability |
|---|---|---|---|---|---|---|
| AI7503012391_14844187_c2_195 | 3707 | 7479 | 3081 | 1026 | 5411 | 0.0 |

Description
sp:[LN:SYIP_STAAU] [AC:P41368] [GN:MUPR] [OR:STAPHYLOCOCCUS AUREUS] [EC:6.1.1.5]
[DE:(ISOLEUCINE--TRNA LIGASE) (ILERS) (MUPIROCIN RESISTANCE PROTEIN)] [SP:P41368]
[DB:swissprot] >gp:[GI:g581558] [LN:SADNAMUPR] [AC:X75439] [PN:isoleucyl tRNA
synthetase] [GN:ileS] [OR:Staphylococcus aureus] [DB:genpept-bct1] [DE:S.aureus plasmid
encoded DNA, mup R gene.] [SP:P41368] [LE:477] [RE:3551] [DI:direct]

| ORF Name | NTID | AAID | NT Length | AA Length | score | probability |
|---|---|---|---|---|---|---|
| AI7503012391_15631901_c3_234 | 3708 | 7480 | 645 | 214 | 943 | 8.8e-95 |

Description
gp:[GI:g3676416] [LN:AF051917] [AC:AF051917:L19570] [PN:putative resolvase Res]
[GN:res] [OR:Staphylococcus aureus] [DB:genpept-bct2] [DE:Staphylococcus aureus plasmid
pSK41, complete sequence.] [LE:2779] [RE:3336] [DI:direct]

| ORF Name | NTID | AAID | NT Length | AA Length | score | probability |
|---|---|---|---|---|---|---|
| AI7503012391_156910_f2_62 | 3709 | 7481 | 483 | 160 | 729 | 4.2e-72 |

Description
gp:[GI:g3676415] [LN:AF051917] [AC:AF051917:L19570] [PN:unknown] [OR:Staphylococcus
aureus] [DB:genpept-bct2] [DE:Staphylococcus aureus plasmid pSK41, complete sequence.]
[NT:Orf149] [LE:2068] [RE:2484] [DI:complement]

| ORF Name | NTID | AAID | NT Length | AA Length | score | probability |
|---|---|---|---|---|---|---|
| AI7503012391_19625062_c3_225 | 3710 | 7482 | 165 | 54 | | |

Description
NO-HIT

| ORF Name | NTID | AAID | NT Length | AA Length | score | probability |
|---|---|---|---|---|---|---|
| AI7503012391_19665885_c1_175 | 3711 | 7483 | 1728 | 575 | 2999 | 0.0 |

Description
gp:[GI:g3676419] [LN:AF051917] [AC:AF051917:L19570] [PN:LtrC-like protein] [OR:Staphylococcus aureus] [DB:genpept-bct2] [DE:Staphylococcus aureus plasmid pSK41, complete sequence.] [NT:Orf575; similar to Lactococcus lactis pRS01 LtrC] [LE:6350] [RE:8074] [DI:direct]

| ORF Name | NTID | AAID | NT Length | AA Length | score | probability |
|---|---|---|---|---|---|---|
| AI7503012391_19744010_c3_232 | 3712 | 7484 | 288 | 95 | 466 | 3.1e-44 |

Description
gp:[GI:g3676414] [LN:AF051917] [AC:AF051917:L19570] [PN:unknown] [OR:Staphylococcus aureus] [DB:genpept-bct2] [DE:Staphylococcus aureus plasmid pSK41, complete sequence.] [NT:Orf423] [LE:755] [RE:2026] [DI:direct]

| ORF Name | NTID | AAID | NT Length | AA Length | score | probability |
|---|---|---|---|---|---|---|
| AI7503012391_2115625_f2_61 | 3713 | 7485 | 195 | 64 | | |

Description
NO-HIT

| ORF Name | NTID | AAID | NT Length | AA Length | score | probability |
|---|---|---|---|---|---|---|
| AI7503012391_2150037_c1_180 | 3714 | 7486 | 336 | 111 | 464 | 5.0e-44 |

Description
gp:[GI:g3676421] [LN:AF051917] [AC:AF051917:L19570] [PN:unknown] [OR:Staphylococcus aureus] [DB:genpept-bct2] [DE:Staphylococcus aureus plasmid pSK41, complete sequence.] [NT:Orf90] [LE:10316] [RE:10588] [DI:direct]

| ORF Name | NTID | AAID | NT Length | AA Length | score | probability |
|---|---|---|---|---|---|---|
| AI7503012391_21754035_f3_110 | 3715 | 7487 | 141 | 46 | | |

Description
NO-HIT

| ORF Name | NTID | AAID | NT Length | AA Length | score | probability |
|---|---|---|---|---|---|---|
| AI7503012391_23468753_c3_236 | 3716 | 7488 | 1647 | 548 | 2838 | 1.4e-295 |

Description
gp:[GI:g3676418] [LN:AF051917] [AC:AF051917:L19570] [PN:unknown] [OR:Staphylococcus aureus] [DB:genpept-bct2] [DE:Staphylococcus aureus plasmid pSK41, complete sequence.] [NT:Orf538] [LE:4531] [RE:6147] [DI:direct]

| ORF Name | NTID | AAID | NT Length | AA Length | score | probability |
|---|---|---|---|---|---|---|
| AI7503012391_23594712_c2_211 | 3717 | 7489 | 309 | 102 | 392 | 2.1e-36 |

Description
gp:[GI:g3676422] [LN:AF051917] [AC:AF051917:L19570] [PN:putative membrane protein] [OR:Staphylococcus aureus] [DB:genpept-bct2] [DE:Staphylococcus aureus plasmid pSK41, complete sequence.] [NT:Orf77] [LE:10692] [RE:10925] [DI:direct]

| ORF Name | NTID | AAID | NT Length | AA Length | score | probability |
|---|---|---|---|---|---|---|
| AI7503012391_23603382_c2_196 | 3718 | 7490 | 603 | 200 | 688 | 9.2e-68 |

Description
sp:[LN:YIL2_STAAU] [AC:P41370] [OR:STAPHYLOCOCCUS AUREUS] [DE:HYPOTHETICAL PROTEIN IN ILES 3'REGION (ORF C) (FRAGMENT)] [SP:P41370] [DB:swissprot] >pir:[LN:S40262] [AC:S40262 ] [PN:hypothetical protein C] [OR:Staphylococcus aureus] [DB:pir2] >gp:[GI:g438228] [LN:SADNAMUPR] [AC:X75439] [OR:Staphylococcus aureus] [DB:genpept-bct1] [DE:S.aureus plasmid encoded DNA, mup R gene.] [NT:ORF C] [SP:P41370] [LE:3621] [RE:>4013] [DI:direct]

| ORF Name | NTID | AAID | NT Length | AA Length | score | probability |
|---|---|---|---|---|---|---|
| AI7503012391_23651712_c2_191 | 3719 | 7491 | 480 | 159 | 779 | 2.1e-77 |

Description
pir:[LN:B56976] [AC:B56976 ] [PN:transfer protein complex TrsJ] [GN:trsJ ] [OR:Staphylococcus aureus] [DB:pir2] >gp:[GI:g310617] [LN:STATRSC] [AC:L11998] [GN:trsJ] [OR:Staphylococcus aureus] [SR:Staphylococcus aureus (individual_isolate pG01) DNA] [DB:genpept-bct1] [DE:Staphylococcus aureus conjugative transfer gene complex (trs).] [NT:putative] [LE:10014] [RE:10478] [DI:direct] >gp:[GI:g3676444] [LN:AF051917] [AC:AF051917:L19570] [PN:putative membrane protein TraJ] [GN:traJ] [OR:Staphylococcus aureus] [DB:genpept-bct2] [DE:Staphylococcus aureus plasmid pSK41, complete sequence.] [LE:33617] [RE:34081] [DI:direct]

| ORF Name | NTID | AAID | NT Length | AA Length | score | probability |
|---|---|---|---|---|---|---|
| AI7503012391_23727302_c3_215 | 3720 | 7492 | 1296 | 431 | 2175 | 2.5e-225 |

Description
pir:[LN:G36891] [AC:G36891 ] [PN:transfer complex protein TrsF] [GN:trsF ] [OR:Staphylococcus aureus] [DB:pir2] >gp:[GI:g310613] [LN:STATRSC] [AC:L11998] [GN:trsF] [OR:Staphylococcus aureus] [SR:Staphylococcus aureus (individual_isolate pG01) DNA] [DB:genpept-bct1] [DE:Staphylococcus aureus conjugative transfer gene complex (trs).] [NT:putative] [LE:5011] [RE:6291] [DI:direct] >gp:[GI:g3676440] [LN:AF051917] [AC:AF051917:L19570] [PN:putative membrane protein TraF] [GN:traF] [OR:Staphylococcus aureus] [DB:genpept-bct2] [DE:Staphylococcus aureus plasmid pSK41, complete sequence.] [LE:28614] [RE:29894] [DI:direct]

| ORF Name | NTID | AAID | NT Length | AA Length | score | probability |
|---|---|---|---|---|---|---|
| AI7503012391_23959802_c2_201 | 3721 | 7493 | 234 | 77 | | |

Description
NO-HIT

| ORF Name | NTID | AAID | NT Length | AA Length | score | probability |
|---|---|---|---|---|---|---|
| AI7503012391_23959802_f1_16 | 3722 | 7494 | 162 | 53 | | |

Description
NO-HIT

| ORF_Name | NTID | AAID | NT Length | AA Length | score | probability |
|---|---|---|---|---|---|---|
| AI7503012391_23959802_f1_32 | 3723 | 7495 | 135 | 44 | | |

Description
NO-HIT

| ORF_Name | NTID | AAID | NT Length | AA Length | score | probability |
|---|---|---|---|---|---|---|
| AI7503012391_23959802_f1_51 | 3724 | 7496 | 123 | 40 | | |

Description
NO-HIT

| ORF_Name | NTID | AAID | NT Length | AA Length | score | probability |
|---|---|---|---|---|---|---|
| AI7503012391_23959802_f2_70 | 3725 | 7497 | 174 | 57 | | |

Description
NO-HIT

| ORF_Name | NTID | AAID | NT Length | AA Length | score | probability |
|---|---|---|---|---|---|---|
| AI7503012391_23959802_f3_119 | 3726 | 7498 | 123 | 40 | | |

Description
NO-HIT

| ORF_Name | NTID | AAID | NT Length | AA Length | score | probability |
|---|---|---|---|---|---|---|
| AI7503012391_24001537_c2_187 | 3727 | 7499 | 750 | 249 | 1184 | 2.5e-120 |

Description
pir:[LN:E36891] [AC:E36891 ] [PN:transfer complex protein TrsD] [GN:trsD ]
[OR:Staphylococcus aureus] [DB:pir2] >gp:[GI:g310611] [LN:STATRSC] [AC:L11998]
[GN:trsD] [OR:Staphylococcus aureus] [SR:Staphylococcus aureus (individual_isolate
pG01) DNA] [DB:genpept-bct1] [DE:Staphylococcus aureus conjugative transfer gene
complex (trs).] [NT:putative] [LE:2283] [RE:2966] [DI:direct] >gp:[GI:g3676438]
[LN:AF051917] [AC:AF051917:L19570] [PN:TraD] [GN:traD] [OR:Staphylococcus aureus]
[DB:genpept-bct2] [DE:Staphylococcus aureus plasmid pSK41, complete sequence.]
[LE:25886] [RE:26569] [DI:direct]

| ORF_Name | NTID | AAID | NT Length | AA Length | score | probability |
|---|---|---|---|---|---|---|
| AI7503012391_24298387_c1_171 | 3728 | 7500 | 147 | 48 | 68 | 0.045 |

Description
sp:[LN:PSBH_CHLVU] [AC:P56323] [GN:PSBH] [OR:CHLORELLA VULGARIS] [DE:PHOTOSYSTEM II 10
KD PHOSPHOPROTEIN] [SP:P56323] [DB:swissprot]

| ORF_Name | NTID | AAID | NT Length | AA Length | score | probability |
|---|---|---|---|---|---|---|
| AI7503012391_24393803_f1_28 | 3729 | 7501 | 171 | 56 | | |

Description
NO-HIT

| ORF Name | NTID | AAID | NT Length | AA Length | score | probability |
|---|---|---|---|---|---|---|
| AI7503012391_24415937_c2_189 | 3730 | 7502 | 489 | 162 | 819 | 1.2e-81 |

Description
pir:[LN:I36891] [AC:I36891 ] [PN:transfer complex protein TrsH] [GN:trsH ] [OR:Staphylococcus aureus] [DB:pir2] >gp:[GI:g310615] [LN:STATRSC] [AC:L11998] [GN:trsH] [OR:Staphylococcus aureus] [SR:Staphylococcus aureus (individual_isolate pG01) DNA] [DB:genpept-bct1] [DE:Staphylococcus aureus conjugative transfer gene complex (trs).] [NT:putative] [LE:7395] [RE:7880] [DI:direct] >gp:[GI:g3676442] [LN:AF051917] [AC:AF051917:L19570] [PN:lipoprotein TraH] [GN:traH] [OR:Staphylococcus aureus] [DB:genpept-bct2] [DE:Staphylococcus aureus plasmid pSK41, complete sequence.] [NT:signal peptide recognized as a pheromone by the] [LE:30998] [RE:31483] [DI:direct]

| ORF Name | NTID | AAID | NT Length | AA Length | score | probability |
|---|---|---|---|---|---|---|
| AI7503012391_24664812_c1_155 | 3731 | 7503 | 423 | 140 | 671 | 5.8e-66 |

Description
pir:[LN:D36891] [AC:D36891 ] [PN:transfer complex protein TrsC] [GN:trsC ] [OR:Staphylococcus aureus] [DB:pir2] >gp:[GI:g310610] [LN:STATRSC] [AC:L11998] [GN:trsC] [OR:Staphylococcus aureus] [SR:Staphylococcus aureus (individual_isolate pG01) DNA] [DB:genpept-bct1] [DE:Staphylococcus aureus conjugative transfer gene complex (trs).] [NT:putative] [LE:1889] [RE:2296] [DI:direct] >gp:[GI:g3676437] [LN:AF051917] [AC:AF051917:L19570] [PN:putative membrane protein TraC] [GN:traC] [OR:Staphylococcus aureus] [DB:genpept-bct2] [DE:Staphylococcus aureus plasmid pSK41, complete sequence.] [LE:25492] [RE:25899] [DI:direct]

| ORF Name | NTID | AAID | NT Length | AA Length | score | probability |
|---|---|---|---|---|---|---|
| AI7503012391_24723137_f1_49 | 3732 | 7504 | 225 | 74 | 315 | 3.1e-28 |

Description
pir:[LN:A36891] [AC:A36891 ] [PN:transfer complex protein TrsN] [GN:trsN ] [OR:Staphylococcus aureus] [DB:pir2] >gp:[GI:g3676434] [LN:AF051917] [AC:AF051917:L19570] [PN:putative regulator of transfer genes ArtA] [GN:artA] [OR:Staphylococcus aureus] [DB:genpept-bct2] [DE:Staphylococcus aureus plasmid pSK41, complete sequence.] [LE:23764] [RE:23952] [DI:complement]

| ORF Name | NTID | AAID | NT Length | AA Length | score | probability |
|---|---|---|---|---|---|---|
| AI7503012391_24792033_c2_192 | 3733 | 7505 | 138 | 45 | | |

Description
NO-HIT

| ORF Name | NTID | AAID | NT Length | AA Length | score | probability |
|---|---|---|---|---|---|---|
| AI7503012391_25587777_f1_52 | 3734 | 7506 | 264 | 87 | 444 | 6.6e-42 |

Description
gp:[GI:g3676425] [LN:AF051917] [AC:AF051917:L19570] [PN:unknown] [OR:Staphylococcus aureus] [DB:genpept-bct2] [DE:Staphylococcus aureus plasmid pSK41, complete sequence.] [NT:Orf86] [LE:12564] [RE:12824] [DI:complement]

| ORF Name | NTID | AAID | NT Length | AA Length | score | probability |
|---|---|---|---|---|---|---|
| AI7503012391_26594052_c1_150 | 3735 | 7507 | 336 | 111 | 567 | 6.1e-55 |

Description
gp:[GI:g3676424] [LN:AF051917] [AC:AF051917:L19570] [PN:unknown] [OR:Staphylococcus aureus] [DB:genpept-bct2] [DE:Staphylococcus aureus plasmid pSK41, complete sequence.] [NT:Orf109] [LE:12231] [RE:12560] [DI:direct]

| ORF_Name | NTID | AAID | NT Length | AA Length | score | probability |
|---|---|---|---|---|---|---|
| AI7503012391_26600927_c2_206 | 3736 | 7508 | 786 | 261 | 1347 | 1.4e-137 |

Description gp:[GI:g3676417] [LN:AF051917] [AC:AF051917:L19570] [PN:unknown] [OR:Staphylococcus aureus] [DB:genpept-bct2] [DE:Staphylococcus aureus plasmid pSK41, complete sequence.] [NT:Orf259] [LE:3618] [RE:4397] [DI:direct]

| ORF_Name | NTID | AAID | NT Length | AA Length | score | probability |
|---|---|---|---|---|---|---|
| AI7503012391_29558262_c2_205 | 3737 | 7509 | 129 | 42 | | |

Description

NO-HIT

| ORF_Name | NTID | AAID | NT Length | AA Length | score | probability |
|---|---|---|---|---|---|---|
| AI7503012391_30273550_c1_162 | 3738 | 7510 | 432 | 143 | 671 | 5.8e-66 |

Description pir:[LN:E56976] [AC:E56976 ] [PN:transfer complex protein TrsM] [GN:trsM ] [CL:single-stranded DNA-binding protein homology] [OR:Staphylococcus aureus] [DB:pir2] >gp:[GI:g310620] [LN:STATRSC] [AC:L11998] [GN:trsM] [OR:Staphylococcus aureus] [SR:Staphylococcus aureus (individual_isolate pG01) DNA] [DB:genpept-bct1] [DE:Staphylococcus aureus conjugative transfer gene complex (trs).] [NT:putative] [LE:13127] [RE:13519] [DI:direct] >gp:[GI:g3676447] [LN:AF051917] [AC:AF051917:L19570] [PN:putative single-stranded DNA binding protein] [GN:traM] [OR:Staphylococcus aureus] [DB:genpept-bct2] [DE:Staphylococcus aureus plasmid pSK41, complete sequence.] [LE:36730] [RE:37122] [DI:direct]

| ORF_Name | NTID | AAID | NT Length | AA Length | score | probability |
|---|---|---|---|---|---|---|
| AI7503012391_30503392_c2_188 | 3739 | 7511 | 1083 | 360 | 1889 | 5.0e-195 |

Description gp:[GI:g3676441] [LN:AF051917] [AC:AF051917:L19570] [PN:putative membrane protein TraG] [GN:traG] [OR:Staphylococcus aureus] [DB:genpept-bct2] [DE:Staphylococcus aureus plasmid pSK41, complete sequence.] [LE:29912] [RE:30988] [DI:direct]

| ORF_Name | NTID | AAID | NT Length | AA Length | score | probability |
|---|---|---|---|---|---|---|
| AI7503012391_33786251_c3_230 | 3740 | 7512 | 1113 | 370 | 1926 | 6.0e-199 |

Description sp:[LN:AACA_STAAU] [AC:P14507] [GN:AACA-APHD] [OR:STAPHYLOCOCCUS AUREUS:ENTEROCOCCUS FAECALIS] [SR:,STREPTOCOCCUS FAECALIS] [EC:2.3.1.-:2.7.1.-] [DE:AMINOGLYCOSIDE PHOSPHOTRANSFERASE, (APH(2''))] [SP:P14507] [DB:swissprot] >pir:[LN:S26353] [AC:S26353 ] [PN:aminoglycoside resistance protein aacA-aphD] [OR:Staphylococcus aureus] [DB:pir2] >pir:[LN:A26048] [AC:A26048 ] [PN:aminoglycoside acetyltransferase] [OR:Enterococcus faecalis] [DB:pir2] >gp:[GI:g152948] [LN:STAAGLSRA] [AC:M18086:M29261] [PN:aminoglycoside resistance protein] [OR:Staphylococcus aureus] [SR:Staphylococcus aureus (strain SK982) DNA] [DB:genpept-bct1] [DE:S.aureus transposon 4001 aacA-aphD aminoglycoside resistance gene,complete cds, and right and left IS256 transposase genes.] [LE:1725] [RE:3164] [DI:direct] >gp:[GI:g153586] [LN:STRBRP] [AC:M13771] [OR:Enterococcus faecalis] [SR:S.faecalis DNA, clone pSF815A] [DB:genpept-bct1] [DE:Streptococcus faecalis 6'-aminoglycoside acetyltransferasephosphotransferase (AAC(6')-APH(2'')) bifunctional resistanceprotein, complete cds.] [NT:AAC(6')-APH(2') bifunctional resistance protein] [LE:304] [RE:1743] [DI:direct] >gp:[GI:g3676454] [LN:AF051917] [AC:AF051917:L19570] [PN:bifunctional aminoglycoside modifying enzyme] [GN:aacA-aphD] [OR:Staphylococcus aureus] [DB:genpept-bct2] [DE:Staphylococcus aureus plasmid pSK41, complete sequence.] [LE:42505] [RE:43944] [DI:direct]

| ORF Name | NTID | AAID | NT Length | AA Length | score | probability |
|---|---|---|---|---|---|---|
| AI7503012391_33786251_f2_66 | 3741 | 7513 | 390 | 129 | 644 | 4.2e-63 |

Description
sp:[LN:TRA6_STAAU] [AC:P19775] [GN:TNP] [OR:STAPHYLOCOCCUS AUREUS] [DE:TRANSPOSASE FOR INSERTION SEQUENCE ELEMENT IS256 IN TRANSPOSON TN4001] [SP:P19775] [DB:swissprot] >pir:[LN:JS0296] [AC:JS0296 ] [PN:transposase] [GN:tnp ] [OR:Staphylococcus aureus] [DB:pir2] >gp:[GI:g152947] [LN:STAAGLSRA] [AC:M18086:M29261] [PN:transposase] [OR:Staphylococcus aureus] [SR:Staphylococcus aureus (strain SK982) DNA] [DB:genpept-bct1] [DE:S.aureus transposon 4001 aacA-aphD aminoglycoside resistance gene,complete cds, and right and left IS256 transposase genes.] [LE:102] [RE:1274] [DI:direct]

| ORF Name | NTID | AAID | NT Length | AA Length | score | probability |
|---|---|---|---|---|---|---|
| AI7503012391_34242300_c1_158 | 3742 | 7514 | 2037 | 678 | 3430 | 0.0 |

Description
pir:[LN:F36891] [AC:F36891 ] [PN:transfer complex protein TrsE] [OR:Staphylococcus aureus] [DB:pir2] >gp:[GI:g310612] [LN:STATRSC] [AC:L11998] [GN:trsE] [OR:Staphylococcus aureus] [SR:Staphylococcus aureus (individual_isolate pG01) DNA] [DB:genpept-bct1] [DE:Staphylococcus aureus conjugative transfer gene complex (trs).] [NT:putative] [LE:2981] [RE:4999] [DI:direct] >gp:[GI:g3676439] [LN:AF051917] [AC:AF051917:L19570] [PN:putative ATPase TraE] [GN:traE] [OR:Staphylococcus aureus] [DB:genpept-bct2] [DE:Staphylococcus aureus plasmid pSK41, complete sequence.] [LE:26584] [RE:28602] [DI:direct]

| ORF Name | NTID | AAID | NT Length | AA Length | score | probability |
|---|---|---|---|---|---|---|
| AI7503012391_34642562_c1_174 | 3743 | 7515 | 207 | 68 | | |

Description
NO-HIT

| ORF Name | NTID | AAID | NT Length | AA Length | score | probability |
|---|---|---|---|---|---|---|
| AI7503012391_35397177_c2_182 | 3744 | 7516 | 1062 | 353 | 1760 | 2.3e-181 |

Description
gp:[GI:g3676423] [LN:AF051917] [AC:AF051917:L19570] [PN:unknown] [OR:Staphylococcus aureus] [DB:genpept-bct2] [DE:Staphylococcus aureus plasmid pSK41, complete sequence.] [NT:Orf346] [LE:11188] [RE:12228] [DI:direct]

| ORF Name | NTID | AAID | NT Length | AA Length | score | probability |
|---|---|---|---|---|---|---|
| AI7503012391_35397177_c3_241 | 3745 | 7517 | 132 | 44 | 142 | 3.1e-09 |

Description
gp:[GI:g3676423] [LN:AF051917] [AC:AF051917:L19570] [PN:unknown] [OR:Staphylococcus aureus] [DB:genpept-bct2] [DE:Staphylococcus aureus plasmid pSK41, complete sequence.] [NT:Orf346] [LE:11188] [RE:12228] [DI:direct]

| ORF Name | NTID | AAID | NT Length | AA Length | score | probability |
|---|---|---|---|---|---|---|
| AI7503012391_36048212_c3_221 | 3746 | 7518 | 774 | 257 | 783 | 7.9e-78 |

Description
sp:[LN:YIL1_STAAU] [AC:P41369] [OR:STAPHYLOCOCCUS AUREUS] [DE:HYPOTHETICAL PROTEIN IN ILES 5'REGION (ORF B) (FRAGMENT)] [SP:P41369] [DB:swissprot] >pir:[LN:S40261] [AC:S40261 ] [PN:hypothetical protein B] [OR:Staphylococcus aureus] [DB:pir2] >gp:[GI:g438227] [LN:SADNAMUPR] [AC:X75439] [OR:Staphylococcus aureus] [DB:genpept-bct1] [DE:S.aureus plasmid encoded DNA, mup R gene.] [NT:ORF B] [SP:P41369] [LE:<1] [RE:450] [DI:direct]

| ORF Name | NTID | AAID | NT Length | AA Length | score | probability |
|---|---|---|---|---|---|---|
| AI7503012391_36605260_c1_169 | 3747 | 7519 | 630 | 209 | 1077 | 5.5e-109 |

Description
gp:[GI:g3676413] [LN:AF051917] [AC:AF051917:L19570] [PN:unknown] [OR:Staphylococcus aureus] [DB:genpept-bct2] [DE:Staphylococcus aureus plasmid pSK41, complete sequence.] [NT:Orf204] [LE:72] [RE:686] [DI:direct]

| ORF Name | NTID | AAID | NT Length | AA Length | score | probability |
|---|---|---|---|---|---|---|
| AI7503012391_3907943_f3_103 | 3748 | 7520 | 2010 | 669 | 3498 | 0.0 |

Description
gp:[GI:g3676420] [LN:AF051917] [AC:AF051917:L19570] [PN:oriT nickase Nes] [GN:nes] [OR:Staphylococcus aureus] [DB:genpept-bct2] [DE:Staphylococcus aureus plasmid pSK41, complete sequence.] [LE:8115] [RE:10112] [DI:complement]

| ORF Name | NTID | AAID | NT Length | AA Length | score | probability |
|---|---|---|---|---|---|---|
| AI7503012391_3908407_c3_214 | 3749 | 7521 | 123 | 40 | | |

Description
NO-HIT

| ORF Name | NTID | AAID | NT Length | AA Length | score | probability |
|---|---|---|---|---|---|---|
| AI7503012391_4300002_c1_153 | 3750 | 7522 | 126 | 41 | | |

Description
NO-HIT

| ORF Name | NTID | AAID | NT Length | AA Length | score | probability |
|---|---|---|---|---|---|---|
| AI7503012391_4428802_f2_57 | 3751 | 7523 | 168 | 55 | | |

Description
NO-HIT

| ORF Name | NTID | AAID | NT Length | AA Length | score | probability |
|---|---|---|---|---|---|---|
| AI7503012391_4486075_c1_154 | 3752 | 7524 | 975 | 324 | 1640 | 1.2e-168 |

Description
pir:[LN:B36891] [AC:B36891 ] [PN:transfer complex protein TrsA] [GN:trsA ] [OR:Staphylococcus aureus] [DB:pir2] >gp:[GI:g310608] [LN:STATRSC] [AC:L11998] [GN:trsA] [OR:Staphylococcus aureus] [SR:Staphylococcus aureus (individual_isolate pG01) DNA] [DB:genpept-bct1] [DE:Staphylococcus aureus conjugative transfer gene complex (trs).] [NT:putative] [LE:521] [RE:1495] [DI:direct] >gp:[GI:g3676435] [LN:AF051917] [AC:AF051917:L19570] [PN:TraA] [GN:traA] [OR:Staphylococcus aureus] [DB:genpept-bct2] [DE:Staphylococcus aureus plasmid pSK41, complete sequence.] [LE:24124] [RE:25098] [DI:direct]

| ORF Name | NTID | AAID | NT Length | AA Length | score | probability |
|---|---|---|---|---|---|---|
| AI7503012391_4586062_c1_176 | 3753 | 7525 | 141 | 46 | | |

Description
NO-HIT

| ORF Name | NTID | AAID | NT Length | AA Length | score | probability |
|---|---|---|---|---|---|---|
| AI7503012391_4724035_c1_170 | 3754 | 7526 | 1134 | 377 | 1728 | 5.7e-178 |

Description gp:[GI:g3676414] [LN:AF051917] [AC:AF051917:L19570] [PN:unknown] [OR:Staphylococcus aureus] [DB:genpept-bct2] [DE:Staphylococcus aureus plasmid pSK41, complete sequence.] [NT:Orf423] [LE:755] [RE:2026] [DI:direct]

| ORF Name | NTID | AAID | NT Length | AA Length | score | probability |
|---|---|---|---|---|---|---|
| AI7503012391_4745437_c2_190 | 3755 | 7527 | 2118 | 705 | 3603 | 0.0 |

Description pir:[LN:A56976] [AC:A56976 ] [PN:transfer complex protein TrsI] [GN:trsI ] [OR:Staphylococcus aureus] [DB:pir2] >gp:[GI:g310616] [LN:STATRSC] [AC:L11998] [GN:trsI] [OR:Staphylococcus aureus] [SR:Staphylococcus aureus (individual_isolate pG01) DNA] [DB:genpept-bct1] [DE:Staphylococcus aureus conjugative transfer gene complex (trs).] [NT:putative] [LE:7896] [RE:9998] [DI:direct] >gp:[GI:g3676443] [LN:AF051917] [AC:AF051917:L19570] [PN:putative topoisomerase TraI] [GN:traI] [OR:Staphylococcus aureus] [DB:genpept-bct2] [DE:Staphylococcus aureus plasmid pSK41, complete sequence.] [LE:31499] [RE:33601] [DI:direct]

| ORF Name | NTID | AAID | NT Length | AA Length | score | probability |
|---|---|---|---|---|---|---|
| AI7503012391_5109675_c2_186 | 3756 | 7528 | 324 | 107 | 535 | 1.5e-51 |

Description pir:[LN:C36891] [AC:C36891 ] [PN:transfer complex protein TrsB] [GN:trsB ] [OR:Staphylococcus aureus] [DB:pir2] >gp:[GI:g310609] [LN:STATRSC] [AC:L11998] [GN:trsB] [OR:Staphylococcus aureus] [SR:Staphylococcus aureus (individual_isolate pG01) DNA] [DB:genpept-bct1] [DE:Staphylococcus aureus conjugative transfer gene complex (trs).] [NT:putative] [LE:1512] [RE:1829] [DI:direct] >gp:[GI:g3676436] [LN:AF051917] [AC:AF051917:L19570] [PN:putative membrane protein TraB] [GN:traB] [OR:Staphylococcus aureus] [DB:genpept-bct2] [DE:Staphylococcus aureus plasmid pSK41, complete sequence.] [LE:25115] [RE:25432] [DI:direct]

| ORF Name | NTID | AAID | NT Length | AA Length | score | probability |
|---|---|---|---|---|---|---|
| AI7503012391_5314202_c3_219 | 3757 | 7529 | 918 | 305 | 1524 | 2.4e-156 |

Description pir:[LN:D56976] [AC:D56976 ] [PN:transfer complex protein TrsL] [GN:trsL ] [OR:Staphylococcus aureus] [DB:pir2] >gp:[GI:g310619] [LN:STATRSC] [AC:L11998] [GN:trsL] [OR:Staphylococcus aureus] [SR:Staphylococcus aureus (individual_isolate pG01) DNA] [DB:genpept-bct1] [DE:Staphylococcus aureus conjugative transfer gene complex (trs).] [NT:putative] [LE:12193] [RE:13110] [DI:direct]

| ORF Name | NTID | AAID | NT Length | AA Length | score | probability |
|---|---|---|---|---|---|---|
| AI7503012391_6929686_c1_152 | 3758 | 7530 | 693 | 230 | 1199 | 6.5e-122 |

Description gp:[GI:g1762100] [LN:SEU40385] [AC:U40385] [PN:transposase] [GN:tnp] [OR:Staphylococcus epidermidis] [DB:genpept-bct1] [DE:Staphyloccous epidermidis plasmid pSK818 insertion sequenceIS257(818B) putative transposase gene, complete cds.] [NT:Tnp; putative transposase] [LE:57] [RE:731] [DI:direct] >gp:[GI:g1762102] [LN:SEU40386] [AC:U40386] [PN:transposase] [GN:tnp] [OR:Staphylococcus epidermidis] [DB:genpept-bct1] [DE:Staphyloccous epidermidis plasmid pSK818 insertion sequenceIS257(818C) putative transposase gene, complete cds.] [NT:Tnp; putative transposase] [LE:57] [RE:731] [DI:direct]

| ORF Name | NTID | AAID | NT Length | AA Length | score | probability |
|---|---|---|---|---|---|---|
| AI7503012391_6929686_c1_163 | 3759 | 7531 | 693 | 230 | 1201 | 4.0e-122 |

Description pir:[LN:A60634] [AC:A60634:C30471:S26349 ] [PN:probable transposase] [OR:Staphylococcus aureus] [DB:pir2] >gp:[GI:g46597] [LN:SAIS2571] [AC:X53952] [PN:transposase] [OR:Staphylococcus aureus] [DB:genpept-bct1] [DE:S.aureus plasmid pSH6 DNA for insertion sequences IS257-1 andIS256.] [LE:188] [RE:862] [DI:direct] >gp:[GI:g3676452] [LN:AF051917] [AC:AF051917:L19570] [PN:putative transposase TnpE] [GN:tnpE] [OR:Staphylococcus aureus] [DB:genpept-bct2] [DE:Staphylococcus aureus plasmid pSK41, complete sequence.] [LE:40946] [RE:41620] [DI:direct]

| ORF Name | NTID | AAID | NT Length | AA Length | score | probability |
|---|---|---|---|---|---|---|
| AI7503012391_6929686_c1_168 | 3760 | 7532 | 693 | 230 | 1205 | 1.5e-122 |

Description pir:[LN:C60634] [AC:C60634:S26351 ] [PN:probable transposase] [OR:Staphylococcus aureus] [DB:pir2] >gp:[GI:g46600] [LN:SAIS2572] [AC:X53951] [PN:putative transposase] [OR:Staphylococcus aureus] [DB:genpept-bct1] [DE:S.aureus plasmid pSH6 DNA for insertion sequences IS257-2, IS257-3and IS256.] [LE:1752] [RE:2426] [DI:direct] >gp:[GI:g3676456] [LN:AF051917] [AC:AF051917:L19570] [PN:putative transposase TnpG] [GN:tnpG] [OR:Staphylococcus aureus] [DB:genpept-bct2] [DE:Staphylococcus aureus plasmid pSK41, complete sequence.] [LE:45713] [RE:46387] [DI:direct]

| ORF Name | NTID | AAID | NT Length | AA Length | score | probability |
|---|---|---|---|---|---|---|
| AI7503012391_6929686_c2_197 | 3761 | 7533 | 660 | 219 | 1116 | 4.1e-113 |

Description pir:[LN:A60634] [AC:A60634:C30471:S26349 ] [PN:probable transposase] [OR:Staphylococcus aureus] [DB:pir2] >gp:[GI:g46597] [LN:SAIS2571] [AC:X53952] [PN:transposase] [OR:Staphylococcus aureus] [DB:genpept-bct1] [DE:S.aureus plasmid pSH6 DNA for insertion sequences IS257-1 andIS256.] [LE:188] [RE:862] [DI:direct] >gp:[GI:g3676452] [LN:AF051917] [AC:AF051917:L19570] [PN:putative transposase TnpE] [GN:tnpE] [OR:Staphylococcus aureus] [DB:genpept-bct2] [DE:Staphylococcus aureus plasmid pSK41, complete sequence.] [LE:40946] [RE:41620] [DI:direct]

| ORF Name | NTID | AAID | NT Length | AA Length | score | probability |
|---|---|---|---|---|---|---|
| AI7503012391_6929686_c3_229 | 3762 | 7534 | 693 | 230 | 1201 | 4.0e-122 |

Description pir:[LN:A60634] [AC:A60634:C30471:S26349 ] [PN:probable transposase] [OR:Staphylococcus aureus] [DB:pir2] >gp:[GI:g46597] [LN:SAIS2571] [AC:X53952] [PN:transposase] [OR:Staphylococcus aureus] [DB:genpept-bct1] [DE:S.aureus plasmid pSH6 DNA for insertion sequences IS257-1 andIS256.] [LE:188] [RE:862] [DI:direct] >gp:[GI:g3676452] [LN:AF051917] [AC:AF051917:L19570] [PN:putative transposase TnpE] [GN:tnpE] [OR:Staphylococcus aureus] [DB:genpept-bct2] [DE:Staphylococcus aureus plasmid pSK41, complete sequence.] [LE:40946] [RE:41620] [DI:direct]

| ORF Name | NTID | AAID | NT Length | AA Length | score | probability |
|---|---|---|---|---|---|---|
| AI7503012391_6929686_f3_115 | 3763 | 7535 | 684 | 227 | 1196 | 1.4e-121 |

Description
pir:[LN:B60634] [AC:B60634:S26350 ] [PN:probable transposase] [OR:Staphylococcus aureus] [DB:pir2] >gp:[GI:g46599] [LN:SAIS2572] [AC:X53951] [PN:putative transposase] [OR:Staphylococcus aureus] [DB:genpept-bct1] [DE:S.aureus plasmid pSH6 DNA for insertion sequences IS257-2, IS257-3and IS256.] [LE:556] [RE:1221] [DI:complement] >gp:[GI:g3676455] [LN:AF051917] [AC:AF051917:L19570] [PN:putative transposase TnpF] [GN:tnpF] [OR:Staphylococcus aureus] [DB:genpept-bct2] [DE:Staphylococcus aureus plasmid pSK41, complete sequence.] [LE:44517] [RE:45182] [DI:complement]

| ORF Name | NTID | AAID | NT Length | AA Length | score | probability |
|---|---|---|---|---|---|---|
| AI7503012391_822802_c3_213 | 3764 | 7536 | 1011 | 336 | 1647 | 2.2e-169 |

Description
gp:[GI:g3676426] [LN:AF051917] [AC:AF051917:L19570] [PN:putative replication initiation protein Rep] [GN:rep] [OR:Staphylococcus aureus] [DB:genpept-bct2] [DE:Staphylococcus aureus plasmid pSK41, complete sequence.] [LE:13205] [RE:14164] [DI:direct]

| ORF Name | NTID | AAID | NT Length | AA Length | score | probability |
|---|---|---|---|---|---|---|
| AI7503012392_1442583_c1_19 | 3765 | 7537 | 144 | 47 | | |

Description
NO-HIT

| ORF Name | NTID | AAID | NT Length | AA Length | score | probability |
|---|---|---|---|---|---|---|
| AI7503012392_1442583_c3_25 | 3766 | 7538 | 144 | 47 | | |

Description
NO-HIT

| ORF Name | NTID | AAID | NT Length | AA Length | score | probability |
|---|---|---|---|---|---|---|
| AI7503012392_23671885_c1_18 | 3767 | 7539 | 159 | 52 | | |

Description
NO-HIT

| ORF Name | NTID | AAID | NT Length | AA Length | score | probability |
|---|---|---|---|---|---|---|
| AI7503012392_2776391_f3_12 | 3768 | 7540 | 207 | 68 | | |

Description
NO-HIT

| ORF Name | NTID | AAID | NT Length | AA Length | score | probability |
|---|---|---|---|---|---|---|
| AI7503012392_29323431_f3_15 | 3769 | 7541 | 123 | 40 | | |

Description
NO-HIT

| ORF Name | NTID | AAID | NT Length | AA Length | score | probability |
|---|---|---|---|---|---|---|
| AI7503012392_30495306_f2_6 | 3770 | 7542 | 123 | 40 | | |

Description
NO-HIT

| ORF Name | NTID | AAID | NT Length | AA Length | score | probability |
|---|---|---|---|---|---|---|
| AI7503012392_34023375_c2_23 | 3771 | 7543 | 501 | 166 | 790 | 1.4e-78 |

Description sp:[LN:REMA_STAAU] [AC:P13969] [GN:REPL:REP] [OR:STAPHYLOCOCCUS AUREUS:STAPHYLOCOCCUS SIMULANS] [DE:REPLICATION AND MAINTENANCE PROTEIN (PLASMID REPLICATION PROTEIN)] [SP:P13969] [DB:swissprot] >pir:[LN:A29827] [AC:A29827:C46568 ] [PN:replication protein REP] [OR:Staphylococcus aureus] [DB:pir2] >gp:[GI:g153064] [LN:PE5PE5A] [AC:M17990] [GN:repL] [OR:Plasmid pE5] [SR:Plasmid pE5 DNA] [DB:genpept-bct1] [DE:Plasmid pE5 (from Staphylococcus aureus, strain RN451) repL proteinand ermC protein, complete cds.] [LE:389] [RE:865] [DI:direct] >gp:[GI:g506624] [LN:STAPT48CG] [AC:M19652] [OR:Plasmid pT48] [SR:Plasmid pT48 (from S.aureus strain T48) DNA] [DB:genpept-bct1] [DE:Plasmid pT48 (from S.aureus strain T48) complete genome.] [NT:putative. ORF B.] [LE:64] [RE:540] [DI:complement] >gp:[GI:g2407672] [LN:AF019140] [AC:AF019140] [PN:Rep] [GN:rep] [OR:Staphylococcus simulans] [DB:genpept-bct2] [DE:Staphylococcus simulans erythromycin resistance plasmid pPV142 rRNAN-6-methyltransferase (ermM) and replication protein (rep) genes,complete cds.] [NT:plasmid replication protein] [LE:1699] [RE:2175] [DI:direct] >gp:[GI:g1791222] [LN:SCU82607] [AC:U82607] [PN:plasmid replication protein] [OR:Staphylococcus chromogenes] [DB:genpept-bct2] [DE:Staphylococcus chromogenes plasmid pPV141 erythromycin resistanceplasmid, rRNA N-6-methyltransferase (ermM) and plasmid replicationprotein genes, complete cds.] [LE:1583] [RE:2059] [DI:direct]

| ORF Name | NTID | AAID | NT Length | AA Length | score | probability |
|---|---|---|---|---|---|---|
| AI7503012392_4304683_c2_21 | 3772 | 7544 | 771 | 256 | 1270 | 2.0e-129 |

Description sp:[LN:ERM4_STAAU] [AC:P13978] [GN:ERMC] [OR:STAPHYLOCOCCUS AUREUS] [EC:2.1.1.48] [DE:RESISTANCE PROTEIN)] [SP:P13978] [DB:swissprot] >pir:[LN:B46568] [AC:B46568 ] [PN:ermC protein] [CL:rRNA (adenine-N6-)-methyltransferase] [OR:Staphylococcus aureus] [DB:pir2] >gp:[GI:g455358] [LN:STAPT48CG] [AC:M19652] [PN:23S RNA methylase] [GN:ermC] [OR:Plasmid pT48] [SR:Plasmid pT48 (from S.aureus strain T48) DNA] [DB:genpept-bct1] [DE:Plasmid pT48 (from S.aureus strain T48) complete genome.] [LE:988] [RE:1722] [DI:complement]

SEQUENCE LISTING (7546 sequences)

SEQ ID NO: 1 - DNA, 135 bp, Staphylococcus epidermidis
ataaacatctcctcttctaatcattcattctttgaattagatattaaatgtgattcattgcaatcacaagcttcacactctatcggaaaagcttctgttgctagggagaggtttaaatcggccatttgtgcataa

SEQ ID NO: 2 - DNA, 510 bp, Staphylococcus epidermidis
agtattatatctaaatctgacataaatttctattattgtattaataaaaaaatttggagaagtgatattatgaaaacttttaaggcagtaagatttcaaattgtgaatgaacatggtgcaatatcagaatacgtcattgaagatggtgtgattataaataaagaaggaagtggcactgggtggttactagaaatagtaatttcaaatgaacactatgaaacatttaagcaatataaggataacaaacaacttttagatattagagtagtcatcacaagacctgctaacgatccagcgttatttaatgcaacagttaaaagcgttaaaaattttaaatattcaatgtcagtcgttttagaatgtcacatctacactttgagacaagaatacgctgagagtttattagaagaattagttgatgaaggacttacaggtgaaaagttgaaaaaaacatttaatcgtatgatgcaatcaaaacctaagttgaaagatgagaaaatcgaaagataa

SEQ ID NO: 3 - DNA, 135 bp, Staphylococcus epidermidis
gataaatcatctgtattaaaaatatttccgaacacattatttactgataaaaagaaaaaaactgctaatatgagagcgacaaatcttaatccccatttactttcaagcatttatgaattcacacctttcttttga

SEQ ID NO: 4 - DNA, 693 bp, Staphylococcus epidermidis
gaaaacaaatcacttttaggaggatttttaataatgaaaaaaacattagttgcatcatcattagctataggactaggcgttgtagcaggtaacgcaggtcatgacgcacatgcaagtgagactacaaatgttgataaagcagagttagctcaaaaagcgttaactaatgatcaatcactaaatgaaagccctgttcaagaaggtgcttataatattaattttgattacaatggtaattcatatcattttgaatctgatggttctacttggagttggagttatgaatcaacaaacaatgctacgcaacctgttcaaccaagccaatctcaagtagctacacaacaacaacctgtacaagtatcagcaccacaaaatgagcaaacagcacaaccacaaacaaaatcaacatctacaagtcaaacttcttcaagtaaagcttcaagtggttcatcagtaaatgtaaattcacatttacaacaaattgctcaacgtgaatcaggtggcgatattcatgcaataaacccatcttcaggtgcagcaggtaaatatcaattcttacaatcaacttgggattctgttgctccaagtcaatataaaggtgtttcacctgcaaaagctccagaaagcgtacaagaccgagcagcagtaaaattatataatactggtggcccaggtcattgggtaactgcataa

SEQ ID NO: 5 - DNA, 153 bp, Staphylococcus epidermidis
atgcgtttgtcgtcccactcttttctaatagctacacttaaaatatttgagatcgtcaatttaaaattaaaatgtaagttattaaaaattaatgacctaaataagattgtaacatccaattatgcttatcaactgaagtttgcatgccgataa

SEQ ID NO: 6 - DNA, 126 bp, Staphylococcus epidermidis
tctttcatgttgggctttttatattgtaattgcatttttgtgaaaatcctctttaaatattttattaatgctcatgcatataatttaaataagcataatgaaccagttgataaatatataatttaa

SEQ ID NO: 7 - DNA, 426 bp, Staphylococcus epidermidis
ggtgatttcccacccaattcaagagacacttttttgaagtcttttgcagctttttccataatttttgaacctgtaggaccagaacctgtaaatgacatcattcttacttttggatgttcacttaaaggatttcctactccagatccatcaccattgactaagttaaacacacctttaggtacgcctactttatcaaaaatttctgctaaaataattgcagcaaatggtgtttcttcagatggttttaaaacaacagggctaccagcagcaaacgcagcagctaatttaagtgaagtttggtttgtagggaaattccaaggtgtaacaagtccagcaactccaattgcttctttaacaaccaaatcatcgccacgttgttcttcaaattggaagctatctaaagcatctcttgcagctgtaaaatga

SEQ ID NO: 8 - DNA, 300 bp, Staphylococcus epidermidis
ggtagtatcccaccaacgcctccacgtaagctagcgctcacgtttcaaaggctcctacctatcctgtacaagctgtgccgaatttcaatatcaggctacagtaaagctccacggggtctttccgtcctgtcgcgggtaacctgcatcttcacaggtactatgatttcaccgagtctctcgttgagacagtgcccaaatcgttacgcctttcgtgcgggtcggaacttacccgacaaggaatttcgctaccttaggaccgttatagttacggccgccgtttactggggcttcgattcgtag

SEQ ID NO: 9 - DNA, 714 bp, Staphylococcus epidermidis
ttttattttttgaggaggctaattatgacattttcaaaagagttgagggaagcatcaagacctattattgatgacatttacaatgatggttttattcaagatttactagcaggtaagttatctaatcaagctgtaagacaatacttaagagcagacgcttcttatttaaaagagtttacaaatatttatgcaatgctcatacccaaaatgagttctatggaagatgttaaatttctagtagaacaaattgagtttatgttagaaggagaagttgaagcgcatgaggttctagctgatttcattaatgaaccatatgaagaaatagtaaaagaaaaagtatggccaccaagtggtgatcattatattaaacatatgtacttcaatgcatttgcacgtgaaaatgcagccttcacgattgcagcgatggcaccctgtccatacgtctacgctgtcattggtaaacgtgcgatggaagatcccaaattaaataaagaatcagtgacttctaaatggtttcaattttatagtactgaaatggacgaacttgttgatgtgttcgatcaattgatggaccgtttaactaaacattgtagtgagacagaaaaaaaagagattaaagaaaatttcttgcaaagtactattcatgagagacatttcttcaatatggcatatattaatgaaaaatgggaatatgggggaaataacaatgaataa

SEQ ID NO: 10 - DNA, 138 bp, Staphylococcus epidermidis
catgtgtcacctccttcttatgttctaatcataactgagcttagttcactggtcaaaaccacaattttattgaaattgttagtaaatgacgatgagattttgatatatttaaagaaaatattgaagtattatatctaa

SEQ ID NO: 11 - DNA, 1131 bp, Staphylococcus epidermidis
acaattacgttaaagaaaaaggctaaaagaactgtaattgtaatggaggaaaacgaaatgacaaaagaaaatatttgtatcgtttttggaggtaaaagtgcagaacacgatgtttcaattttaactgcacaaaatgttttaaacgcaattgataaagaacgatatcaagttgatatcatttatataacaaacgatggtgaatggaagaaaaaagataatattacacaagaaataaaaaatactgatgaactcgtcattaacgatgtagagactggagaaatctcacagttactcagtaaaggtagtttaggaaaatcatatgatgcagtattcccgttattgcatggtccaaatggagaagatggaactatccaaggtctttttgaagtacttgatataccatatgtaggtaatggtgtgttagctgcttcaagctcaatggataaactcgtgatgaaacaattatttgagcatagaggtttacctcaattaccttatattagctttttaagaagtgagtatgaaaaatatgaaaataatatcattaagttagttaatgataagttaacatatcctgtatttgtaaaacctgctaatctcggttcaagtgttggtataagtaaatgtaacaatgaagaagaattaaaatctgggatagctgaagcattccaatttgatcgtaaacttgtcattgaacaagggattaatgctagagagatcgaagtagctgtcttaggtaacgattatcctgaaacgacatggcctggtgaggttgttaaggatgtagctttttatgattataaatcaaagtataaagacggtaagattagattagatattccagcagatttagatcaagatgttcaaatgacattaagaaacatggcattagaggcctttaaagctactgattgttcgggattagttcgtgcagatttctttgttactgatgataatcaaatttatatcaatgaaacaaatgccatgccaggatttactgcatatagtatgtatccaaacttatggaaaaatatgggcttatcttaccctgatttaattgctaaattgattgatttggctaaagaacgttatgaagataaaaagaaaaataaatataaaattgattattag

SEQ ID NO: 12 - DNA, 672 bp, Staphylococcus epidermidis
aggaggacgtttgaaatgagtattttagttattggagcaaatggaggcgtaggttctaaactagtaagtcaattaaatgaagaacacgttgattttacagctggtgtacgtaaggaagatcaagttaaagaattagaaaataaagggattaaagctacattaatagatgtagaaaaaaatagtattaatgatttaaaaaatatctttacagattatgataaagttatcttttcagttggatctggtggaagcactggagcggataaaacaatcattgttgatttagatggtgctgtaaaaacaattaaagctagtaaagaagcgggtatcaaacattatgttatggtatcaacatacgattctagacgtgaagcattcgatgcgagtggagatttaaaaccgtatacaattgcaaagcattatgctgatgattacttaagaacatcagatcttaattatacaattgtacatccaggttcacttacagatgatgctggaactggaaaaatagaagctgatttatatttcgacaaagcaggatcaattccacgtgaagatgttgctacagttttaaaagaagtagtaacttctgatggttttaataatcaagaattccaaattttaagtggcaatcatggtgttaaagatgcattgaaaaactatgaatcttaa

SEQ ID NO: 13 - DNA, 243 bp, Staphylococcus epidermidis
aattttttttttcccctaaaaaaaagagttttttgttccgaaaacccttcttcattcaagcggggttgtttcgtcaaggcttttgcccattgcggaagattccctactgctgcctcccgtaggagtatggaccgtgtctcagttccagtgggggccgatcaccctctcaggtcggctacgcatcgttgccttggtaagccgttaccttaccaactagctaatgcggcgcggatccatctataa

SEQ ID NO: 14 - DNA, 1215 bp, Staphylococcus epidermidis
tacgcaaagtttcaaagggagttagatacaatgcataataaacaaaagatattagattttatagaaaataataaatatgattatgtagaaataagtcatcgtattcatgaacgccctgaattaggcaatgaagaaatttttgcatcgagaacattaattgaccaattaagagcaaatcgattcgaaatcgaaacggatattgcaggacatgcaacaggatttatagcaacgtatgattctgatatgactggaccggttataggatttctagctgaatatgatgctttacctggtcttggtcacgcatgcgggcataatattattggtactgctagcgtacttgctgcagtagcactaaaagaagtcgtcgatgaaattggtggtaaagtagtcgttttgggatgtcctgctgaagaaggtggggaaaatggctccgcaaaagcttcttatgttaaagcaggtgtcattgatgaaattgatgtagcattgatgattcatcctggaaatgaaacctatcgtacaattaatactttagctgtggatgttctagatattaaattctatggacgtagtgcgcatgcatctgaaaatgcagatgaagcattaaacgctttagatgcaatgatttcatattttaatggtatagcacagttaaggcaacacattaaaaaaggacaacgagttcacggggttattttagacggtggtaaagcggctaatattatacctgattttacacatgcgagattttatactcgagctacttcacggaaagaacttgatgttttaactgaaaaagtaaaccaaattgcaagaggtgctgcgattcaaactgggtgtgattttgaatttggtcctatccagaatggtgtaaacgaatttatcaaagcgcctaaacttgatgatttatttgaaaaatatgcaactgaattaggagaagaagtgattgatgatgattttggttatggatctacagatacaggtaatgtaagtcatgttgtaccaactatacatccacatattaaaattggttctcgaaatcttgtaggacatacccaccgctttagagaagcggctgcaagtttacaaggtgatcaggcactcattcgaggtgcaaaaattttagcattaatgggactagaattaatcgaaaataaaccgttgttagacgaaataattgaagagcatacgcatataaaggggcatgttaagtaa

SEQ ID NO: 15 - DNA, 1194 bp, Staphylococcus epidermidis
atgatgactacaccgttcaaaagaattcatctaatagttatggactcagtaggtataggcgaaggtcctgatgcagcggcattcaatgacgaaggatcacacactttaaagcatactttagaaggatttaagcaaaagttaccacatctagaacaacttggattaggaaatattgcaccgcttcctgttgtttcaaaagttacacatccaggtgcattttataccaaactaagtgaagcttcagtaggtaaggatacaatgactggacattgggaaattatggggttaaatataatgcaaccatttaaggtttatccaaatggtttcccagaagagcttgttaaagagattgaagatatgactggacgaaaggttgtagcaaatagacctgcttcaggaactcagattattgacgagtggggcgaacatcaaatgaaaactggagatttaatagtttatactagtgctgatccagtcttacaaattgctgcacatgaagacgtgattccacttgaagaactttacgagatttgtgaaaaagttcgtgaactaacaaaagatcctaaatatttaatagggagaatcattgctcgaccatatgttggtgaacctggtaacttcactagaacttctaatcgacatgattacgcgttaaaaccatttggacgaacagtgatgaatagccttaaagatagtggttatgatgtaatcgcgattggtaaaattaacgatatttatgacggtgaaggcgtgacagaagctatacgtactaaaaataatatggacggtatggatcaattgattgaagttgtaaaaaaagattttgaaggtatcagtttccttaatttagttgattttgatgcattgtatggccatcgtcgtgataaagaagggtatgctcaagcaattaaagattttgatcttcgtttacctgaattaatgaatcatttaagagaagatgatttagttattattacagctgatcatggtaatgatccaattgctaaaggtacagatcatacacgtgaatacattccacttttaatgtttagtccgaaaattaaagattatcatgaactttcacaagacacgacatttagctctatcggtgttacaatagcagataacttcaacgtagaattacctaaatatggaaaaagttatttaaaagaaatgggggttgagcatcaatga

SEQ ID NO: 16 - DNA, 912 bp, Staphylococcus epidermidis
attatgtggttttgctttttgaaatccggatttataataattaaacaaattttaagcactccttttttttcatataaatacaatatcaaaattctaataaattttaaattaatatctaacataatagagcacaaaatgttagaatatgctaataagataacattgaagggagataatatcatgaaatttgctgttatcactgatattcatggaaactttgatgcgcttcaaactgttttagatgatattgatagtagagatgatatcgaaaaaatttataacctaggtgataacatagggattggacatgagacaaataaagtactggatactatatttgaccgggatgatatggaaatgattgcaggtaatcatgatgaagctattatgtcactcgtcaatggaacaccttatcctgaagatttaaaagggaaattttatgagcatcatcaatggatagaaggacatttagatgagtcctattacgatgaaattaatcaattgcctagatatattgaaatgaccataaaagggaaaaagattttatttattcattatgaaattgaaaatgataaaatgtcagctcctattgatgaacaaccttttgcacctattacaaaagatgacgaacaagctatttctgaattatttaaagacaaagaagccgatttaattttatttggacataaccataggttgcatatgtttgatgataaatcaacagtatattttaatcctggatcagtaggtttgaacaatggttcaaacaccgtatatggtattattaccgttaatgaaaaaggaatttcagtagagagagtgaaattagcgtacaataatgaagaatttttagcaggatttgaagaaaagcaagtaccagctagagaatttatatttaagaatttcatttaa

SEQ ID NO: 17 - DNA, 162 bp, Staphylococcus epidermidis
tcggcccccactggaactgagacacggtccatactcctacgggaggcagcagtagggaatcttccgcaatgggcaaaagccttgacgaaacaaccccgcttgaatgaagaagggttttcggaacaaaaaactcttttttttaggggaaaaaaaaaattttaa

SEQ ID NO: 18 - DNA, 1029 bp, Staphylococcus epidermidis
atgatatacacgtttcaactttacttaaacaagccattcaccactccaaacatcctagtgaaggtggaatttctaatgacaaatcataatcatcaacatcatcattctcatgcacacggacacgttcatacagataataaaaaggtactcatgttttctttcattatcattagtctcttcatgcttgtagaaattataggtgggtttttagcaaatagtctagcattattgtctgatggttttcacatgctaagtgacgctatatccttaggagtagctcttatagcttttatatatgctgaaaagcatgctacaaaaagtaaaacatatggttacaagcgttttgagattttagcagcacttttcaatggagttaccctatttatcatcagtattattataataatcgaagcgatacgaagatttttagaacctcctgaggttcaatcgaaggaaatgttcatcattagtgtgattggtcttatggtaaatatcattgtagcgatacttatgtttaaaggaggagatacctctcacaaccttaatatgagaggcgcatttttacatgtacttggagacttgttcggctctgttggcgcaatcgttgcttctcttttaatttggggctttaattttacaatagcggatcctatagctagtattttagtttcgttaattattttaaaaagtgcttacggcatttctaaatcatcccttaacatattgatggaaggaacgcctaatgatatagatttaaatgctgtaattaaagcaattagtaaagatgaaagaattcaaaatgtacatgattgtcatgtatggaccatttcaaatgatatgaatgcattaagttgtcatgcagttgtaccagaatatttatcagttcaaacgtgtgaaacaatgttaaagtcaatcgaaagtgacctattgcaattaaatattcagcatatgacaatacaacttgaaacaccagaacacaaacacgatgaatcaacattgtgctcaggtatacatgaacactctcattag

SEQ ID NO: 19 - DNA, 1686 bp, Staphylococcus epidermidis
atacataggttactcacagtttttaatagattttatcaatcattaaatagtttactaaattttacaggaggtcagacaatgacaaagtttatttttgtaacaggcggggttgtgtcatcattaggaaaaggaataacagccgcttctctaggaagattacttaaagatagaggacttaaagttacaatacaaaaattcgatccatatttaaatgtagacccaggcacaatgagtccgtatcaacatggtgaagtgttcgttacagacgatggtgctgagactgatttagacttaggacattatgaacgttttatagatattaatttaaataaatattcaaatgttactgccggaaaagtatattcacatgtgttgaaaaaagaacgccgtggtgattacttgggtggtactgtacaagttattccccatattacaaacgaaattaaagaaagattgctattagctggtgagagtactaatgcggatgttgtaattactgaaattggtggaacaacaggtgatatagagtctttacctttcttggaagccattcgtcaaattagaagcgacttaggtcgtgaaaatgtaatgtatgtacattgtactttgctaccatatattaaagctgctggggaaatgaaaacaaaacctacacagcacagtgttaaagaattacgaggtctaggtattcaacctgatttaatagtagtacgtacagaatacgaaatgacacaagatttgaaagacaaaatcgccctattttgtgatatcaaaaaggaaagtgttatagaatgtagagatgcagattctctttatgaaattccgttacaacttagtaagcaaaatatggacgacattgttattcaacgtttacaattaaatgccaagtatgaaacgcaattggatgagtggaaacatctattaaataccgttaataatttagatggtaaaattacaatcggtttagttggtaaatatgtgagcttacaagatgcttatctatcagttgttgaatcacttaagcatgctggttatccatttaaaaaagacgttgtggtaaaatggattgattcaagtgaggtcaatgatgataatgttgaggcttatttatccgacgttgatggtattttagttcctggtggatttggattcagagcaagtgaaggtaaaattgcagctattcgttatgcccgtgagaataacataccattctttggcatttgtctaggaatgcaattggcaactgttgaatttgcgcgtcatgttttaggctatgaaggtgcgcattcagcagaattagatccaagtacaccatatccaattatagatttattaccagaacaaaaagatattgaagatttaggtggaaccttaagacttggtctttatccttgccacattaaagaaggtacattggcagagaaaatttataataaaaacgatattgaagaacgtcatcgtcatagatatgaattcaataacgagtttagggaacaattagaaagtaacggtatggtattttcaggtacaagtccagatggtcgtttagtagaaattattgaaatacctaaaaatgatttctttattgcatgtcaattccatcctgaattcttatcaagacctaatcgtccacagcctatatttaaatcatttgtagaagcggcgttgaattaccaacaaaaataa

SEQ ID NO: 20 - DNA, 138 bp, Staphylococcus epidermidis
tacaatttaacctgtaccaaaataagagacactattcacaatgaacagtgtctctctttatatattaatttagataatcaatacataaaatattatattatcatgcaaattattttaattcatgacttacttgattag

SEQ ID NO: 21 - DNA, 126 bp, Staphylococcus epidermidis
agtaaaataacactaagagacaaaataaataatactttaatttctcaaaacatctgcctaaatgatcttaattttgagcttgttcatcttcttttattatcaattaaattatattttatcaattag

SEQ ID NO: 22 - DNA, 171 bp, Staphylococcus epidermidis
ttgttgcaaactcatatttatgtgaaagtccgttttgaattaaccaaattgcatagttataacaataaacacaatttccatcataataaattattggcatgtgtatacactcctttttcattgcttaattatttatattcccatttaggtataataaataaaccttattaa

SEQ ID NO: 23 - DNA, 294 bp, Staphylococcus epidermidis
gggagcttgactgcgagacctacaagtcgagcagggtcgaaagacggacttagtgatccggtggttccgcatggaagggccatcgctcaacggataaaagctaccccggggataacaggcttatctcccccaagagttcacatcgacggggaggtttggcacctcgatgtcggctcatcgcatcctggggctgtagttggtcccaagggttgggctgttcgcccattaaagcggtacgcgagctgggttcagaacgtcgtgagacagttcggtccctatccgtcgtgggcgtag

SEQ ID NO: 24 - DNA, 471 bp, Staphylococcus epidermidis
ctatggttgacccaaatgaataatttagcattacaaagccttaccgaaagtatagcgataaagtattttggcaaagcttttaagcacgaggtatattataataagcgtttacgtaccactggcggtagatatatattaagtagtcataatatagaaataaatccaaaacagtatgaaatgtttggagaaaaagcagtcattgatatcataaaacatgaactgtgtcattattttcttcatttagctggtgaaggatatcaacatcgtgataaagcattcaaaattttgagtgccaaagtaggagcacctaggttttgtactccgacagaatcttatcaagatagagctaattataaatataggtgcatctattgtgaacaagaatttattcgtataaagcgtgtgaatcttgaaaaaatgcgttgtggacgatgtggaggtattttaaaacttattcaaacaagaaagtga

SEQ ID NO: 25 - DNA, 123 bp, Staphylococcus epidermidis
ctccgtcatgcgctggttcgaatccagctagcccagccattagagccattagctcagttggtagagcatctgacttttaatcagagggtcagaggttcgaatcctctatggctcactttctag

SEQ ID NO: 26 - DNA, 786 bp, Staphylococcus epidermidis
tcatattgcgccctctactacaaagggagtaaaaatttaatagaaagaggtgagtttatggatcacaaatccccactcgttagttggaacgtctttggtttcgatattgtttttaatttggccagtgttttaatggtagtgattacagcaattttagtttttattttagctatagtttgcactcgaaacttaaagaaacgaccaactggaaaacaaaacttcattgaatgggtatttgattttgttagaggtattattgaaagtaatatggcctggaaaaaaggtgggaatttccacttcttagcagtgacattaattcttttcatttttgtggccaacatgcttggtttaccgttcgcaattgtcactcatgaccatacgctatggtggaaatcaccaacagcagacgctacggtaactctaacgttatctacaactatgattttgttaacgcactattacggtattaaaatgcgtggaacaaaagcttatgcagctggatattttaaacctttctggccattagctattattaatgtattcgaagaattcacttctacattaactttaggtctacgtttgtacggtaatatttttgcaggtgaattattactcggtttacttgcatcattgttctttgaacaacctgcatggggttggataattagtattcctggattaattgtttggcaagcgttctctatattcgtgggaacaattcaagcatatatctttgtaatgctttcaatggtttacatgtcacataaagtggcagacggacattaa

SEQ ID NO: 27 - DNA, 156 bp, Staphylococcus epidermidis
gatatgtatttgaagctaactatctttctcactcgtattgagtgtagcatatatgattatttcacaaactactatatgaatatactatcattttataaactttctatcctgtgtccatttgacgtaggattcttacatattatatcaactgcctaa

SEQ ID NO: 28 - DNA, 165 bp, Staphylococcus epidermidis
ccgttatattaccattttaagataacatttgtttatcttttttgcgaatttttgtactatataattgaaggtaaatatgttttgttttttaacgatatattaaagttatatgaagatttattatttggagatagtaataaactaaaaaacatggaggaaaaatga

SEQ ID NO: 29 - DNA, 1215 bp, Staphylococcus epidermidis
gcaatgaattattcttctcgtcaacaacctaaacgtaactggttacgtaaagtagactggatactcgtactagttatatcactattagcactaacaagtgttattttaatcagttccgctatgggtggcggacaatatagtgcaaatttcagtattagacaaattatttattatattttcggagctattattgcatttttaattatgataatttcaccgaagaaaattaaaaataatacttatattttatatagtatattttgcgttctattaatagggttacttattttacctgaaacttcaatcaccccaattattaatggtgctaaaagttggtacagtttcggtcctataagcatccaaccttccgaattcatgaaaattatacttatacttgctttggctaaaacgatatctaaacataatcaatttacatttaataagtcttttcagtctgatttaatgttattttttaaaattttaggtgtatccattatacctatggcattaattctattgcaaaatgacttaggtactactttggtgttatgtgcaattatagctggcgtcatgttagtaagtggaataacatggaggatattagcccctctatttattgttgcatttgtgagtggttctagtattatattagctatcatttataaaccatccttgatagaaaacctattaggaataaaaatgtatcaaatgggacgtatcaattcttggttagatccctattcatacagtagtggggatggatatcacttaacagaatctttaaaagctattggttctggtcaattattaggtaaaggttataaccatggcgaagtttatattcctgagaatcataccgactttattttttcagtgattggagaagaaatgggctttataggttcagtattattgatattacttttcttattcttaatatttcaccttatacgattagctagtaaaattgatagtcagtttaacaaagtatttatcataggatatgtatcgttgattgtttttcacgtgttacaaaatatcggcatgacggttcaattactaccgattacaggtataccacttccgtttattagttacggtggaagttctttatggagtttaatgactggtataggagtagttctttcaatttattatcatgaaccccaacgatatgaaatacccacattatctaaaaaatctaatacaatttaa

SEQ ID NO: 30 - DNA, 636 bp, Staphylococcus epidermidis
ttaagcgattatgttttgaaaaaggtggaactatcaatgtatgaaacgtaccattcaggttggattgaaaccataacaggaagtatgtttagtgggaaatctgaagaacttatacgtcgcttaagacgtggaatatacgctaaacaaaaggtggttgttttcaaaccagcaattgatgatcgttaccataaagaaaaggtcgtctcacataatggtaatgagatagaagcgattaatatatctacagctcaagaaattttaaatcatatgctagaagaagtaaacgtcatcggaattgacgaagtgcaattttttgaagacgatattgtcaacatagttgaaaaattagctgaaaacgggcatcgtgttattgtagcaggtttagatatggattttagaggagaaccgtttaaacctatgcccaagttgctcgcagttagtgaacatattacaaagttgcaagcagtatgttctgtatgtggttcaccttcgagtcgtacacaacggttaataaatggtgaaccggcgaaagtagatgatcccatcatattggttggtgcaaatgaaagttacgagccacgttgtagagcacatcatatagttgcacctagtgaaaatgagaaggaggaaatgtag

SEQ ID NO: 31 - DNA, 165 bp, Staphylococcus epidermidis
atctatacctattccataaatcacttgtatcgcctctttagtatatcaccaataatcttttatcaagtcttttatatatcatcgtttaatttttctaatgaagttacatttgtcgttattgatttttgttgtttaatttgttttttcaatctttgtgcttcttga

SEQ ID NO: 32 - DNA, 573 bp, Staphylococcus epidermidis
caagtttgctatgttccttttttattttatacaaaggggtgggttcaaatgcgtgatttacaacaactgcttgatgaattgaaagatatgtcattctttaatccaggcgaaatgtgtatcattggttgttcaacttccgaagttataggtaaacgtattggttctgttggatcaatggacgtagctaaagaaatttacgaaaatttgaaacaactagagattgatacaggcgtgacatttgcttttcaaggatgtgaacatattaacagggcagtaacgatagaaagagcaaatttcaacccattgactatggaagaagttactgtcgttccagacgttcatgcaggtggtagtttatccacttacgcttatcaacaaatggaagatcctattgttgttgagcatattactgtttcaaaaggtatagatataggtcagaccttaattggaatgcatattaaacatgtgtgtgttcctgtaagaacaagtgttaaacaaattggagaagctatcgttaccatagcgacatctagacctaagaaaattggtggcgaacgagctaaatatcaataa

SEQ ID NO: 33 - DNA, 1587 bp, Staphylococcus epidermidis
gtgaacatatatgtaaaaaagcatattaagaaatatacacgtaaaaggagaattattttgcaaaattttaaagaactagggatttcggataaaacggttcaaacattagaagcaatgggatttaaagaaccgacacctatccaaaaagatagcatcccttacgcgttagaaggagatgacatccttggacaagcccaaactggtactgggaaaacaggggcgtttggtatacctttaattgagaaagttgtaggccaacagggtgttcaatcattaattcttgcgccaacgagagagcttgctatgcaagtagctgagcaattaagagagttcagtaaaggtcaaaaagtacaagttgttacagtctttggtggtatgcctattgaaagacagattaaagcattaaaaagaggccctcaaattgtagtaggtacgccgggaagagttattgatcatcttaatcgtcgtacacttaaaactcaaggaattcacacgcttattttagatgaagcagatgaaatgatgaatatgggattcatcgatgatatgagatttattatggataaaattccagctgaacaacgtcaaactatgctattttctgctacgatgccaaaagcaatccaagaattggtacagcagtttatgaaagctcctaaaataattaagacaatgaataatgaaatgtcagatcctcaaattgatgaatattatacaatcgttaaagaattagagaaatttgatacatttacaaactttttagatgttcatcagcctgaattggcgattgtctttggtcgtactaagcgtcgcgtagatgaattaacaagcgcgctattatctaaaggatacaaagcagaaggtttacatggggatattacccaagcaaaacgtttagaagtattgaagaaatttaagaacgatcaaatagatattttagttgctacagatgtggctgcacgtggtcttgatatttctggtgtgagtcatgtttataattttgatatccctcaagatacagaaagttatacgcaccgtattggacgtactggtcgagcaggaaaagaaggtattgcagttacttttgtaaatccaattgagatggattatattcgacaaattgaagatgtcaataatcgtcgaatgaaagcattaagacctccacatcgtaaagaggtgcttaaagcgcgtgaagatgatattaaagatagagttcaaaactggatgtcaagagaaaatgagccacgtttacaaagaatatcaagtgaattacttaaagaatatgatagtacagaattagtagcctctttacttcaagaacttgtagaagctaatgatgaagtggaagtacaattaacttttgaaaaaccattagcacgtaaaaatcgcagtaataaaggcggttctagaagaagtaatcataaacgtggtaatggtaagtttgataataaaaatagacgatcaaaagggtctaaaggtcaatcaagcaaaaagaaaaaccaaaagaaatttgaccgtagagataagcaacaaaaaagtggtaatcaatcactaaaaggtcgcacatttgctgatcaccaaaaataa

SEQ ID NO: 34 - DNA, 141 bp, Staphylococcus epidermidis
aaatatgtatattggcgcaaattgtcattaaaatttagttctatatttagattatcaaatgcaattgaatttaaaaatatgataatattaagtttcagaagccgttatgtacttaaagtagtaaataaaaagatcaattaa

SEQ ID NO: 35 - DNA, 327 bp, Staphylococcus epidermidis
ataatacgatataatatgaacagaggtgactttatggcagacatggagagtgcacatcactcagagcaaataaaaacaaatttaaaatcaagattaaatagaatagaaggtcaagtaagagcaataaatcgtatgattgatgatgacgtttactgtgatgatgtactaactcaaattagagcaacacgttcagcattgaatagtgtagctactaaattactagaccatcacatgaaaggttgtattatggaaaaaataaacgacggtgcgcaagaagaagcaatggatgaattgctcgtgacattccaaaaattaataaaagattaa

SEQ ID NO: 36 - DNA, 207 bp, Staphylococcus epidermidis
tctgtgcgatattctttaaataagttttactattttgttatcacaatacgaattattttacctaaagagtttaattatctaagattaagcatcttgaatagcaaaagtaagttcacagctacaagcaagttggccatcaacagtcgctttagccgaacccttaccaataggaccttttattttagttatttcaacttccaacattaa

SEQ ID NO: 37 - DNA, 147 bp, Staphylococcus epidermidis
aaattgaagtatttaaaaacaaattacaacaattctaacgataataggaacgaactttgtatcaagttgtattataaaagacaaataatttttaatacgtacttaattttaaattttaagattcatagtttttcaatgcatctttaa

SEQ ID NO: 38 - DNA, 129 bp, Staphylococcus epidermidis
tttaaatatctttgctattggtcattgaacataagttcagtggcctctttttatgctataataatgacagaaatttacattttatggttacaatattcaatttcgggaaggttttatataataaaatag

SEQ ID NO: 39 - DNA, 150 bp, Staphylococcus epidermidis
aattctcatcttgactacctgtgtcggtttgcggtacgggcacctgttatctatctagaggcttttctcggcagtgtgaaatcaacgactcgaggaaacaatttcctctccccatcacagctcagccttatgagtgccggatttgcctaa

SEQ ID NO: 40 - DNA, 375 bp, Staphylococcus epidermidis
acaaatattcatatgttggagtgtgaattttcaatgagtggatatcatattaacgttgaaagcaatcaggatacattgattaaagtcactcatattttcaaagctttaagtgattttaatcgtgtgagaataatggagtttcttgaaaacggtgaagcaagtgttggacatatttcacattctttaaatatgactcaatcaaatgtatcacatcaattgaaactacttaaaagcactcatcttgttaaatctaaaagacaagggcaatcaatgatttattctatagatgatatacacgtttcaactttacttaaacaagccattcaccactccaaacatcctagtgaaggtggaatttctaatgacaaatcataa

SEQ ID NO: 41 - DNA, 132 bp, Staphylococcus epidermidis
atgatttctcatcaaccatttcttttgtgtaatcttgaattttcatataaaaatacttcctttcaaaggattttctttaaattaacgtcaaataatcatttgttaatagtaacaaaaataaattataaatga

SEQ ID NO: 42 - DNA, 672 bp, Staphylococcus epidermidis
aaatcaagtcaaaaaggtagagatatgaatatgatgtttgattcaaaacaattatcagtctattttatttgcggaacacaagatatacctaaaaataaatcaattgagcaagttctcaaagaggcattagaagctggaatcacgctatatcaatttcgtgaaaaaggtccgaatgcactaaaaggggaaaagaaaaaacagttagccttaaaacttaaacaattatgtcactcatatcacgtacctatgatagttaatgatgatgttcaattagcccaagagattaatgctgatggcattcatgtaggtcaagatgatatggaaattcaacaatttgcaagccaatttaaaaataagattataggtttaagtgttgggaatttgaaagagtatcaacaatctgatttgtctaaagttgattacattggagtaggtccaatgtatacaacatcatcaaaagatgacgctagtaaacctgttggtccatctatgatatctcaattaagattatatattcatgattttcctatagttgccattggaggtataaatgaaactaacgtgcagcctattgttgacgaaggtgcagatggtatttctgtcatctcagctattacacgtagtaccaatatagacaaaacggttaaatatttcttaagatatttcacctaa

SEQ ID NO: 43 - DNA, 669 bp, Staphylococcus epidermidis
gtaaggagtctatctatgaactcaagaatgaagattaaaaaagcttatgagtatatgaaaagtttccatcaacatgatacaactggacatgatattgcacatgtggaacgtgtctataacaacgcttgttatatcgctaaacgagaaaatataacagatacacttgttatagaactatcatctttattgcatgatactgttgatagtaaattaactgatgaaattttagcatatgatcagcttaaacagttcttatctaccctagatttaagcagtgaaatatcacaacaagttctctatattattaaacatatgagttatcgagctggtaaaaataatcacgttaaactttcaatagatggtgaaatcgttagagatgctgatcgcctagatgcaataggagcaatcggcattgcgagaacattccagttttcaggacactttggtgaacctatgtggactgaaacgaagctttcaaatgaagagttacatacgtctctcgttgaagaattagacaattcagcaataaaacatttttatgaaaaattatttaaattaaaagatttaatgcacactcctactgcaaaaaaacttgctgaagaaagacatcaatttatgattcaatatctcaaacaatttatgtcagagtggaattttaataaagagtaa

SEQ ID NO: 44 - DNA, 687 bp, Staphylococcus epidermidis
actaaaaaacatggaggaaaaatgatgaataaagcaaaattgatagaccatacattattaaaacctgattcaacaaaggaacaaatagatactattataaatgaagcaaaagcatatcagtttaagtctgtatgtgtgaaccctacacatgtacaatatgcatctgaacaacttaaaggaacagacgttttagtgtgtactgttattggatttccactaggtgcaacaactacagcggttaaatcttatgaaacaaaagatgcgattaacaatggtgcccaagagattgatatggtgataaatattggagcacttaaggatggctgttttgatgaagtgcaaaatgatatcgaagccgtcgttcaagcagccaatggtaaaacagttaaggtaattattgagactgttttattaactgagaaagagaagattaaagcatgtcaattatctgaagcggcaggtgcacattttgttaaaacatccacaggttttgctggtgggggtgcaacagttgaagatgtaaaattaatgaaagatactgttggtgatcgtttagaagtaaaagcgtcaggcggcgtgagaaatctagaagattttaataatatgattgaagcgggtgctacacgtattggtgctagtgccggtgtgcaaattattcaaggacttgaatcaaatactgattactaa

SEQ ID NO: 45 - DNA, 486 bp, Staphylococcus epidermidis
aataacatgcaatctacacaagattatattgaaatgcggttgccagcttctgcagaatacgtaagtttaatacgtttgacgctttcaggggtgttttcaagagctggcgcatcttacgatgatatagaagattctaaaatagcagtgagtgaagcggtgacaaatgcggttaaacatgcatataaaaaaaattctgaaataggcatgattaatctttgttttgaaatatttgatgatagaattaaaattgttatttcagaccaaggagaaagttttgattatgaagccacaaaatcacatttaggtccatataatgataatgaaaatattgattttctacgtgaaggtggtctaggattatttttaattgagtctttaatggatgaagttactgtttataaagaatctggtgtaacaatcagtatgattaagtatataaaaaaagagcaggtgcgaaataatggcgaaagagtcgaaatcagctag

SEQ ID NO: 46 - DNA, 2187 bp, Staphylococcus epidermidis
gtaatttttaaagaaaagcgtggtagaaaaaaacaaatggataacagtttaattgaaacaattgtaagtaaatatcaattttcggaaaaacaaattaaagcagttttaaaattgctgaaagaaaacaatacggttccatttatagcgagatatcgtaaagaagctacaggtggacttgatgaagtagaaattaaacaaatcaatgatgaatataactatatgttaaatcttcaaaaacgtaaagaagaagtaatacataatattgatcaacagggtcttttaacttcagatttaaagcaagacatattaacacagacgaagctccaaagagttgaggatttgtatcgtccatataaacaaaaaaagaaaacacgtgcaactgaagctaaaagaaaaggattagaagatttagcagattggttttcacaatcaaaattggatacaaaaattgaagataaagcccaattattcttaaatgatgaagtgactacaattgaagatgcaatagaaggagctaaagatattatagctgaacgtatttcggataatcctcaatatcgctctaaaatacttaaagatgtttttaatcagggactaattgtttcctcgaaaaagaaaaaagccgaagatgagaaacaaacattttctatgtactatgattacaatgaaccaattaaacgtattgctaatcatcgtgttttggcgatgaatcgaggagaaaaagaaaaagtattatcaataaaaattgattttgacacgacacgtattcaaagagaaatagcaaatgttgagataaaaactcaaaatgaggcaactccgtttattaaagaggctattcaggatagtcttaagcgattaattcttccttcaatagaaagagaaattagaggagatttaacacaaaatgcagagtctcatgcaatagatgtattcagtgaaaatcttagaaatttattactacaaccaccaatgaaaggtaaacaaattcttggagtagatccagcatttagaacaggttgcaagcttgctgtcgtcaatccatttggtacctttattgctaaaggtgttatttatcctcatccaccaatatcaaaagttgaggaagcggaaaaagagctagtaaaggtgataagtgactataatattgagcttttagcgattggtaacggtactgcgagtagagaaactgaacaatttgttgctaaagtaataaaaaaatatcaacttcaagctcaatttatcatagtcaatgaagctggcgcatcagtttattcagcatcagaaattgctagacaagaatttccagattttcaagtagaagaacgaagtgcagtttcaattggtagaagagttcaggaccctttaagcgaacttgttaaaatagatcctaaatctataggagtaggacagtaccaacatgatgtcaatcaaaaagatttaagtagtgccttaacgtttgtagtagagactgccgtcaatcaagttggtgtggatgtgaatactgcttctaaatccttgttacaatatgtatcaggtcttacatcaactatcgctcaaaatattattgattatagagaagaaaacggacctataaaacatcataaagaaataagtagtattaaacgattaggtgcaaaaacatttgagcaaagtattggttttttaagaattgttgatggtgaagaacctttagataatactgcaatacatcctgaaagttacgatgttgcatatcgcatgcttcatcaactagatttaactgcacaagatataggttccgttaaactcaaaaatacgttatcaaatgttaatatttcaacacttgtgtctcaattaaatattggtgaacctacattaaaagatataatacaatctttgattgcacctaatagagatccaagagatgaatttgaaacacctattttgaagtccgatgtattatcgattgaagatttatctaaaggcatgaagttgaatggtacagtaagaaatgttgttgactttggagcatttgtagatatcggtgttaaacaagacgggctagtacacatatcaaaattatctaagaaattcgttaaaaatccaatggatatgataagtgtaggagatattgtagaagtttggattttagatatagatgaaaataaaggcaaagtttcattgactatggttgacccaaatgaataa

SEQ ID NO: 47 - DNA, 1404 bp, Staphylococcus epidermidis
attaattttaagataaggagcattataatgactgaggaaattaactatttttggcttaattgtggttacaatagatggaatcataatgaaccattagtgggacagacagcgttatttgaatctggcgcacattttaatcctacacaaggatatagagcatttaaaaaagctaaagctggagatcaagtgattttctatcaagtacaaacagattctggacttttaggtataggtgaaattataagtgtgcaatccggtgctcaaaataaaataagagtagaatttaaatttaaagaaacgctaaaaccacttacaacggattatcttaaaagaagtgaaacactcgattttcgtatgagtaacatgagggaaacacttttcaaccaaatcagagagtcagaatttgagttaatagttagtttaggtaaaggaaaatcgaaaattcctcgatattttttattagcagaaacagaagcgtttgaacctggtaaaaactatactatatttactcatacatttaatggaatcaaaaggaatggttatcatttttacactcaactagaggtgggtgataacattattatatataataaatatcaaaaccaatcggttatcggtattggcgaagtatcaaagcatatacatgagaaaccacctataccaggtcgaacgaatagtacagctattgaaattttttatgagaaagatatcaagcccatttcattaggtcatttaaataaacatcctaaattgaagaatctgtactttttacaagaaaatgcgaaacagtcaatagcaagtatgtcacaagctcaatacgatgccattttggacatgagtatgaataatggtattaaacatccttttgaaacagtaaaaaaagcagaactatcaactcaaaatgctgaagatgatagtttaaaaccttttgtattattagttgttgaacaaaaaggagaaggcttaaaggcagctgaagaattactccaaaaaacaaatgcaaaccctgtgattactagcggacatccagattttactgaagatatgctttatggtaaatatttacctaatgagtcaggagcgctatattatcgtgaaggattcatcacacatctaatgcctaagaaagataaaagttatttagtcattgataacttcaatcgcatcgatgtagatattttccaaacatatattaatgtacttgaaggctatgaagtgacattaccgagatataataaagatggaagcatgattaagtggtcaaaaaataaagattctttttatcattttaatcctaattggcatattgttggtattacatatgactctatagaaaaaattaagcaaaaatattcgtcacagtttttaaaatatacgcgtatcgtcaaagtgaatcatgactaa

SEQ ID NO: 48 - DNA, 1155 bp, Staphylococcus epidermidis
aatttgtttaattattataaatccggatttcaaaaagcaaaaccacataatctaaagttaatactactctcattaataacttttgtcatttgctatattacttctaatattgcattctcattagttatattaagagctcaaaggttaccaatgttagctcaactcggtgaatctactacaaaacctataatatctattatttttattttactcattttagctttattatttatttttgtaggttacccattgataactggtacagtatatgcaattcaaaaagctattaataaagagaaagttctttttagtgatttattttttgcttttaaaaaaggcaaatatgctaaatcagtaattttagctttaataactttagttttattcattgtaatcgtacttattctagtgctattaaataaattatatagtttagctcttagcccaatattaatcggcttacaacaatcaataagcggctacgacaatccaatgggaattttaattacaatacaaattgtgttgttactcataacaggtttcatctcatcaattttctattggtttgtaattatattcattattaattatactaccgcttatacagaagattcatctcgtaaagtaatgagtaatttaaaagaaggatttaaaggtattaaaaacggtaagaaaacttggtttaaatttttcattggcgtattacttattagtttacttgcaagtattattaacaaaccgctattattcggtgtacaatacttaacaagcagtatgtctcaaacggtggctcaaactattattataatagctagaatcgtatctatagtattacgcctatgtctttattacattttgatttttggaattattaattatttcgttagacgtggtgacaaaccagtcaaaagcaaaagacgtcataaaaataaagatattaacaaaggtaatgtaaacgacaaagtagatactaaattaaatgcttccaactccaaagatacagaagcagataaaatgaaagatcaacaaacacatatacaacaagacaaaactgatagtcaagaaaataacatatatgattccatcaaagaaaaagtaaatgaaaataaagaaaatgttacagaacaatctaaaaatctatttgataagaaatag

SEQ ID NO: 49 - DNA, 183 bp, Staphylococcus epidermidis
acaatttataagatattttttatagttgttttgtataagaaaaacgtgactttcgatcagcaacatagcacgggtggaattttaattcaactttttgaaaatgaattaaattctgcccttatttctttacagcatataatcacagaagaggtgaaaacatgcacacacaaatatgggatttaa

SEQ ID NO: 50 - DNA, 501 bp, Staphylococcus epidermidis
aatcattataatataataaccattgtaaaaatgaggttcgaaggagtgtttgatatgagtcaacaacaagatgtagtcaaagaattaaatcaacaagtcgcaaactggacggtagcttatacaaagttgcataatttccattggtacgttaaaggtcctaatttcttttctttacacacaaaattcgaagaattatacaatgaagctagtcaatatgttgatgatttagcagaaagaattttggcaataggtggtaatccaattggaacactttccgagtgtttagataaatcaatagtaaatgaagcaggaaaacattattcagctgaagaaatggtagaagaattgtctaaagatttttctaaaatctctaaacaattagaacaagcaattgaagtgtcgggaagtgctagtgatgacgtttcagaagatatgtttatcggcatgcaaacttcagttgataagcataattggatgttacaatcttatttaggtcattaa

SEQ ID NO: 51 - DNA, 963 bp, Staphylococcus epidermidis
gcttttaataatggaggtgtgaacatgccgttatttttaaaacccatttttctggataaagtatggggcagtgataatcttcgtcaatttgggtatcaactacctaataatcacataggtgaatgttggggaatttcagcacatccacacggaaaaagtgtgattgaaaatggtatatttgctggtcaaacattggatcaagtatggaacaatcatagagaaatatttggagattttccaagtaaagattttccattaatggctaaaattgtagatgctgctgcgccattgtctattcatgtacatcccgacgattcttatgcatatgaacacgaagaaggtcaatatggaaaatctgaatgttggtacatcattgaagctgatgaaggtgcaaagattactataggtacgtatgcgaaatctcgtgatgaatttgaagagcaattggagcaaggtacatttgaaaattatttgagaacaatacaagtgcaaccaggtgatttttactttataccagctggaacgatacattctataggtgcaggcattatggcgtatgaagtcatgcaatcatcagatatttcatacagaatttatgattatcatagaaaaactgataatagcgaggaacgtgaattaaatatagataaggcattagatgttattaattattcaaatgaactacctaatatcactcctcaaaatgaagtgatagaaaatcacaattgtacacatattgtatctagtgatttttttactatggttaagtgggatatttctggaactctaaattatatgaagcctagagaattttgtcttgtttctgttttagatggacaaggtaaacttattgtagatggtgatatatatgaaatatctaaaggttcaaactttgtgttaacttccgaagatttagatagtgttttcgaaggagattttaaactaatcattagttacatttaa

SEQ ID NO: 52 - DNA, 219 bp, Staphylococcus epidermidis
aatgttaataatcataaaaattatatgtttgatgattgttgtcttatgaattttatcattagacgtcttattaattgtaaagtaataatcgatgacttgaatatgatgatgtcacttttttatattattaatgtccatataaaggtaattttagttatccttgacttacgctatggtagtaaaataaataaaaagaacatatttgtattttttaattga

SEQ ID NO: 53 - DNA, 1194 bp, Staphylococcus epidermidis
gtaatgaataataaagtaaatggtccgtttctcacacttagtgatttgtataatgatgacattgtttacacatctcgaccttcatatgtgtcgaacccatggttgaaaccagatgaacaccaatcaaatttcttaactggaagagaattacttatagctaatcgttttcctgtcattgttcatgaggcaagtgttacaaacaaattagaacaactttttaatatagtgggtagggaaattccaccacatacttataaatttaaagatcaagaaacatatgaaagcttgataaggaatttagctcttcatcaaggtaaaaaaatctactttcaatatattcataatgaagatattttacctaaagaatattatgcacttgataaagatgtttttgttgctcttaataataaagcacgaattccagaatggactaataacaaatatctaccacaaagagaaattgtctcaattaaagattttgaatctcgtattcaagcatggtcgtatccatttgtcataaaaccaggcgatgatttacctacagcaggaggatatggtgttatgatttgttataatgatacagatttagataaagctatcacacgcatcaacaatgcatcagcagagactgaacatttaatcattgagcaaaaaattaatgcagtgaataactattgtgtacaatttgcttattcagatgatattggtatcaaatacttaggaacagcgcaacagttaactaatgactatggattttacaacggaaatgaaaatgttaatgatgtgcctcagaatgtaatagacgctggtagagagattatggaaataggcgtaagcaaaggtttttttggtgtagcaggttttgacttactagtagatgataataatgatgtttatgcgattgatttaaactttaggcaaaacggatcaacgagtatgctacttttagcaaaagatttaactcatggatatcataaattttacagttacttttctaatggagataatacaaaattctataatgctattttaaaatacgtagaattaggtgtactttatccactttcctattacgatggagattggtatggaaagaatcaagttaattctagatttggctgcatttggcatggggaaaataaagaattaattaatcaatatgaacaacaatttatattggaagctggattataa

SEQ ID NO: 54 - DNA, 792 bp, Staphylococcus epidermidis
atgatgaataatttagaacgattacgttcagaaaatccactcgtaatttgctataccaatgatgttgtgaaaaactttactgcgaatggtttactaagtttaggtgctagtcccgcaatgagtgaggcaccagaagaagctgaagattttactcgaatggctagtgcgcttttaattaacatcggtacactcacacgtgaaaatgaagaagacattatcaaaataggtaaaattgctaatcagcaaggtacaccaatagtttttgatccagtggcagttggtgcttctacatatcgtaaaaatttttgtcaacgttttcttggtgaagttaatgtcacagtaataaaaggcaatgcttcagaaatattgacattaatagattttaatacaactatgaaaggtactgacagtgacagcgaattagattcagtaaatattgcaaaaaaagcggctaatactttaaatactgctattgtcattactggaaaagatgatattattgcaaaaaatgagaaaataattaaattatctaatggttctccgcttcttactaaaatcacgggggctggatgcttgttaggtggtgtattagcaagtttcttgtttagaaatactcaaccttcaattgatttattagttgaagcggtaagtgtctacaacatcgcagcagaatttgctgaacaagcgcctcatgtaaatggacctggtacttttctatctgaactgctagatcaactttatcagatgaatgacattacttataaaaatcaagtcaaaaaggtagagatatga

SEQ ID NO: 55 - DNA, 870 bp, Staphylococcus epidermidis
atggaggataatatgaaaaatataaaagcaatttttttagatatggatggaacgattttacatgaaaataataaagcctcggaatatactaaacaagtgattaatgaattgagagagcaaaattataaagttttccttgctactgggagatcttattcagaaatcagtcagcttgttcctgatggattcactgtagatggtattatcagttcgaatggaacttcaggtgaaattcatggagataatttgtttagacatagtttaactttagaacgagtacagaaaattgtggaattggctaaaaaacaacatatttattatgaagtttttccttttgaaagtaatcgtatatctcttaaagaagatgaagattggatgaaagaaatgatttccactatagagccacctgacgctgtaagtcaaagtgagtggtcatcgcgaagagaggcaattaaaggaaaaatagattggcgagataccttacctgatgcacacttttctaaaatatatttatttagtcccaacttagataaaataactgattttcgcaaccagcttgttgaaaaccaatcaaatttaggtattaccgtatctaattcttcgcgttataatgctgaaacgatgccatatcatacagataagggtacaggtatcaaggaaatgattgatcactatggtattaagcaagaagaaactttagttattggtgatagtgataatgatagagctatgtttaattttggccatcacactgttgcaatgaaaaatgcaagacaagaaattaaaaatcttacagatgatattaccgaatacacgaacgaagaagatggtgcagcacattacttaaaaagtcatttattagataactag

SEQ ID NO: 56 - DNA, 1026 bp, Staphylococcus epidermidis
agtggaagtaaggaggcgcatttcgtggaagaattcacaaaaagttataaagcccttgttaaagaaagtttaataactaacaataaaacattattaattaagaaatgtgaagcattcacaaatgaagttataaagaaagatgttttacctgaagatatagttgagatacataaagattatattaatacattagatttaactgaagaagatatattagaaacactcgatgtgttacaagaagtcgttaaaggatttggatatagttaccgagattaccaaagacttgttaataagcttcaagtccacgataaagaaatggatttagcctcaagacttcaacaaactatgctgaaagctgatattccacaatttgatagcattcaaataggagtgatatctgttgctgcacaaaaagtaagtggtgattattttaatcttattgaccataaagatggcacaatgagttttgctgtggcagacgttataggttcaggcataccagcagctttagctatgagtatgataaaatttggcatggatgcttatggacattcacaactacctagtgatggtttgaagcgtttgaaccgtgttgttgaaaagaacgttaaccaaaatatgtttgtcacaatgttttatggactgtatgaagagatgaatcatctactttactgtagctcagctgggcatgaacctggctatatatatcgcgcagaaactgaagcgtttgaggaaattggtgtgcgaggaagagttctaggtgtgagtcccaaaacacgttatagccaacaggaaatccctatttatcttgatgatttaatcataatttttactgatggtgttacagaggcacgtgatgtagagggtaattttattgataaagataagttgttagacttaattcaaaaatataagcatatgcatccacaggatatagttcaaattatttacgaagcgattttaaaattacaaaatcctgcgagaaaagatgatatgactattttaattataaaaagagtaaactaa

SEQ ID NO: 57 - DNA, 225 bp, Staphylococcus epidermidis
gccaacatcctagttgtctgggcaacgccacatccttttccacttaacatatattttgggaccttagctggtggtctgggctgtttccctttcgaacacggaccttatcacccatgttctgactcccaagttaaattaattggcattcggagtttgtctgaattcggtaacccgagaggggcccttcgtccaaacagtgctctacctccaataatcatcacttga

SEQ ID NO: 58 - DNA, 399 bp, Staphylococcus epidermidis
gttcgaatcctacctgcggagccatggctccttggtcaagcggttaagacaccgccctttcacggcggtaacacgggttcgagtcccgtaggagtcattttatggagaattagctcagctgggagagcatctgccttacaagcagagggtcggcggttcgaacccgtcattctccaccatttaattaaatactgcggaggggtagcgaagtggctaaacgcggcggactgtaaatccgctccttcgggttcggcagttcgaatctgcccccctccaccattcttgggctatagccaagcggtaaggcaacggactttgactccgtcatgcgctggttcgaatccagctagcccagccattagagccattagctcagttggtagagcatctgacttttaa

SEQ ID NO: 59 - DNA, 465 bp, Staphylococcus epidermidis
aaatttaacaagaatttgaatagaattgacaccataccacaggctatattatcatttagattgtatgagtggaacggtttacatgattggtataggacactcggaggctataaaatgcgtcgtttcaacatcattttcaaacaatatttgcaatattatctttatatattggtaataattggaatattgtactcaatttcaccccacccatttctcttgggtcttatgataggtacatgtggttctttagtaaatacatacatctttgagatttatttagctaaatcaatgcataaagaaactacacaaatgtctactggtagtacttggaggtatttagtggcagttattgcatgtgtattatggttattctttaaagaacacattaatattatcggagttttaattgggttaatgatttcttatattgtaatcatattgcgccctctactacaaagggagtaa

SEQ ID NO: 60 - DNA, 1332 bp, Staphylococcus epidermidis
aatgggtgcaagtctatgcctggtagagaacgaacatctccgcagtatgaatctttccacgaattatataaaaacaatactactaaagagctcactcaaaaagccaaatctttaaaattaactaattacagtaaattaaataaaaaagaattggtacttgccattatggaagcacaaatggaaaaagatggtaattactatatggaaggaatattagatgatattcaacaagatggatatggtttcttaagaaccgttaactattctaaaggtgagaaggatatttatatttctgcaagccaaattcgacgttttgaaataaaacgtggtgataaagtaacgggtaaagttcgtaaaccaaaagataatgaaaaatattatggtctacttcaagttgattttgtaaacgaccataatgcagaagaagtcaaaaaacgtcctcacttccaagctttaacacctctttatccggaagaaagaatcctattagaaacgcaatctacaaattattccactcgtattatggatttagtcacaccaataggtcttggtcaacgtggtcttatagttgcaccacctaaagctggtaagacaagtttattaaaagaaatcgctaacgcaatagcgagtaataaaccggaagcgaatttgtttatattactagtaggtgagcgtccagaagaagtgacggatattgaaagatcggttgaatctgcagaagtcgttcattcgactttcgatgaaccaccagaacaccatgttaaagttgctgaattattattagagcgtgcaaaacgattagttgaaattggagaagatgtaattatacttatggactccataacacgtttggcacgagcatataatctagtcataccacctagtggacgtacattgtcaggtgggcttgatcccgcttcattacacaaacctaaagcgtttttcggtgcagcacgtaacattgaagctgggggaagtttgacaattttagctactgctttagttgagacaggatctcgtatggatgatatgatctatgaagagttcaagggtacaggtaatatggaattacatcttgatcgtaagttatcagaacgtagaatattcccagcgatagacataggtcgtagttcaacacgaaaagaagagctattaatcactaaagcggaattagattcattatggcaattacgaaatttatttactgattcaacagactctacagacgttttattagaaaacttaagcgttcgaaaagtaatgaagaattgtttaagcaattgccaaaaagcagttgaagagagtactaaaactggaagaccaattatttaa

SEQ ID NO: 61 - DNA, 399 bp, Staphylococcus epidermidis
cacatgttaaataaaatagtcattgttggtagaatgacgaaagatgctcaaatctatgaaaaggaggataacaaaatagcaacattttgcgttgctacagaaagaaactacaaagatgataataatgaaatttctacagattatttactttgtaaagctttcggtaaaactgccactaatattgaaaagtacactagtcaaggtactttagtaggtataactggacaaatgcgttcaagaaaatatgaaaaagaaggccaaacacattttgttacagaattatacgttgaaacaataaaattcatgtccccaaaaaataaaaacaatgaaactccctctgataatcaatttgaaaacaacacttatcaacctgatgatttagaaataattcatatttaa

SEQ ID NO: 62 - DNA, 327 bp, Staphylococcus epidermidis
atgaatctaaatattgaaacaataactcatgatgatttttatgaggttaaagttggtggagaattggacgtatatactgtacctgaattagaagaggtactagtaccaatgagacaagaaggcacacatgatgttcacgttaacttagctaatgtgagctatatggattcaacaggtctcggtttattcgtaggcacgttaaaagcattaaatcaaaatgataaaaatctctatatcttaggtgtttcagagcggataggtagattgtttgatattacaggtttaaaagatttaatgcatgttaatgaaggaacggaggtagaataa

SEQ ID NO: 63 - DNA, 714 bp, Staphylococcus epidermidis
atgaagctaaagagagagttcacgcactcacatctaaatatccattatataattaatagacatacacattggaggaaaatgattatgagtaaagtacatgtttttgatcacccattaatacaacacaaactaagttatattagagatgctcgcactggaacaaaagagtttagggaacttgtagatgaagtcggtatgttaatggcttatgaagtaactagagacttagaactgcaagatgttgaaatacaaacacctgtgactaaaatgacagctaaacgtttggcgggtaaaaagttagcaattgtacctattttaagagctggtctaggcatgacagatggtgtgttaagtcttgttcctgctgctagggtaggacatataggactatatagagatccagagactcttgaagcggtagagtactttgcgaaaatgcctcaagacatcgatgaacgtcaaattattgtggttgatcctatgcttgctactggtgcttcagctattgaagcaatttcttcattaaaaaaacgtggagctaaaagtatacgttttatgtgtttaatagctgcccctgaaggcgttgaaaaaatgcaagaagcacacccagatgtagatatatatattgcggcattagatgaaaaattaaatgacaaagcgtatattacaccaggtttaggtgatgcaggggatagattattcggtactaaataa

SEQ ID NO: 64 - DNA, 1512 bp, Staphylococcus epidermidis
atggccataaaagctgaagaaatcagtgcattgcttcgctcacaaattgaaaattatgagtcagaaatgtccgttacagatgttggtacagtactccaaattggtgacggtatcgcattaattcacggacttaacgacgttatggctggtgagctagtagaattccataacggtgttcttggtttagcacaaaaccttgaagaatctaatgtgggtgtggttattttaggaccatatgaagaaattagtgaaggtgacgaagttaaacgtactggccgaattatggaagtaccagtcggagaggaaatgataggaagagttgttaatcctcttggacaacccattgacggacaaggtccaatcaatgcgactaaaactcgtcctgtagagaaaaaagcaactggcgtaatggatcgtaaatctgtagatgaaccattacaaacaggtatcaaagcaattgatgctttagtaccaattggccgtggtcaacgtgaattaatcattggtgaccgtcaaactggtaaaacaactgttgcaattgattcaatcttaaaccaaaaagatcaagatacaatttgtatttatgttgcaataggtcaaaaagattcaacagttcgtgcaaatgttgaaaaattaagacaagcaggtgctttagactacacaatcgttgtatctgcatccgcagctgatccagcaccattactttatattgcaccttattctggtgtaactatgggtgaagagttcatgtttaatggaaaacatgttcttatcgtttacgatgatttaactaaacaagcggcagcataccgtgagctatcattattattacgtagaccaccaggtcgtgaagcatatcctggggacgtgttctacttacacagtagattattagaaagagctgcaaaacttaacgatgatcttggaggcggttcaattactgctttaccaatcattgaaactcaagctggcgatatctcagcatacgttccaacaaatgttatctcaattactgacggacaaatattcttacaatctgatttattcttctcaggtgttagaccagcgattaatgctgggcaatcagtatctcgtgttggtggttcagctcaaattaaagcgatgaaaaaagttgcaggaacattacgtttagacttagcttcatatcgtgagttagaatcatttgcgcaatttggttctgatttagatgaatttacagctaaaaaattagcgcgtggtgaacgtactgttgaagtattaaaacaaggtcaaaataacccactgcctgtagaacatcaagtacttattatttttgctttaactaaaggttacttagatgatattcctgtccaagatatcaatcgttttgaagaggaatttaaccactgggctgagtcaaatgcaactgaattattaaatgaaattagagaaactggtgctttaccagatgctgataaatttgattctgctatcacagaatttaaaaaaggatttaataaatcagaagaataa

SEQ ID NO: 65 - DNA, 126 bp, Staphylococcus epidermidis
aaaataataaacaataacctgagacatcaatcgttgtctcaggtattttttgtggtagatgctaatggactttggttaaaacatgagttaacaatatatcttttatttgaatttactctttattaa

SEQ ID NO: 66 - DNA, 132 bp, Staphylococcus epidermidis
gtgacagcaaaaccgtctttcactattgaaccatgcggttcaatatattatccggtattagctccggtttcccgaagttatcccagtcttataggtaggttatccacgtgttactcacccgtccgccgctaa

SEQ ID NO: 67 - DNA, 543 bp, Staphylococcus epidermidis
ataatggcaaaggtagcaaaaaaatatgccaaagcattatttgatgtcgctctagatacaaatcaactagatgttgtctatgaagatttagaaacaattagccattcatcgtttgatttcatcaaacaacttaaagcaattgatagtaatccaagcttaactgcaaatcaacgtgaagaatttgtagaaagagtttacaacgaagcaaatccatatgtggtaaatactttaaaagtattagcagataaccgacatatttcaattgtagagaatgtttttaaatcattccaaaatttatataacaaatactacaaacaagattttgcaattattgaatcgacttacgagttaagcgaagatgaaatatcaagaattgtagaacttatcaaaaagcaaactgaattatcaaatgtaattgttaacactaaaatcaatcaagatttaattggtggatttagagttaaggttggaactacagttatggatggtagtgttagaaatgaccttgttcaattacaaagaaaatttgaaagagctaactaa

SEQ ID NO: 68 - DNA, 204 bp, Staphylococcus epidermidis
ggaaatcaaaagtcttatcttgttccctttttatattcaaagttaaatattttaatgagtataattatactaaattttctacttttaaatgaacttgaaaagagtgtaatgcttgattctattgaatccaatttaaagcattgttattttaaagggtcattttcagaaaataatggtatagtaatcaataaaacgctttattag

SEQ ID NO: 69 - DNA, 1296 bp, Staphylococcus epidermidis
tattttaaaaagaaggaaacaaaggagaaaagtgatatggctcaagaggtaataaaaattagaggtggacaagcactaaaaggagaagtagaaattagtggagcaaaaaatagtgcagttgctattatccccgcaactttattagctcaaggacaagtaaagttggaaggccttcctcaaatctctgatgtcgaaactctagtaagtttgttagaagatttaaatattgaagcaagattaaatggtaaacaattagaagtggatactacacaaatagagaatgcacctctacctaataataaagttgagtctttacgtgcttcttattatatgatgggcgcaatgcttggtcgttttaaaaaatgtgtaattggattgccaggtggatgtccactcgggccaagacctattgatcaacatattaagggattcaaagcattaggagcagaaattgacgaatctagcaatacatccatgaaattagtagcaaaagaacttagaggcgctcatatatttttagatatggtaagtgttggagcgacgattaatattatgcttgcggcagtccatgccaaaggtcaaactgttattgataatgcagccaaagaacctgaagtcgtagatgttgcaaactttttaatgagtatgggtgctgatattagaggagcaggtacaacatcaataaaaatcaatggtgttgaggaactaaaaggttcagagtatcaaattattccggacagaattgaagctggttcttatatgtgtatggccgcagcaatgggtgaggaggtcattttacataatattgttcctaaacatgttgaagctttaactgttaagttgcaagagttaggtgtagatattgaaattgaagatgaaaaaataatcattcgtaaacaaacaccgtataaaaatgtagatataaaaacgcttgtttatccaggttttgcaactgatttacaacaacctattacaccattattattcatgacagaaggaccttcgtttgtgactgatactatttatccagcgcgttttaaacatgtagaagaattacagcgtatgggtgctaatattaaatcggatgagggaacagctgtgattaaaccttcgacacttaatggagctgaagtatatgcaagtgatttacgcgcaggcgcttgcttaattactgcaggtttaatagctgaaggtgtgacgacaatatttaatgtaaaacatatttatagaggatatactaacatcgttgaacatcttaaagcacttggtgctgatatttggacggaaacggtataa

SEQ ID NO: 70 - DNA, 144 bp, Staphylococcus epidermidis
cctcataaaaatcatcatgagttattgtttcaatatttagattcatttaatacactcctagtctttatcaaatgtgtttatcctacatatgtactcaagattacctataccctacatgaattaactttaatctacattttataa

SEQ ID NO: 71 - DNA, 435 bp, Staphylococcus epidermidis
gcaatgaaaaaggagtgtatacacatgccaataatttattatgatggaaattgtgtttattgttataactatgcaatttggttaattcaaaacggactttcacataaatatgagtttgcaacaattaaaggtcaaataggtaaacaattttttgaaaattatcctgatgctcaaaataagaatagtgttattcttcaaaaaggaaatcatttagaatttgaatcacaggctgttgcaacattgatatcgtcactacctaatcactctaaatttcttggaataggattaagattaattcctaaaccactaagagatttaggatatcgattatttgcaaataatcgagataaaatgtggaaaacacattggcacaagccaactgattatgaaaaatcattttttcttgatgataatgaaaaaatcaaactaacctaa

SEQ ID NO: 72 - DNA, 1092 bp, Staphylococcus epidermidis
gaaggaggaaatgtagtgtttgatcaattagatatagtagaagaacgatatgaacaattaaatgaattactgagtgatcctgatgtcgtgaatgacgctgataaattaagaaaatattcaaaagaacaagctgacttacaaaagactgttgatgtgtacagaagttataaaaccaaaaaagaagaattacgagatattgaagatatgctaaatgaaacatctgataaagaagaagttgaaatgctaaaagaagaaagtagtgctttaaaaacagaattacctgatatggaagaagaattaaaaatcttacttatacctaaagatcctaatgatgataaagatgttatagttgaaatccgtgcagctgcagggggagatgaagctgcaatatttgctggggacttaatgagaatgtattcaaaatacgccgaggcaaacggatttaaaacagaaatagttgaagcttcagaaagtgatcatggtggatataaagaagtgagtttctcagtatctggtacaggtgcttacagtaaattaaaatttgaaaatggtgcacatagggtccaacgtgtgcctgaaacagaatcaggggggcgaattcacacttctaccgcaactgttgctgtattacctgaagctgaagatgtcgaaattgagatacgtaatgaagatttaaaaattgatacttatcgctctagtggtgctggtggtcagcacgttaacacgactgactctgcagtgcgtattacacacttgccgactggtgttatagcaacttcttctgaaaagtctcaaattcaaaaccgagaaaaagctatgaaagttttaaaagcacgattgtatgatatgaaattgcaagaagaacaacaaaaatatgcttctcaaagaaaatcagctgttggtacaggtgatcgttctgaaagaataagaacttataattatcctcaaagtcgtgtgacagatcatcgaattggtttaacgcttcaaaagttaaatcaaatcatggaaggaaatttagacgagattgtggaggcactcacactttcagaacaaactgagaaactgaaagaattaaacaatggtgaattataa

SEQ ID NO: 73 - DNA, 186 bp, Staphylococcus epidermidis
cggcttctgaaacttaatattatcatatttttaaattcaattgcatttgataatctaaatatagaactaaattttaatgacaatttgcgccaatatacatatttttattatgactattacatattaaaagttaataaggtgctatcattctgtgatattctagcaaatttaaaagaagtcatgtaa

SEQ ID NO: 74 - DNA, 426 bp, Staphylococcus epidermidis
aaagctatgaaaataatttttgtatgtagtggcaacacttgtcgaagcccactggctgaaagtatagccaagtcccttttaccacacgatagtatagcttcaagagggctattcgcagttgagggacaggccatatctaaggaatcgttagaattaattcataagtacgatttacctgaaccatcacgagcacaagcatttcatatagatgatcttgatgctgatattatacttaccatgacgcaagctcataaagatttaatattttctatgtatggacgacaatctaatgtctttacattaaatgagtatgtaggtgacacacaagaaattgatgacccatttggtggctcgtttgatgtttatgaacaaacttataccaaaatttatgatttagtcgacaaaataaaatttaaacacgagtaa

SEQ ID NO: 75 - DNA, 216 bp, Staphylococcus epidermidis
gagggtatgaaattgaaaaaaggattgataaatgtttcaggtattaaaacaactgaacaagctaaacagctcaaagatcatttatctaagatgataggcatcaatagtgtggatatcgattaccaaatgaatgagattcgagtagaatttgacactcctgcaaatttaaataacattgaaaaagaaatttacgattacggatttcgtattttgtaa

SEQ ID NO: 76 - DNA, 357 bp, Staphylococcus epidermidis
gcatcaatgaaagttttaagattcttattaggactagcatttggaacagctggtgttttacattttactagagagagacaatttagaaatattgttccagattatttacctttacaaaaaactgctgtattggtaacaggtgttatagaaatcttttttggtatcatgttgcttattaaaagaccagcatcatggttgaaaaagggtattaatttattcttgttagcagtgttcccagcaaatatttatatggctcgtaaaggattgccattaggtgacaaagaactacctaaatgggcactttattcgagattaccattgcaatttgtgcttattaaagccattaaaaaattataa

SEQ ID NO: 77 - DNA, 840 bp, Staphylococcus epidermidis
acaatggtgaattataaagagaagtttgcagaagccaagacaattgccgtaaatgaggggtttgaatcaactcgtgccgaatggttgtttttagatgtttttggttggtcgaaaacagattatttaattcataaagatgagcaaatgtctttgacatcaattaacaaattggataaagcgttggatagaatgatcacaggagaacctattcaatacattgttggatttcagtctttttatggttatcaatataaagtgaatcaacactgtcttataccaaggcctgaaaccgaggaagttatgttgcattttttagaattgtgtaaaaagactgataccatagcagatattggaactggaagtggtgctatagcaattacgcttaagttactgcaacctgaattaaatgttattgcaacagatttgtatgaagatgctttaaatgtagctaagcaaaatgctagtcattatcaccaaaatattcagtttttgcgtggaaatgctttaaaaccgctaattgaaaatgatataaaattggatgggctgatatctaatccaccatacataggccatagtgaaataatagatatggagtcaacagtactaaattatgagccacatcatgctctatttgctgagaaaaacggatttgctatttatgagtcaatattagaagatttaccatttgtaatgaaacaaggtggacatgttgtttttgaaataggttatagtcaaggagatatcttaaaaagaatgattcaagatttatatcctgaaaaagaagtagagattttcaaagatatcaatggaaatcagcgtattatatctattatttggtag

SEQ ID NO: 78 - DNA, 351 bp, Staphylococcus epidermidis
ctatcgaacctttttttaaattttaaaatgttaaaaagtaatatccatttttataagtatctttattgcctcttttcgtgtacaatgttatacagtaatcttacgaaggagcttaatatggattatcttggtcagttcgcaattgttcatttaatcttacatgttgtttgtatttgcgtagcttattgggctttaaattccataaaattagaccaattttttaaaaagggctacccattacaagttcaagtttgtatgatttttatttctattttactgggtacggcagtcagtaactttatagttgatttattgcaatattcaactcaagtgaaatacttgataaaataa

SEQ ID NO: 79 - DNA, 204 bp, Staphylococcus epidermidis
ccgcttattgattgttgtaagccgattaatattgggctaagagctaaactatataatttatttaatagcactagaataagtacgattacaatgaataaaactaaagttattaaagctaaaattactgatttagcatatttgccttttttaaaagcaaaaaataaatcactaaaaagaactttctctttattaatagctttttga

SEQ ID NO: 80 - DNA, 186 bp, Staphylococcus epidermidis
ttatgtttagatatcgttttagccaaagcaagtataagtataattttcatgaattcggaaggttggatgcttataggaccgaaactgtaccaacttttagcaccattaataattggggtgattgaagtttcaggtaaaataagtaaccctattaatagaacgcaaaatatactatataaaatataa

SEQ ID NO: 81 - DNA, 123 bp, Staphylococcus epidermidis
agtaagttagatggtaagggaagtaacaatccataccaatttgcttccagtcattttcctattagaggtaaagtgctcctaaagcgcctgaaaaagcaccattctcaatatagtacggtttaa

SEQ ID NO: 82 - DNA, 1488 bp, Staphylococcus epidermidis
cctatgatagaagtctttactatggcacttcatcaatctaatattataattaatattttattagttagtgcctttttattaaatttagtttttgcattcattattattttcatggagaggcgtacagcaaattctatatgggcgtggttattggttttagtttttctacctttagtaggattcatattgtatttattattaggtcgccaaatacagagagaacatatatttaaactcgccaaagaggataaagttggtcttgaaatgattgttgacgagcaattagaggcattgaaaaagcaagacttttctaagggtaatcatcaaattgttaaatttaaagaaatggtacaaatgttactttataataatgctgcttttttaacaactgataatgatctaacaatttatacagatggtcatcagaagttcgatgatttaattaatgatattagacacgcacaatcatatattcacatccaatactacattattcatagtgataatctcggaaagcaattgttacatgaattagaaaaaaaagctgaagaaggtatagaagttaaaatgctatacgatgatatgggctcaagagatttacgaaagaaagatctaaaaaagtttcgtcaaaaaggcggtcacgctgaatctttctttccatcaaaattaccacttattaatttaagaatgaataatagaaaccacagaaaaatagtagtcattgacggtacgattggatatgttggtggttttaatgtaggagatgaatatataggtaaatctaagaaatttggttattggagggacacacacttacgtattaaaggtgacgcggtaaatgcccttcaacttagattcatcttagattggaactcacaatcaactcgtgacaatttaacttatgaatctcgatattttcctgatgttgactctggtggtacgataggcatacaaattgcttcaagtgggcctgatgaagattgggaacaaattaaatatggttatttaaaaatgatttcatcagccaaagaatctatatacattcaatcaccatacttcattcccgatcaagcttttttagattcgattaaaattgcagcgcttggtggtgtggatgttaacatcatggttcctaacaaacgtgatcatccctttgtttattgggctacgcttaaaaacgtagcgtctttacttgaagctggcgttaatgtctatcattatgataatggttttctacattcaaaaacacttgtcattgatgatgaggtagcaagtgtaggaactgccaatatggataatcgaagctttacattaaactttgaggtcaatgcttttatttatgatgaaggcgtagcacgatcattaaaacaagctttcattaatgatatgaaattatctaacaagctcacttctgaagaatatgctaaacgaaatctgctagttaaattcaaagaagggatttcacaactactttctccaattttataa

SEQ ID NO: 83 - DNA, 375 bp, Staphylococcus epidermidis
tatactaaagaggcgatacaagtgatttatggaataggtatagatttaatagaaattgaacgaattaaaaatcttcagaatcaaacaaaatttattgaaagaatacttactatagaggaaagagacaaattaaatcaatatacaaacgagcaacgtagattagaatttttagctggacgctttactgtgaaagaagcatttagtaaggccttaggtactgggttggggaaatcagtatcgtttcaggatattaactgttacaacgacgctctaggtaaaccatgtattgactatcctggtttttatacacatgtgagtattacacatacggagaattatgctatgagtcaagttattcttgaaaaaaacgaatga

SEQ ID NO: 84 - DNA, 492 bp, Staphylococcus epidermidis
agcaataaggaggataaatgcatgactaaaatgaatgtagaaagctttaatttagaccatactaaggttgttgcaccttttattcgtctagccgggactatggaaggtcttaatggtgatgtcatacacaaatatgacattcgtttcaaacagcccaataaggaacatatggatatgcctggtctacattccttagagcatttaatggcagaaaacattagaaatcatactgataaagtagtagatttaagtcctatgggttgtcaaactggattctatgtttcatttattaatcatgacgactacgatgacgtattaaatattatcgatcaaacattgcatgatgtgttaaatgctagcgaagtcccagcttgtaatgaggttcaatgtggttgggctgcaagtcattctttagaaggtgctaaaacaattgctcaagcatttttagataaaagagagcaatggaatgacatctacggagaaggtaaataa

SEQ ID NO: 85 - DNA, 1377 bp, Staphylococcus epidermidis
atacaaaaggagcgtttaaaaatgggaaaatattttggtactgatggtgttcgtggtgtcgctaaccaagaactcacacctgaattggcttttaaactaggtagatacggaggatatgttctcgcacataataagggtgaaaagcatcctcgagttttagtaggaagagatacaagagtatcaggagaaatgctagaatctgcattaattgctggtttaatttcaattggcgcagaagtgatgcgcttaggtgttatttcaacaccgggtgtggcttatttgactaaagaaatggaagcagcattaggtgttatgatttctgcgtcacataatccggttgctgataatggaattaaattttttggttcagatggctttaaattgtcagatgatcaagaaaatgaaattgagcaattattagatcaaaccaatcctgatttaccacgtccagtaggagaggatattgtacattattcagattattttgaaggtgcacaaaagtatctaagttatcttaaatcaactgttgatgttaattttgagggtcttaaaattgtattagatggtgcaaacgggtcaacttcttctttagccccattcttgtttggcgatttagaagcggatactgagacaattggatgtaatccagatggttataatattaatgaacaatgtggctctactcatccagaaaaattagctgaagcggtgttagaaactgaaagtgactttggtttagcttttgatggagatggcgatcgtattattgcggtagatgaaaatggacaaattgtagatggagatcaaattatgttcattattggtcaagaaatgtataaaaaccaagaactcaatggaaatatgatagtttcgacagtaatgagtaaccttggtttctacaaagctctagaaaaagaaggtattcagtcaaacaaaactaaagttggagatcgctatgttgtcgaggaaatgagaagaggaaattataatcttggtggtgaacaatccggtcatatcgtattaatggattacaatactactggtgatggattattaacgggtgttcagttggcttccgttattaaaatgagtggtaaaactctaagcgagttagcttctcaaatgaaaaagtatccacaatctttaattaatgtgagagtgactgacaaatatcgtgttgaagagaatattcatgttcaagagataatgacgaaagttgaaacagagatgaatggtgaaggaagaattcttgttcgtccttctggaactgaacctttagtacgtgtaatggttgaggctgcaactgacgcggatgctgaaagatatgctcaaagtatcgctgacgttgttgaagacaaaatgggtttagataaataa

SEQ ID NO: 86 - DNA, 522 bp, Staphylococcus epidermidis
aaggtgatactcatgaagtcttataaatatatgcatcaaaacggtattaaagtaatgagaattagtggtgctttttggacacttttacttgtgatagcattgtctattttaatattgcttaatgaattaaaattccattttattgatactaaaaatttaataattggagtaataattttaactacaatagtttgtattttatttatgattatagtgccttggtttaaatttaaacatcttagatattttttagatgataaagaaatacatattagagaaggtatcatttttatagatgtgcacgtcatcccttactttagaatacaaaatatagatatagttgagggatttatcatgagaaagttccaactcgcttcgctgtcattatcaactgctgggggaaattctgaaatagcattgatagatattcaagaagcacaaagattgaaaaaacaaattaaacaacaaaaatcaataacgacaaatgtaacttcattagaaaaattaaacgatgatatataa

SEQ ID NO: 87 - DNA, 141 bp, Staphylococcus epidermidis
ttcatcaaactatttaactttcaaaaaggtcgtgcaatatgtaatgtaagcgtttttttcataattcaccaaaaaataaaagcatgcgatgaaagtaacatcctaattaatttacagatgctctttcattgcatgctttga

SEQ ID NO: 88 - DNA, 165 bp, Staphylococcus epidermidis
aaagcgttttgcgacgcaaaatcttacttactatctagttttgaatgtataatcattcatttgtctggtgacaatggcaaggaggtcacacctgttcccatgccgaacacagaagttaagctccttagcgccgatggtagtcggactgacgttccgctagagtag

SEQ ID NO: 89 - DNA, 1098 bp, Staphylococcus epidermidis
attaaattctgcccttatttctttacagcatataatcacagaagaggtgaaaacatgcacacacaaatatgggatttaagaatgtataaaaataatgttagtcaatatccacatatagatgagataaaacaaactttcctagatggaggtttagtagcgatacctactgaaacagtatatggtcttggtgcgaatgctagaaacgaagaagcagtcgaaaacatctatgttgcaaaaggacgtccgtccgataatccgttaatcgttcatattcacagtattgaacaactcgatgattttgtagagtatattgatgataaggttaaagtattgatggatgaattttggccgggacctatttcttttatattaccacttaaacagggatatctttgcagtaaagtgactggtggattagaatctatcgctgttagaatgcctagtcataaaatagggagagcattacttcaaattgtagatgaacccatagcagctcctagtgctaatattagtggtcgaccgtcaccaacaacttttgaacatgtgaatagagatttaaatggtaaagtcaacggtatagttaatggtgatcaatgtgaagaaggacttgaaagtactgtgattgattgcacacagtttccgtttcgtatcgcgcgaccaggttcaattacgcaagatatgatagaaactaaactacctcattcgataaatcgtcaaatatatgaggaaaatgaaaagcctatcgcacctggtatgaaatataaacattattccccagagaccccattaacaattgttaaagatttaaataaaaaaattgctaatgatgataaatggtcaaaagtagcatttgtattcccagagagtcaaagaagtttgattcccgaaaatagcatttttatatctttatgtgaaaataagggagattttaaatcagcaggccataatttatatgaaattttacatgaacttgaccagaatgaagaaatagaagaggcatatatttatggatttgaagataatcatcacactgaagctatcatgaaccgaatgttaaaagcagcaagttataaactaattaaaggtgaaaagctatga

SEQ ID NO: 90 - DNA, 189 bp, Staphylococcus epidermidis
acctacaactggaatggattttatataaagagacaactatttaaaacatttggtaagcatattttaaatgattcacaactttctgtcatacttgtaacacatataatagaagaaatgccgttatttttgaaaaagatttacttaaagacttttaaatatttaacaaggttaatatttaagatgttatga

SEQ ID NO: 91 - DNA, 537 bp, Staphylococcus epidermidis
cgaaaggagtgtcatgagcccgtgactgcaacagctaatacatttattctcggtgcaggagttgaatgggggacaacatttgtaacactcgtaacatttgtaatcctcatcatacttttgaagaaatttgcttggggtccattaaaagaagtaatggacaaacgtgaacgtgatatcaataaagatattgacgacgcagaacaagctaagataaatgctcaaaaacttgaagaagaaaatagaaagacacttaaagaaactcaagatgaagttcaaaaaatcttagacgatgctaagattcaagcacgtaagcaacatgaagaaattattcatgaagctaacgaaaaagctaatggtatgattgaaactgctcaaagtgaaattaatagtcaaaaagaacgtgcaatttctgatattaataatcaagtttctgaactatcagtacttattgcatctaaagttcttagaaaagaaatttcagagcaagatcaaaaagaattagttgaaaagtatttaaaagaggcaggggataaataa

SEQ ID NO: 92 - DNA, 891 bp, Staphylococcus epidermidis
aatgttattttgtcgtatgacagtgtcaataatgattggtataataatcaatatggaaaagtattacccggaggagatgttatggatttttccaatttttttcaaaatctgagtactataaaaattattactagtttactcgatttactgattgtttggtatgtgttgtatcttctcattacagtttttaaaggtactaaagcaattcaattattaaagggaatagttgtcattgttatcggccagcaaatcagtaaaattcttaacttaacagcaacatctaaattgtttgatattgtaattcaatggggtgttttagcactcattgtgatatttcaacctgaaataagaagagccttagaacaattaggtagaggaagttttttaaaacgatatacgaatacttatagtcgcgatgaagaaaagttgattcaatctgtgtctaaagctgttcaatatatggctaagcgacgcattggtgcgcttattgtttttgaaaaagagacaggtttgcaggattatatagaaactggaataccgatgaattcagatatatctcaagagctactaactaatgtatttatccctaatacgccattacacgatggtgcaatgataattcaaggaagtaagattgccgttgctgcaagttatttaccattatcagatagtgttaaaatatcaaaaagtttaggaactagacatagagcggcagttggaatttcagaagtttctgatgcttttactgttgttgtatcagaagaaactggtgatatatcagtcacttttgatggaaaattaagaagagatatttcaaaagatgtttttgaagaattgcttgctgaacattggtttggtgcacactttcaaaagaaaggtgtgaattcataa

SEQ ID NO: 93 - DNA, 882 bp, Staphylococcus epidermidis
ttaatagataggggtaaagcaatgtttataaaaaaagattttgatgatattacagttcaagtatttgaagaaaaatatagagatgcacttaaccaatttgaattaagtgaacgacaacaaatatattcttcattgcctcaaactgttttagatgatgcattaaaagatgaaaatcgaattgctaatgtagctttaaataaagaaggaaaagtagtggggttcttcgtattgcatcgttattatcaacatgaaggttatgatacaccaaacaatgttgtttatgtacgttcattgtcagttaatgaaaagtttcaaggccatggatatgggacaaaaatgatgatgtttttaccagagtatgttcaagcattatttcctgattttacacatttatacttagtagtagacgctgaaaaccaaagtgcttggaacgtttatgaacgtgcaggttttatgcatacagctacaaaagaagaaggacctattgggaaagaaagactttattatttagatttagattcaaaacatgtatcttctttaaggctaaaagagggggaagccgcatataatgatgatattcacgtgattaatttgcttaaagatgatgtaaaggtaggctttattgcactagaacaaaatgataataaaatgaatatttctgcaatcgaagttaataagcaaaataggaatgagggaattgcagaaagtgctttacgccaattaccaacgtatatacgtaaacagtttgaagacattgaaattttatcaattactttatatggcgaacgtaatgaattaaaaccattgtgcttgaatagtaattttgtagcaatagaggaaactgaggattatacacgttttgaaaaatatattaattattaa

SEQ ID NO: 94 - DNA, 207 bp, Staphylococcus epidermidis
ctgtgttggctttctaacccgcaccacttatcgtggtgggagacagtgtcaggcgggcagtttgactggggcggtcgcctcctaaaaggtaacggaggcgctcaaaggttccctcagaatggttggaaatcattcatagagtgtaaaggcataagggagcttgactgcgagacctacaagtcgagcagggtcgaaagacggacttag

SEQ ID NO: 95 - DNA, 297 bp, Staphylococcus epidermidis
ctctgttccagatggttcagggcaaaggagctgaaaaaaatgaaacaaggaattcatcctgaataccacaaagttatctttttagatacaacaacaaactttaaattcttaagtggttctacaaaaacatcttcagaaactatggaatgggaagatggaaatgaatacccagttattcgtttagatgtatcatcagattctcatccattctatactggacgtcaaaaattcgcagcagcggatggtcgtgtggaacgtttcaacaaaaagtttggactcaaatcaaacaacaactaa

SEQ ID NO: 96 - DNA, 471 bp, Staphylococcus epidermidis
tattattacagcttaagctcggaggttttaaaaatggaaacgatttttgattataatcaaattaaacaaattatcccacatagacaaccttttttactaatagataaaattgtagagtatgaagaaggtaaaaggtgtgtaggactaaagcaagtatcaggtaatgaaccatttttccagggacatttccctaattacgctgtgatgcctggtgttcttattacagaagctttagcgcaaactggtgcagtagctatgttaaatagtgaagaaaataaagggaaaatagcattgtttgcaggcattgataagtgtcgcttcaaaaaacaagtcgtacctggagatacattaatgttggaagttgaaataactaaaataaaaggtcctattggtaagggttcggctaaagcgactgttgatggccaacttgcttgtagctgtgaacttacttttgctattcaagatgcttaa

SEQ ID NO: 97 - DNA, 792 bp, Staphylococcus epidermidis
aaaaagagcaggtgcgaaataatggcgaaagagtcgaaatcagctagtgaagtatcacctgaacaaattaaccaatggattaaacaacatcaagaaaacgaagatagccaagctcaagataaattagtaaaacattatcgtaagctgattgaatctttagcttataagtattctaagggacaatcacatcatgaagatttagttcaagttggtatggttggtctaataggtgctattaatagatttgacttatcatttgatcgtaagtttgaagccttcttagtaccaacagttattggtgagattaaaagatatttacgagataaaacatggagtgttcatgtacctagacgtattaaagaaatcggtccaagaatcaaaaaagttagtgatgaattaacaaatgaacttgaacgttcaccatctattagtgaaatcgcacaacgcttagaagtttcagatgaagaagttttggaagcgatggagatgggtcagagttacaatgccctaagtgtggatcactctatagaagcagataaagatggttcgacagttacattattagatatcatgggacaacaagatgataattatgatttaacggaaaagcgtatgatattagagcgtattttacctattttgtcagagagagaaagacaaatcatacaatgtacttttattgaaggtcttagccaaaaagagactggtgaaagaattggtcttagtcaaatgcatgtttcacgtttgcaacgtaccgcaataaaaaaattacaagaagctgcaagacagtaa

SEQ ID NO: 98 - DNA, 1083 bp, Staphylococcus epidermidis
  modified_base (1060)..(1060): a, c, g, t, unknown or other
gtagtttcaaggaggacatatatgtcagagaagttttatagagcaacatatttaaatgtgaatttagatgcaattttagcaaattatcaaaatttcaatcaattacacgctaataagactgtcatttcagtcattaaagccaatggatatggattaggaagtgtgaaaatagcacaacatttaatgcgtcatggtgcaacattttttgcggtggctacacttgatgaagcaatagaattaagaatgcatggagttgatgctaaattattagttttaggtgttgttccaacagaagacattgagaaggctatacagcatcgtgttgctttaacagtaccttctaaagcatggttgaaggaaactatcaagcaaattcctgatgataaccaaaaaaatttatggctacatgtaaaattagatactggtatgggccgaattggaatgaaagatatagatgaatataaagaagtggttgatttaattaataaaagagatcatttagtttttgaaggagttttcacacattttgcgagtgcagatgaacctggaaattctatgaatgaacaatatactttgttcaaagagatggttaatcaagttgagaaaccaaactatattcattgtcaaaattctgctggatcactactcatggatggtcaattttgtaatgcaataagattaggaatctctctttatggatactatccttcagaatatgttaaagataatgtaaaagttcatttaagaccaagtgcgcagttagtatcagaaaccgttcaagttaaaacacttaaagctggtgaaactgttagttatggacgtacatatattgctgatgaagaaatgacaattgcaattttacctattgggtatgccgacggatatttaagatcgatgcaaggtgcgttcgtcaatgttaacgggagtcaatgtgaagtcattggacgtatttgtatggaccaattgatagttaaggttccttctcatgtaaaaacgggtgataaagtaatacttatggataatcacgttgattcaccaccatcagctgaaaccgtacccnataaacaaggtaggactaactag

SEQ ID NO: 99 - DNA, 501 bp, Staphylococcus epidermidis
atcttgaaaaggagtacatttatgaaaaatgatagtacgtttcatagaagcccaatccaagcgctaaagtactattacataactagttgcataggtttatttattttgcttgttatacttagtttacttttgtattttagctatttaaatcattggtggccttttacatcctacatctttcttgggctaggtttgttatcgattttaaacacttgtatatctccactaattaaatatagatatcattattataaaattcacgaagattttgtcatattaaaaagattatttatttttaggaaagaagaattaagtaaaatagagagaatacaatttatcgatattggaactaatccgttatcaaaaaaattaaatcttaattccataactttatttactgcaggtcatacaatctcatttccaataatatctgagaaagaagcacaaaatattcaacaacaaatactattgagattgagaggtgcaaatgacgatgtatag

SEQ ID NO: 100 - DNA, 936 bp, Staphylococcus epidermidis
atgcttgaaagtaaatggggattaagatttgtcgctctcatattagcagtttttttctttttatcagtaaataatgtgttcggaaatatttttaatacagatgatttatctcaaaaatcatccaaaactattcaagatgtgcccgttgatgttatctataatagtaaagacctacatgtaactaaaattcctgaaaacgtcgatgttaatttaacaggaccacaatcaaaattaatcaaaattgaaaaccctgaagatttgaaagtagttgttgatctttctggaaaaaaagcagggaaatatcaaaaaaaatatcaagttagaggcatagatagtggtatcaactatcaaattaaacctgaagttgcacacattaaccttgaaaataaaataacacgagttatgcatgtgcaaccagacattagtagtaacagtttagatccaaaatataaaataagtaaacaaagtatttcaccagaaactgtaaaagtgactggtggagagcaacaattaaaaaatatagcttatttaaaagcaacttttaaaaattctagtaaagtgaacaaagacaccaatgatgttgcagatgttagtgcatttgataaacaattgaataaattaaatgtatcaattaatccaaatgaagttaatttaaaagtaacagttgaaccattcagtaaaatggttaaggtacgtaaaaaaacaacgggtaagcttaatgaaaataaagaattagatagtgttaaactggaagataaagaagtagaaatctttggtaatagagatgaattacaaaatattaatgaaattactgctgaagtagatattgatggaatttcagaatctacagaaaaaacagtatcatttaacttacctaaagatgtgactaaagtgaatccaaaggaaacaaaagcgtatataaatgttaaaaattga

SEQ ID NO: 101 - DNA, 126 bp, Staphylococcus epidermidis
ttcgtggaaagattcatactgcggagatgttcgttctctaccaggcatagacttgcacccatttcattaattatttattttacgaagttcaaaaataataaacgcatagttagcttaaccaaataa

SEQ ID NO: 102 - DNA, 363 bp, Staphylococcus epidermidis
atgattagaagaggagatgtttatttagcggatttatcaccagttcaagggtctgaacaagggggagtaagacctgtagttatcattcaaaatgatactggtaataaatatagtccaactgtaattgtagctgcgattactggtaggattaataaagcgaaaataccaacccacgtagaaattgaaaagaaaaagtataaattagacaaagattcagttattcttcttgaacaaattagaacactagataaaaagcgtttaaaagaaaaattaacatttttatcagagagtaaaatgatagaggttgataatgccttagatattagtttgggattaaataactttgatcatcataaatcttaa

SEQ ID NO: 103 - DNA, 246 bp, Staphylococcus epidermidis
tataaggagagaggctttgtgaagcaatttatatatatttctctagtttgtggcattatttccggagcagggatatttttacaattaccacattatccatctatgatgattccaagatttgtggcgattcttggaataattagcgctgcaatcacaataagagataaggaaataagtggtatgcttaaacttggtgggataatgattaatataatgccgttacttgggagtgtcattgctaaataa

SEQ ID NO: 104 - DNA, 540 bp, Staphylococcus epidermidis
agagattggaggtttacaatgtcaaaaatcttaaacacacaattaactggtatttttaatcggcttgaaaaacaagagttggatattcaaatggcagctcaatgtctcattcaagcaattggtggagaaggacatgtctatatcaaaggctacgatgatttaaaattctatgagtcattcatattacaaagccatgaaaaattagcgtctagcttaccacttgaagatttacaaaattttaacgatatagatacaacagatagggtactgttattttcaccatactacacttcggaagttgaaagtgatgtacttcaacttattgatttagatgtcgatttagtgcttatttgtaataaccctaaacgagatgattttcctaatcatttaattcattatgttaatttatcaacacctaggcccattgtttacacagaagattatgataaaatcattcaaccacatccgatggccttaaattatatttattatgatatttatactcaaatgattgagatgactagagacctagatttatag

SEQ ID NO: 105 - DNA, 819 bp, Staphylococcus epidermidis
ttgttatggagtgatagacatatgaagattggaattgatgccggagggactttaattaaaattgtacaagagcatgacaatcgtagatattacagaactgaattaacaactaatatccaaaaagtcatagattggcttaacaatgaagaaatcgaaacattaaagcttacaggtggaaatgctggagtaatagcagatcaaattcatcattcccctgaaatatttgtagagttcgatgcatcatcaaaaggtttagaaattttattggatgaacaaggtcatcaaattgaacattacatttttgctaatgtaggtacaggtacttctttccactattttgatggaaaagaccagcaacgtgttggaggtgtaggtaccggaggcgggatgatacaaggtttaggctatttattgtccaatataacagattataaagaattaacgaatttagctcaaaatggagatcgtgatgccattgatttaaaagtaaaacatatttataaagatactgaaccaccaattcctggagatttaacagcagcaaattttggaaatgtattacatcacttagataatcagtttacatcagctaacaaacttgcctctgcaattggcgtcgttggtgaagttataacaactatggctattactttagcacgtgaatataagactaatcacgttgtatatatcggttcatcatttaataacaatcaattactacgtgaagttgttgaaaattacactgttctaagaggatttaaaccgtactatattgagaatggtgctttttcaggcgctttaggagcactttacctctaa

SEQ ID NO: 106 - DNA, 732 bp, Staphylococcus epidermidis
ctattaaggagaagatatattatgacagaaagtacacctcacattaacccaaatggagttaaaatagctaaaactgtattaatgccaggcgatccattacgtgctcaatatattgctgaaaattttttagaaaatgttgaacaattcaatacagtacgtaatatgtttggttacacaggaacttataaaggcaaagaagtttctgtgatgggctctgggatgggaattccaagtattggtatttattcttatgaactttaccatttctttgatgtggatacaatcattcgcgtaggttcatgtggcgctcttcaagaagatgtcaatttatatgatgtgattattgcacaagccgcttccacaaactcaaattatgttgatcaatttaatataccgggtcactttgcgcctattgctgattttaatctagtagctaaagctaagaaagctgctgatgaaattggtgccatatcacatgtaggtaacgttttgtcatctgatacattttataatgctgattcaacttttaatgattcatggaaaaagatgggtatcttaggtatcgaaatggaatctgcaggtctatatttaaatgccatccatgcaaataaaaaggctttaggtatttttacagtaagtgatcatattctaagagatgaagccactagtgcagaagagagacaaacatcatttactcaaatgatggaaatagcgctcgaaatagctgaatag

SEQ ID NO: 107 - DNA, 228 bp, Staphylococcus epidermidis
cccaagaatggtggaggggggcagattcgaactgccgaacccgaaggagcggatttacagtccgccgcgtttagccacttcgctacccctccgcagtatttaattaaatggtggagaatgacgggttcgaaccgccgaccctctgcttgtaaggcagatgctctcccagctgagctaattctccataaaatgactcctacgggactcgaacccgtgttaccgccgtga

SEQ ID NO: 108 - DNA, 690 bp, Staphylococcus epidermidis
gccacacccggtgttgaaataacacctaagcgcatcacttctgcgccaattgaaattaaaccagcaattaatgcagattctagcatttctcctgatactcttgtatctcttcctactaaaactcgaggatgcttttcacccttattatgtgcgagaacatatcctccgtatctacctagtttaaaagccaattcaggtgtgagttcttggttagcgacaccacgaacaccatcagtaccaaaatattttcccatttttaaacgctccttttgtatctatcaatttttaacatttatatacgcttttgtttcctttggattcactttagtcacatctttaggtaagttaaatgatactgttttttctgtagattctgaaattccatcaatatctacttcagcagtaatttcattaatattttgtaattcatctctattaccaaagatttctacttctttatcttccagtttaacactatctaattctttattttcattaagcttacccgttgtttttttacgtaccttaaccattttactgaatggttcaactgttacttttaaattaacttcatttggattaattgatacatttaatttattcaattgtttatcaaatgcactaacatctgcaacatcattggtgtctttgttcactttactagaatttttaaaagttgcttttaaataa

SEQ ID NO: 109 - DNA, 888 bp, Staphylococcus epidermidis
  modified_base (849)..(849): a, c, g, t, unknown or other
tactccaaaggtggtgagataatggcctctcttaaagagatagatagtcgtattaaatcgacaagtaagatgaagcaaataacaaaggcgatgaacatggtttctagttcaaaattacgtagagctgagaaaaatactaaatcatttagaccttatatggaaaagatgcaagatgctattacagctgtagctggttcaaatagtacttctaatcatccaatgcttaaatctagagatattaaaagaagtggttacttagtaatcactagtgataaaggcttagccggtgcctatagtacaaatgttttaaaaagcttagtaaacgatatcaattctaaacacaacgacagtagtgaatatagtctaatcgttttaggtcagcaaggtgtagatttcttcaaacatagaggatatgaaattgaaagttctttagttgaagttccagatcaaccttcatttaaatctattcaatctatagctaaacatgctattgatttatttagcgaggaaaacatagatgaattgactatttattacagtcattatgttagtgtcttagaaaataaacctgcaactaaacaagttttaccattatctcaagaagattcaggtcaaggacatggtcaaatgtcttcatacgaatttgaaccagataaagaatctattttaagcgttattttgccacaatacgttgaaagcttaatctacggtacaatcttagatgcaaaagctagtgaacatgcttcacgtatgacagcaatgagaaatgcttcagataatgcgacagaactaatcgatgatttatcattagaatacaatagagcgagacaagctgcgattactcaacanattactgaaattgttggtggatcatcagctcttgagtaa

SEQ ID NO: 110 - DNA, 234 bp, Staphylococcus epidermidis
atattaggaggaaattttattatgaatttaatcgcagcggcaatcgcaattggtttatcagcattaggtgcaggtattggtaacggtcttatcgtatctagaacagttgaaggtgtagcacgtcaaccagaagcacgtgggcaattaatgggtatcatgttcattggtgttggtttagttgaggcattaccaatcatcggtgttgtaattgcattcatgacatttgctggataa

SEQ ID NO: 111 - DNA, 132 bp, Staphylococcus epidermidis
acaaccatgggtttcatcagtaatcactttaatgtgatcatcattattattaaatattttcatttattttatcataatatcatccactattctaaacaacacttatcattaaaagttgattttaaaaattaa

SEQ ID NO: 112 - DNA, 168 bp, Staphylococcus epidermidis
aataaagctatttctaacgaggtgataattgtgaagaatcaggataagattcaaaatgtagtcaaattattatcatcattgggtgtgaatattaagaaaactaagtctcgtttagatattattaatactttgcctacatctaatcaagtaagtcatgaattaaaataa

SEQ ID NO: 113 - DNA, 1239 bp, Staphylococcus epidermidis
atgtcttatatcgagaaaaaggataaagttgtttacgatgctattcaaaaggagtttcaacgacaaaatagtaatattgaactcattgcatcagaaaatttcgtatcacaagcagttatggaagcccaaggttcagtattaacgaataaatatgctgagggttatcctgggcgtcgttattatggagggtgtgagcatgtagatgtaactgagtccattgccattgaaagagcaaaagctttatttggagcagaacatgttaatgttcaaccccattcaggttctcaagctaatatggctgtgtatttggttgctttagaaatgggcgatactgtgttaggtatgaatttgagtcatggtggtcatttaacacatggggcaactgtcaattttagtggtaaattttatcattttgttgaatatggtgtggaccaagaaaatgaattaataaactatgatgaagtgagacgtttagcaattgagcatcaacctaaattaattgtagctggtgcttcagcatattcaagaactattgactttaaaaaatttaaagaaattgctgatgaagtaggagctaaattgatggtagatatggcacatattgctggtttagtagctgctggtttacatcctaatcctttagaatatgctgattttgtgactactacaactcataaaactttacgcggtccacgtggtggtatgattttatgtaaagaagaatataaaaaagatatagataaaacaatcttcccaggtattcaaggcggtccattagaacatgtcatcgccgcaaaagctgttgcatttggagaagctttgaacgacgattttaaagattatcaaaatcaagtcattaaaaatgcacaagctttagctcaaacattaattgaagaaggcttcagagttgtatctggcggaacagacaatcatttagttgcagttgatgttaaaggttctatcaatatgactggtaaattagctgaagagacacttgataaagtaggaattacatgtaataagaatactattccatttgataaagaaaaaccgtttgtaacaagtggtgttagactaggaacaccagcagctacaactcgtggttttgatgaatctgcatttgtggaagtagcaaaaattattagtttagcattaaataactatgataatgatactaaactaaatgaagctaaagagagagttcacgcactcacatctaaatatccattatataattaa

SEQ ID NO: 114 - DNA, 216 bp, Staphylococcus epidermidis
aagttgattttaaaaattaaaaatgcaagtatcatcgttagacacttgcatatcatcatcttttatttagcaatgacactcccaagtaacggcattatattaatcattatcccaccaagtttaagcataccacttatttccttatctcttattgtgattgcagcgctaattattccaagaatcgccacaaatcttggaatcatcatagatggataa

SEQ ID NO: 115 - DNA, 1467 bp, Staphylococcus epidermidis
tatatgtatatatcttttctaaggagtgaatataataagatgagaaatttcactaaacaatatataaacggtgaatgggttgatagtgcaagcggtgaaactattgatgttattaaccctgcaactgaagaagtaatgggtaaaattgctaaaggtaacgaagaagatgttaataaagctgtagatgctgcagataaagtatatttagaatttagacatagttctgttgaagaaagaagagaacttttagataaaatcgtaaaagaatatcaaaatagaaaaaatgatttaattgaagcaattactgatgaactaggagcgcctttatcagtttccgagaacgttcattatcaaatgggattgaatcattttacagctgcaagagatgctttagatagcttccaatttgaagaacaacgtggcgatgatttggttgttaaagaagcaattggagttgctggacttgttacaccttggaatttccctacaaaccaaacttcacttaaattagctgctgcgtttgctgctggtagccctgttgttttaaaaccatctgaagaaacaccatttgctgcaattattttagcagaaatttttgataaagtaggcgtacctaaaggtgtgtttaacttagtcaatggtgatggatctggagtaggaaatcctttaagtgaacatccaaaagtaagaatgatgtcatttacaggttctggtcctacaggttcaaaaattatggaaaaagctgcaaaagacttcaaaaaagtgtctcttgaattgggtgggaaatcaccttatatcgtattagatgacgttgatgttgaagaagctgctaatgcaacaacgaaaaaagtagttaacaatacaggtcaagtttgtactgcaggaacacgtgtacttattcctgaaagtattaaagaagactacttaacagcagttaaagaagcatttagtaaagttaaagtaggtcaaccaagagaagaaggaactcaagtaggtcctattattagtaaaaaacaatttgatcaagttcaggattacattgataaaggtatcaatgaaggagcagagttattctacggtggtccaggtaaaccagaaggattagataaaggatattttgcgcgtccaactatatttattaatgtagataatcacatgacgattgcacaagaagaaattttcggacctgtcatgtctgtaatcacttataataatcttgacgaagctattgaaattgctaatgatactaaatatggtcttgctggctatgttattggtaaagataaagatacattgagacatgttgctcgttcaatcgaagctggtacaattgaaattaatgaagctggtagaaaaccagacttaccattcggtggttataaagaatctggcttaggtcgtgaatggggcgattatggtatcgaagaattcttagaagtaaaatcaatagctggatattttaaataa

SEQ ID NO: 116 - DNA, 147 bp, Staphylococcus epidermidis
catcatcatattcaagtcatcgattattactttacaattaataagacgtctaatgataaaattcataagacaacaatcatcaaacatataatttttatgattattaacatttcatttttcagtattaaatcaaaaactgtaagataa

SEQ ID NO: 117 - DNA, 135 bp, Staphylococcus epidermidis
ccactcctcttaaccttccagcaccgggcaggcgtcagcccctatacatcaccttacggtttagcagagacctgtgtttttgataaacagtcgcttgggcctattcactgcggctcttctgggcgtgaaccctaa

SEQ ID NO: 118 - DNA, 675 bp, Staphylococcus epidermidis
gggttaagtatgtcatacaaatatgaagcattttttaaagatattttgattaatgaatatatttattttgcttcaaaaaataaaaaattaattagaatacaacatgagaatttgccatatattgctatgtggacagacgaaaatgttgctgagtcttatttgttacatcattcaattgattacgacaaaatcattagagcagatattgaccgttttgtaacatatgaaatggatgaaatctttgatccaggtgacaaagttttagttaatgtgaataatggtgaagaaggaaacattgtagatatagttaaaatgactgatgagttgatgtctgaattagatgatataagaatgagagagtttattaaagatgtcgcaaaatatgacgaagtatacggattgacaaacaaaggtgaaaagaattttattatgatttcagatgatgaccataacaaaccacacatcatgcctgtttggagtattaagagtagagcgcgtaaagtacgtgatcaagattttgaagaatgtgatttaatcgaaattgaaggtgaagtctttagtgaatggttagacaagttacgcgatgataataaagcagtggcgattgatttgaaatcaggtgttgttggtactgttgtatcagcgcaaaaactgtcaaatgaagcaacattttaa

SEQ ID NO: 119 - DNA, 123 bp, Staphylococcus epidermidis
ctattcgtcattgagatgtcttggtctaactactttcttcgctgggaagtagttttattttttgaggaggctaattatgacattttcaaaagagttgagggaagcatcaagacctattattga

SEQ ID NO: 120 - DNA, 1860 bp, Staphylococcus epidermidis
gcagtgataattaatcataatagccgtgttatcccatttgttggaggatattatatgtgtggaattgttggttatattggctacgataatgccaaagaattactattaaaagggttagaaaaattagaatatcgtggttatgactcagcaggtattgctgtagttaatgatgatggtacaaaactttttaaagaaaaaggaagaattgctgaattacgtaaagttgcagataatagtgatgaggatggtacgttaggaattggtcatacacgttgggcgacacatggtgttccaaattatgaaaattcacatccacaccagtcaacatctggacgttttacattagttcataatggtgtaattgaaaattatgaagaattaaaagctgaatatttatctgatgtcactttttcatcagaaactgatacggaagttattgtacaattagtagattatttttctagacaaggattagctacagaagatgcatttacaaaagtagttaaattattacatgggtcatatgctttaggattattagatgataatgataaagatactatttatgtggctaaaaacaagtctccgcttttagtaggtgtaggtgaaggtttcaatgttattgcttctgatgctctagcaatgttacaaactacaaaccaatacaaagagatacatgaccatgaaatagttattgttaagcgagacacagtagaaattaaagatcttgaggggcacattcaacaacgtgatacgtatacggcagaaatagatgctgctgatgcagaaaaaggcgtatatgatcattacatgttaaaagaaattcatgaacagcctgcagtgatgcgtcgcattattcaagaatatcaagatgaaaaaggtaatttaaaaatcgattcagagattattaatgatgtagcagatgctgatcgtatttacatcgttgcagctggtactagttatcatgctggattggttggtaaagaatttattgaaaaatgggcaggtgtacctactgaggttcatgtagcttctgaatttgtatataatatgccacttctttctgaaaaaccactatttatttatatttcacaatctggtgaaacagctgatagtcgtgctgtattagttgaaacaaataagttaggtcacaaatcattaacaattactaatgttgctggttcaacattatcacgtgaagcggatcatacattacttttacatgctggacctgagattgcagtcgcatctacaaaagcatatacagcgcaaattgctgttttatctatcttatctcaaattgttgctaaaaatcatggtcgtgaaaccgatgttgatttattaagagaactagctaaggttactacagctattgaaacaattgttgacgatgcacctaagatggagcaaattgcaacggatttcttaaaaactactcgtaatgcattcttcattggacgaacaattgattataatgttagtttagaaggtgcattaaaattaaaagaaatttcttatattcaagctgaaggatttgcaggtggggaattaaagcacggaacaatcgctttgattgaagatggcacacctgttataggtttagctacacaagaaaacgttaatctatcaattcgtggaaatatgaaagaagtagtagcacgtggtgcatatccttgtatgatttcaatggaaggtttgaataaagaaggagacacatacgtgattccacaagtacatgaattattaactcctttagtatctgtagtgacaatgcaattaatctcatattatgctgcgttacaacgagatttagatgttgacaaacctcgtaacttagccaaatcggttacagtagagtaa

SEQ ID NO: 121 - DNA, 567 bp, Staphylococcus epidermidis
agaaaatcctttgaaaggaagtatttttatatgaaaattcaagattacacaaaagaaatggttgatgagaaatcattcatcgatatggcctatactttattaaatgataaacaaacaacgatgaatttatatgatattattgatgaatttaaatctttaggcggatatgagtatgaagatattgaaaatcgaatcgtacaattctataccgatttaaacactgatggtcgttttttaaatgtaggagaaaatctttggggtctacgtgattggtactctgtagatgatattgaggaaaaaatcgcaccaacaattcaaaaattcgatattctagatgacgaagatgaagaagatcaaaaccttaaattattaggtgatgacgacgctgatgaagatgacgatattcctgctcaaacagatgatcaagaaacattagacgagtcagataatgatgaagatgatgttgaaatgaatgaagcagatatcgttattgatgaagacgaagacgaagatattgctgaaggtgaagaagaagcctttgaagacgccgaagactttaatgattaa

SEQ ID NO: 122 - DNA, 1521 bp, Staphylococcus epidermidis
gaggtgcaaatgacgatgtatagtccgcaaaagctacatccaatttcttatattgatggcttgattagtgtgattaaatcaaatttcattgtaattatcatctttttatttaatataaaagattttaaatatgatgatttttcgtcttatattattccaggtataatgactttgatattttctatcggtttcattcataatattattaaggtttataatacacgatattggattgaagaggatcattttattttaactactggtgtttttaataaggaacgaaaagaactaaatattagtcgcatacaatctgcagatacgtctcaaggtttgattaatcaaattgttggcggcgttgaactcatcattaaaacaccaagtgatggcatagaattagggacaatttccaaaaagcaaagtgaagttattgaacaagaattgcgatctattcaagaacgcatgaataaccaggtaaatcaagaagctaaagagttaaatgatgagaatcatactcagacatatcaacaacatgccaaaccccaatatgcaatatttaaaatgccttttaaacaactattatttatgtctatgacaagtggagctatagcacttgcttttgtgacactatctcctattattggcagtctctcaagtgttattccatgggataaatttggtgaagaaatatcttcggtatttaaaacgatatatttcattgtcatttttattgtcatactagtgttattattaagttatataatcggaactatcatgtacttaataaagttttatggatatcaagttattcaagataatcatcaacttaaaattcaatatggattatttacaaagaaaaatatcactgtaccaactgaccgactgcaaggtgtacttgaacatcaatcttttatacgaaaattatttggttatacatctatacatttctatattacaagtgatatagatactactgaaggggaacccactgataatgatggaagaattatgattttaccgtttattccaagaaaagaggcatataaagtgattaggcctttggttcctgagatgacatttaatcatgctaaaattggcatgcctttaaaaggatttcatcgtcactttctaattccttccttatgtattattggtatgggcattattggatggtatatgtggtctttatggtctttaatcatagctttattaccaatcttattattttttgtttacgctatactttatacacgttttagtggttttgcttttagcgaatcagagctagttgtccaaaaagcgtctatattaaatattaagagattttatgttaaaaaagaaaaagttttaggaatggctattagccaacatccctttcttgaaagaagtcaactcgcaaattttcaatttgttattgctaagggtagtagtcagcaaaacattggtttgaagtttagtgaagtagataatgttcttaaactcaaaaattggtacatgaaaggtgatactcatgaagtcttataa

SEQ ID NO: 123 - DNA, 171 bp, Staphylococcus epidermidis
aatttaaaaattgaacgaatgatttataaaaagttttacacacctctatatataattatactaatcgtagattttatagatataaagagctttgatatagagttgatgattcaacaaaactctataataaaaaactgtctacaatacccaaacgggaaagtagacagttga

SEQ ID NO: 124 - DNA, 150 bp, Staphylococcus epidermidis
atattaaaaataaaaaaatcgctccctctcacagcaattgtaaggggagcgtatctatttaatacacgtgtcctaattaaaggagcccaaataaaatactaccaccttttaaataaaaataaaagtcccactttaatgtttctgttataa

SEQ ID NO: 125 - DNA, 1428 bp, Staphylococcus epidermidis
aaggaggaaatcaacatgggaattggccgtgtagctcaagttatgggtccagtaatagatgttcgttttgaacataacgaagtacctgagataaataatgcattacacatcgaagttcctaaagaagatggagcgcttcaattaacattagaagttgcacttcaactaggtgacgatgtagttcgtacaattgcaatggactcaactgacggcgttcaaagaggaatggaagttaaagatacaggtagagacataagtgtacctgtcggtgacgtaactctaggaagagtgtttaacgtactaggagaaactattgacttagatgaaaaaattgatgattcagtacgacgtgaccctatccatagacaagctccaggattcgacgaattatcaacaaaagtagaaatcttagaaactggtattaaagtagtagacttattagcaccttacataaaaggtggtaaaattggattatttggtggtgccggtgtaggtaaaaccgtactaatccaagaacttattaataacatcgctcaagaacacggtggtatctcagtattcgctggtgttggtgaacgtacacgtgaaggtaatgatctttactatgaaatgagtgacagtggtgttatcaagaaaactgcaatggtctttggtcaaatgaatgagccacctggtgcacgtatgcgtgtagcattatccggattaacaatggccgaatatttccgagatgaagaaggccaagatgtgttattattcattgataacattttcagattcactcaagctggttcagaagtttctgcgttattaggtcgtatgccatcagctgttggttatcaacctacacttgctacagaaatgggtcaattacaagaacgtataagttcaacaaataaaggttcagttacatcaattcaagctgttttcgtaccagccgatgactatactgaccctgcgccagcaacaacgttcgcacacttagattcaacaacaaacttagagcgtaaattaacagaaatgggtatttatccagctgtagacccgcttgcttctacatctagagctttggaaccttcagtagtaggtcaagagcattatgatgtggcacgtgaagttcaatctactttacaaaaatatagagagttacaagatattattgcgattcttggtatggatgaattatcagatgaagataaacaaactgtggaacgagcacgtagaattcaattcttcttatcacaaaacttccacgttgcagaacaatttactggacaaaaaggttcatatgtacctgttaaaacaacagttgcagacttcagagatattttagatggtaagtatgaccatattcctgaagacgcattccgtttagtaggtagcatggaagacgtaattgagaaagcaaaagatatgggtgttgaagtctaa

SEQ ID NO: 126 - DNA, 1305 bp, Staphylococcus epidermidis
ataatgagaatgattgacatcatagaaaagaaacgagacggtaagtcattaacaaaagaagaaatagaattttttgtaaacggatacactcatgaggaggttccagattaccaagcttcaagtttagctatggcgatattctttcaagatatgaatgatgaagaaagagcggcattgacaatgtcaatggttaactcaggagagaagatcgacttaagcgatatcaatggtattaaggtagacaagcattctacagggggcgtcggtgatacaacgacactcgttcttgccccattagtagcggcagtaggtgttccagttgcaaagatgagtggtcgtggtctaggacatacgggggggacgatagataaattagaatcagttaagggatttaatgttgaaatcagtgaaaaagattttataaaacttgtaaatgataaccaagtagcagtaataggccaatcaggcaatctcacaccagctgataaaaaattatatgcattgagggatgtaacagggacagttaactctattcctctcatcgcttcgtccataatgagtaagaaaattgctgctggcgcagatgcaattgttctagatgtcaaaactggcagtggtgcgtttatgaagacgctagatgatgccgaagcacttgcgcatgcgatggtaagaattggtaataatgtaggtcgtaatacgatggctattatttcagatatgagtcaacctttaggaaatgcaattggtaatgcgctcgaattaaaagaagctatcgcaacattaaaaggaaatgggccgaaagacctaacagagcttgtgttaacacttggttctcaaatggttgtcttagctgaacaagcaacatctttagatgaagcgcgtcagatgctaatcgatgctataaaaacaggcaaagctttaaacaaattcaaaacatttctatcgaatcaaggaggagatgactctattgtggattctcctgaaaagttacctagcgcgaaatatcaagttgaatttaaagctaaaaaagatggttatataactgaaataatagctaatgagataggcgttgcttcaatgatgttaggcgctggtcgtcaaacaaaagaagacgttattgatttaggtgtaggtatcgtgttaaataaaaaagtaggagaacatgttgagaaaggtgaaaatattttaactattcataccaacaccaaagagatcgatgatattttatataaactagacaatagtattactattgagagtaagggcgaagctccaaccttaattcataaaataataaccgagtag

SEQ ID NO: 127 - DNA, 1062 bp, Staphylococcus epidermidis
atatttttgatgaaaaaagttatgaccatatttggaactaggcctgaagctataaaaatggctccgttgattaaaacgttagagaaagattctgacctggaacccgttgttgtagtcaccgcccaacatagagagatgcttgattcagtgttgaatacttttaacataagtgcagattatgatttgaatattatgaaagctggtcaaacattgtctgaagtaacatctgaagcaatgaaaaagttagaagatatcatacaaaaggaagtgcctgatatggtacttgttcatggtgatacagtgacaaccttttctggagcattagccgcattttatagtcaaacacctataggacatgttgaagctggattaaggagttataataaatattcaccttatcctgaagaaataaatagacaaatggttggggtaatggcagatttgcactttgccccaacctataatgctgcacagaatttagtaaaagagggtaaattagccaaacatatagctatcactggtaatacagctattgacgcaatgaattatacaatcgatcaccaatattcatcatctatcatacaaaaacataaaaataaaaactttattttactcacagcacatagacgtgaaaatataggtaaacctatgataaacgtgtttaaagcgattagaaagttgattgatgaatatcaggatttagcgttggtctatcctatgcatatgaatcccaaagtaagagatattgcgcaaaaatatttaggaaatcatcctaggattgaattgatagaaccacttgatgtggttgattttcataattttgctaaacaagcatatctcattatgactgactctggtggaatacaagaggaggcaccatcattacacaaaccagttttagtattgagagatagtactgaaagaccggagggagtagatgctggaactttgagagtcattggtacgaatgaagaagatgtctataatgaaactaaaaaattaatagaaaacccagacctttatcaaaaaatgagtcaagctgttaatccatatggcggttga

SEQ ID NO: 128 - DNA, 924 bp, Staphylococcus epidermidis
attagtatgataaaatatactctatgtgaatataacattagaggtggaaaaatgaagaaaaaagcgttactacctttgtttttgggaataatgatttttctagcaggttgtgattactctacacctgagaagcaagatggattcttctttaatacttttgttcaacctatgaaacatctcttacagtggttaggaaatgatgtttttcataataattttggactagcaattattgtattagttcttttcattcgtttaatcttgttaccatttatgttatctaactataaaaatagtcacatgatgcgtgagaaaatgaaagtggctaaacctgaagtagatggcattcaagaaaaggttaaacgtgcgcgaacacaagaagaaaaaatggctgcaaaccaagaacttatggaagtttataaaaaatatgatatgaaccctatgaagagcatgttaggatgtttacctatacttattcaaatgccaattattatgggattatactttgtattaaaagataagcttgtaaatggtttatctgaacatccgcatttcttatggttcaatttaactaagcctgatatttggattacagttattgccggtgtgctatactttattcaagctgtagtttcaagcaaaacgatgcctcaagagcaacgtcagatgggctatatgatgatggttatttctccaataatgattatttggatttctttacaagcatcatcagctttaggtttatattggtctgtcagtgcattattcttagtaattcaaacgcattttgctaatatttattactctaaacttgctaaaaaagaagttcaaccttttattgaaaagtatgaaagagaacataatccatcttcaaagaaaaaagggaaaaatactcaagtagtatcaaaaaagaataaaaaataa

SEQ ID NO: 129 - DNA, 210 bp, Staphylococcus epidermidis
atatcagtgataacagcaaatttcatgatattatctcccttcaatgttatcttattagcatattctaacattttgtgctctattatgttagatattaatttaaaatttattagaattttgatattgtatttatatgaaaaaaaaggagtgcttaaaatttgtttaattattataaatccggatttcaaaaagcaaaaccacataatctaa

SEQ ID NO: 130 - DNA, 156 bp, Staphylococcus epidermidis
  modified_base (51)..(51): a, c, g, t, unknown or other
tacttatggataatcacgttgattcaccaccatcagctgaaaccgtacccnataaacaaggtaggactaactaggacgtattatgtaatttatcaagacgtcttccaagaatatattattatgataataatgaagaggttactaacgaattgttaa

SEQ ID NO: 131 - DNA, 417 bp, Staphylococcus epidermidis
gaggtatggataatgaatacacttagactaaatattgtcactcctaatggttctgtctatgaacgtgaagacgttgagatggctgtcttacaaacaacagctggtgaaatggggattatgtatggtcacattccaactgttgctgcattaaaaacaggtcatgtgaaagttaattttcacaacggaaatgaatttattgcagtaagtgatggctttattgaagcaagacaacatcaattatcaattatcgtccaaacggccgaacctgctagtgaaatcgatgttgaaagagctaaattagctaagtcgagagcagaatcacatttagaagatgatgatgataatacagacataaatagagctaaaagagcacttgaacgagcaaataatcgtttacgtgttgcagaattacaataa

SEQ ID NO: 132 - DNA, 207 bp, Staphylococcus epidermidis
tataacaacttttggaatcagatggaggttcttttcatgttatcttttaatcaaaatagaaaccacagtcttgaacaatctttaaaagaaggttatgcacaaatggccgatttaaacctctccctagcaacagaagcttttccgatagagtgtgaagcttgtgattgcaatgaatcacatttaatatctaattcaaagaatgaatga

SEQ ID NO: 133 - DNA, 948 bp, Staphylococcus epidermidis
ctaaacattgtagtgagacagaaaaaaaagagattaaagaaaatttcttgcaaagtactattcatgagagacatttcttcaatatggcatatattaatgaaaaatgggaatatgggggaaataacaatgaataaacctaaaattgcactaacaatagcaggcacagatcccaccggtggggcaggtgttatggcggatttaaaatcatttcacgcgtgtggcgtttatggtatggccactataacaagtatcgttgctcaaaataccctaggagttcaacatatccataatttagaatcttcatgggtaaaggaacaacttgatagtgtgtttgatgatgaattaccacaagctatcaaaacgggtatgattgcaacaaaaaaaacgatggagttgattcaaagttacttaaaggaacattccaatattccttatgtgattgatccagttatgcttgccaaaagtggtgattcattgatggatgaaaatactaaaaatcatttgcaatcaacattattacctttggctgatgttgtcactccgaatatacctgaagctgaggaaattactggtattaaaattaatgatgaagaaagcatacgtaaagcaggtcaaatctttattaatgaaattggtagtaagggtgttgtaattaagggagggcattcagccgatttaaataatgctaaagattttctttttactaagaatgaaacgtatacctttgagaacaaacgctttgatactaaacatactcatggaactggttgtactttttcagcagttattacagcagaattagctaaaggtcgttccataaaagatgcagttaaaaaagcaaaagagtttatttcattaagtattgaacataccccagaaattggcaaggggagaggacctgtaaatcattttgcttatatgaagaaagtaggtttagatgatgaataa

SEQ ID NO: 134 - DNA, 132 bp, Staphylococcus epidermidis
agaaacaacgtatttaacatgaattctgatacactcactatttcatatcactcaaatataaatgttgttaatttaaaaattgtgttaagaattataccgtttccgtccaaatatcagcaccaagtgctttaa

SEQ ID NO: 135 - DNA, 912 bp, Staphylococcus epidermidis
tataatgacgttgaaaaaaacgtgcactgttgcactcaaggaggaactttaatgcctttagtttcaatgaaagaaatgttaatcgatgcgaaagaaaacggttatgcggttggtcaatacaatcttaataacctcgaatttacacaagctattttagaagcgtctcaagaagagaatgcgccagttattttaggtgtttctgaaggggcagctcgttatatgagtggtttttatacagttgtgaaaatggtagaaggtttaatgcatgacttagacatcacaatcccagtagcaattcatttagaccacggttcaagctttgaaaaatgtaaagaagcaattgatgctggattcacatctgtaatgattgatgcatctcatagtccttttgaagaaaatgttgaaatcacttctaaagtagttgagtatgctcatgatagaggcgtttctgtagaagctgaattaggtacagttggtggacaagaagacgacgtagttgctgatggcgttatctatgcagaccctaaagaatgtcaagaattagtagaaaaaactggaattgatactttagctccagcattaggttctgtacatggaccatataaaggtgaacctaaattaggatttaaagagatggaagaaattggtgcttcaactggattacctttagtattacacggtggtacaggtattccaactaaagatattcaaaaagctattccttatggtactgctaaaattaacgtgaatactgaaaatcaaattgcgtctgctaaagcagttcgtgaagtattaaacaacgacaaagatgtgtatgatccacgtaaatatttaggaccagcacgtgaagcaattaaagagacagttaaaggtaaaattagagaattcggtacttctaatcgcgctaaataa

SEQ ID NO: 136 - DNA, 165 bp, Staphylococcus epidermidis
ggtgacttagtggacaaagttaataagatcgccaaactaaataaattattttgggaaactacggatagcgtgtataaaattcatataatagcacgcttatttcatgatgtattcgttgataatgattatgataggggattatcaaatttaagcagtgataattaa

SEQ ID NO: 137 - DNA, 135 bp, Staphylococcus epidermidis
cgattgatagtcaataatgttaaaattcaaatcttatttgtaaactgggacatgattgattattctaacttttttatcaaacactacttaatattcttaaagaatcatacacttataatccagcttccaatataa

SEQ ID NO: 138 - DNA, 153 bp, Staphylococcus epidermidis
attttctcagtttttagcttcaaacatctttttaatatcaaatttataatgttcgtttataaaaaaagcaccccaaaagttaaattaaaatctaacttatggggtgtaaatactataaacatgtcgcagactttttctaatataatcaattaa

SEQ ID NO: 139 - DNA, 1296 bp, Staphylococcus epidermidis
ctgattagagttttaagtggaggattaaagatggataaaatagtaataaatggtggaaatcgtttaacaggtgaagttaatgttgaaggagctaaaaatgctgtattacctgtacttacagcgtcattacttgcttctgaaggacacagtaaactagttaatgtcccagagttaagcgatgttgaaacaatcaataatgtattatctacactcaatgcaaatgtagagtatgataaagataaaaatgcagttaaagttgatgcaactaaaactttaaatgaagaagccccttatgaatatgtgagtaaaatgcgagcaagcatcttggttatgggaccactacttgctcgactagggcatgctattgttgctttgccaggaggatgtgcgattggaacacgtcctatcgagcagcacattaaaggatttgaagctttaggtgcagacattcatttagaaaatggaaatatttatgcaaatgctaaagatggattaaagggagcacatattcatttagattttccgagtgtaggtgcaactcaaaatattattatggcagcgtccttggcatcaggaaaatctatcattgagaatgtcgctaaagaacctgaaattgttgatttagctaattatattaatgaaatgggcggtaaaattacaggtgcaggtactgataccattacgatacatggtgttgaaaaactttacggtgttgaacatgcaattataccagatagaattgaagctggaacgttacttatcgcaggtgcaataactcgtggtgacatatttgtacgtggtgcaattaaagaacatatggctagtttaatatataagcttgaagagatgggggtagatcttgaatattatgaagaaggtataagagttacagcaaatggagatttaaatccagtagatgtaaaaactttaccacacccaggtttcccaactgatatgcaatctcaaatgatggctttattattaacagcaaatggacacaaagtgattactgagactgtttttgaaaatagatttatgcacgttgcagaatttagaagaatgaatgcgaatataagtgttgaaggaagaagtgctaaaattgaaggaaaaagccatttacaaggtgctcaagttaaagcaacagatttaagagctgctgcagccttaatcttagctggtttagttgcagagggaactacgcaagtgactgagttaaagcatctagatagaggatacgtcaatttacatggaaaactaaaaagtctaggtgcaaacatagaacgtgtaaatcgataa

SEQ ID NO: 140 - DNA, 1374 bp, Staphylococcus epidermidis
ttattagaggttttagttatgataaacgtaacattagagcaaattaaaaactggatagattgtgaaattgatgaaaaacatttaaaaaaaacgataaatggggtttcaattgattcacgaaaaatcaatgaaggggcgctatttataccttttaaaggtgagaatgttgatggccatcgttttatcacgcaagcgttgaacgatggtgctggagctgtttttagtgaaaaagagaataaatattctgaagggaaccaaggtcctattatttgggtagaagatactttaatagccttacagcaattggcaaaagcatatctaaatcatgtgaatcctaaggtgatagcggttactggttctaatgggaaaacaacaacaaaagacatgattgaaagtgtattatcaactgaatttaaagttaagaaaacacaaggaaattataataatgaaattggaatgccgttgactttactagaacttgatgaagacacagaaatttctattctagaaatggggatgtcaggttttcatcaaatagagttgttatctcatatcgcacaacctgatatagcggtcatcacaaacattggtgagtcacatatgcaagatttaggatcgcgagaaggcattgcaaaagctaaatttgaaataacaactggtctcaaaacaaatggtatatttatttatgacggagatgaacctttattaaaacctcatgttaatcaagttaaaaatgcgaaattaataagcattgggttaaattcagacaatacatatacttgtcatatgaacgatgtaaaaaacgaaggtattcattttactatcaatcaaaaagaacattatcatttaccaattttgggcacgcataatatgaaaaatgctgctattgcaattgctattggacatgaattaggcctaaatgaaacaataattcaaaataatattcacaatgtgcaattaaccgctatgagaatggaaagacatgaatcatcaaataatgtaacagtaattaatgacgcatataacgcaagtccaacgagtatgaaagctgccattgatacattaagtggcatgaaaggtcgaaaaattttaatattagcagatgtacttgaattaggacctaatagtcaattgatgcacaaacaagttggtgaatatttgaaagataaaaatattgatgttttatatacatttggtaaagaagctagttatatccatgatagtggtaaaatttttgttaaagaagcaaaatactttgataataaagaacagttaattcagacgctaatatctcaagttaaacctgaggacaaagtcttagttaaaggttcacgaggtatgaaacttgaggaagttgttgacgcattgttgtaa

SEQ ID NO: 141 - DNA, 126 bp, Staphylococcus epidermidis
ttgaagcgggtgctacacgtattggtgctagtgccggtgtgcaaattattcaaggacttgaatcaaatactgattactaatactaaatttatgtctaaaggaatgatgaataatgagaatgattga

SEQ ID NO: 142 - DNA, 141 bp, Staphylococcus epidermidis
tttatcctttctttcaattatactcgagcggcctttgttaatcataaaatattaataaaaggtcgctttaaatacatagcaaaggcctataatttcaataattatctgataaatttcatttgtattacaacgatattgtag

SEQ ID NO: 143 - DNA, 129 bp, Staphylococcus epidermidis
aaccccatttcaatcattctatatattaagagcgtgggacatcagttatgttcccacgctctaaaaattttcaataggttttataaatttcagatgaatctatctcaatatttactttttcacatataa

SEQ ID NO: 144 - DNA, 153 bp, Staphylococcus epidermidis
actatatgttcttcagttaaatctagtgctttaaatacatcaggtgatgaaattccgatgttaggcttagctaaaacaacccatgcagaaggtggtctttttaggaaagttacttgctcgccacgccccgtacacacagcagtttggttataa

SEQ ID NO: 145 - DNA, 1521 bp, Staphylococcus epidermidis
attgataaatcaaagttcaaaggagagaaatttatgtcagaagaaatgaacgaccaaatgcaagttcgtcgtcaaaaattacaagaattaattgatttagggattgatccttttggtcatcgattcaatcgctcatctacttcaagtgagttaaaagaacagtgggaccaattctctaaggaagaattgcatgaaaaagaagacgaaagccacgtgtcaattgcaggtcgtcttatgactaaacgtggtaaaggtaaagcgggatttgcacatattcaagacttgaaaggtcagattcaaatttatgtaagaaaagatcaagttggagatgatcaatttaacatttggaaaatggctgacttaggtgacatcataggtgttgaaggtgtcatgtttaaaactaatacgggcgagatttctgtcaaagctaagtcatttactttactatccaaatcattacgacctttacctgataagttccatggtttacaagatatagaacaaagatatcgacaacgttatttagatttaattacaaatgaagatagtacgcaaacgtttattaatcgtagtaaaataattcaagaaatgagaaactatttaaataaacaaggattcttggaagtagaaacaccaatgatgcaccaaattgctggaggtgctgctgcacgtccgtttgttacgcatcataacgcattagatgctactctttatatgcgtatagctatagaactacatttgaaacggttaattgtcggaggtcttgaaaaagtctacgagataggcagagtttttcgtaatgaaggtgtatctacaagacataaccctgaatttacaatgattgaattgtatgaagcttatgctgattatcatgatataatggatttaactgaaaatatggtcagacacattgctcaagaagtgtttgggtcagctaaagtacaatataatgatgaagaaattgacttagaatcttcatggaaacgacttcacattgttgatgctgttaaagaagttaccggtgtagatttttataatgttaattctgatgaagaagctattagattagcaaaagaacatgatattgaaattactgaaaatatgaaatatggccatatattaaatgaattttttgaacagaaagttgaagaaacacttattcaaccaacgtttatttatggtcaccctattgaaatttcaccgttagcaaagaaaaatccaaacgatgaaagatttactgatcgttttgaattatttattgtaggaagagagcatgcaaatgccttcacggaattaaacgatccgattgatcaacgccaacgttttgaagcgcagcttgttgaaaaagaacaaggaaatgatgaagctcatgatatggatgaggattacatcgaagcattagagtatggaatgcctccaactggtggtctaggtatcggtatcgacagattagtaatgctattaactgattctccgtcaattagagacgtattactattcccatacatgagacaaaaatag

SEQ ID NO: 146 - DNA, 195 bp, Staphylococcus epidermidis
cgaacaaggtcgagtgacttcaatggaaatgtggcaaaagcaggtacagatatcaaagaaaacgatgaactcattattcgttttggacaaaaattagtcacagttaaagtaacaggattaagcgaccatgctacaaaagaaaatgcaaaaggtatgtatgatttgattaaagaagaacgtattaatgaagagtga

SEQ ID NO: 147 - DNA, 138 bp, Staphylococcus epidermidis
agtaggacgttgccaggcaaatatcgtataagatgcgatgagcctaatcgagaccgaaaggtctcttttttttatacaaaaatagttctaaaaaataggtttctcggcgaggagaaagtattaggaacttatgaataa

SEQ ID NO: 148 - DNA, 810 bp, Staphylococcus epidermidis
tttaaaatgcccaatgttgtaggtgttcagtttcaaaaagcagggaaattagaatactacgcgccgaatcaattagatgtaaaggttggtgactgggttgttgtccaatctaaaagaggtatagaaattggccacgtaaagtttccattacgtgaagttgatgtagaagatgtcacattaccgctaaaaaatatcattcgtaaaatgaatgaagatgatcaagaaacatattatcgtaatgaacgcgatgccaatgatgcgttagaattatgtaaaaaagtagttaaagatcagcaattagatatgcgattagttaattgtgaatatacattagataaatctaaagtgatttttaattttaccgcagatgatcgcattgattttcgcaaacttgttaaagttttagctcaaaatctaaagactagaatagaattacgtcaaattggggtaagagatgaagcgaaattattgggtggtatcggtccttgtggacgttctttatgttgttctacatttttaggagatttcgaacctgtatccattaaaatggcgaaagatcagaacctatcattaaatccaactaagatttcaggagcttgtggtagattgatgtgttgtcttaaatatgaaaatgactactatgaagaggctcgaactcaattacctgatgttggagatatgattcaaacaccagatggtcacggaaaagtgataggattaaatattttagatatttctatgcaagttaaaatagagggtctagaacaacctttagaatataaaatggaagagatagaagtattgaattaa

SEQ ID NO: 149 - DNA, 615 bp, Staphylococcus epidermidis
gaaatgtctacatttataacgtttgaaggtccagaaggagcaggaaagacctcagtaattaaaaaagtaagcgaaagattagctaaagaatatgatattgttacaacacgtgaacctggtggagtattaactagtgaagaaatacgtcgtattgtacttgatggagatagtatagacattcgaactgaagctatgctgttcgctgcatctagacgtgaacaccttgttgaaaagattatcccatctttacaggcaggtaaaattgtcctttgtgatagatatattgatagttcattggcttatcaaggttatgcaaggggtataggaattaaagaagtaaaattattaaatgaatttgcaattaatggtttgtatccagacttaacgatttatttagatgttgatgcggaaattggtcgtcaaagaattctaaaaaataacagagaacaaaacagattagataaagaggaaaaagcttttcatgaaaaagtgatcgaaggatatcaaaaagtgattagtgataatcctcatcggtttattaaagtcaatgctaaccatagtttggataaagttgttgaagaaacataccaatctatcatcaaatatttaaaataa

SEQ ID NO: 150 - DNA, 141 bp, Staphylococcus epidermidis
tgttcattaactcgtttagattatctaaattcattgtctctctcatttattcataagttcctaatactttctcctcgccgagaaacctattttttagaactatttttgtataaaaaaaagagacctttcggtctcgattag

SEQ ID NO: 151 - DNA, 153 bp, Staphylococcus epidermidis
  modified_base (126)..(126): a, c, g, t, unknown or other
atgctttcagcacttatcccgtccatacatagctacccagctatggccgttggcaccacaactggtacaccagaaggtatgttccatcccccggtcctcttcgttactaaggacagctcctctcanattttcctacgcccaacaaacggatag

SEQ ID NO: 152 - DNA, 597 bp, Staphylococcus epidermidis
cgtccaacagcatcaatttcatcaataaaaatgatacatggggcatttttcttagcattttcaaataaatcacgaacacgactcgcaccaacaccaacaaacatctcaacgaagtcagatccactaattgagaagaatggtgcaccagcttcacctgcaaccgcacgtgctaataatgttttacctgtacctggaggcccaacaagtaagacaccttttggaattcttgaacccatttgtttaaatttcttgttatcttttaagaaatctacaatttctattaattcttgtttctcttcgtcagctcctgctacatctgagaaacgaactcgacgtttattactgtcgtacatcttagctttggattttccaaagttcatcatacgaccaccgccgccgccaccttgggcttggctaaggaagaaaataaataataatgcaatgattaatacaggaatcagtgtcgttaaaatactaacgaatacactttgtttttcttcttctttaactgtaaatttaagattatcttgtttcttagctgtatctgtgattttttgtaaatctttttcattgttatataaaattgtcgatgagtaa

SEQ ID NO: 153 - DNA, 480 bp, Staphylococcus epidermidis
atggttaaagcttatttaggattagggagcaatattggaaatagagaactacaactcaatgaggctattaaaatacttcatgactatcaaggtattcaagtaactcaagtttctcatatttatgagactgaaccagtgggatatactaatcaaccgaaattcttaaacttgtgcattgagatagagactgaattgaatccacaatctttgttaaaatgttgtttaacaacggaacaacaacttcatcgtaaaagagaaatacgttgggggcctagaactttagatatagatatactactgtttggtgatcaaattattgaacaagataatttatcagtgccgcaccctagaatgaaagaacgttcgtttgttcttatcccgttaaatgatatagccaccaaacaaatagaaccgatttctaataaaagtatcggacaactagtagtacctgataatagtgtgaaaaaatataaggaataa

SEQ ID NO: 154 - DNA, 210 bp, Staphylococcus epidermidis
tttatcaatttattgttccatgtctttctgttgaaaactttaggagctatatattgtttcctaatcagttttaatttatatttaagccttttattatacccttcttatcttcatatgtattgttattcaatgaaggttgatattgcatctaatcaaagcaaatctactcactttattattctacaagaccatcaaaatgtaataaagtaa

SEQ ID NO: 155 - DNA, 1386 bp, Staphylococcus epidermidis
agtgtaaattttaatggagggttagcattcatgcaaagacatgcgattattctggcagcaggtaagggcacaagaatgaaatcaaagaaatataaagtgctccatgaggttgctggcaaaccaatggttgaacatgtgcttaacaacgtaaaacaagctggcgttgatcaaattgtaactattattggtcatggcgctgagagtgtgaaagatacattgggtaatcaatcattatatagttttcaggataaacaacttggaacagctcatgctgtgaaaatggcacatgaacatttagcagataaagaaggaactactctagtagtatgtggagatacaccacttattacataccaaactttacaatcacttattgaacatcatgaaagtacacaatcacatgttactgtattatctgcttctactatcaatccttatggttatggacgaattattagaaatcataatggaatattagagcgtattgttgaagagaaagacgcaaatgactcagaacgtgcgattaaagaaattagttcaggtatttttgcctttaataatcgagtactatttgagaagttagaacaagttaaaaatgataatgctcaaggagaatattatttacctgatgttttgtctttaattttaaaagacggaggtaaagctgaagtttattgtaccgaagattttgatgaaatcattggtgttaatgatcgtttgatgttaagtgaagctgaaaaggctttgcaacaacgtatcaatcgctatcatatggaaaatggtgtgacaatcattgatcctagttcaacatttattggaacagatgtgaaaattggaatagatacaactattgaaccgggcgtgcgcatcggaggtcatacaacgattgaagaagatgtgtggataggccaatactctgaaattaataatagcacaattcattcgaatgctaacataaaacaatcggttatcaatgactctattgttggagagaacacaacagttggacctttcgctcaactacgcccaggatctaatttaggttctgaagttaaagtaggaaactttgttgaagtgaagaaagcagatattaaagatggtgctaaagtatcacacttgagctacattggagatgctgaaataggtgagcgtacaaatatcggatgtggttctatcactgtaaactatgacggcgctaacaaatttaaaacaatagtaggtaaagatgcttttataggatgtaatacgaaccttatagcacctgtaacagtaggtaatcatactcttattgcagctggatccacaattacagataatatccctgaagatagtttagcattagcgcgtgcaagacaagtaaataaagagggctacctaaaaaaatag

SEQ ID NO: 156 - DNA, 153 bp, Staphylococcus epidermidis
ataaaactatatactactttggtctttactataagacatttcctacaaaagattaagttaaacgtaaaaaaagatagtcgaacgaaagtgaggacaacaaataatcctccttttcgacgacttttacattactatatgactaacttctattaa

SEQ ID NO: 157 - DNA, 897 bp, Staphylococcus epidermidis
aaaggagatttaacaatgacacatgattatatagtgagaggtttagcatacggtggggaaataagagcatatgctgcaatcacaacagagtcagtacaagaagcacaaacacgtcattatacatggcctactgcttctgccgctatgggaagaactatgacagctactgttatgatgggtgcaatgttaaaaggaaatcaaaagttaacagttactgttgatggcaaaggtccaattggcagaattattgctgacgcagatgctcaaggaaatgttcgtgcatatgtagaccatccacaaacgcattttccactcaacgatcaaggtaaattggatgtacggcgagcagttggtactgatggttccattcaggttgttaaagatgttggaatgaaagactacttttctggtgcgagtccaatagtatcaggtgagctaggagatgatttcacatactactatgccacaagtgaacaaacaccatcatcagtaggattgggtgtattagttaatccagacaactcaatcaaagcagcgggaggatttattattcaagttatgccaggtgctactgatgaaacggtgactaaattagaagaagccattagtcaaatgcaacctgtatcgaaattaattgagcaaggacttacacctgaaggaatattaaatgaaattttgggtgaaggtaatgttcaaattttaaattcaacgtcagcgcaatttgaatgtaattgtagtcatgagaaatttttaaatgctattaaaggtttaggagaggcagaaattcatagcatgattaaagaggatcatggagctgaagctgtatgtcacttctgtggtaataaatatcagtatagtgaaagtgaattagaagatttattagaaacaatgaaatag

SEQ ID NO: 158 - DNA, 123 bp, Staphylococcus epidermidis
cctgctcctcacttacccatcaacgttactgttgcttgtaagtgtttatttgttcgcaattctacgaacgatagtattatacatgttgatgtaggatacgtcaaattcaattgtaaattttag

SEQ ID NO: 159 - DNA, 546 bp, Staphylococcus epidermidis
attataatgcataaggatttaaagaatgttttgttatcggaagaagacattcaaaatatttgtaaagagatgggagctatcattactgaggattataaagatcgcccactcgtttgtgttggtattttgaagggatcagtcatgtttatggcagacttaattaaacgtattgatacacatttatcaatcgattttatggatgtttcaagttatcatggtggaacggaatcgactggggaagttcaaatattgaaagatttaggtgcttctatagaaaataaagacgtacttataattgaagatatattagaaactggtacaactttaaaatctattacagagttattgcaatcacgtaaagttaactctttagaaatagctacattattagataaacctaaccgtcgcaaagctgatatcgaagcaaaatatgttggtaaaaagattccagatgaatttgtagttggttatggtttagattatcgtgagttatatagaaatctgccatacataggcacactaaaagcagaagtttattctaaatag

SEQ ID NO: 160 - DNA, 417 bp, Staphylococcus epidermidis
tctcaatttaatattcacgtaacagatgaatggataattcaaattgcatatgataaattaataataatggctaaaagtgaaatggatcaatatatattagaccgtatatgtattagaaagccaggtacatatgaatttaatgattatcaaattgatattcatcctgacttaccacaacagttatatccgcttactgtgcgtgtccgacaaaatggagatgtgtataaattaaatggtcaaaaaggtcataaaaaagtgagtcgtttatttatcgataaaaaagtgactcttgctgaacgtcagcgcatcccactcattattaatcaagaaaatgcagtgttagctattggcgatttatatgttaaagaaaattttaaagaatttattttgatttcgaataatggagatgaattataa

SEQ ID NO: 161 - DNA, 891 bp, Staphylococcus epidermidis
atggaatataaagatatagcaacaccatctcgaacacgtgctttgcttgatcaatatgggtttaattttaagaaaagtttaggacaaaattttctaatagatgtaaatatcattaataaaattatcgaagcgagtcatatagattgtacaacgggtgtaattgaagttggaccaggtatgggatcattgactgaacaacttgcaaagaatgctaagaaggtgatggcttttgaaattgatcaaagattaatacctgtgcttaaagatacactttcaccatacgataatgtaacaattatcaatgaagatatacttaaagctgatattgctaaagctgtagatacacatctacaagattgtgacaagattatggttgttgctaatttaccgtattatattaccacacctattttacttaatttgatgcaacaggatgtacctattgatggttttgtcgtaatgatgcaaaaagaggtaggagaacgtttgaacgctcaagtaggtaccaaagcatacggttcgttatcgattgttgctcaatactatacggagacaagtaaagttttaacagttcctaaaactgtatttatgcctcctccaaacgttgattctatcgttgtaaaattgatgcaacgccaagaaccacttgtacaggttgatgatgaggaaggcttttttaagttagcaaaggccgcttttgcacaacgacgtaaaacaattaataataactaccaaaacttctttaaagatggtaagaagaataaagaaactatacgacagtggctagaaagcgctggtattgatcctaaaagacgtggagaaacactcacgattcaagatttcgccacattatatgaacaaaagaaaaaattctccgaattaacaaattaa

SEQ ID NO: 162 - DNA, 144 bp, Staphylococcus epidermidis
gaagggtataataaaaggcttaaatataaattaaaactgattaggaaacaatatatagctcctaaagttttcaacagaaagacatggaacaataaattgataaatcaaagttcaaaggagagaaatttatgtcagaagaaatga

SEQ ID NO: 163 - DNA, 966 bp, Staphylococcus epidermidis
atgttaaataatgaatataagaattcatcaatgaagatcttttcgcttaaaggaaatgaacctttggcacaagaagtagcagatcatgtagggattgaattaggtaaatgttctgtaaaacgttttagtgatggagaaattcaaataaatattgaagaaagcattcgtggttgtgatgtttttattgttcaaccaacttcatacccagtcaatcttcatttaatggagttacttattatgattgatgcgtgtaaacgcgcgtcagcagcaaatattaacatcgtagtaccatactatggttacgctcgacaagatagaaaagcccgtagtcgtgaacctattactgctaaattagtagctaatttaatcgaaacagcaggtgccaatcgtatgatcgcattagacttacatgcacctcagatccaaggattcttcgatattcctattgatcatttaatgggtgttcctatccttgcacaacactttgagaatgatcctgatattaatccagaagaatgtgtagttgtgtcccctgaccatggtggggtaacacgagctcgtaaattagccgacattttaaaaactccaattgcaattatcgacaaaagacgtccgaaaccgaatgtggcagaagttatgaacattgtgggtgatattgaaggacgtactgcaattattatagatgacattattgatactgcaggaacaattactttagctgctcaagctttaaaagataaaggtgctaaagaagtctatgcttgctgtacacatccagtgctttctgggccagcgaaagaacgaattgaaaactctgcaatcaagcaacttatagtaacaaactcaattcaattagaagagaatagaaaacctaataatacaaaagaactttctgtagctggtttaattgcgaaagcaattattcgtgtatacgaaagagaatcagtaagtgtattatttgactaa

SEQ ID NO: 164 - DNA, 357 bp, Staphylococcus epidermidis
tataatgataaaaagaggtgtataaaaatgaaaatgattatagcgatcgttcaagatcaagatagtcaagagctttcagaccaactcgtaaaaaacaatttcagagctacaaagttagcaactactggtggatttttaagagcaggcaatacaactttcttatgtggggttaaggatgaccgtgtcgacgaggttctatctgtcattgataatacttgtggtaatagagaccaacttgtttcaccaataacaccaatgggtggtagtgcagattcatatattccttatccagttgaagttgaagtaggtggcgcgacagtatttgtaatgccgattgaagcatttcatcaattctag

SEQ ID NO: 165 - DNA, 882 bp, Staphylococcus epidermidis
atgaatatcaaaacagatggttggtctaaaaaagcacatattgttgtggctgtctcaacaggcattgatagtatgagtttattatatagcttattaaacgactatcaacatacatatcgtaaattaacatgtgttcatgttaaccacggattgcgtgaacagtcatatgaagaagaagcgtttttgagagagtattgccatcaacatcatattgacatttatataaagcgtttagacttaagtgatattgtagcagacggtaatagtattcaacaagaagcgcgtcaacgtcgttatgaatggtttggagatatcatagctcaattaagagcagatgtattgttaacagctcatcatcttgatgatcaacttgaaacgattatatatcgtttgtttacagggagatcaacacgtaattcattaggtatgacatacgagtcgtattttaatcaatacaaagtgtatcgtcctatgttaaatttaaaaaaaactgaaatattagcgtatcagtatgcgaaccaaattccatactatgaggacatgtctaatcaagatagaaaatatgttagaaatgacattagacaacgcatcatacctgcaattaacgagaacccgcatttaaacgcgcatcagctactcaaacttaaggattggcatgatattgaattgcaatcgttaaaagaacaagctgaaacgttcatcaataacgaagtttcaaaaagtaaatatttaacctattccttttctagaactgcttttaatgaattgaatgtgaatatcaaaagcgtagttatggatttgttattccaaaaattagattgtcatttagcaatgccacaacatgcttatgacgagtgttttgaacagattagaaatgaataa

SEQ ID NO: 166 - DNA, 132 bp, Staphylococcus epidermidis; identical to SEQ ID NO: 66

SEQ ID NO: 167 - DNA, 408 bp, Staphylococcus epidermidis
caagcaatgaataaaaaagtagaacatatcggtaaccaatatacgtcacaagaaaataagaaaaaacaacgacaaaaaatgaaaatgcgtgttgtacgtagacgtattgctttattcggaggtattcttttagcgattatcctcattctacttgtattgcttgtcattcaaagacataataacgatcaagatgcagttgaaaggaaagagaaagaaactgagtttcaaaaacaacaagatgaagaaattgctttaaaagagaaacttaataatttaaatgataaagactatatcgagaaaatagcgagagacgattattatttaagtaataaaggtgaagtcatttttagattacctgatgataaaaaatcctctcagtcaaagacttcaaacgaaaaaggcaattag

SEQ ID NO: 168 - DNA, 378 bp, Staphylococcus epidermidis
aggagaatgaatatgaacgacatcatctttcttaatggaatgcgtttttatggttatcatggagtattagctgcagaaaatgatattggacaaatttttgttgttgatattactttaaaggttgatcttagttatgcaggtcaatcagatgatgtaaaagatactgtaaattatggagaggtttataaagatgtaaagtctattgttgaagggccacgttcatgcttaattgagcatctggctgaacgtattgcaaaacatataaattcacactataatcgtgtaatggaaacgaaagttagaatcactaaagaaaacccacctattcctggtcattacgatggtgttgggattgaaatagtgagggagaatgactaa

SEQ ID NO: 169 - DNA, 1881 bp, Staphylococcus epidermidis
agtcaagtgaaatcaatgattgcaaattacattagcgaagataatcgttttcaagaattagatgaagtcttcggccaagagaatattttagttacgggattatccccgtcagcgaaggcaacaattattgctgaaaaatatttaaaagatcataaacaaatgctactcgtaactaataatttataccaagcagataaaatcgaaactgacattttacaatatgtagatgactcagaagtttataaatatcctgttcaagatataatgactgaagagttttctactcaaagtccacaattgatgagtgagcgtgttagaacgttgactgcgttagcccaaggcgaaaaagggttatttattgtgcctttaaacggctttaaaaaatggctaacaccggttgatttatggaaagatcatcaaatgacgcttaaagtaggtcaggatattgatgttgatgcgttcttaaataaattagttaatatgggttatcgtcgagaaagtgtagtgtcacatattggtgagttttcattgcgtggtggaatcatagatatatatccgttgataggaacacctgtgagaatagagctatttgatactgaagttgattccatcagagactttgatgtagaaacacaacgttctaacgataatataaatcaagttgaaatcacaacagctagtgactacattattactgatgaagtgatacaacacttacaaaatgaacttaaaaaagcatatgaatatacacgccctaaaattgaaaagtccgtacgtaatgatttaaaagagacatatgaaagttttaagttgtttgaatctacctttttcgatcatcaattgttacgacgtcttgtttcatttatgtatgaaaaaccatcaacccttattgactattttcaaaaaaacgcgattattgtagttgatgagtttaatcgtattaaggaaacagaagaaacacttacaacagaagttgaagattttatgagtaacttaattgagagtggaaatggatttatcggacaaggatttatgaagtatgaaagttttgacgcattattagagcaacatgccgttgcatatttcacattatttacatcttcgatgcaagtaccattacaacatattattaagttctcttgtaaaccagttcaacaattttatggtcaatatgacattatgcgctcggaatttcaaagatacgtgcatcaagattacactgtcgtagttcttgttgaaactgaaacaaaagttgaacgtattcaatcaatgcttaatgaaatgcatattccaacagtatcaaatattcacgaagatattgatggtggtcaagttgtagtgacggaaggtagtctttctgaaggctttgaattaccttatatgcagttggtagtcatcacagaaagagaattatttaaaacaagacaaaagaaacaacgtaaacgaacaaaaacgatttctaatgctgaaaaaataaaatcatatcaagacctaaatgtgggcgattatatagtgcatgtgcatcatggtgtcggacgatacttaggtgtcgaaacactagaagttggagatacacatcgcgactatattaaattgcaatataaaggaactgatcaattattcgttccagttgatcaaatggatcaagttcaaaagtatgtggcttctgaagataagtcgcctagattaaataaattaggcgggacagaatggaaaaaaacaaaggcgaaagttcaacaaagtgttgaagatatagctgatgaattaattgatttgtataaagcacgtgaaatgtctgtaggttatcaatacgtcctagatactgcagagcaatcagcatttgagcatgattttccatatgaattaacacccgatcaatag

SEQ ID NO: 170 - DNA, 138 bp, Staphylococcus epidermidis
cacattgcgaaaagctttctgcatgcgtcatttcctcctacttccaataataaaactaacaaaaattgtaacacaacactttatattcaggctagtatttcaactttagtattgcatctacaattttgtcgattttaa

SEQ ID NO: 171 - DNA, 2106 bp, Staphylococcus epidermidis
cgcatgcagaaagcttttcgcaatgtgctagttatcgcaattattggcgttattatatttggcctcttttcatttttaaatggaaatgggaatatgccaaaacaacttacatatactcagtttgttaataagttgaataaaggcgatttaaaaactttagaaattcaaccagagcaaaacgtatatatggtaagtggtaaaacaaaaaaagatgaagattactcatcgacaattttatataacaatgaaaaagatttacaaaaaatcacagatacagctaagaaacaagataatcttaaatttacagttaaagaagaagaaaaacaaagtgtattcgttagtattttaacgacactgattcctgtattaatcattgcattattatttattttcttccttagccaagcccaaggtggcggcggcggtggtcgtatgatgaactttggaaaatccaaagctaagatgtacgacagtaataaacgtcgagttcgtttctcagatgtagcaggagctgacgaagagaaacaagaattaatagaaattgtagatttcttaaaagataacaagaaatttaaacaaatgggttcaagaattccaaaaggtgtcttacttgttgggcctccaggtacaggtaaaacattattagcacgtgcggttgcaggtgaagctggtgcaccattcttctcaattagtggatctgacttcgttgagatgtttgttggtgttggtgcgagtcgtgttcgtgatttatttgaaaatgctaagaaaaatgccccatgtatcatttttattgatgaaattgatgctgttggacgtcaacgtggtgcaggtgtaggtggcggtcatgatgagcgtgaacaaacattaaaccaactattagttgagatggatggttttggagaaaatgaaggtattattatgattgcggctacaaaccgcccagatatcttagaccctgcattgttacgtcctggtcgttttgatagacaaattcaagttggacgaccagatgttaaaggtcgtgaagcaattcttcatgtgcatgcgaaaaataaacctcttgatgaaacagtagatttaaaagctatttctcaaagaacgccaggtttttctggtgcagacttagaaaacttgctaaatgaggcatctttaattgcagcacgtgagggtaaaaataaaattgatatgcgcgatattgaagaagcaactgaccgtgttattgcaggtccagctaaaaaatctcgtgtaatttctgaaaaagaacgtaatattgtagcgcatcacgaagcaggtcatactatcatcggtatggtgcttgatgaagctgaaattgtacacaaggtaacaattgtccctcgtggacaagcaggcggttatgcaatgatgttaccaaaacaagatcgcttcttaatgacagaaccagaattactcgacaaaatatgtggtttattaggtggacgagtatctgaggatattaactttggtgaagtatcaacaggtgcttcgaatgactttgaacgagcaacgcaaattgcaagatctatggttacagaatatggtatgagtaagaaattaggaccattacaattctcaagcaatagtggtggacaagtattccttggtaaagatatgcaaggtgagccgaattattctggtcaaattgcttatgaaattgacaaagaagttcaacgaattgttaaagagcaatatgaacgttgtaaacaaatcttgttagaacatgaagaacaacttaagttaattgctaaaacactactttcagaagaaacattagttgcagaacaaattcaatcattattctatgatggtgttttaccagaagtagattatgactctgcaaaagttgtgaaaaatgaaaatagtgattatagtgatggaaagtatggaaaatcatacaacgacattcgtaaagaacagttagaagatgacgataaagaagatgatgacaaccatgaaaaagatgaagtaaaccaagacaacacagacagagaagctgataatacttcacatacgaatgaaccaggtcatcaacaatctccgaacatcgataaaccatacaatcctaacgatccaaatcatagacaatag

SEQ ID NO: 172 - DNA, 729 bp, Staphylococcus epidermidis
tgggtaagtgaggagcaggttagacgtatccaatgtctaaacctcgaaattcgaaaggtggaaatacgaatggcttcattaaagtcaatcattcgtcaaggtaaacaaacacgttctgacctaaaacaattaagaaactcaggtaaagtacctgcagttgtatatggttacggtacaaaaaatacttcagttaaagttgatgaagttgaatttatcaaagtaatccgtgaagtaggacgtaatggtgttattgatttaggcgtaggttctaaaacaattaaagtaatggtttcagattatcaatttgatccattaaaaaaccaaatcactcatattgactttttagcaatcaacatgagtgaagaacgtactgttgaagtacaagttcaattagttggtgaagctgtaggtgctaaagaaggcggcgtagttgaacaaccattattcaacttagaagttacagctacacctgaaaatattcctgaaactatcgaagtagatatcagtgaattacaagttaatgacagcttagcagtttctgatattaaaatctctggtgatttcacaatcgaaaataatccagaagattctatcgtaacagtagttcctccaacagatgaaccttctgaagaagaagttgaagctatggaaggcgaatcagcaactgaagaaccagaagttgttggtgaagacaaagaagacgatgaagaagaaaataaagaagactaa

SEQ ID NO: 173 - DNA, 144 bp, Staphylococcus epidermidis
caatcaatagaatttttgatgtccaaaattgattttggcatattgccccacctcactacacattacattttaccatatttgagtcgttttcgtcaaataaaatttaaattttatcaatgtgaagggcctttgtcaacattttaa

SEQ ID NO: 174 - DNA, 855 bp, Staphylococcus epidermidis
tacaggagggataacatgacaactttatatttagtaggaacaccaattggaaatcttggtgatattacatttcgagctatagaaacattaaaaaaagttgatgtgattgcatgtgaagatacacgtgtaacacggaaattgtgtaatcattatgaaatacaaacacctctaaagtcgtatcatgaacataataaagaacaacaaactgactatttaatcaagcagttacaaactggcttaaatatagcgttagtatcagatgctgggttgccattaattagtgatccaggatatgaattggttgtcgaagcacgtaaaaataatataaatatagaaacagtaccaggtcctaatgctgggttgactgcacttatgtcaagtggattaccatctttcacatacacatttttaggttttttgccaagaaaagaaaaagaaaaaattgaagtgcttgaggatagaatgtttcaaaatagtactttaatactttatgaatcgccttatagggttactgatactttgaaagcaatagctaaaatagattcacaaagatggattactgttggtagagagctaacgaagaaatttgaacaagttcttacacttacagttgatgatatgttgaaattgattaatcatgacaaattacctcttaaaggtgagtttgtgatactgattgaaggtgcattacctaagagtggtgaatcatggtttgaaagctatacggttaaagaacatgttgattattatattgaaaccaaacatgttaaacctaaaaaagcaattaaatttgtcgctacagatcgacatatgaagacgggtgacatatataatatttatcataatattgattaa

SEQ ID NO: 175 - DNA, 960 bp, Staphylococcus epidermidis
attgtaaaactaaaaggagtgttttggatggcacaaaaacctgtagattatgttacacaaattattgggaatacacctgtagtcaaattaagaaacgttgttgatgatgatgcagctgatatttatgttaagttagaatatcaaaatccaggtggttcggtaaaagatcgtatcgctttagcgatgattgaaaaagctgagcgtgaagggaaaattaaacctggtgatacaatcgttgagcctacgagtggtaacactggtataggtctagcatttgtatgtgctgccaaggggtacaaagcagtttttacaatgcctgaaacaatgagccaagagcgccgtaacttattaaaagcttatggtgctgaactagtattaacaccaggatctgaagctatgaaaggtgcaataaaaaaagctaaagaattaaaagaagagcacggctattttgaaccacaacaattcgaaaatccagcaaatcctgaaattcatgaacttacaactggaccagaattagttgaacaatttgaaggtcgacaaattgatgcatttttagctggtgtaggaactggtggtacgttatctggtgttggtaaagtattgaagaaagaatatccaaatgtggaaatagtagctattgaacctgaagcttctccagtattaagcggtggtgaaccaggccctcataaattacaaggattgggagcaggtttcgtacctgatactttaaatacagaagtttatgacagcatcatcaaagtaggtaatgatactgctatggatatggcacgtcgtgttgctagagaagaaggtatattagcaggtatttcatctggtgctgcaatatatgctgctattcaaaaagcaaaagaattaggtaaaggtaaaacagttgtaacagtattaccaagtaatggggaacgttacttatcaacaccattatattcatttgataattaa

SEQ ID NO: 176 - DNA, 123 bp, Staphylococcus epidermidis
aactatttttgtataaaaaaaagagacctttcggtctcgattaggctcatcgcatcttatacgatatttgcctggcaacgtcctactctagcggaacgtcagtccgactaccatcggcgctaa

SEQ ID NO: 177 - DNA, 165 bp, Staphylococcus epidermidis
aaaacgttttgcgacgcaaaatcttacttactatctagttttgaatgtataatcattcatttgtctggtgacaatggcaaggaggtcacacctgttcccatgccgaacacagaagttaagctccttagcgccgatggtagtcggactgacgttccgctagagtag

SEQ ID NO: 178 - DNA, 351 bp, Staphylococcus epidermidis
cctttgaatcgaaacgaattattcgaaagacttatgaaattagaacatcacgttgaacaacttacaaccgacatgtcagaacttaaagatttaacagtcgaacttgttgaggagaatgttgctttgcaagttgaaaatgaaaatttaaaacgattgatgaacaaaactgaagaatcggttgaaactcacttagataaagataattataagcatgtaaaaacaccatctccaagtaaagataatttagcaatgttatatcgtgaaggttttcatatttgtaagggtgaattattcgggaaacatcgtcatggtgaagattgcttattatgccttaatgtgttgagtgattaa

SEQ ID NO: 179 - DNA, 189 bp, Staphylococcus epidermidis
caactaaagcgaatcacttttggatattacaaaaattggacttattcaaatggttattcgtttaatttaaatgaattgtgtattaataataaacgtaagttgcataatctcatgaaaatgggaataaataaagactacaataacaaagagtctgaacatatattcaatgtccagactcaccttaaataa

SEQ ID NO: 180 - DNA, 867 bp, Staphylococcus epidermidis
agtttacttagtaagattattaggatagaagggtttgaaaagatgagatataaaagaagcgaacgtattgtatttatgacacaatacttcatgaaccacccaaataagttgatacccctcacttattttgtaaagaaatttaaacaagcaaaatcgtcaattagtgaagacgttcaaatcattaaaaatacgtttcaaaatgaaaaattaggaactattattactacagcaggtgctagcggtggagtaacctataagcctatgatgagtaaatcagaggccacagaggttgttgatgaggtgatagagcaattacaagagaaagaccgtttgctacctggaggatatttatttttatccgatttagttggtaatccttctctattaaataaagtaggtaagttaattgctagtatatatatgaacgaagaacttgatgctgttgttaccatagcgactaaagggatatcacttgcgaatgcagtcgcaaacgtattaaatttacctgtagtggttataagaaaggacaataaagttacagaaggttctacggtttcaatcaattatgtttcaggatcatctagaaaaatagaaacaatggtgttatcgaaacgaactttagctgagaattctaatgtcctcgtagtagacgattttatgagggctggtggctcaattaatggagtaatgaatttaatgaatgagtttaaagcccatgtaaaaggggtatcagtacttgtagaatcaaaagaagtaaaacaaagattaattgaagattatacttccttagtcagattgtcagatgtcgacgagtacaaccaagaatttaaagtggaaccaggcaacagtttgtctaaattttcttaa

SEQ ID NO: 181 - DNA, 333 bp, Staphylococcus epidermidis
agatatactaggggggctcactacatgaaagtgacagatgtaagacttagaaaaatacaaacagacggcagaatgaaagcactcgtttccattacgctagatgaagcttttgtaattcatgatttacgtgtaattgaaggaaactcaggtcttttcgtcgcaatgccaagtaaacgtacaccagatggtgaattccgtgacatcgcgcatcctatcaattctgatatgagacaagaaatccaagatgcagtgatgaaagtatatgatgaaactgatgaagttattccagacaaaaatgctacttcagataacgaagaatcagacgaagcttaa

SEQ ID NO: 182 - DNA, 798 bp, Staphylococcus epidermidis
tataatctaaggataggagagataatgatgttaatcgatacgcatgtacatttaaatgatgaacaatatgatgaggatttaaatgaagtgatatctcgtgcgagagaagcaggcgtagatagaatgtgtgtagtaggttttgatacacctactattgaacgtactatggagctaatagataagtatgactttatctatggtattatcggttggcatcctgttgatgcaatagattgtactgatgaaagattggaatggatagaaagtctttctaaacatcctaaaattattggtattggtgagatggggttagattatcattgggataaatcaccttctgatgtacaaaaagaggtatttaaaaagcaaattacattagctaaacgtgttcaattacctattattattcataatcgtgaagcgactcaagattgcatagatattttgattgaagaacatgcagaagaagtgggcggaataatgcatagttttagtgcttcacctgaaattgctgatgtcgtgattaataaattgaacttctatgtttcgcttggaggacccgtcactttcaaaaatgcaaaacaaccaaaagaagttgctaaacacgtaccaatggatcgtttgttatgcgagacagatgccccgtatctatccccgcacccttatagaggtaaacgtaatgaaccagaacgtgttactttagtagcacaacaaattgcagatttgcgtggtatgacttatgaagaggtctgtcgccaaacaaccgaaaatgctgaacgtttattcaatttgaattaa

SEQ ID NO: 183 - DNA, 285 bp, Staphylococcus epidermidis
tgtgtagtgaggtggggcaatatgccaaaatcaattttggacatcaaaaattctattgattgtcatttaggaaatcgtattgtacttaaagccaatggtggacgtaaaaagacaattgaacgatcaggggttttaaaagaaacatatccatctgtttttattgtcgaattagatcaagataaacacaactttgaacgcgtatcttatacatacactgatgtgcttacagaaaatgtacaagtttcatttgaagaagataatcatcaagaagcagttgcacactaa

SEQ ID NO: 184 - DNA, 1608 bp, Staphylococcus epidermidis
catggaaagagcaagactatggaccgtcttctttgtggtgatgtgggatatggtaaaactgaagtggctgtccgcgcagcgtttaaagctgtcatggatggtaagcaagttgcgtttttagtaccaacaacgattcttgcacaacaacactacgaaacactacttgaacgtatgcaagattttccggtcgaaattcaattggtaagtcgattccgcacagctaaagaaataagggaaactaaagaagggctcaaatcaggatatgttgacattgtcgtaggtacacataaattattaggtaaagatattcaatataaagatttgggattgcttattgttgatgaagaacaacgttttggagtgcgacataaagaacgcattaaaactttgaaaaaaaacgttgatgtactgacgcttactgcaacaccaataccaagaacattgcatatgagtatgttaggtgtacgtgacttatcagtgattgaaacaccacctgaaaatcgttttcctgtacaaacttatgtcttagaacagaatacgaactttattaaagaggcattagagcgtgaattatctcgcgatggacaagtattttatttgtataacaaagtgcagtctatttatgaaaaaagagaacaacttcaaatgttaatgcctgacgctaacattgctgtagcacatggccaaatgactgaacgtgatttagaggaaacaatgttaagctttattaatcacgagtacgatattttagtaacgactacaattattgaaacaggtgtagatgtaccaaatgctaatactttaatcatagaagaggctgatcgttttggtttaagccagctataccaattaagaggacgtgtaggacgttcaagtagaattggttacgcttatttcttacatccagctaacaaagtgttaaatgagactgctgaagagcgattgcaagctattaaggagtttaccgaactaggttcaggttttaaaatcgctatgcgagatttaaatattcgtggtgcaggcaatttactcggtaagcaacaacatggctttattgattcggttggtttcgatttatactctcaaatgttagaagaagcagtaaacgaaaaacgtggcattaaagaaagatcgccggatgcaccagatattgaagttgaattgcacttagatgcttatttaccagctgaatatatacaaagtgaacaggctaaaattgagatttataaaaaacttcgaaaagtagaaacagaagaacaacttttcgatgtcaaagatgaattaatagatcgttttaatgattatccaattgaagtcgaacgattattagacattgttgaaatcaaagtccacgctctacatgcgggtgtcgaattgataaaagacaaaggcaaatctatacaaatcattttatcacctaaagcgactgaagatattaatggagaagaattgtttaaacagacgcaacctcttggtagagcaatgaaagttggcgtgcaaaataatgcaatgaatgtaacgctaacaaaatcaaaacaatggttagatagtttgaaattcttagttagatgtattgaagaaagtatggcgattaaagatgaagactaa

SEQ ID NO: 185 - DNA, 141 bp, Staphylococcus epidermidis
aataagcctgggacattgatgatatattgtctcaggcattttaatgtattgttagtcaatggcaaaattagtaatgattgtgtaatggattacttgaaatttataccatattgttcgggagggactgcgacttcttattga

SEQ ID NO: 186 - DNA, 972 bp, Staphylococcus epidermidis
gtagtctttttacataatgaatatcataaagggagtaagtcgcttatggatgaacaacaacagttagctaacgcatatcattctaacaaattgtcacatgcatatttgtttgagggtgatgatgcacaaacgatgaaacgtgtcgcaatccattttactaaattaattctttgtaataatagtaatcaatgcgaactgaaagttgatacttttaatcatcctgacttttcatatgtgtcttctgatgaaaatacaattaaaaaagaacaaattgaacaacttgttcatcatatgaaccaactacctattgagggtcaatataaagtatatattattgaggattttgaaaaattaactgttcaaggggaaaatagtatactaaaatttttagaagagccccctgataatacaattgcgatacttttatcaacgaaaccggaacaaatattagacactatacattcaagatgtcagcatgtatattttaagcctattgataagcggcagtttatagagcgtttagtagagatgtcaatagcaagaccggtagcagaaatgctaagtacctatacaactcaaatagaagcagcatcgtcgttaaatgaggaatttgatttagttactttaagaaaatcaatcatcagatggtgtcaattaatattatctaataaagctatggctcttataggtgtcattgagttattaaaacaagctaagaatcgtaaattacaattacttactttatcagccgtcaatggctttttcgaagatataatgcatgcaaagatagaaatggataattattatacatttagtgatttaactgaagaaattgaaaattatgcaaatcaattaacttttaatcaattaatcctcatgtatgatcagattactgaagcgcataaaaagttaaatcaaaatgttaatccaacacttgtttttgaacaaatagtaataaaaggtgtgatttaa

SEQ ID NO: 187 - DNA, 261 bp, Staphylococcus epidermidis
aaggtgtttattatggataaacattttgtttatattgttaaatgtaatgacggaagtttatatacaggctatgctaaagatgtaaatgcacgcgtaataaagcataataacggtaagggtgctaaatatacaaaaataagacggccggtagagttagtttatcaagaaacatatacaacgaaatcggaagcattgaaacgtgaatatgaaattaaaacatatactagacaacaaaagttaaaaatgatacaggagggataa

SEQ ID NO: 188 - DNA, 186 bp, Staphylococcus epidermidis
ttggttattatacatctcttattggctaatatgaaatctattgctcatacatgtttattgagtattataaccatgagagatgataacaatatttttaccaaaagtttaaaaatgtattggtataaactatacataaaaaagtcccttttcactcaattcatacgtgagcaaaaagagacttactaa

SEQ ID NO: 189 - DNA, 846 bp, Staphylococcus epidermidis
gagtatattattgaaaaaggtgaaattatgattaaaacaaaaataatggggatattaaatgtgacacctgactcattttctgacggaggacagtaccactcagttgatcaagctgtgaagcgtgctaaagagatgatagatgaaggtgtagacatcatagacgttggaggtgtctcaacacgaccaggtcataaagaagtatcgcataaagaagtatcgcttaaagaagaaatgaatcgtgtattgcctgtggttgagtctatcgttaaatatgatgtgcaaatttcggttgatacatttcgaagtgaagttgcggaagcttgtcttaaacttggtgtttcaatgattaatgatcagtgggcaggcctatttgattcgaatatgtttaatgtggtatctcaatacggtgctgaaattgtacttatgcataatggtgacggtcatagagataaacctgttgttgaagagatgcttgtatcattacttgcgcaagcgaataaggctgaactagccggtataccacataataaaatctggttagatcctggaataggttttgctaaaacacgagaagaagaaaatgaagtaatggcaagattagatgaattagtagcgaccgaatatccagttttacttggaacaagtcgaaaaagatacattaaagaaatgatgaatcaagattcttctccttcagatagagatgaggcaactgcagctacaacggcttatggtataatgaaaggcgttcgtggggttcgagttcataatgtattattaaatacgcgactagcccaaagtatggattttctaaaggagaatgaatatgaacgacatcatctttcttaa

SEQ ID NO: 190 - DNA, 144 bp, Staphylococcus epidermidis
acgatcgctataatcattttcatttttatacacctctttttatcattatatcataattattttaaatatttgatgatagattggtatgtttcttcaacaactttatccaaactatggttagcattgactttaataaaccgatga

SEQ ID NO: 191 - DNA, 606 bp, Staphylococcus epidermidis
agatacataatattaatagtggaggtaacaataatgaaatgcattgtcggtcttggcaacattggtaaacgttttgaattaacaagacataatattggtttcgaagttgtcgatgatattctagaacgccaccaatttactttagacaaacaaaaatttaaaggtgcatatactattgaacgtttaaacggcgaaaaagtattatttattgagccaatgaccatgatgaacttatctggtcaagctgtagcccctttaatggattattataatgtcgatgttgaagatttgatcgttttatatgatgatttagatttagaacaaggacaagtgcgtctgcgccaaaaggggagtgcaggcggtcataatggtatgaaatcgataattaaaatgcttggtacagatcaatttaaacgtattcgaattggtgttggccgtccaacaaatgggatgtctgttccggactatgttttacaaaaattttcaaaagaagaaatgatcattatggaaaaggtaattgaacattctgcaagagctgtagaatcttttattgaaagttctcgttttgatcatgttatgaatgaatttaatggtgaagtcaagtga

SEQ ID NO: 192 - DNA, 405 bp, Staphylococcus epidermidis
aaaatgtcaatcgaagtaggaaacaagcttaaaggtaaaattacaggtatcaaaaagtttggtgcattcgtagaattacctgaaggaaaaagtggtttagttcatatcagtgaagttgccgacaattatgttgaaaatgttgaagaccacttatcagtaggtgacgaagtagaagttaaagttttatcaatcgcggatgatggtaaaattagtttatcaataaaaaaagctaaagaccgccctcgtaagcctcgtcacagtaaagctaatcacggtaaaccagttcaaaaaactgaagactttgagaaaaaattaagtaacttcttaaaagatagtgaagataaattaacgtcaattaaacgtcaaaccgaatcacgcagaggcggtaaaagttctagacgttaa

SEQ ID NO: 193 - DNA, 549 bp, Staphylococcus epidermidis
tttatgaaaataaacgaatttattgttgttgaaggtaaagatgatactgaacgagtaaaaagtgctgtagattgtgatactattgaaacaaacggtagtgcaattgatacatatactttagaagtgatacaacacgcgcagcaaactagaggtgtgattgtactgacagatccagatttcccaggtgataaaattagaaatactatacgggaacatgtttctggtgttaaacacgcatatgtagatagagaaaaggccaaaagtaaaagaggtaaaataggaatagaacatgcaaacattaaagatattcaagaagcattaatgcatgtaagttcaccacttgaagaagctaaagaaactattgataaaagtgtactcattgatttgggattaattatcggtaaagatgcaagataccgtagaaatatcttaggtcgaaaattacacatcggtcactctaatggaaagcaattattaaagaaacttaatgcttttggctatactgaagacgatgtcagaaaagcgctatttgaagaagaggagaattaa

SEQ ID NO: 194 - DNA, 177 bp, Staphylococcus epidermidis
ctcaactggatagagcgtttgactacggatcaagaggttatgggttcgactcctatcgggcgcgccattttatgtatcgatttaatttacatacgggaagtagctcagcttggtagagcacttggtttgggaccaaggggtcgcaggttcgaatcctgtcttcccgacttcttttga

SEQ ID NO: 195 - DNA, 1281 bp, Staphylococcus epidermidis
tgtattaggatacaaagaaataaagcacttaccttttggagacaaattatatcaaatgaagagaggaagacggtcatgacacatacaattacaatagttggtttaggtaattatggcattgatgagttacctttaggtatctatcgttttttagaaaaagagtctaaagtatatgctagaaccttaaatcatcctgtcatcaatacgctaaagaaagaaattgaattcgagagtttcgatagtatttatgaagcacatgaccgttttgaagatgtttatgaagcgattgtcacatcactaatagaattggcacaatctgaagatattgtttatgcagttcctggtcatcctagagttgctgaaactacgactgtaaaattattagagtatagtcattttaataaggatatctctgtgaaggtacttggaggaaaaagttttattgatgacatttttgaagcggttgatgtagaccccaatgatggttttacactgcttgatggtacgtcattaaaagaatcggccttaaatgttcgtacaaatacagtaattactcaagtttatagcgtaatgatagctgccgatttaaaacttactttaatggaaagatatcctgatgattttaatgtgaaaataattactggttctcatagtgatggagctcacgtaattgaatgcccactttatgaaattgatcgctacgacgattattttaataatcttacaagtttatttattccaaaaatcaatgaggatacattactttatcaagattttgattacgcagttcaaactattgatttactcgttgataatgaaaaagggtgtccgtgggataaagtacaaactcacgactcattaaaacggtatcttttagaagaaacgtttgaattatttgaagccattgataatgaagatgattggcatatgatagaggaattaggagatatacttttacaagtattattacattctagtataggtaaaaaagaaggatatattgatatcaaagaaattatagaaagtctcaacaccaagatgattcatagacatccacatatctttggtaatgcgcatgtaacttcgcaagaggatttaaaagacatttggtcacgtgctaaagaaaaagaaggtaaagtgcctcgtgttaaatttgagaaagtatttgcagaccacttcttgaaattgtatgataaaacaaaaaataggcaatttgacgaagatatctcaaacaatttttacaacaaggagagaaaattcatgagattagataaatattaa

SEQ ID NO: 196 - DNA, 543 bp, Staphylococcus epidermidis
gaaagagggatgactttgattattagggcattggagaagacagatttatcatttatacatcatttgaataatgagtattccattatgtcgtattggtttgaagagccttatcaatcattaagcgaattagaaaatttatatacaaagcatattttagatgaaacagagcgacgtttcattgttgaagagggatcaacatctgtaggcgtggtagagttattagaaattaactttatacatagaacttgtgaagtgttaattattatcgatccgcagtatgcaaataatgggtacgcgaaaaaagcctttaaaatggctattgactatgcttttttagtattaaatatgaataaggtatacttatatgtggatattaagaatgagaaagcagtacatatctatcaaagtaataatttcgaaatagaaggaacgttaaaggaacacttctatacaaggggagaatatagagattgctatgtaatgggcttgttaaaaaggaattgggttaataagaatgatgatgatttgtctcatataagatga

SEQ ID NO: 197 - DNA, 183 bp, Staphylococcus epidermidis
tatttcaactttagtattgcatctacaattttgtcgattttaaaatgcattattctttgtttactatctgttaacattaattatcttaatagttttaatcaattcataacatttttgaattgttactttgagtctacactaaatctacgcacagttcattatactaacatacttattaattaa

SEQ ID NO: 198 - DNA, 900 bp, Staphylococcus epidermidis
aggctttatgttaaaatcattttaataacaattcaaagcgagggcggaaaaatgatatatgaaactgcgccagctaagataaattttacgctcgacaccctttttaaaagagatgatggttatcatgaaattgaaatggtgatgacaacagttgatttaaatgatcgattatcttttgaaaagcgaactgataataaaattgttgtcgatattgagcataattatgttcctaacgataataaaaaccttgcgtataaagcagctgatttaatgtttgagagatttaatattaatgaaggtgtgacaatttcaatcgataaagatataccagtttcagctggactcgcaggtggttctgcggatgctgccgctacaatgagaggattgaatcgattgtttggtttaggtcaatctttagacgctttagctgcattaggcatacaaataggcacagacatacctttttgtatttataaccaaactgctgtgtgtacggggcgtggcgagcaagtaactttcctaaaaagaccaccttctgcatgggttgttttagctaagcctaacatcggaatttcatcacctgatgtatttaaagcactagatttaactgaagaacatatagttcataatgaaaagtgtaagcaagctttagagaacaatgattatcatttattatgcaatagtctttctaaccggttagagcctgtttctatggctatgcatcctgacattaaaaagattaaagataacatgctacaatgtggtgctgatggtgctttgatgagtggaagcggtcctactgtttacgggctagctcaaaaagaaagacaagctaaaaatatttataatgcagtgaatggttgttgtaatgaagtttacttagtaagattattaggatag

SEQ ID NO: 199 - DNA, 402 bp, Staphylococcus epidermidis
aaaaggagtgtcaaattcatcatgaaaataatcaactcagataaggtacccgaagcactaggcccatattcgcatgcaactgttataaacggttttgtctttacatcaggtcaaattccactcacacttgatggaacaattgttagcgatgatgttcaagaacaaactaagcaagttttagaaaatttaactgtggtattaaaagaagcaggttctgatttgaattctgttgttaaagcgacaatctatatttctgatatgaatgattttcaacaaattaatcaaatctatggaaactatttcgtcgaacaccaaccagctcgtagttgtgttgaagtgtcacggttgcctaaagacgtaaaggtagaaattgaattgataggtaaagtgaaggaattataa

SEQ ID NO: 200 - DNA, 1983 bp, Staphylococcus epidermidis
ggaggaccagtgatggctaaagatacattttatataacaaccccaatatactatccgagcgggaacctacacatcggtcatgcatactctacagtcgcaggcgacgtgatagctcgctataaaagaatgcaaggctatgatgttcgttatttaactggcactgatgagcacggtcaaaaaatccaagaaaaagctcaaaaagctggcaaaacagaactagaatacttagatgaaatgatttcaggtattaaaaacttatggagtaaacttgagatttctaatgatgattttattcgaactacagaagagcgtcataagcaagtcgttgagaaagtgtttgagcgattattaaaacaaggtgacatttatttaggtgaatacgaaggttggtattctgttcctgatgaaacatattatacagagtcacaacttgttgaccctgtttatgaaaacggcaaaattgtaggtggtaaaagtcctgattctggtcacgaagtcgaacttgtaaaagaagaaagctatttcttcaacattaataaatatacagaccgcttattagaattttacgatgaaaatccagactttatacaaccaccatctagaaaaaatgaaatgattaataactttatcaaaccaggtttagaagatttagcagtatcacgtacatcattcgattggggtgtacgtgtaccatctaatcctaaacatgttgtatacgtgtggattgatgcacttgttaattatatttcttcattaggttatctatctgatgatgaaacattatttaataaatattggccagcagacatacacttgatggctaaagaaattgtacgtttccactctattatatggccaatattgttaatggcgttggatttaccacttcctaaaaaagtttttgcacacggttggattttaatgaaagatggtaaaatgagtaaatctaaaggtaatgtcgtagatcctaatgtattaattgatcgttatggtcttgatgcgacacgttattacttaatgcgtgaattaccgtttggttctgatggcgtatttacaccggaagcctttgttgaaagaacaaattacgatcttgcgaatgatttaggtaatctagtgaatcgtactatctctatgataaacaaatatttccacggcgaattacctgcataccaaggtccaaaacatgaattggatgaaaaaatggaagcgatggcgcttgaaactgttaaatcattcaatgataatatggaaagtttacaattttctgttgctttatcaacagtatggaaatttattagtcgtacaaacaaatatattgatgaaactcaaccttgggttcttgcaaaagatgaaaatcaacgtgagatgcttggtaatgtaatggcacatcttgtcgagaacattcgtttcgctacaatcttattacaaccattcttgacgcatgcacctagagagatatttaagcaacttaatattaacaatccggatttacatcaattagatagtctgcaacaatatggtatgttgtcagaggcaattactgtaactgaaaagccaacaccaattttcccaagattagacactgaagcagaaattgcttatatcaaagaatcaatgcaaccacctaaatcaataaaacagtctgatgaacccggtaaagagcaaattgatatcaaagattttgataaagttgaaatcaaagcagcaaccattattgatgcggaaaatgtaaaaaaatcggagaaactattaaaaataaaagttgaattagataatgaacaacgtcaaatagtatctggtatagctaagttttatcgtccggaagacattattggtaaaaaagttgcagttgttactaatttaaaaccagctaaattgatgggacaaaaatccgaaggtatgattttgtcagctgaaaaagatggcgtacttaccttgataagcttgcctagcgcaattccaaatggtgcagtaattaaatag

SEQ ID NO: 201 - DNA, 150 bp, Staphylococcus epidermidis
atattaaaagtgtcacgattagttaaacgacgtacattagctaaagaaattagcgaacaaggtcgagtgacttcaatggaaatgtggcaaaagcaggtacagatatcaaagaaaacgatgaactcattattcgttttggacaaaaattag

SEQ ID NO: 202 - DNA, 159 bp, Staphylococcus epidermidis
ctcagcttggtagagcacttggtttgggaccaaggggtcgcaggttcgaatcctgtcttcccgacttcttttgatattgggggcttagctcagctgggagagcgcctgctttgcacgcaggaggtcagcggttcgatcccgctagtctccaccatttaa

SEQ ID NO: 203 - DNA, 750 bp, Staphylococcus epidermidis
catcctttttttaggagtaaagatatgttagaagataatgaacgcgttgaccatttaataaaagaaggatatgagattatacaaaatgatgaagtattctctttttctactgatgccctattgttagggtatttaaccgaagttcgcaaaaatgataaagttatggatttatgctccggcaatggtgttattccattattattagctgctaaatcaactcaacctattgaaggaatagaaatacaagagcaactagtgagtatggcacgtcgcagttttaaattgaatgatttgaacgatagactaactatgcaccatatggatttaaaagatgtatatcaaacatttcaacctgctcaatatacattagtgacttgtaatcctccttattttaaaatgaatcaaaatcatcaacatcaaaaagaagcacataaaatagcacgtcacgaaataatgtgtaatcttaaagattgtattgaagctgcaagacatttacttaaagagggtggtcgttttattatggttcatcgagcggaaaggctaatggatgtcttaaccgaattaagacatggtaaaattgagcctaaagcactgacgttagtgtatagtaaacatgataagcctgcacaaacaattgttgtggaaggaagaaaaggtggtaaccaaggtttagatatacgtaatccattatacatatataatgaggatggatcatatagcgatgagatgaaaggtgtttattatggataa

SEQ ID NO: 204 - DNA, 1575 bp, Staphylococcus epidermidis
ttagatgtattgaagaaagtatggcgattaaagatgaagactaagagtgagacggcgtttaacggcgtcgttatacttaccttagcattaattattgtgaagatactaagtgccatttatcgcattccgtatcaaaatgttttaggtgatgacggtttatatgcttatcaacaaatatatcctgtcgtagcactaggggttattttatctatgaatgccattccaagtgctgtgactcaagtgataggtgttaatcgatccgatgaagtctatacaagggttatgtttcgattacaatgcataggttttatcgtctttattttgctttttatgtttgcgaatatgattacccgatggatgggcgattctaatttagcacccatgttaaagatggccagttttagttttattttaataggtgtcttaggagtgttaagaggattttatcaatcaaagcaagtaatgaccataccagcaatttcccaggttatagaacaggtaattagagttagtttaatcattgttgcaattattatgttttcaatgaaacattggtctatttatcaagcaggagcattagctatattggcatcttcgattggttttttaggttcaatgttatatttattacttaaaaaaccacttaaacttaagttatgctatcgctttaataatacttccattcaatggaagcagttgtttatttccatatccatatttgcattgagtcaacttatcgttattttatggcaagttgtggatagttttacaataatacgtttattacaacatagcggtattgcttttaaagaagcaattattcaaaaaggcatttatgatcgtggtgcttcatttatacaaatgggtttgattgtaactacgacttttagtttcgttcttatcccattacttactcaagcaattcgtgaacataatcaaattcatatgaatcgttatgcaaatgcatcaattaaaatcacggtagtaataagtacagcagctagtataggattaattaatctgcttccacttatgaatgttgtattctttaaaagtaatcatttaactctaactttgagtatttatatgtttacagtgatatgtgtttcgttaataatgatgaatatctcattattacaagttcaaaccagtattcgtcccattattatgggtgtgataataggaatactgtccaaaattattttaaatgttatattaatacctttttggggtatcgtgggtgcaagtgtgagtacagtcttatcactactactttttgtcataatattgcaagttgcagtcttaaagtactaccgttttaatcgtatatctttatttatcgttaaacttattttaggtatgataattatgagtatagttgttcaaactgtcatgcttgccttaccttcaaaaagtaggatgttaggattactagaacttatagttagctcaattataggcatagtgattataatgttgtatattgttatatttaatgtattaggatacaaagaaataaagcacttaccttttggagacaaattatatcaaatgaagagaggaagacggtcatga

SEQ ID NO: 205 - DNA, 1371 bp, Staphylococcus epidermidis
gatgaaaaattaaatttagagagagttattaatatgaaaagaccaataattcaaaaattaaatcacttgatagagaaaaaagctatctctatgcatgttcctggacataaaaacatgacaatcggctacttaaataggcttgatttagcaatggatatgacagaaattactggattagatgatatgcattatcctgaaggaattattttagaaagcatggagaattttaggaaacataaaaactatgatgctttcttattagttaacggaacgacttcaggtatattatcggttatccaagcgttttcgacaagaaaaggtaaatatttaattagtagaaatgttcataaatcagtatttcacggtttagacataacacaacaacaagcgacaataactaagacagatgtcagtaagaaaacgaatcaatatgtaaatccaaagataaatcaagataaaaatcaatattataaacttgccatctgtacataccctaattattacggtgaaacttttgatatttctcaatatatcaaacaattacatcacagagggataccgatattagtagatgaagcgcatggtgcacattttggtttagatggatttccagaatcctcaatgaattttaatgctgattacgttgtgcagtcatatcacaaaacactccctgcactaacaatgggatcagttatatatatacataaagatgcaccattaagacaacaagtcatagattatttaacttatttccaaacgtcaagtccttcgtacctcattatgtctagtttagaattagcgaataaattttataaagaatatgattctacattatttgaccaacgaagaaagatgttaattgatttattagtaaatatgggatttacagttatagaaccagaggatcctttaaaattggttgtgagttttgagggtgttgaaggttatgatgtgcaaaaatggtttgaggataaagaaatttatgtagaattagctgatatgtatcaagtgttactcgttctccccctatggcatgaaggagataaatttccttttaagttgttgattgaaaaaattagagaaattaacgtgccaaaaaaatgtacgcgcgacataaaacctcttaattttatgacgggttttagcgaatacaaaactgttcattttcaaaatacgaaagaagtgtctattaaaagggcagaaggtaaagttttagcacaacatatcgttccataccctccaggtataccggtgatgtttaaaggagaagtcgtgacgtctcatatgatagacttattaaataaatatgataaacaaaatattaaagttgaaggtttaaatcataaaaaaatattagttaaggatgaataa

SEQ ID NO: 206 - DNA, 126 bp, Staphylococcus epidermidis
tctgctacttcttgtgccaaaggttcatttcctttaagcgaaaagatcttcattgatgaattcttatattcattatttaacatttatagtcctccaattatttacttagacatttatattatatag

SEQ ID NO: 207 - DNA, 180 bp, Staphylococcus epidermidis
tcatgttgctctattccccctgtgctcctaatttttctcccccgccgattgctttcggtctctcccccccattttttgtacttcgcaattcactccccctctgacacccttttcctcttacttaattatattgtaaccggttccaatcatttacacaatactcctattcatttttcttaa

SEQ ID NO: 208 - DNA, 153 bp, Staphylococcus epidermidis
agtttggcttttttccacttaataattaagaagatggtccgtcatatagctatcaatcagttcaagaattttattaaccttgataagcttttaagtccaaagaaaaatcaattgttaattttggagagatatccaaattatgatttcccctaa

SEQ ID NO: 209 - DNA, 369 bp, Staphylococcus epidermidis
ataaaggagttttcaataatgaaaaataaaaaaggattaggcataggtcttatcacaattatgattatcgtttgtattgtactagtaatcatgatgttcgtgggtggtaagaaagaatcatactacggtattatgaaagatagcacgactattgataaaatgataaatactaaaaatgaaaaaattgaaaaaaacgtagaattacctaaagatgctaatgtatcagttaaaaaagaagattttgtgatgctctttaaagatgaaaaaactggaaaaattactaaagttaagaaagttaatcacgatgacgtacctcatggtttaatgtcaaaaatccatgatatgggtaatatgaaacacggaatgtag

SEQ ID NO: 210 - DNA, 2112 bp, Staphylococcus epidermidis
tatacaatgacatgttttttaaatatatataaagaatatcattctccccctgaacgcaatattaatagaattattctgatgttttcacttacaaatgacttaaaaatcactattaatggtgaaacaaaagatttaggtaatcatatagctatcattaatcaatctgacatctattttattaatagtgcttcaaatctcgtattactctctattccagttatttatttttatagtaaagataataaattttttaaatgttattttgacagacatttattacaatcaagcagttttgttaaaacaattattttacaagctattcaacatttaataaaaggagaaaatcaagatgagcaatccatctctaaaataatacaaacgctactaaaagaagcagtcattcgatataagaaaaaatatattcctcaaattgcagttaatcattcagtgtttactgaaggattaacatttattcattcaaaagtatcacagtcactttcactacgagaagtagctcaacattgtaatatatctgaatcttattgttctaacctatttgcaagatatcttaatatgaattttaaagattattttacaagcttaaaagtgattgactctataaaaaggctactttcatctgaggactcaattaacgctatttcagaacaatctggatttagtagtcataccaattttacaaatcaatttaaaaattatttaggttgtagcccaaaacaataccgaacgattatctctaagttagactccttaccttcgataagttttagtgatactgacttttcacaatatattgatttaattaatcaatttgagtttagtgatcatttggctactgaaacgactgaaagagatatcaatgaattttatcctcaagatcagactaaaaactctaaagcgtttatacgttttcaaaatttcaacgaattatttcaatttgtttttaatgaatattacaacattgattttacctccctgccacaagctgtaatttttatcaatgatatcactgatatttcgacgcgagaggtgaactttaatttattaaatcgatgctttgaaaaattattcgaaaaaaatataggtttagccatgagattaacatctacaaatgaatttgaatctatcaaagaaataattttattatttcttaatagccaccaagattataaaatgaacaaaaaaatggttaaatttatgttagtctttgaaactaagaatatgtcagtgaacgatatacatttatgccatttaaaaattaaaaataaaaataaagctatccgttatagtataactgttgaaggattactacaccaaaattcttctattgatcgaacttatgatatgatgaagcgattaaatttcgattactattttatagacattgaaaatctagaaaccaaaaactcattaattaccaaacgtaaatcgtacttacattcgtccacacactttgaaaattataaacaatttatattagattccggtataccttcaactaaatttgtttacaataatttatctttaaagtgttttaaatatacaaacaatggtacttatccacttcaattatctgaccttgtttgtcatttagtcgcattaatgcgttacgggggtggtgtaagttatcaactgatagaagatgagagtccttttattgccttatttaatcgttatggtagtcccctacctctcatgcacctctataaattaatcgaaccatttttaaatgaacctttagagatagctaacaattttttaatgagtcgcaaagatggtaactatcactttttattatttaataaaataaatgatcgttatctatctgatagtcaacagcgctacgtttttaaaaatacattatcaaccaactcattaattattattaaaacgttaaatcatgagcatggcgcaattcaaaaccttctaccacaaactaaacaacaattttatattgaacgtagtattcttgatgaacttgataaatcaaatcaaccaaaaacagaattagctatacaacatgaccatcatcttcctttccaagtcaccttaaaacacgatgaagtcaaatatatttgttttaaaccttcttaa

SEQ ID NO: 211 - DNA, 150 bp, Staphylococcus epidermidis
gtgctgaataatgacacatcaaacatgttgagtcttgttatggtcgatatctcttttattgttctttcaattaacgttgaaatgagcagcgtacatttagttacagtgacttcgttttataattcattcgaacttctcctaaacctctaa

SEQ ID NO: 212 - DNA, 141 bp, Staphylococcus epidermidis
aataatatcaaaatttaccgtattataatcattttagattatgatgcggttatttattgtctatttattgtcattcatatcatcaagctctattttataaactttattttctttatactacaatatataattgcaaaatga

SEQ ID NO: 213 - DNA, 468 bp, Staphylococcus epidermidis
attatgtgtgataaggatatatacaataataaggagatgataattttgaataaacaacaagtgacaaaagcaatagaaaaagtattaaattcttcaaaaattggtgtcctatcaacagcacatcataataaacctaatagcagatatatggtcttttacaacgatgacttaaacttatatacaaaaacgaatatcaattcactaaaagtcgaagaaatagaaaataatcctgatgctcatattttattaggctataacgaaacaacaaacaatagctttgttgaaatagatgccactatagaagttgtcaaaaatcaaaaagttattgattggttatgggaaactcaagacaaaacatttttcaattcaaaagaagatcctgaattatgtgtactcaaagttatacctcgttcaattaaattaatgaatgatgatgaactagatacgccagctacaattgagttataa

SEQ ID NO: 214 - DNA, 132 bp, Staphylococcus epidermidis
gacctatgcctaatccttttttatttttcattattgaaaactcctttatctatattaattcatttatacataattttaagtcattttgcaattatatattgtagtataaagaaaataaagtttataaaatag

SEQ ID NO: 215 - DNA, 1296 bp, Staphylococcus epidermidis
aggggagtttgcataatggctctattcaagaaaaaaataagtctaccaacgcaagtaattattgctttggtactcggtgtcatcgctggtctattactatatggacaagatgatgttgcaaattatattaagccatttggtgatgtgttcttaaatttaattaagatgatcatcattccgattgtattttgttcattagccttatctatttcaaatttaggggattctaaaaaggtaggaagctatggatggaaagcaatcctttattttgagattattacaactatcgctataggtttaggtcttatcattggtaatctattcaaaccaggttcaggtctagatccagataaattacctaaaggcgatattactaaatatcaatcatctgcacattcagcagaacaagcgactacttatggtaatcattttatagatacattagttcatattgtgccaacgaatttatttgaatctatggcaaaaggtgagttattaccgattatctttttcgcagtattttttggattaggattagctgcgataggagaaaaagcagaacccgttaaaggattcttaaatggtactttagaagctgtattttggatgatcaataaaattttaaaattagctccaattggagtatttgcatttatctgtacgacagtaatgacttttggtgcttctgcattaattccattatttaaattattagttgttgtagtatttgctatggttttctttgttattgtagtattaggaattgttgcaagaatggttggaataagtattttttcaatcatgaagatacttaaaagtgaattgttacttgccttttctacttcaagttcagaagcagtattgccgattatgatgaagaaaatggaacgctttggttcgccaaaagatgttacttcatttgttattcctatcggttattcatttaatttagatggctcagctttatatcaatctatagctgctttatttgttgctcaaatgtatgatatacatttatcattaactgaacaacttgtattaatggccacacttatgattgcttcaaaaggtatggctggggtgccaggcgtatctattgtagttttattaacaacattaacttctatgaacataacagcacaaggtcttgctttaattattggtattgatcgtttattagatatggttcgtacatgtgttaatgttattggtaatgcactatcaacagttgttattgctaagtgggaaaacgtctatgataaagagaaaggtcaaaactacttaaattcaatttaa

SEQ ID NO: 216 - DNA, 147 bp, Staphylococcus epidermidis
tggctcttatgcatttttgaaaaaatgcaaacagaagcaaaacaatctatgattgttagtggctcttatgcatttttgaaaaatgtaaacagaagcaaaactatctatgatagtaagtggctcttatgcatttttgaaaaaatgtaa

SEQ ID NO: 217 - DNA, 378 bp, Staphylococcus epidermidis
ttgaaagaacgcggaaaaatagaaaaattgtggcgtgaagaaaaatatcgtgtgctatttcatgatcagaatgcatatcattcgataagaacgttattaaaatcgcctaccacattgggtgaagtgaaagaacatataacgcacgctttaaccattacacctacaaaaggctcagttatcaatgcttttgaacatatgtgggggtatttcaaaaaacaatgtacacaatatgaaaagcaacatagccgagaattaaaagcgttgtatattgaaaatcaaattgactattttgagctgttgtcttttttaaaaaatttagcagataaatatgctgtcgagtacttacaacaaagtaccatactcaatattacaaaatga

SEQ ID NO: 218 - DNA, 315 bp, Staphylococcus epidermidis
  modified_base (120)..(120): a, c, g, t, unknown or other
agcggcaggctaactcccgccttaagaggggcgcagggggctagacatgaatcgggcgcgtgggcgctcaattttacatcacagatgttggggcgaactgggtcccaacggctcaccgantgggaccgcacacccaacccggggctattggggcggaggggcggggacaggagaccgggggggtataaaactgtactgttaatcaaacgggatatcagggaacaggcgattgatgcggagggaccgccgggagatgaagatgggagtgaactgggattacactcgcaaccgggcgtgggtgcgaaacgagtgtga

SEQ ID NO: 219 - DNA, 129 bp, Staphylococcus epidermidis
gtggaaaaaagccaaacttcatatagcactaaaaaggggctatattataaagaagtcgttttcaaagatgaacctaacgtgacatatgtgattcaacctatcagtacttcaaaaaggaatattcattga

SEQ ID NO: 220 - DNA, 153 bp, Staphylococcus epidermidis
cagataaatatgctgtcgagtacttacaacaaagtaccatactcaatattacaaaatgaagtgacaaaatcatttaacaattatatttcgtcaggcaagcacgaatacgtaaaacagatctttatttatatgtcaattttggttttaaaataa

SEQ ID NO: 221 - DNA, 138 bp, Staphylococcus epidermidis
  modified_base (70)..(70): a, c, g, t, unknown or other
atcgggcgcgtgggcgctcaattttacatcacagatgttggggcgaactgggtcccaacggctcaccgantgggaccgcacacccaacccggggctattggggcggaggggcggggacaggagaccgggggggtataa

SEQ ID NO: 222 - DNA, 132 bp, Staphylococcus epidermidis
cacacgatatttttcttcacgccacaatttttctatttttccgcgttctttcaactaaatcccctccaaagtgatattgatttaactgcagatgttaaagctagtttaatattttttaagaaaaatgaatag

SEQ ID NO: 223 - DNA, 990 bp, Staphylococcus epidermidis
aaggttagttccatgcttaagttaaatccctataaaataggatttagaactgtcaaaactgctgtgggaatgactttaggagtaatcatatgtaaacttctaggcttagataattatgcatccagtgctattttagttgtattgtgcataaagcacactaagatgcattcagtacaagcaattttatctcgactagtttcatgtttactcatattatttttaggttcagcaatttttagtcttttaggacaacatgcatttgttttaggtttaattgttttgttgtttattcctttgacagttgttctaaatgtgcaagaaggtgttatcactagttgtgtcatattattacatgtctttaacgccaaagctattaatgggcaccttattttaaatgaaataatgctattaatagtgggcttaggtatagcatttctaatgaacttaatgatgcctagtttagataagaaattgaatcattttaagcaggatatagaaaatcaaataactgaaatatttaatatttttagtcaagcctgctcaatgcataatgatcatttaaatattaaatttgattcattacttttaaatattaaaaaagcaaaatcacttgcttttagagatgttaaaaatcactttgtacgaaacgaaaattcattttatcattattttgatatgagagaagaacaagttgaattattaaaacgtatgacatcgttattagaaagaataaatacagatgatcctatactcgaaaagatttcacaattaatgtatgaaattggaagtaacgtaaatagcaatgattatacggctctaagactacattcactttatgaaatacgtttatctctcgatgatttaccattaccgactactcataagactttaaattcccgagcacatattattcaaattctaaatgaactagaagaatacttaaatattaaatctcaatttggttctttaaaattgcatagtgaaatataa

SEQ ID NO: 224 - DNA, 1236 bp, Staphylococcus epidermidis
caattttactcgtttataagatgttataattatgtagtgtataaggaggcatacaagatgactgaagaattcaatgaatcaatgattaatgatattaaagaaggtgacaaagtcactggtgaagttcaacaagtagaggataaacaagttgttgtgcatattaatggtggcaaatttaatggaattattcctattagccagctttcaacacatcatatcgaaaaccctagtgaagttgtaaaagtcggtgatgaagtcgaagcatatgtcactaaaatcgagttcgacgaagaaaatgatactggggcatacattttatcaaaaagacaacttgaaactgaaaaatcttatgaatatttacaagaaaaactagataacgatgaagtgattgaagctgaagttactgaagtagttaaaggtggtttagtcgttgacgttggtcaaagagggtttgtacctgcttctctaatttcaactgatttcattgaagatttttctgtattcgatggtcaaacaatccgtattaaagtggaagaacttgatcctgaaaacaatagagtcattttaagccgtaaagctgtggaacagttagaaaacgacgctaaaaaagcttcaatattagattctttaaatgaaggcgatgttattgatggtaaagttgctcgattaactaactttggtgctttcattgatattggtggcgtagatggtttagttcacgtttctgaattatctcatgaacatgttcaaacaccagaagaagttgtgtcagtaggtgaagcagtcaaagttaaagttaaatctgtagaaaaagattctgaacgtatttctttatctattaaagacactttaccaacaccatttgaaaacattaaagggaaatttcacgaagatgatgttattgaaggtactgtagtacgtttggcgaactttggcgcattcgtagaaattgctccatccgtccaaggtttagtgcatatttctgaaatcgatcataaacatatcggttctcctaacgaagtattagaacctggacaacaagttaatgtaaaaatattaggtatcgatgaagataatgaaagaatttcattatcaatcaaagcaacgttacctaaagaaaatgtcattgaaagtgacgcatccacaactcaatcatatcttgaagatgataatgatgaagataaaccaacattaggcgatgtttttggtgataaatttaaagaccttaagttttaa

SEQ ID NO: 225 - DNA, 192 bp, Staphylococcus epidermidis
attgtacactctgtatatcaactcgatattttagataagttaccatttataaatcaaatgatttcagttaatatttctatacctttttctaattgttttttagtgatggtcaatggcggtaataacctaatcacatttttaccagctgttaaaatgattaaccccatacgtttagcttctcgcactacttga

SEQ ID NO: 226 - DNA, 162 bp, Staphylococcus epidermidis
attcagatatcatcgtggcttaatataagaaaagtaacagctcaacgagctgaaaatcatcaaaaaaattataaaaaagacaattcctatattatttcaatagaaattgtctttatttacttatcttggacctttttgttccagcctcttgtaaatttttaa

SEQ ID NO: 227 - DNA, 123 bp, Staphylococcus epidermidis
ggcaagtcatcatggctgccttatttttttgaatttattgctaattatcataaaataaattgtacaatattacttaaattcaaacaggggattatctttcattcaattataaaaacaagatag

SEQ ID NO: 228 - DNA, 186 bp, Staphylococcus epidermidis
tcaaatccatcgacatctatcattataaataaagattccagtcactacagtaagatgctgactagaatagctatatcatgtcatactaatgagaggacatcttcttcacaaagattctcttactatagaatcgacgagctaaacttgatagacggagatagcaattatacgggagcgagactatga

SEQ ID NO: 229 - DNA, 330 bp, Staphylococcus epidermidis
ggagtgacatcaatgaaaacattgaaattattgaaaaaaacacgagcatttaccttgatagaaatgcttttagtattactaataataagtttattgttaatacttataattccaaatattgcaaaacaaacatctcatattcagtcaactggatgtgatgctcaagttaaaatggtaaacagtcaaatagaagcctacgctttaaaacataatcgcaacccttctaatattgatgatttggtttcagatggttttataaaagaaggacaaaaaacatgtaaatccggtcagacaattagtattgcaaatggagaagcagttgccaattaa

SEQ ID NO: 230 - DNA, 894 bp, Staphylococcus epidermidis
aaagaaggattaaaaatgcctcaaagagtattgctcgttgatggaatggctttattatttagacatttttatgcaacaagcttacacaatcaatttatgtacaattctaaaggaattcctacaaatggtattcaaggttttgtaagacatatttttagcgctatcaaggaaatcgaacctactcacgtagcagtttgttgggatatggggcaagaaacattcagaaatgaaatgtatgatggctataaacaaaatcgcccagcacctcctgatgaacttattcctcaattcgattatgttaaagaaatatcccatcagtttggttttgtaaatgttggtaagcgtaattatgaagctgatgatattattggcagtttagcggaaacatattcacaagaacatgaagtttatatcattaccggagaccgagacttactccaatgcattaatcataatgtagaagtttggcttataaaaaaaggttttacaatctatcaacgttacacgcttgatcgtttcattgatgaatacgggcttaatcctcaacaattaatagatgttaaagcttttatgggtgatacagcagatggctattctggtgtaaaagggataggtgaaaaaacagcaattaaattaattcaaaatcatggaactgtcgaaaatgtagtgaacaatttatcatcattaactcccgctcaacagaaaaaaataacaaataatttaaatcatctgcatttatcaaaatcactcgcagaaatatataccaaagttccaattgaaacagacaaactttttaaagagatgacatatgctcatacactaaatgagattttatccatttgtaatgaacatgaactatacgtttcaagtaaatatattgcaactcacctctaa

SEQ ID NO: 231 - DNA, 132 bp, Staphylococcus epidermidis
atacatttgtcattatatcataggttaacgttattgagtgactcaaaggttaaccttgtgaaaaaaatatcaatcttaatggtaattacatctttttggtgtttatttaccgttttctgccaaatgtcttaa

SEQ ID NO: 232 - DNA, 1596 bp, Staphylococcus epidermidis
ttaattatgtcaaagatatattgcattaaagtaataaaaacgttactatatcaaagatacatagaagtgacaggttataaagatgaaagcgagaaggataaaatggataagcaagaacgatacaatagaagagaaaatattagaaatttctccattattgctcatatagaccatggtaaatcgacattagctgatcgaattttagagaatacaaaatcagttgaaactcgagaaatgcaagatcaattacttgactctatggatttggaaagagaacgaggcatcactattaaactaaatgctgttcgattaaaatacgaagctaaagatggagaaacttacacatttcatttgatagatacaccaggacatgtcgactttacatatgaggtttctcgctcattagctgcatgtgaaggtgcaattcttgtagttgatgctgcccaaggtatagaagcacaaaccttagcaaacgtttatttagcattagataacgatttggaacttttgccagttgttaataaaatagacttgcctgcagctgagcccgatagagttaagcaagaattagaagatgttataggtatagatcaagaagatgtagtacttgcaagtgctaagtcaaatataggtattgaagaaattttagagaaaatagttgatgttgtaccagcaccggacggtgatccagaagccccacttaaagcacttatctttgattcagaatatgatccatacagaggagtaatatcttcaattcgaattattgatggtgttgttaaagctggagataggattaaaatgatggctaccggtaaagaatttgaagttacagaagtcggaatcaatacacctaagcaactaccggtagaagaattaacagttggtgatgtgggttatattatcgcaagtatcaaaaatgttgatgattctagagtaggtgacacaattactttagctgaaagacctgctgacaaaccgttacaaggatataaaaagatgaatccaatggtattttgtggtctattccctattgacaataaagactataatgacctaagagaagctttagaaaaattacaacttaatgacgcatccttagagtttgaaccagagtcttcacaagcacttggttttggatacagaactggatttttaggaatgttacatatggagattattcaagaaagaattgaaagagaatttggtattgaactcattgcaacagcgccttctgttatctatcaatgtatcttaaaagatggttctgaagtttcagttgataatccagcacaaatgcccgaaagagataaaatagaacatatttatgaaccatttgtcaaagctacgatgatggtgccgaatgattatgtaggtgcagtgatggaattatgtcaacgtaaaagaggtcaatttataaacatggattatcttgatgatataagagttaatattgttcatgaaattccattatcagaagtaagtttttcgatttctttgatcaacttaaatctaacacaaaagggtatgcttcttttgattatgaatttattgagaataaagaaagtaatcttgttaaaatggacatattactga

SEQ ID NO: 233 - DNA, 747 bp, Staphylococcus epidermidis
agaatacggtcaggcagtattttagtcatgaatcaatatgaagatatgagtttagtatatgacaaacttactcaagatcaaccgtatcattcgtggtttaatattgttgagcatttcttaccttctgatagtcatgatttgttagatattggttgcggtactggcaacttaacacaattactaacgtcactaggtgaagtcactggtatggatattagtgtagatatgttatcaatagctagacaaaaaacaaatcaagtgaagtggatcgaaggtaatatgactcactttaatttgaacaaaaaatttaatatgattacaatattttgtgattcactgaattatttagaaacattaaatgacgtaaaaatgacattcgaaagagtgtatcaacatttaaataaaaatggtgtttttatttttgatgtacatactgttcataaaatgaaaacattatttaataataaaagttatattgatgaatctgataatgtttttgtaggttgggatgcaatatgtggggatgaaccattaagtgtttatcatgaaatgactttctttgtatcacagcaaaatggattgtatcaacgctttgacgaatcacattatcaaagaacatatgaggaacaaatttatcgaaatttactaaaagatgttgggtatcatagtgttaagacttttacagactttaacattcacagtcatgaagaagatgcccatcgcttgttttttgttgctaaaaaataa

SEQ ID NO: 234 - DNA, 132 bp, Staphylococcus epidermidis
gattctaggtctcttacatcaaggaattatattgagagggaaagtttaatattattaaattttcaacttagttaccatcttaaattactttcaaaatgcctgagacaatcaatgctgtcccaggcattttaa

SEQ ID NO: 235 - DNA, 174 bp, Staphylococcus epidermidis
gaattatatcccagactcattgaactcaaaatttatatatattactatccggaaccgagtttggaaagtacttcaatgatatttaagttcgatttcccccatttagtaaattatttaatttcaacgattttaacattcatttcgccaccgttaggaagtggaacacgtacttga

SEQ ID NO: 236 - DNA, 123 bp, Staphylococcus epidermidis
aaaacattccccccacatacaagttgttcttttggattggtcattttcaactatccccttttatatgcccgtaaaagactaacgttaagaaatgacgtttcaataaaagcagtagacctttga

SEQ ID NO: 237 - DNA, 681 bp, Staphylococcus epidermidis
ttttttgtgtttaatattaacagacgatatatcgatttttttatgaaatggaagttgtacatcttgattatattaataatgttaacaacattctttttttacttactcaatgataacaataatgatttgatacagaatagtcaggaaagacaatctaaaatatctgaccagcaaataaaaaatagcaaaaagttaaataaaaaagaagtgtctattcaaaaagataatacaaaagaaactaaaatatttatcgatattaaaggtgctgttaaacatccgaatgtatatgaaatgtcttcttcgaatagagtcattgatgctttaaataaagcagaggtattaaaggatgcagacttatcacaattaaatctttctgaaaaattagttgatcaaaaacttatctatgttcctaaaaagggtgagaatagtatgaaaatcaattcacagcaatcaacattgaattcgagtgacgtaaaaatcaacacgaatcaacctttaaatttaaactctgctactgaagaacaattgaaaaacataccaggaataggtccaagtaaagctaaagaaattttaaattacagagaacaaaatcatggatttaatagtatcgatgacttaatgaaaataaaaggattcggaaagaaaacatttgaaaaactgaaagaacattttactatttaa

SEQ ID NO: 238 - DNA, 141 bp, Staphylococcus epidermidis
gtaaaagtgttagaacacttatggaaagagacaaaaaagcagaataaagagtgtaatattactttttatgagcgaatgttaaaaaatttcgtcataaatcgcataaaaccaacgtttctattacataaatcgttgcgatga

SEQ ID NO: 239 - DNA, 468 bp, Staphylococcus epidermidis
tttgaggtgttaattgtgccaaaaaagtcagtgagacatataaaaataagagagataatttcaaatgaacaaatagaaacacaagatgaactagttaaacgtttgaatgagtatgatttaaatgttactcaagctactgtttcacgagatattaaagaattgcaattaattaaagttcctgcacctacagggcaatatgtttatagtttaccaaatgatcgtagatatcatccattagagaagttgggtagatatttaatggattcatttgtaaacattgagggtactggtaatctactagttcttaaaacgcttcctggtaatgctcaatccattggtgctatacttgatcaaattgattgggatgaggtacttggtacaatttgtggtgatgatacatgcttacttatttgtcgagacgaagaagcgagtgaagaaatcaaaactcgaattttcaatttattataa

SEQ ID NO: 240 - DNA, 945 bp, Staphylococcus epidermidis
attcgtcagttaaagtgtatcgaaaggagactggacatgcaaaaaaatattctaaaaagtggcatcgaaatttctgaacttgggttaggttgcatgagtttaggcacagattataaaaaagcgcaaccaattattgaaagtgcaattgataatggtattacgtattttgatactgcagatatttacgatcaaggagttaatgaagaaattgttggtaaagccttaaaaaaatatcaaaatcgtgatgacatcgttatcggaactaaagttggaaatcgattaactgacgatggacatatgacgtgggatccttcgaaaaaacatattaaagaaagtgttaagggatcattgaaacgattaggattaaaccatttagacttatatcaattacatggcggaacaatagatgatcctctagacgaaactattagtgcatttgatgaattaaagcaagaaggatatattcgtgcatatggaatttcatctatacggcctaacgtgatagactattatcttaaaaatagtcaaattgaaacacttatgtcccagtttaatttaatagataatcgccctgaaagtcttattaatgacgttcatgataagcaagttaaaattctagcacgtggccctgtatttaaaggtttattaacttcaaaaagtgttgatgttatagatgaaaaatttaaaaacggtgtgttagattacactcaagacgaattaggtagcacgattgcttctattaaagaattggaaagtaatttaaccgcgttatcatttaaatatttaacttctcatgatgctatggggtcaattattgtaggagctagtagcgttgaacaacttgaagagaatgtccgcaattattataaagaaatcagtttagatcaaatcaaatctgcacgtaatagagttaaagatattgaatatacacaacatttgaaataa

SEQ ID NO: 241 - DNA, 144 bp, Staphylococcus epidermidis
ttgtttaagtttgaaaacataggtattaaaatcattgttattgtactaactataaaaaaggctagcaatgcatcaataattaaagaccctttaaatttatattttgacaaatctcaaacgccccttttcaatatggaagattaa

SEQ ID NO: 242 - DNA, 1404 bp, Staphylococcus epidermidis
ggagaggcttttatggttaaaaatatggatacaattgtacaacttgcgaagcatagaggatttgtattccctggtagtgatatttatggtggattatcgaatacatgggattatggtccgttaggtgttgaattaaaaaataatattaaaaaagcttggtggcaaaaatttattacgcaatcaccttacaatgtgggtattgatgctgcgattcttatgaatccaaaaacatgggaagcatcaggacatttaggaaattttaatgatcctatgattgataataaggacagtaaaattcgttatcgtgcagataaattaatcgaagattatatgcaaaatgaaaaaggtgacgaaaactttatagcagatggcttaagttttgatgagatgaaaaaaattatagatgatgaaggaattgtttgtccggtcagtaagactgcaaactggaccgatatccgtcaatttaatcttatgttcaagactttccaaggtgttactgaagattctactaatgaattatttttacgacctgaaacagctcaaggtatttttgtgaactataaaaatgttcaacgttctatgcgtaaaaaattaccttttggtattggtcaaattggtaaatcattccgtaatgaaatcacaccaggaaactttattttcagaacaagagaattcgaacaaatggaacttgaattcttctgtaaacctggcgaagaaattgagtggcaaaattattggaaaacttttgcaagtgaatggttaacagatttaaacatctcagaagacaatatgcgccttagagatcatgatgaagatgaattatcacactattccaatgctactactgatattgaatataaattcccatttggttggggtgaattatggggtattgcgagtcgtacagactatgatttaagacaacatagtgaacattcaggtgaagattttaaatatcacgatcctgaaacaaacgaaaaatacattccttattgtattgaaccatctcttggtgcagatcgtgtgactttagcatttttatgtgacgcgtatgctgaagaaggtgttgaaggtagtaaagatgcacgtacagttatgcacttccaccctgctttagcaccatataaagcggcagtattaccattaagtaaaaaattatcaagtgaagctattaaaatttttgaacaactaagctctagctttgcaatagactttgatgaatcacaatctattggtaaacgttatcgtcgtcaagatgaaataggtacaccatattgtattacttttgattttgattcattagaggacaaccaagtaacagtgcgtgacagagatagtatggaacaagtacgtatgccaatatcagaacttgaaacatttttagctgagaaagttaaattttag

SEQ ID NO: 243 - DNA, 129 bp, Staphylococcus epidermidis
tctggttttacttcattctgctctgcaactgcaacagctgctggacgtgctaatcctgcagcacaaccgcatgttgagttgattacaacaaatgttgtatcatcattatctatattttgcatatactga

SEQ ID NO: 244 - DNA, 246 bp, Staphylococcus epidermidis
tttgtgcatacctgttcgtatgttggattttctacatgtcctccactatatccggaaacgactgattttattccaggatatgaggtgaagggtttaaccatgcaccaaaaacaacctccagctagtgtcgcatatgccatgttatattccctccttaagttatctgtttgtttaaatttacgctatattgtcgggaatttaaagtatttaactcagaatcattcatgtgattttgtgacaacttag

SEQ ID NO: 245 - DNA, 1488 bp, Staphylococcus epidermidis
ggatgtgataccatgaatgatcatcaaaaaaatcatgcaacatctcaagatgataacacaaagtcaacaccatctaagaatagcaagcatataaaaattaaattatggcatttcatactcgttattttgggtattattcttttaacatccatcattactgtagtatcaacaattttaattagccatcaaaaaagtggtttaaataaagaacaacgtgcaaatttaaaaaaaattgaatatgtctatcaaacacttaataaagattattacaaaaagcaaagttctgataaattaactcaatctgccatagatggtatggttaaagaacttaaagatccatattcagaatatatgactgctgaagaaacaaaacaatttaatgaaggtgtatcaggtgatttcgttggcataggtgctgaaatgcaaaagaaaaatgaacagataagtgttactagtccaatgaaggattcaccagcagaaaaagctggtattcaacctaaagatatcgtcacacaagtgaatcatcattcggtagtcggtaaaccacttgatcaagttgttaaaatggtccgcggtaaaaaaggaacatatgttactttaactataaaacgtggttcgcaagaaaaggatattaagattaaacgcgataccattcacgttaagagtgtagagtatgagaagaaaggcaatgtaggcgtactaacaatcaataaattccaaagcaatacttctggtgaactcaaatctgcaatcatcaaagcgcataagcaaggcatccgtcatatcattttagatttgagaaataatccgggggggttattagatgaggcagtcaagatggctaacatctttattgataagggaaatactgtcgttcaattagaaaaaggtaaggataaggaagaattaaaaacttctaatcaagcactaaaacaagcaaaagatatgaaagtatccatcttagttaatgagggatcagctagtgcttcagaagtgtttacaggtgctatgaaagactatcataaagctaaagtttacggttctaaaacatttggtaaaggtatcgttcagaccactcgtgaatttagtgatggttcattaattaaatatacagagatgaaatggctaacgcctgatggccattatattcatggtaaaggaattagaccagatgttagtatctcaacaccaaaataccaatcactcaatgtcattccagataacaaaacttatcatcaaggtgaaaaagataaaaatgttaaaacgatgaaaataggtctaaaagctttaggttatccaattgataacgaaacaaacatatttgacgaacaattagaatctgctattaaaacatttcaacaagacaataatttaaaagttaatggcaattttgataaaaaaacaaatgataaatttactgaaaaactagttgaaaaagcgaataaaaaagatactgttttaaacgatttactaaacaaactaaaataa

SEQ ID NO: 246 - DNA, 612 bp, Staphylococcus epidermidis
catctcatcacaaacattacaacaggtttaaaagatgtggttgaagttacattcaatcaaatcactgtagatggtgacacttcaacaaatgatatggtgcttgtgatgtcaaatggatgtacaaataataacgaaattaaaaaagacagcgaagactactataaatttaagcagatgcttctatatattatgaccgatttagcaaaaagtattgcaagggatggcgaaggtgcttctaaattaatagaagtcacggttaaaggtgcaaaagaatctagtgctgcaagaatgattgctaaaagtgtggtgggttcaagtttagtaaaaaccgcaatttttggcgaagatcctaattggggtagaattattgctgctgcaggttatgctaaaacatattttgatattaatcaggtagacatttttataggtaggatacctgtattaataagatcctcaccagtaaagtacgataaagaagaaattcaagaaataatgagtgctgaagaaatatcaattcagcttgaccttcatcaagggaattgtgaaggtcaagcatggggatgtgatttatcgtatgactacgttaaaatcaacgcactatacaccacttag

SEQ ID NO: 247 - DNA, 1068 bp, Staphylococcus epidermidis
cctatgaacactttaatactactaacgaaaagagggaataatttgaatatcgaagatttcgattatcatttgccagagtctctcattgcacaaacaccactaaaaaacagagaccaaagtagattgttagttcttagcaaagatactggtgagctgacacacttacattttagagatgtcatccattattttgagcctggtgatacattggttcttaatgatacacgtgttatgcctgctagattatttggcctaaaagaagaaactggtgctaaagttgaaatgctaatgctcacccaaattgaaggtaatgattgggaagttttacttaaacctgcaaagagaattaaaaaaggtcatcgtctaaattttggagatggtaaaatcgttgctgagtgtattgaggaacttgaacagggcgggcgtattatgcgtctacattatgagggtatactccaagaacgcttagatgaattaggcgagatgccattacctccatatattaaagaaagattagatgatcctgataggtatcaaacggtttatgctaaagagagtggatcagcagctgcaccaacagcgggtttacattttactgatgatttgctaaataaaattaaacaaaaaggggtacatatcgcttttattacattgcatgttggattaggaacctttagacccgtaagtgttgaaaatatcgatgatcacgaaatgcatagtgagtattatcaaatgacacaagaaacggctgatttattaaataaaacaaaagaaagtgggaagcgtgtgatatcagttggaacaacatcaacgcgtacattagaaacgatacgtcgtgatcatcctcaatttgttgccacaagtggatggactgatatctttatttatcctggctttgagtttaaagcgatagatgggttaattactaatttccacttacctaaatcaacgttagtcatgctagtatcagcatttagcaataaaaaatatattttaaacgcttatcataaagctgttgaaatggagtatcgattctttagttttggagatgcaatgttaattatataa

SEQ ID NO: 248 - DNA, 177 bp, Staphylococcus epidermidis
acaaaattaacgaggtgccttatgtataaagactataacatgactcaacatactctactaatggaaacttcagttcttatccccacaaatgatatttcacgacatgtaaatgatattgcagaaacaattcccgatactgaattcgatgaattcagatatcatcgtggcttaatataa

SEQ ID NO: 249 - DNA, 150 bp, Staphylococcus epidermidis
atgaaagtaactcatcaatttgttgttgaatggatgtctccaacatttgaaattgatgttcggcaagttgagtcatctcatggatataatcatttaattgtcggcgcaatgagttcaaatcatcttgtaataattcaagagtttgattag

SEQ ID NO: 250 - DNA, 276 bp, Staphylococcus epidermidis
agaggagtaactaaaatggaattaacttcattgattataccaattttattattggtcgtaatgtatttcttattaataagaccacaacaaaaacgtgcaaaagaacatcgtgcaatgattaaccgtgttgaagcgggtcaaaagattactacaatcggtggtattaaaggaactataaaagctgtagatgaaacttctgtaatcattacagtaaatagtaatggaacagaaatgacttttgaaaaaccagctataaaacaagtagatccttcataa

SEQ ID NO: 251 - DNA, 993 bp, Staphylococcus epidermidis
aaagtaatgacagatattattttagctgctgatataggcggaacaacttgtaaattggggatatttgacaaggatttagaacaattgcataaatggtctattgatactgatacaagtgaccacactggtgagttacttttaaaaaacatttataattcttttactgaaaagattgcagaatataaatatgattttaacaatgtagttggagtcggtattggtgttcctgggcctgttgattttgatactggagttgtatacggagctgttaatttacattggcccgatagtgtcaatgtaagagaaattttcaaacaatatgttaattgtccagtttatgttgataatgatgctaatgttgctgctttgggagaaaaacataaaggtgccggcgaaggtgctgatgatgtagtagccattactttaggtaccggcctaggtggaggtataatttctaatggagaaattgtacatggacacaatgggtctggcgctgagattggacatttaagagctgattttgatcaacgttttcaatgcaattgtggtaaatcaggttgtatagaaacagttgcttctgctactggtgtagtaaatttagttaatttctattatcctaaattaacgtttaaatcatcaattttacaacttattaaagataaccaagtaactgcaaaagctgtatttgatgcggctaaagctggcgatcaattctgtatatttataactgaaaaagtggcaaattatatcggttatttatgcagtatcattagcgttactagtaatccaaaatatattgttctaggagggggcatgtctacagcgggacttatccttatagaaaatattaaaactgaataccgtaatttaacttttactccagctcaaaataatactgagatagtacaagctaagttagggaatgacgctggtattactggtgcagctgggcttatcaaaacatatatcatagataaagagggtgctaaataa

SEQ ID NO: 252 - DNA, 156 bp, Staphylococcus epidermidis
tacattaagacattaaggttttccaaaagattaatgagcctgatattattttttcaggctcataaaaatctatattttattatttttattcatcatatgaaatcaaactcatcacatcataatcttttattttatcaattccattcaaatatttaa

SEQ ID NO: 253 - DNA, 1143 bp, Staphylococcus epidermidis
catatgcctgcagtgacatatgagcatataaaaacatgtaaacaatccggtgccagattaggaattgtacatacaccgcatggatcttttgaaacaccaatgtttatgccggttgggacaaaagcaacagttaaaacaatgagcccggaagaattaagaaacatagaagcaaagattatattaggaaacacatatcatttgtggttacaacctggaaatgatattatcaagcacgctgggggattacacaaattcatgaattgggacggtccaattttaacagattctggtggtttccaagtatttagtttaagtaatttgcgtaaaatttctgaagaaggtgtagaatttagacatcataccaatggctcaaaactatttttgagtcccgagaagtctatgcaaatacaaaatgatttaggttctgatattatgatggcatttgatgaatgtccaccaatgccagctgaatatgattacgtcaaagattcaatcgaacgtacaactcgatgggcagccagatgtttaaaagcacatcaacgccctggagatcaagcactgttcggtattattcaaggtggagaatacaaagacttaagagaacaaagtgctaaagagctagtcagtcttgattttccagggtatgcaataggagggctgtctgtaggtgagccaaaacctgttatgtatgacatggttgaacatacagaacaatttatgccgaaagataaacctagatatttaatgggagtaggttctcctgatgctttgattgaatgtagcattaggggcatggatatgtttgattgtgtattacctactagaattgctagaaatggtacttgtatgacatcaaatggtcgattagttgttaaaaatgctaaatatgcagatgatttaagaccacttgatgaacaatgtgactgttatacatgtcaacattacacaagagcttatattagacatctagttaaagcggaagagacttttggtatccgtcttactactattcataatttacattttctgctaaaattaatggaagatattagacaagccattcgagaagaccgtcttttagattttaaagatgaattctttgaacaatatggattaaatgtagaaaaccctaaaaacttttaa

SEQ ID NO: 254 - DNA, 135 bp, Staphylococcus epidermidis
tactgtaacgcattcctgaaatgtgtattaaaacagggtagctttatgctatcctgttttttaaaaattattaattgggggtacacgtatgacaacagatttgaaaaaaacacctttatatcaaaattacgttga

SEQ ID NO: 255 - DNA, 645 bp, Staphylococcus epidermidis
gagtctgaagccgacagtatagtctggatgggagaaaatggaggttttttgttgttcaaatttcctccttttctaagtaagatgaatggaaggagaaaattatatatgcaacaaaacaaacgtttgattacaattagtatgttaagtgcggtagcgtttgtgttaactttcatcaagtttccattgccatttataccaccgtatctaactctcgattttagtgatgtaccgacgttattagcaacattcctcttaagtcctattgctgggattatcgttgcactcatcaaaaatattttaaattttctattcaatataggggatcctgttggaccagtagctaactttttagcaggcgtcagctttttgctatcatcatactatgtttatagaaaaagaaaaaataatcgttctttaatttatggattaattacaggtacaatcgttatgactattgttttgagcatcttaaattattttgtgttacttccattatatggaatgatatttaatttaggtgatgtgcttaataacgtaaaaattgttattgtgtctggagtcataccttttaatttaattaaaggcataatcatttccattatatttgtgctgttatttagaagattaagacatatcatcaaataa

SEQ ID NO: 256 - DNA, 606 bp, Staphylococcus epidermidis
ttatttatggcttttgaattaccaaatttaccttatgcatatgatgcattagaaccacacatcgacaaacaaactatggaaattcatcatgacaaacatcataacacatatgttacaaaattaaattcagcagttgaagggacagatttagaagctaaatcaatcgaagaaattgttgctaatttagatagtgtgccatctaatattcaaacagctgttcgtaataatggcggtggtcaccttaaccattcattgttctgggaactattatcaccaaattctgaagaaaaaggtgaagtagtagataaaattaaagaacaatggggttctttagatgaatttaaaaaagaatttgcagataaagctgcagcacgctttggttcaggatgggcttggttagttgtaaacaatggacaattagaaattgttacaacaccaaatcaagataatccaattactgaaggaaaaacaccaattttaggtttagatgtttgggagcatgcttattatcttaaatatcaaaataaacgcccagattatatcaatgcattctggaatgttgttaactgggaaaaagttaatgaattatataatgcaactaaataa

SEQ ID NO: 257 - DNA, 339 bp, Staphylococcus epidermidis
gctaatgcggcacattacggtgcatcgaaagcagggtttagcgccgttcttaatgcattgagattagaacaaccggaattaaaagtgctcaatgtacagcccggtccaatagatacaccattccaaaaaaacgcagatcctactctaaagtattttaaaaattatagacacatgatgatacaacctcaacaacttgccaagcaaatagtggaaggaataatactaaataaaattgaaattaatcaaccatcatggatgcaaataatgcttaaattttatcaattatgtccacgtacactagaaaaattatgtccaaatctatttaaaaataaagtttaa

SEQ ID NO: 258 - DNA, 465 bp, Staphylococcus epidermidis
aggagtgaggcttccgtggaagaacgattaaatcgcgtgaagcaacaattacaacaatcttcatataaattgactccacaaagagaggcaactgttagagtattaattgaaaatgaaaaagatcatcttagcgcagaagatgtgtacttaaaagtcaaagataaggctccagaaataggattagctaccgtttatagaactttagaattgctagctgaaataaaagtgctagataaaataaattttggtgatggtgtagctcgttttgatttaagaaaagaaggagccaagcatttccatcatcatcttgtttgtatggaatgtggtaaagttgaagaaattgaagaagatttattacctgaggttgaaaatcgtgttgaaaatgagtttaatttcaagattttagatcaccgtttaacgtttcacggtgtatgttttgaatgccaagccaaaaataagcaataa

SEQ ID NO: 259 - DNA, 972 bp, Staphylococcus epidermidis
gggtttaatttgtacaatatactatcatacgctatgagtcatgcatttaactacaaaaccaataaaagtatctataatattttaacaggcaagaagtcacaccaaacgtttttcgatgcgtcaagccaacaacttttgtcattatatcatagtttacctaacttaaagtattcaacttttgagcaatttatactccaaaaggatgattttaaaaaatcaattcaagtaaaaatacatccacaatacacttatgatagtctcactcaaacctttagttgcatacaattacttatccaaacgttatctcatacacgcaaggagtcaaatacatttattccaatcgttcaaaatacctatatccaacaaagggttaaacaactttatcatcaggtcattgaatcaaatcaagtatcaaatactatagacgaaatatatttattatttgagaatttaaataataaatataaccatacatttcttcattattatttacaaggatatgaggaatccatgtatactagacaacaaataagtttaattgagggtataccacaatcagaattatttgaacgagaaatgaatgaactgattgacatattgaatcaattaaaagattcaacgaaatatccaatactttctcaagctatcattctttcaccattactaacaaatacatacttaagctatcaaaagttaaaatctggtctcaatttaaaagaaattgctcaattacaaaatgtaaaacttaacacaattgaagatcatattctagaaatgtatattaaaggttatttgatagactatacattatttataaataaaaaagatattctcgaatttataaactactatcaaaaacatcgcggtgaacgattaaaattttataaagaacattttactgattggacttactttcaaattaagttagttatagtaggaatagaaagaggtgatttaattgctgaaagataa

SEQ ID NO: 260 - DNA, 762 bp, Staphylococcus epidermidis
gtggataatttgcaaagatattttatgaatcaaagcgctgatgaaaatcagtgcttttttattgaaaacaaagaagactatcatcatatcgtgaatgttatgcgctataaagaaggacaaaatattattgtcactttttcagatgaaaatgtattcaaatgtaaaattatttcaataaacgatcaatcgattgaaattaaattagtagaaaagcaacaaattaacactgaactacctcagaacattacaatatgtagtggtttaatcaaagcagacaaatatgaatggatgatacaaaaagcaactgaaatgggggcaaatgagtttatagctgtagccatggaacgttctgtggtcaagctcactgattctaaagtagaaaagaaattatcgagatggcaaaaaattataaaggaagctgcagaacaaagttatcgtttaacaataccaaatataaaatttaagtcgaatttaaaagaaatttatggtatgataagtcaatatgactatgttcttatagcatatgaagaacaagcaaagcacggtgaattaagtcaatttaagcaaacaattaaacaatttaagacacaggatcgtgttttaatcatatttggacctgaaggtgggctatcagatagtgaaatttcattattcggtgatgtaagtactatagttggattaggtccacgtatcttgcgtgctgaaactgcacctctttacgctttaagtgcagtaagttatgaaaaagaattattggggtga

SEQ ID NO: 261 - DNA, 2220 bp, Staphylococcus epidermidis
ccaatgttttacattgctcttgcttttttggtaggggtactttggataaaattcaaagtaatctctatctccttaatattaactcttttgttactaattatgataaaaaggcttaatattataatactattattaatgtttatttcagctataagtttcttttttttaataagttcctataaccaaaccgaaattaaaaacataaatagtttatataatgaaccgtttattgatgattttgttactttcaaatcttttacgcctaaatcaacatactatactggcatattaaattataaaaataaagactatagatacttttacaaaatattaaagtcaaatttcaagcaagatttaactcataaaagttgtcgagttaaaggagaatttaaattcgaaaaagagttgtccttgttgaatatttcaacagttcaatttaagtcttgccaagaaaacaatattttcactcctatatatcatcatcaaaattatatcaccaaaataattcatatatctggggtcacgcatcctgaaagaatattagcgttgataacaggtgatacctctctaattgatgaatattacaaatctaacatcaaagatataggtatttaccatttactagctataagtggtacacatgttggtacaattattgtcctcgtttatcaactgttagtacgtttaaatatacctctagttctcattaaaggtgtaactattttactattattaatctacgctgtttatactggatttgtacctagtgccatgcgtgccatttcaattgcaatcattatacttatgttgccaatccattttaggaaaagttctatacatgtgctttcatttatatttgtgttaatgattctcttaaatcctcaatttataaatcacattggttttcagttctcttttttgataagtttatttattatattggcaaaaccatatataagtgctttaaaaccacttaaatgtttgtttattattagttttttggctcaattaggttcaattgtaattaatacctatcattttaatcaatttcaatggataggtttgctatctaattttatatttgttccattctattcttttatattatttccttcggtcattatctactttattttaattcacttttttcaacatagcttcctattaaatacttatataaatatgctttttaaaattcatgactggctagttcaattatttttaaatttaaatcatttaaagtggtacattcctaaattaaaccaatatagtttacttattttgattatactaacgttaatttttctttacatacttgtctatagagggtttgttacatccgtactaagttttttaattgttttaatcatttttacacatttaattagaccacattatgccgagttaacactttttgatgtgggtcaaggagatagcattttattcaaaacaaagtcaaataaaagtgttttgattgatacaggaggtaaaaaaaatgaaaatgtaagttttaaacataataatattgccaaatataaaattttaccaattattaaaaaaaagggtattaccactataaattatttagtaattacacatcctcatgccgatcatatgggtgaattaatatattttttaaataatattaatgtgaataatctcgttttaaatattgaaagtttcccattaaaattacttaaagaggttacgacaaaatgcaaggaaaaaaaaataaatatcttggatgtaaatcaagtgaaaaaaatagatattgataatagtaaaataagctttttaaatagttttataccattaattgatgataaaaatgaacattccattgttacattaattgaatataacggcattaatattctactgatgggagatgcaactgttaataatgaagacattctaatgaagagatataatttaccaaaaatagatattctaaaagttggtcatcatggaagtaggacaagtagttcgaaattatttattaaagatatagaacctaaaatcagtcttatatctagtggtaaaaataataagtatcatttacctaatttggatgttattcaaagattaaaatattatggtagtaaagtttttgatactcaagacaacggggaattaactataaatttagatgaagaagtttacatagtctaccgtgataatttaaatcaaaagagtttagctagagaaagtgtatcgtaa

SEQ ID NO: 262 - DNA, 513 bp, Staphylococcus epidermidis
gagtgcatttacatgtttaaaaagttatttggaaaagctaaagaagttgacaaaaacattaaaatctacgcacctttgacaggtgagtatgtcaaaattgaagatattcctgatccagtttttgcgcaaaaaatgatgggagaaggctttggtattaatcctacagagggtgaagttgtttcaccgattgaaggcaaagtcgataatgtttttccaacgaaacatgccgtagggttaaaagccgaaaatggattagagttattagttcatatcggattagataccgttcaattggatggaaaagggtttgaagtacttgttgaaagtggagatgacattaaaataggtgacccacttatacgttttgacttagaatatattaataataatgcaaaatctattatttctcctattattattacaaactctgatcaaactgaatcaattcatattgaagacgtacaagcagtagttaaaggggaaacacaagttattgatgtgacagtaagctaa

SEQ ID NO: 263 - DNA, 465 bp, Staphylococcus epidermidis
aaaagcatttatcgaatcacactggggaggctcaaaatgattaaaaaaaacaaagaagaactgaatgacatggagtatctagtcactcaagaaaatggtactgaacctccgtttcaaaacgagtattggaatcactttgaaaaaggaatttacgttgataaattgtccggcaaaccattatttacttcagaggataaatttgaatctaattgcggttggccaagtttctccaaagcattaaatgatgatgaaatcgtagaacttgttgataaatcatttggtatgattagaactgaagttcgatcagaaaaagcaaatagtcacttggggcatgtttttaatgacggacctaaagaaaaaggtggtttaagatactgtattaactctgctgcgattcagtttataccttatgataaactagaagagttaggatatggagatttaattaaacattttaaaaaatag

SEQ ID NO: 264 - DNA, 135 bp, Staphylococcus epidermidis
agttcatttcttactgactccttaggtttgttttcatctacccatctattttacttgagtaaaagattcaattcaagcatgttcattaaacatcaaaacgtcggtatttatttaaatattttagagattgactaa

SEQ ID NO: 265 - DNA, 717 bp, Staphylococcus epidermidis
gaggaaagttatatgtataatgaaatatttggtattgcgtcatttattgttacattcgctttaatggtactgatgtatcgctgttttggtaaacaaggactaattgcttgggtagcaataggaacgattatcgctaatatacaggtcataaaagcggttcatatttttggtattacggctacacttggaaatgtcatgtttgcttctatatatttagctactgatatattaaatgacatctatggtcgtaaagttgctaaaagagcggtgtggcttggtttctcttctaccttagtaatgattatagtcatgcaaatgtcattgcattttattcctgctccagtagacaatgcgcaaaactcattaaaaatgatttttgatttagttcctagaattgctataggttccattattgcttatatcataggccaacatattgatgtatttatattcagtatgattaaaaagatatttagctctgataagaccttttttattagagcatatggtagtaccattttaagttctatcattgataccggtttatttgtttcaattgcttttattggtactatgcctggtactgctgtttttgaaatatttattaccacttacttgttaaaactagtgtcaactatttttaatgtaccatttggatatatcgctaagtcactatatcgaaaaggaaagatagaacaactagataatgggtattga

SEQ ID NO: 266 - DNA, 732 bp, Staphylococcus epidermidis
attctatcctactcttttttaatacatataaggagtttaaaaatgattaaccttaaccaaagattatcaattgtatgctcatttattaaaagaggaacattggctgatattggttcagaccacgcatatctacctatatatgcaattcaaaacgacttatgcacaaaagcaatagcgggagaagtgattcaaggaccttataaggctgctaaaagaaatattgcaaattatgaattaaatcaacaggttgatgtacgtctaggcgatggtctaagcgttataaactcagaagaccaaattgataatataactgtttgtggtatgggagggccattaattgcaaaaatattaaacgatggaaaagataaattagttaaccatccaagactcatactacaaagcaacatacaaactcaagcattaagacaaactcttaataaactttcatatgaaatcgttgatgaaagaatcattgaggaaaagggtcacatatatgaaatcgtggtagctgagtttaataataacttagttaaattaaatatattacaagaaaaattcggaccatttttacttagagaatgtaataacatttttcaaaaaaaatggcaaagagagttagaagcactgcgtgatataaaatcccaattgaattcaacatcacatcatgagagactaaaagaaatagaagatgaaattaacttaatacaagaggtgttaattaatgaaaattag

SEQ ID NO: 267 - DNA, 1059 bp, Staphylococcus epidermidis
aggaacacctattcatattattccaagaaaaagaaattaaaaacaaaggggaattcaataatgagaaaaattacagtttttggtatgggtagttttggtactgcattagctaatgtattagctcaaaatggtcatgatgttttaatgtggggcaaaaatgtagagaatgtagatgaacttaacacacatcatatgaacaaaaattatcttaaagatgctaaattagattcatctataaaagcaactgtagatttaaataaggcagtgcaattttcagatatctatcttatggcactacctacaaaagcaattagagaagtatcaaaagatatcgatcaattactcacatctaaaaagacttttattcatgttgctaaaggcattgaaaacgatacatttaagcgcgtatctgaaatgattgaggactctatctcttcagaacataatggaggaatcggcgtcttatcaggtccaagtcatgctgaagaagttgttataaaacaacctacaactgtagctgcatcatctaaagataataatgtgagcaaacttattcaagatttatttatgaacgactatttacgtgtttacacaaataatgatttagtaggtgtagaattaggtggtgctttaaaaaatattatagctatagctagtggtatcgttgccggcatgggttacggtgataatgcaaaagcagctttaatgacacgaggtttagccgaaatcagtcgacttggtgagaaacttggtgcagatccaatgactttcttaggtctaggtggcataggtgacttgatcgtaacttgtacgtccacacattcacgaaattacacacttgggtttaaattagggcaaggcaaaacagcagaagaagctttaaaagagatgaaaatggtggttgaaggtatttatacaactaaatcagtatatcatcttgctcaacaagaaggagtagagatgcctatcactaacgcattatatgaagttttatttgaagatgtccctgtaagtaaaagtgttagaacacttatggaaagagacaaaaaagcagaataa

SEQ ID NO: 268 - DNA, 138 bp, Staphylococcus epidermidis
agtaaagcctataatccacgtatttttattcataatgctgctcctttttatctaataatgcaacattcaatattctatcataataaagaaatattagtctatataaaatttcagaaaattaaaacattgtacaattga

SEQ ID NO: 269 - DNA, 180 bp, Staphylococcus epidermidis
ttgccatctctgaaagatttgctcacttgtttgaactctaacatgtttatgattcctttctatccaattgctttaagtggatttatttttattatagacaacacagaaaatagactgcctaataaagaaataatgataagaacaattccatatatcaacatcgttaataaattaaaatga

SEQ ID NO: 270 - DNA, 573 bp, Staphylococcus epidermidis
aagtatcaatatgatttaaatttattgttaccactcgttaaaattctaaaaaagaggtgttttagtaagatgattagattagcaactaaaaatgatttacttagtattactcaattagtcaaagaggctaaacagattatggaagaattcaacaacaaccaatgggatgatgaatatcccgcgaaagagcattttgaagaagacatcgaaaataaaacactatatgttttagacgttgatcatacaatttatggtttgattgtgatcgaccaaaatcaatcggagtggtatgatgacattgattggcctgttaatccaaatggggcatacgttattcacagattacctggatcaaaacaatataaaggtgctgccactgaacttttccaatttgccattgacttagcaaatgaacatgatattcatgtcattttaacagatacatttgccctcaataaacctgctcaaggattatttgaaaagtttggttttactaaagttgatgagatagagatagattatcatccttttgatagaggggcacctttttatgcatattataaaaacatataa

SEQ ID NO: 271 - DNA, 123 bp, Staphylococcus epidermidis
aaaatcaaatacgtaatgcttttggttttgaaggaacacctattcatattattccaagaaaaagaaattaaaaacaaaggggaattcaataatgagaaaaattacagtttttggtatgggtag

SEQ ID NO: 272 - DNA, 1317 bp, Staphylococcus epidermidis
aaagaaaaatataggagtttggttatgaaaactacgattaaacaagcgaaaaaacatcttaaccaagaagtaacaattggtgcttggttaactaataaacgttcaagtggtaaaatagcgtttttacaattacgcgatggtacaggatttatgcaaggagtagtagtaaaatctgaagtagatgaagaaacatttcaactagcaaaagatataactcaagaatcatctttatacatcacaggaacgattacagaagataatcgttctgatttaggctacgaaatgcaagttaaatcaatcgaaattgtacatgaagcacacgattatcctattacaccaaagaatcatggaacagaatttttaatggatcatcgtcacttatggttacgttcaaaaaaacaacatgctgtcatgaaaataagaaatgaaattatccgtgcaacatatgagtttttcaatgaaaatggcttcactaaaattgatccacctattttaacagcaagtgcaccagagggaacaagtgagttattccatacaaaatatttcgatgaagatgcattcttatcacaaagtgggcagttgtatatggaagcagccgcaatggctcacggacgtgttttttcatttggcccaacttttcgtgcagaaaaatctaaaacacgccgtcatttaattgaattctggatgattgaaccagaaatggcctttacaaatcatgcagaaagcttagaaatacaagaacagtatgtgtctcacattgttcaatctgttttaaatcattgccaattagaactcaaagctttagatagagatacaactaaactagaaaaagttgctacacctttccctagaatttcttatgatgatgctatcgaattcttgaaaaaagagggattcgatgatattgaatggggtgaagactttggtgcacctcatgaaacagccatcgctaatcactatgatttaccagtattcattacaaattatccaactaaaattaaaccattctatatgcaaccaaatccagacaatgaagatacagtattatgtgctgatttaattgcgcctgaaggttacggtgaaattattggtggttccgaacgtattaatgatttagaattattagaacaacgcattaatgagcacgaattggatgaggaaagttatagctattatttagatttacgtcgctatggtagcgtaccacatagtggttttggcttaggcttagagcgaacagtagcttggatttctggagttgaacatgttcgtgaaacatccccattcccacgtttacttaatcgcttatatccataa

SEQ ID NO: 273 - DNA, 315 bp, Staphylococcus epidermidis
tataatgaatatcattataaaacctcaggaggtgaattcataatgaataaaactgatttaattaatgcagttgcagaacaagctgacttaactaaaaaagaagctggttcagcagtagatgctgtatttgaatctatccaaaactcacttgctaaaggtgaaaaagtacaattaatcggtttcggtaactttgaagtacgtgaacgcgctgctcgtaaaggtcgtaaccctcaaacaggtaaagaaattgacatccctgcaagtaaagtaccagcatttaaagctggtaaagcattaaaagatgctgtaaaataa

SEQ ID NO: 274 - DNA, 630 bp, Staphylococcus epidermidis
cacttgagatataacatttcacgtatatttggagtgttagtgggtataccagtggcctttattgtttggcttattactgtttttgcgttggatttatcattcattatagacatgcttatcagttttggtagtttcattgcatcatacttccctacgcaaaggctcacttcacgaaagtatcttaatgaaattggtttatcaagaagagattacagatatgttcaatcacagcttcatcatgcacatactaaaattagaaatatcttaaagtcatttattaatattcgttcaatcaaagattttagacaagtaaatgatatatatcgaatttctcgttctattcatacaagcattaagcaaagacccgcgatgttttttaaagttgaaagctttttctattctcatttggataatgcacttaacttagtagactcgtatacacgtcttgcaagaatgccacgtaagtcgcaagatgaaaagctaaaattagaacaaacacgtattactctagatgaaataaagagaacgctcattgctgaccttaaaaggcttaatgaggaagattatgagcgactagatgttgaaatagaattaaataaattagaacagcaacgtcgacataataattaa

SEQ ID NO: 275 - DNA, 1725 bp, Staphylococcus epidermidis
gaaactggatacatcactatattaaggagaatgtacatgtttagaaagtctatgctcatcttaatgattgctgtcattttgttcgtaacagcatgtagcaaagataaaacgcaagatgaagcgaaaagaaaagcagatgctaaaggtaaaccagatacatggattgcagatagaaagcttaaaggacttgtgtttcaaagtgataacgatgcctcccctaaaatgaataaagaagtcgctcaagaacttaagaaaaagactggcatcacgttagaacttcaaaccgtttctaatgaagattccacagaagcattaacttcaggactcgcttcaggagatttacccgacttcatcgtttattacttagacgatagtggaagacctgaaatgaaagtactaaataaagcagcgaaacaaggtcgactcacagacttaacgaaaatgcttaaaaacacaaaaatttatagtaagtatttcaaaaaaggatatttaccaaaagatacgaaagataacatcatgtttaataaagaacaagatggaacgtaccttgtacatatggggattaaccgtcatccaggacaagaagaacgtcgcactgtaggtggtccttacgtcagaaaagatatcatggataaacttcatatcgaccctacttctatcaagacgtccaaagatgtagaaaaacttgctgaaaagatgaaagaacaccacttcaaagatgataatggtaaagaaatcacacctattggcccaacagcgtggggcggtgacgatcgtactaaattctataatgaccttgtgtggactggtcagtctgatgagaaatttttaaataaaggtaagaaaattatacatgaatcacaaaccgaatatccacttaaacgtgtacattacgttaaagaccttatgaagaaaggcttaatgacaaaagagttctatacaatggaagaaaataaagcaaaagaaggactcgttaatggctcatggggcattgtttcagatttacataactatgttactgaaaatcaaagtatgaaatacgttcctcttgggccactcaatacagtcaaaggtaaatttagagttgaaaagccatataaatcaggcgcaaacggttgggctgtaccaagtacgactgaacatcctgaagacgtcgttaaactcgctgatttccttgcaagtcgcagaggtaaattactcggtcagtacggtattaaaggacgtgactatacgttagataagaaaggtaaccctcatgttaaacctgaagtgttaaaagaagttgaaaataatccagacgaagctaaaaaacgtggttttagaggtgcgggttcttattgggcagatcatcttggttatactgatatagataataaagctgatttcggtgaaactgaatacggagataatacaaaaacgaaaaagacgactcctgaaaagattgctgatatgtggcattatgatcaaagacagaaacacgccaaaatcgtaaacggactcacagtaaagtcattcttatctaaatatgaatatggcgaagatttagaagttgcactcgatgattatagtgacgctattaaacgtgcttattattctcaatcagacaaggaaacgaaacaaattattgatagtgctaagcaacgtttagaagaggcaggcttaaatcaatttgaaagatacgttgaaaatcaaagagataaaaaaggaactcaaattatttattaa

SEQ ID NO: 276 - DNA, 774 bp, Staphylococcus epidermidis
ataattatgtataaaagaaatgaacgtttgaatcttattcgtaaacgtgttgatcagtacggacaggtggcagtaaaagatttagctatattcttacaagttacgcctgaaaccgtgagaaaagatttagaaaccttagaaaacgataaactgattacacgtacacatggaggtgcgatacaatacaatcatattaataaagagaaatcatatgcgaataagtggcagaaacaatcacaagtaaaagagcgtattgctaagaaagctgctttgcaaataaagtctggagaaattattgtcatcgatggtggaaccacaacagggcgaattcctcaatatctcaatgatattactcagaccacgattgtgacgaattctctgaagattgcggatgaattgaatcgtgctatagaggagcaacgaattcaagcagaagtgattatgcttgctggaaagacgaatactgaacaagatgttgtgcgcgggcatatgacgaatgagttattacaacgttttaaatttgataaagcttttatttcatgtggttcgtttgatacgagtgattgttatgaatttgatctggaagaagcgcatgcaagtcacattatgattcaaaaaagtcaactgagttatctcttagcggatagtagtaagcgagatgcgcatgcgtcgtatcgtattgatggttttagcgaaattgattatatgatttctgattatgctaaacctcagaatatagaatattttaatcagaagcattggttacagatttaa

SEQ ID NO: 277 - DNA, 273 bp, Staphylococcus epidermidis
ggagtgtcgtatatggaaaattttgataaaacaatgaaatttagttatgaagaaattccaaaggaagatgtcaaatcagttcttcagaatgtccatcgtacattagaagaacgtggatataatgcagttaatcaaatagtgggttacttattatctggagatcctgcatatattccacgtcaaaatgaagcaagaaaccaaatacgtcatatagaccgtgatgtaattatggaagaactcgtttcaaactatttaaaagagtctaagaattaa

SEQ ID NO: 278 - DNA, 171 bp, Staphylococcus epidermidis
gattatcagtattatatgaatcgtgtttcgaatttcaactcgatagatttgttgaattttagaatgaaattcttcgagttgtgttcacctaaatttagttgggacaaacttaatataaatgagtttttcaaattaattaagttatggactaccaatactaccaatgtatag

SEQ ID NO: 279 - DNA, 1278 bp, Staphylococcus epidermidis
aataaaaatctccttgtttgtctaactgacttatgttgtgtgattgaatatgataatatattaaacatattacaatttaatgtattgaagaatagaaaggggcgtgcgatcatgagataccttacatccggtgaatcacatggaccacaacttacagtcatcatagaaggtgtaccagctaatttagaaattaaggctgaagatattaataaggaaatgtttaaacgtcaagggggatatggtcgggggcgtcgtatgaaaattgaaaaagatactatagaaattgtgtcaggcgtcagaaatggctttactttaggaagtccaataactttagtagttactaacgacgatttcactcattggagaaaaataatgggcgtcgcaccaattagtgatgaagaaagagaaaatatgaaacgtaccattacaaaacctagaccgggccatgctgatcttataggtggcatgaaatataatcatcgtgatttaagaaatgtgcttgagcgttcatctgctagagaaacagcagcaagagttgctgtgggtgctgtttcaaaaattcttttagaacaattagatatccacttatatagccgtgtagtcgaaattggtggtattaaagacaaaggtttatatgatgtagatatgttcaaaaataatgtagataaaaatgatgtacgtgtaattgacgaaaatattgcgcaacaaatgagagataaaatagatgaagcgaaaaaagacggagattcaatcgggggcgtagttcaagtaatggctgaaaacatgcctattggagtgggaagttatgtacactatgaccgtaaattagatggacgcattgcacagggtgttgtgagtatcaacgccttcaaaggtgtaagttttggtgagggatttaaagcagctgaaaaacctggtagcgaaattcaagatgaaattcattataatcaagattcaggctattttagagctacaaatcacttaggtggatttgaaggaggcatgagtaatgggatgcctataattgttaatggtgtcatgaagcctattcctactttatataaaccactaaactcagttgatattaatactaaagaagacttcaaagctactatagaacgctcagatagttgtgcagtgcccgcagctagcgtagtatgtgaacacgttgtcgcttttgagttagcaaaagcagtactcgaagagtttcaatctaaccacatggaccaactcgtagcacaaattaaagagcgtcgacaactcaacatagaattttaa

SEQ ID NO: 280 - DNA, 1116 bp, Staphylococcus epidermidis
ttaaatcttcaaaggagcaaagacatgatacaaatcaaggatttaaacaaagtttacgacaatggtagttacgcagttaaagatttcaatttagatattgaggacaatgaatttgtagtatttgtaggaccttcgggatgtgggaaatcaacaacgttacgtatgattgcaggacttgaagatgtgagcaaagggacaattagtatcaacgataaagtaatcaacgatttacaacctaaagatcgtaagattgctatggtctttcaaaactatgcattatatccacatatgacagtttataaaaatttagctttcggcttaaaaatgcgaggaatcaagaagaaaatttatgacgaaaaaattcaacatgcagctcaaatattagaaattgaaaacctcctcgaccgtaaacctaaagccttatctggaggacaacgtcaacgtgtggcacttggtcgagctatcgttagagaagctcaaatctttctcatggatgaaccactttctaatttagatgctaaattacgaagtaacatgagaagcgaaattataaaaatacataaacaaatgaaagcaacaacgatttacgtgacacacgaccaaactgaagctatgacaatggcatcacgtatcgtcatattaaaacaaggcgaaatacaacaaattggtacgcctgaagaaatttatcgtcatcctgtcaatgaatttgttgccactttcattggtagcccatcaatgaatatggttccaatgacctacaacatggatgcttggtacttcgatggacaaaaagtggctgatgctacattacttcaacttgcatcgcatgcacaatacagacttggtatacgacctgaagacttacatcttgttaatgataacgaaataagtaattatccaatccaactttctcaattcactgtagacttagttgagttaactggttcatacaaattacttcactgtcatcacaatgagcataaaatcatagcagctgtagatagtaatttggattttgaattaggacaaacagtttccttcggtataaaaacggaagatgcacactttttcgattctgattcaggcgaaagagtacaagaggaggttttatcatga

SEQ ID NO: 281 - DNA, 138 bp, Staphylococcus epidermidis
aaaaagattcattgtaaaaagatttctattataatgaaagatcttaaaataaatttatcaataaaaagctcctatcttttgttgttaaaacttaagataggagctttattcgtattcaaaatttttacttataactaa

SEQ ID NO: 282 - DNA, 132 bp, Staphylococcus epidermidis
attgttgttcaaaatgctattgtgataaatgaagagcaaaccgaaattaaacggtcggaacatctgctcttttttattgagcaaatgtatgagttattcattgtcaaaattatcaacattaaaaacgtataa

SEQ ID NO: 283 - DNA, 612 bp, Staphylococcus epidermidis
aaggtagttcatactaagatgtatcaatggctttgggaaacttcactttatcaaaaatggttgatttcttttattttaatttgcaatatatttggtacgatatacggttatcattggtatagtagtcaattagctaacacaccaaattattttaaattatttgttccagatagtcccactgctacattatttttatgtttatcattattattcatactatttaataagcgttatgccctgattgacgctttagcttttataactctatttaaatatggtagttgggctgtaattatgaatattttgatgtttataaaaatgaatgatattgccataaacggacttatgttgctcatttctcacgcaattatgatattagaagctatctatttttatcctcgttttaaaatatctaaattggctggattgatgagtttcatatgggtgacgatcaatgacgtaatagattacatatacggacaatatccctactatgattttatcgccaaacatttaattgaagtaggggtattggcttatagtctcactatcatttcgtatattttatttttaaaattacaaaagtggttgaaagttaaaacatttgattaa

SEQ ID NO: 284 - DNA, 1005 bp, Staphylococcus epidermidis
aatttatctcatgttgatgaaacattaaatttacgtaacttgaaaaggagcgcgtttatgccaggaataattcaaattgacgatattaatcaatctcaagctttaataggaaataacgatgaaaacctaaaagcgattgaagcacattttaatgtcgtaatacatgctagaggtcaagaaattgctgttaaaggtgaaaaaatagagcatgttgaaaaagcagaattagttctaaagaatttacttaaagtaattgaattaggtaatacaattacgcttaaagatgtagaagctgctataaaaatggccgacaataatacaattcatcatttattagatttatacgatgaagaaattacaaaagatgcttatggtaaaacaattcgtgctaagactatgggacaacgtatatatattaatgctatgaaacgtaatgatttagtatttggcattggtccagctggaactggtaaaacctttttagcagtcgtatatgcggctaaacaactacgtaaaggatctgttaagcgtattgttctaacgagacctgctgttgaagcaggtgaatctctaggatttctaccaggcgatttaaaagaaaaagtagatccatatttaagacctctttacgatgggttaaatactgttttaggtagagagcaaactcaaagactcatcgaacgaggtgtaatagaaattgcgccattagcatatatgagaggtagaaccctagatgatgcatttgttatattagatgaagctcaaaatacgacacatgcacaaatgaaaatgtttcttacccgcttaggatttggatcaaaaatggttgtcactggtgatcaaactcaaatcgatttaccaaaaggtgtaaaaagtggtttgaaagaagcggtaaaaaaactaagtggtgtcagcggcataagtatcatgaaaatggatcaaagtgatgtagttagacatccacttgtaagtaaaattattaatcgttatgaaggagttgaataa

SEQ ID NO: 285 - DNA, 141 bp, Staphylococcus epidermidis
ttgataactcattacattcctcccttaaatatttctaatatatatggtaaaaaaacgattaacccaatacatattgaaacgattgaaacgatgacaacactaaacgcagctatatctttagcgtattttgcatattcatga

SEQ ID NO: 286 - DNA, 276 bp, Staphylococcus epidermidis
catttttatcaaaggaggcgaataaatatggcaaaatatacaatcgttgatatggatacatgtatagcatgcggtgcttgcggtgcagctgctccagatatatatgattacgatgatgaaggtattgcatacgtaatccttgacgataaccaaggtactactgaagtgcctgaagagttatatgaagatatggaagatgcgctagaaggttgtcctactgactcaatcaaaattgaagacgaaccatttgatggtgacgcactgaaatttgaataa

SEQ ID NO: 287 - DNA, 888 bp, Staphylococcus epidermidis
ctacggcatcaacggactctatcggtacgcaagacttttgtcttgcgtatttttatgtatataattataaagaagcatagatataatgaattggaatcaaaggagctaaagatgaaacatcaattttcaaggaatgaattagcaataggacaagaagggctgaacttactaaaaaataagactgttgcagttttaggtgttggtggcgtcgggtcatttgcagctgaggcattggctcggactaatatagggcacatcatacttatagataaagatgatgtcgatattacaaatgtgaacaggcaaattcatgcactgacttcaactattggtcaaagtaaagtcacgctaatggaagaaagaatcaaattaataaatcccgattgtaaagtaacttctttgcatatgttttataccgaggaaacatacaaagatatcttcaataattatgatattgattattttattgatgcaagcgatacaatcatttataaagttcatctcatgaaagagtgtttagaaagaggaattgagttaatttcaagtatgggtgcagcaaataagactgacccgacacgttttgaaattgcagatatttcaaaaacacatactgatcctatggctaaagtaattagaaatcgtttaaaacgccttggtattcgtaaaggtgttaaagtagtattttctgatgaaagtcctattgttattcgcgaggacgtaaaagaaacagtaggagataaaaatgcaatcaatagaaaagggcaaatgcctccatcttctaatgcatttgttccaagtgtagtaggccttatttgtgcaagctacgttgtcaacgatattttaaaagatatacctgtaaggcgaattaaagataaaggacaaaattaa

SEQ ID NO: 288 - DNA, 198 bp, Staphylococcus epidermidis
agaagtaatcaaggaggcatgagtatgtctaatttatggattatatttgcagttactgtactaatagcagtttattccgcaattgaagtatttacaaatttaaatcataaacaacaaccaagatttaaatattttactatcgcatttgttgtgtttattatcttagcgattatagaagttatatttcttgctcaatga

SEQ ID NO: 289 - DNA, 240 bp, Staphylococcus epidermidis
aaattaaatcaaaaacaaacagaacctaagataacatatatacttcaggttctgctaacaaatagggcattgatgtctaaatttagcccttttattaagatttatttaactttggtcgtaggtcctatcattgagaatttcgctcgaaaattctacggacaaaccaaattgaatttcgaagctagttcagcacatggaactctgattcgcttttgtataactatatttctgatacaataa

SEQ ID NO: 290 - DNA, 1332 bp, Staphylococcus epidermidis
ggagggtgtcaattggatataaaaatgcctaagcttggtgaaagtgtgcatgaaggtacgattgaacaatggttagtatcagtaggagatcatgtagatgagtatgaaccattatgtgaagttattacagataaagtaacagctgaagtgccttcaacaatttctggaacaataacagaattagtggttgaagaaggacaaactgtcaatattaacacggtgatttgtaaaatcgattcggaaaatggtcaaaatcaaacagaatcggcaaatgagtttaaggaagaacaaaatcagcattctcaatcaaatataaacgtgtcacaattcgaaaataatcctaaaactcatgaaagtgaggtgcatacagcctctagtcgcgcaaataacaatggacgattttcaccagttgtctttaaattagcttctgaacatgatattgatttaacacaagtcaaaggaactggttttgaaggtcgtgttactaagaaagatattcaaaatattattaacaatccaaacgatcaagaaaaagagaaagaatttaaacaaacagataaaaaagatcattcaacgaaccatggtgactttttacatcaatcctcaactaaaaacgaacactcaccatcatcaaatgaacgtgtcgtaccagttaaaggtattagaaaagctatcgcacaaaatatggttactagtgtcagcgaaataccacacggttggatgatggttgaagctgatgcaacgaatttggttcagactagaaactatcataaagctcaatttaaacagaatgagggttacaatttaactttctttgcgttttttgtaaaagctgttgcagaggctttaaaagtaaatccattactcaatagtacatggcaaggagatgaaattgttatccacaaagatattaatatctctattgctgttgcagacgatgataagttgtatgtgccagtcattaaaaatgcagatgaaaaatcaattaaaggtatcgcgcgtgaaatcaatgatttagctactaaagcaagattaggaaaattagcacaaagtgatatgcaaaacggtacatttacggttaataatactggttcttttggttctgtttcttcaatgggaatcattaatcatccacaagctgccattttacaagtagaatcagtcgttaagaaacctgtagttatagatgatatgattgcaattagaaatatggttaatttgtgtatttcaatcgatcatcgtattctcgatggtgttcaaacgggaaaatttatgaatcttgttaagaaaaaaatagaacaatattctattgaaaacacttctatttattaa

SEQ ID NO: 291 - DNA, 696 bp, Staphylococcus epidermidis
aaaataagtcatatactaaaaatgtatcatattttaattagaaaggggcttttaaatatgaagactgttttgattgtaggcgcaaatggtagagtatctatcgaagcgacaaaaattttcctagagaactcaagatttaatgttgatttatttttgagaaatgcgcatcgtatacctgattacgcctctaatagaattaaagtttatgagggagacgctaaaaatattgaggatttagaaagtgctttaaacaatgttgatgttgtttttgcaagtttatcgggatcacttgataaacaagctgaaactatcgtaaaagccatggataacaaaaatgttaagagactgatttttgtagcagctcctggtatttatgatgaactaccagaaccattcaatcaatggaataaagaacaatttggcgaaaaattgaatcgctaccgcaaagcatctgatattatagaaaattcagatttagattacacaataatacgtccaggctggcttacagataaaaatgaaaatgtatatgagatcacagcaaagaacgaaacatttaaaggtactgaagtatcacgtaaaagtgtagcatctttagcagtacaaattgccaaaaacccagaactacactctaaagaaaatattggtgtgaataaacctaatacagaaggtaataaacctgcttggttcaattag

SEQ ID NO: 292 - DNA, 1350 bp, Staphylococcus epidermidis
atattgagtcatcgttatataccattaacagaacaagataaaaatgaaatgctaaatagtattggggcaaaatctatttccgaattatttgatgatatacctacagatattttattaaaaagaaatttaaatattgccgaaagcgaagcggagacgatattacttagaaggttaaatcgtctcgcagctaaaaatacaactaaagaaacacatgcaacatttctaggtgcgggcgtttatgatcattatactccagctgttgtcgatgcaatgatttcaagatctgaattctacaccgcatatacaccttatcaacctgaaatttctcaaggtgagttacaagcaatttttgaatttcaaacactcatttgtgaattaacagatatggatgtagcaaattcttctatgtatgatggtatgactagttttgctgaagcatgtatattggcactaagtcatacaaaaaaaaataaaattgtagtttcaagtggactacattatcaagctttacaaattctacacacatacgccaaaactcgtgatgaatttgaaataattgaagttgaccttaaaggtactattactgatttagagaaattagaacaacttatcgatgacaacacagcagctgtcgctgtccaatatcccaatttttatggttctattgaagatttagaacaaattaataactatataaaggataaaaaagctttatttatcgtatatgccaatccactttctttaggattactaacacccccaggtacattcggggcagacatagtagtgggagatacacagccttttggtattcctacacaatttgggggtccgcattgtggatactttgctacaacaaagaaattaatgagaaaagtacctggtcgattagttgggcaaactcaagatgacgaaggtaatcgtggatttgttctcacgttacaagctagagaacaacatatccgccgtgataaagcaacttctaatatttgttcaaatcaagctttaaatgcacttgcatcttcaatagcaatgtcagctttaggtaaacaaggtatttatgaaattgcagttcaaaatcttaaaaatgccaattatgccaaaaataagtttgaagaacatggttttgaggtactaaaagcacaatcttttaatgaatttgtagtcaaatttaatcaaccaataaaaaatattaatcttaaattagcagaatatggatatattggtggttttgacttaggtgaagtatctgatgattttaaaaaccatatgttagtagcagttacagagttaagatctaaagatgaaatcgatgatttcgttacgaaagcaggtgagttaaatgattag

SEQ ID NO: 293 - DNA, 1416 bp, Staphylococcus epidermidis
agaaaaatccatagaaacagtacgtggcgtagggtatgtgattcgatgattaagcgccaaaaattaaaatataaatggatgcttattacgacgctcattaccttcacgacaatattacttttctgcttaattattattttctttttaaaagatactttacgaagtagtgaaattgacgaagctgaaagaagttcaaatgatatcgccaatctgttccattctaaatctttaagtgatatatctgcattggatttaaatgcatccttagaaaattttcaagaaatattgatttatgatgataagggtaggaagttaattcaaacatcaaatgataatacacttgcttatgataacaaaattgatttcaaacatcctgaacgtatacatattcaaagaagccacggtattaattacttagtaataactgaacctatacgttcgaaagatttttctggatacagtgtattagtccattctcttcaaaattatgataatctcgttaaatcactttatatagttgcacttgcttttggattaattgcaaccattattactgccggcgtgagttatatcttttcttcacaaattactaaaccgatagttacaatgtccaataaaatgaatcaaattagaagagatggttttcaaaataaacttgaattaactacaaattatgaagaaacagataatttaattgatacttttaatgaaatgatgtatcaaatagaagaatcttttaatcagcaacgtcaatttgtcgaggatgcttcacacgaattaagaacgccactgcagattattcaaggtcatctaaatttaatccaacgttgggggaaaaaagatccagcagttttggaagaatctttgaatatttcaattgaagaagtgaatcgaataacaaaacttgtcgaagaactacttttacttaccaaagatagagtcaatcataatgttttggaatgtgaaaatgtagacgtaaatagcgagattcaatcacgtgtgaagtcactgcaacacctacatccagattatacttttgaaacacatcttgctactaagcctatccaattaaaaattaaccgtcatcagtttgaacaactcttactcatatttattgataatgcaatgaaatacgacactgaacataagcacattaaaattgttactcaactaaaaaataaaatgattatgattgatattactgatcatggtatgggtataccaaaagctgacttagaatttatctttgatagattttatcgtgtagataaatcacgtgctcgtagtcaaggaggcaatggattaggactatcaatagcggaaaaaattgtgcaacttaacggtggtatgattcaggtagaaagtgaactacaaaagtacacgactttcaaaatcagttttccagtactaaactaa

SEQ ID NO: 294 - DNA, 1095 bp, Staphylococcus epidermidis
acaaaatgtctaaagaaggtgttatatgtgaagaagttgtcgataaatacatttaaatataagaggaataaatatcttactgaaatacaatcaatagacttactacagagattacaacagcttttaagtcacggattcactttatatcaaagttttaaatttttaaactcctattttaaatataaagagcgaacaataaataaaaagattatccaacatctacaaaacggtgctacatgttatgatattttaaaaataatagggtatccagaattagttcttcttcaaataaaatttgctgaaaactacggcaacattgaggaggctctcgttgatactgttcaatatatgaaaagaaatctgaaagctaaaaaacgactcatcaaaaccttacaatatcctgttgcattaatttctatcttcttattcatattaaccattttaaatataactgtcatacctcaatttcaacaactttatgagactatgaatgttaaattatcaacatttcaaaatctactaactcttattattacccgtcttcccaaactaactttcatttttatctttattagtggtatagcattttttatcacttataaattctactattatctaccaattgagaaaaagttaaaatctattttaaaaatcccaatgattaatacgtattataaaatatatagaacttatcaactttccaatcaactttctttattttacagaaatggtacaagtcttcaacaaattgtccgtatatatcgtaatgagcaagataacgattttcttaaatttctgggtgattatctttttaaagaagctaataaagggctcccgttacctgttatattaatgaatttaaaatgttttcaaaatgatttgattaaattcatagaacaaggagagaaaaatgggaaattagatatagaattaaagttatacagtcaaatgctattacagcaatttgaagaaaaagtgttaaaacaaacaaaatttatacaacctatcatcttctttatcttgggaatttttattgtatctttatacttagtcattatgcttcctatgtttgaacttatgcaaacaataaaataa

SEQ ID NO: 295 - DNA, 732 bp, Staphylococcus epidermidis
aatatgtcccaaatgatgtttgacaatttcctctcaagttctcgcgcaaaatggggtgagcgttcaggtttaacacttttcttaccacatgtttttgaaggacagggaccagagcattcatcggcacgcttagaaagatttctacaattagccgctgaaaataattcaactgtagttaatctatctagtgcaagtaattacttccatttactacgtgcacaagccgctagtttagataccttagaaatgagaccattaattgtcatgtcacctaagagtcttttaagaaataaaacagtagctaaacctattgatgagtttacatctggcggttttaaacctatcatcacagaagatatcgatgaacaaaaagtcaaaaaagtgattttagcatcaggaaagatgtatattgacctaaaagaatatttagctaaaaatcctaacgattctattcttctcatagcagtagaaagattatatccgttcccagaagaagaaattaaagaagtattaaaatcgttacctcatcttgaaaatgtgtcatgggttcaagaagaacctaaaaatcaaggtgcatggttattcgtgtatccttatctaaaagcacttgttgctaataaatatgatttaacttatcacggtagaatacaaagagctgcacctgctgaaggcgatggagaaattcataaacttgtacaaactaaaattattgaaagtagcattaacaattaa

SEQ ID NO: 296 - DNA, 150 bp, Staphylococcus epidermidis
acattttaccataattcaaagatttttataagaggcaattatacgaatatgtctccaagcattattattagtagggtaaatttaaataattctaatattaaaatgcctgggacagcattgattgtctcaggcattttgaaagtaatttaa

SEQ ID NO: 297 - DNA, 1782 bp, Staphylococcus epidermidis
aaaggaagtctaaaaatgaataaaagaacaacgtattgtggtttagtcacagaagaatttttaaacgaaaaagtaacattaaaaggttgggttcataacagacgagatttaggtggattaatttttgttgatttaagagatcgtgaaggtattgtccaaatagtttttaatcctgacttttccgaagaagcattgcaagttgctgaaacagtacgctcagaatatgtagtcgaagttgaaggtgtagtaacaaaacgtgatgctgaaactattaacccaaaaatcaaaacaggtcaagttgaggttcaagtttcaaatattgagattattaacaaatcagaaacacctccattttcaattaatgaagaaaatgtaaacgttgatgaaaatattcgattaaaatatagatatttagatttacgtagacaagaattagcgcaaacttttaaaatgagacatcaaactacgcgttctatccgtcaatacttagataataatggcttcttcgatattgaaacaccagtattaacaaaatcaacacctgagggtgcgcgagattatctagtaccttcccgtgtacacgagggtgaattttacgcgttgccacaatcaccacaattatttaaacaactattaatgataagtggttttgataaatattatcaaattgttaaatgtttccgtgatgaagacttacgtgcagatcgtcaaccagaattcactcaagttgatattgaaatgagttttgtcgatcaagaagatatcatagccatgggtgaagatatgttacgtaaggttgtaaaagatgtaaaaggaatagacgttagtggcccattcccacgtatgacatatgcagaggctatggaccgttttggttcagataaacctgacactcgtttcggtatggaacttatcaatgtgtcacagcttggtaaagaaatgaattttaaagtttttaaagatacggtagataacaacggcgaaattaaagcaattgtcgcaaaagacgctgcaaataaatatacacgtaaagacatggatgcattaacagagtttgtaaatatatatggtgcaaaaggattagcttgggttaaagttgttgatgatggtttaagtggcccaattgctagatttttcgaagatgttaatgttgaaacacttaaacagttaacagaagctaaacctggagatttagtaatgtttgtagctgataaacctaatgttgttgctcaaagtttaggggctttaagaattaaattagcaaaagaattaggtttaattgatgaatcaaaattaaatttcttatgggtaactgattggccgttattagagtatgatgaagatgcaaaacgttatgtagcagcacatcatccatttacttcacctaaaagagaagatatcgaaaagctagacactgaacctgaaaatgtacaagccaacgcttatgatattgttctaaatggttatgaacttggtggtggttctataagaatacacgatggtgaattgcaacaaaaaatgtttgaagtattaggatttactaatgaacaagctcaagaacaatttggtttcttattagatgcttttaaatacggtgctccacctcatggtggcatcgcgttaggtttagatagacttgtgatgttattaacaaatagaacaaacttgagagatacaattgcattccctaaaacagcatcagctacatgtcttttaactgacgctccaggagaagtatctgataaacaactccaagaactctcactaagaatcagacactag

SEQ ID NO: 298 - DNA, 138 bp, Staphylococcus epidermidis
aagttaaaacatttgattaaagacaaatttgacagtaaaatgaaaataaaggagagtgagtttaatgtctttaatatcaatgattatatatttcgtaatattaatggtcattccaatgtgggctcaacacaaagttaa

SEQ ID NO: 299 - DNA, 150 bp, Staphylococcus epidermidis
gaggacttgcaaaacgagaaacagggcacccacctgtatatagcaggccgaatgatcaagctatttataactacggcatcaacggactctatcggtacgcaagacttttgtcttgcgtatttttatgtatataattataaagaagcatag

SEQ ID NO: 300 - DNA, 147 bp, Staphylococcus epidermidis
agtaaacttttttcaaatttaagttttcgtaaatcaaaattttttgtttgtaatttttcaaaaaacaaaagacttaaaacatttataagacaacattttaagtcttttattaacaaaaatgaaaacaaagaaattaatataagataa

SEQ ID NO: 301 - DNA, 567 bp, Staphylococcus epidermidis
cgtaaatttaaacaaacagataacttaaggagggaatataacatggcatatgcgacactagctggaggttgtttttggtgcatggttaaacccttcacctcatatcctggaataaaatcagtcgtttccggatatagtggaggacatgtagaaaatccaacatacgaacaggtatgcacaaatcaaacaggacatgtggaagctgtacaaattgaatatgaccctaatattacaacatttgaaaatatcttagacgtttactttaaaacatttgacccaactgatgacggagggcagttctttgatagaggtgaaagctatcaacctgtcattttttatcatgatgagaatcaactcaaagctgccgagttaaagaaacaacaaattgacgaagagggtatctttaaaaaacctgttatcacaccgataaaaccatataaaaatttctatcctgcagaagaatatcatcaagattactacaaaaagaatcctacgcattatgaacaataccaacgtggatctggtagaaaagcatttatcgaatcacactggggaggctcaaaatga

SEQ ID NO: 302 - DNA, 144 bp, Staphylococcus epidermidis
aatcgatttaatccctttaaagtaaccacttataaaagtgaaaactttgaagggatttttcatttactttttttatcattaaataccaacttaatgacattagtaactataaacgttataatgttaagtgaacgaaatgggtga

SEQ ID NO: 303 - DNA, 168 bp, Staphylococcus epidermidis
gaacttattaaaaaaaagaaacttatagctgaaataaacattaataatagtattataatattaagcctttttatcataattagtaacaaaagagttaatattaaggagatagagattactttgaattttatccaaagtacccctaccaaaaaagcaagagcaatgtaa

SEQ ID NO: 304 - DNA, 1461 bp, Staphylococcus epidermidis
atgaatattaataaactttattggaaggctttatactactggattaggtatcttaattataatgtaatttatcgtgataaagaggacgatgaaatatggttgtctcataagagaaaacattcaattgttgtatttagaaaagatgtcacatctacccaagagattaggtttgataaatcaaaaattatggaacgacctgaagaaatacaacaattcatcggttatatacctgaatcttatgaattttattattttacggataaagagctttcaaaagaaaatttaaatgaagaaaaaccaattaaactgaaatttaaaattataagcaatgagcaaagcttaaattcactccctataaactttttacttttaaaaatgctaattaataatgaagataaaaggacttaccttcattacaaaagaaaagttttaacacaaaatcttgttgataaacatatgcaacgttttacccctattacatatacacttatcttaattaatattgtgatatggttatgtatgattttatacttaaatcgattttctgatgttaaactattagaagtaggtggacttgttcattttaatgttgttcacggagaatggtatagacttatttcgtcaatgtctttacattttaatttcgaacacattttaatgaatatgctctctctatttatttttggtaaaattgtcgaatcaatcattggatcatggcgaatgctaataatttatataatatccggattatatggaaattttgtttctctatcatttaatacgactacaatttcagtcggtgctagtggagcaatatttggtctaattggttctatttttgtgattatgtatttaagcaagaattttaataaaaaaatgattggccagttattaattgctttggttgttttaatcgttttttcactttttatgtctaatattaatataatggcacatttaggtggatttatcagtggtgtattaattacattaataggctattatttcaaaacacaacgctctttattttggtcatttttgattgtatttttacttatattcatcattttacaaattagaatatttactataagtgaggataatatctatgataaattaattcgggatgaaatgattaaaggtaattatagcgaagcaaaaaatgttgtaaaacaaacacttaataataattacgccgatgatgaaacatattaccttagtggtttgattactgcaactaagagttcgcaagcagaggccgtatcagaatgggaaagaggtttaagaaaatttccaaattcaggtgtacttaattatgaattagctatagctaatcgttctttaagtgatgataaaaaggctttaaaatatataaaaaaagctgtagcaattaatcctaataataaaaaatatgttaatttaaaaaaagagttgagtaaatctaatgacacgaaaaattaa

SEQ ID NO: 305 - DNA, 441 bp, Staphylococcus epidermidis
atggatattaaaaaaattgaggaagtcattaaattggtaaaagctaatgatgtaaaaaaatttaagtataaggactctcataatgaaatagaacttgattttactaatggagcatctcaacaacattcgcaacaatcatctcaagatattcaacaagagaatattaaatccttagatgaaaagcaagagtccatatcaaatgaccagcaagagattaaatctcctatggttggaacatttttcttacaagatagtaaagaactaacagaacctaagattaaagttggcgatactgtaactgaaggagatattatcggttacattgaagctatgaaagttatgaatgaagtaactacggatgttactggtgaggtcactgaaatattagtagaacatggagacaatgttgaatatgatcagctactagtcagagttaaatag

SEQ ID NO: 306 - DNA, 369 bp, Staphylococcus epidermidis
ctagaaattaatatgaaacgttttaaatatgcatatgagggtttttgcgcaattttaaaaaaagaccaaaatttcttattacacattttagcggccataattattatcatattaggatttgtgttaaatattgatcgtatagattggatattaatcatcgtagctataggacttgttttaagttttgaagctattaatacctcaattgaatttgttgttgacctaattacaactgactatcatgaatatgcaaaatacgctaaagatatagctgcgtttagtgttgtcatcgtttcaatcgtttcaatatgtattgggttaatcgtttttttaccatatatattagaaatatttaagggaggaatgtaa

SEQ ID NO: 307 - DNA, 558 bp, Staphylococcus epidermidis
aatcattataaaggtaaaggtgaaaagatagtgggaatcataaaaaaattatttatgccaaatgcatatgtgaaatcaatatttgaaattgatatagaaaaacttgccgatagtggtgttaaaggtatcataactgatttagataatacacttgttggttgggatgttaaagaacctactaagggtgttaaatcatggtttgctaaggctaaagatttaggaataactgtcacaattgtgtcaaataataataaaagtcgagtatcaagtttctcaagtaatttaggtgtagattatatattcaaagcacgtaaaccgatggggaaagcctttaagatggctattaaaaaaatgaaaattcaaccgagagaaaccgttgttgtaggagatcaaatgcttactgatgtgtttggtggcaattgtaatggtttatatacaattatggtagtacctgttaaacggactgatggattaattacaaagtttaatcgattaattgaaagacgattattaaatcattttagaaaaaaaggttatattaaatgggaggaaaattga

SEQ ID NO: 308 - DNA, 168 bp, Staphylococcus epidermidis
attgtctataactatatcataacaagtagatttataagcaacaaagaatatgctttcaaaaaagttttaattattaaattattttcccgactcacacgacaattaaacaaaattgttaatgtgaatcttgttaatatttttctaaacctactaattgatatactataa

SEQ ID NO: 309 - DNA, 138 bp, Staphylococcus epidermidis
tcgcagcataatctgcgtatacttccatgtttggacactccttgtcaaattatcaatgttcctataatagcaccattatttgtttatttctacttttctgttttaccaatgaaaaaatttatgtcatttaaattttaa

SEQ ID NO: 310 - DNA, 1683 bp, Staphylococcus epidermidis
ttttttaataacataggaggagatattatgaaaagaaattggtggaaagaagcagttgcatatcaagtatatccacgaagttttaatgatagtaatggagatggaataggtgatctacctggattaattgaaaaattagattatctagaaaatttaggaatagatgtcatttggttaagcccaatgtatccatcaccaaacgatgataatggatatgatattagtgactacaaaggcattatgagtgaatttggtacaatgaacgattttgatcaattgttatcaagcatacatcaaagagggatgaaattaatattagacttagtggttaatcacacatcagatgaacacccttggtttattgaatcaaaatctagtaaaacaaatgcaaaaagagattggtatatttgggcagatcctaaaccggatggatctgaacctaataactgggaaagtatctttaatggttcaacttgggagtttgacgaatcgactaagcaatactatttccatttatttagcaaaaagcagccagatttaaattgggaaaatccagatgtaagacaagctgtgtttgaaatgatgaattggtggtttgaaaaaggtattgacggatttagagttgatgccattactcatattaaaaagaattttgaagcaggagatttacctgtacctgatggcaaaaaatttgctccagcatttgatgtagatatgaatcagccaggaatacaagaatggctccaagaaatgaaagataaatcgttaagtcggtatgacattatgactgtaggcgaggctaatggtgttactcctaatgatgctgaagaatgggtaggagaagaaaatgggaaatttaatatgatattccagtttgaacatcttggtttatggagtactggcgatacgaaattcgatgttaaatcctataaacaagtcttaaatcgttggcaaaagcaactagaaaatgtaggttggaatgctttatttatcgaaaaccatgatcaaccacgtcgtgtttcaacctggggtgatgataaaaattattggtatgaatcagcaactagtcacgctactgcctactttttacaacagggcacaccttttatttaccaaggtcaagaaataggtatgactaattatccatttgaaagcattgaaagtttcaacgatgtcgcagtgaaaactgaatatcaaatagtcaaaaaagaaggtggagatgtcaatcaattactagataaatataaaatggaaaaccgagacaatgcaaggactccaatgcaatggaataattctatcaatgctggattcactactggtaagccatggtttcatgtaaaccctaactatacagaaattaatgttaaacaacaactaaatgataagttttcgatactttcttattataaagcgttaattcaactaaaaaaatctgatttgatttacacctacggtaagtttaatatggtcgatgctgaaaataagcaggtttttgcatatacacgcacatttaaaaacaatactgtattaattgtagccaatctcacaaatgaagtatcagaactaaacctaccttttgaattagatatttcatctgtagatataaaattgcataattatcacttaaatgatataaatttagaccatattaaaccttatgaatcattcgtcgttgaaatataa

SEQ ID NO: 311 - DNA, 132 bp, Staphylococcus epidermidis
gctcataataatatgaggaataaaaatgaaaaagatatatcaaaattggtaataaacatagtattacttctctatcgaggggacttggttaaaaataagtttatttacatagttctcaatggtcaaaaataa

SEQ ID NO: 312 - DNA, 1056 bp, Staphylococcus epidermidis
ttacataataatacaataaggagtgtatatatgcatatttctatagtaggtatcacaggctatacaggactagaattgttaagattagcacttaatcaccctcatgtaacagtttcatcgattcatgctacaaaagaagtgggagtgcaaatttctgatatattccctcatttgaaaggtatttttgataaagaaattcaggttttcgacagtgaatttattatgacacattcagatttggtattttttgctactccgagtggcgttgcaaaagatttatccaaaaatttcgttaaaaataattttcctgttatagacttatcaggtgaccatcgtttatctccagatgtttatctcaaatggtataaaaaatcaccgtgtactgttgatatacaaaagcgttttacatatggtctctcagaagtaatgaatattagtcatcgcaatagatttattgctaaccctggttgttatgcaactgcaactgaattagcgctatatcccttaatcagcaatcatttaatccgtgttgattctataattgttgatgctaaaagtggtcttactggagctggtaaaaaattaaatcagtcatcgcattacgtaaatgtaaacaataattatgtgacgtataaacttaataaacatcaacatattcctgaaattgtacaaacgttgcagttttttaacaaaagtttacagaatattcagttttcgacatcgcttattccggttaatagaggtattgttgcaactatatacacacggcttgaaaacggagttaaaataaatcaaatagaatctacctacaaggatgtatataaaaataagcctttcataagaattaaagatggattaccacagttaaatgaagtaataggaacaaattacactgatattggttttgtttataacgaaaccacgggtgttttaacaatttcatcagttattgataatttaattaaaggtgccgctggacaagcaattcaaaacatgaatctgatgtttaatttcgacgaaactgatggtttaattttggcgcctttatatatctaa

SEQ ID NO: 313 - DNA, 696 bp, Staphylococcus epidermidis
agaggtgataagatgaatattggcattatcattttcatcatatctgtgataattacaggtgttagcgcattacgagataaaagtcacgaggacagacaaaatcaaagacccaatcaaaaaacctcaaacgagcaacatcaagaaggtggtttctttgaaaaattagaaaaaacttttcaagaaattagtgacgaattaaatgatgaacctgaaaaaaaacagagtaaaccttttgaaacttcattaccaccactgaacgaagattggaatgaaaatgaaaagaaaaaaacatcacatcataaagaaaaacaaaatacttcacaatccaaacgtcaaacaacgtctactcatgaacatcaaaatatccctcagccagataaaacaacatcaagagatgataattatgaaaaacttaagcaagaacttgaacaagatgtaactaaaaatttaattgacgtacgtaaagaaattgataaagaaaaagaaaagcaacttgttatgattgagaggaaagctcaagacattatcaacgataaatatctttcagaaagaacaaaacgatatagaataaaacaactactaaattctaggaatgttgagaaaaacatgtcgcgctctgcttttcaatatgatagtgatgaagttattaatggtattatttggtcagaaattttaaataaaccaaaacagctttaa

SEQ ID NO: 314 - DNA, 1509 bp, Staphylococcus epidermidis
atgattagtaaatcaagtcctttaatatttgaaagatccaaaaaagatagatatgcgtattcattaccacaaaatgacattgagaatatcagtattgcttcactcttagatgataagtatattcgtaaacataaggctgaatttcccgaggtttcagaattagatttagttagacattataccgaactatcaaataaaaatttcggggtagatactggattttacccattaggttcttgtacgatgaaatataatcctaaaatcaatgaaaaggtagcgcgtatttctggttttagtgaatctcatcctttacaagaagaagaacacgttcaaggttctcttgaaattatatatagtttacaagaagaattgaaggaaattactggtatggatgaagttaccctacaacctgctgcaggtgcacatggtgagtggactgctttaatgattttcaaagcttatcatgaaaaaaatggacaaagccatcgtgatgaagtaatagtgcctgattcagcacatggtactaatcctgcttctgcctcatttgctggatttaaatcagtaactgtaaaatctaatcaacgtggggaagttgacatagaagatttaaaaagagtagtaaacgataatacagctgcaatcatgttaactaatccaaatacattaggtatatttgaacagaatattattgaaatagggaaaatcgttcatgaagcaggaggtttattatattacgatggagcaaatttaaatgctattttagataaagtacgtcctggtgatatgggctttgatgcggtacatcttaatttgcacaaaacattcactggtcctcatggcggtggtggaccaggatcaggaccagttggagtagtagagaaattagccagttatctacctaagcctatggttataaaagataacgataggtataaatatgataatgatattccaaattcaattggacgagtaaaaccgttttatggaaatttcggcatttatttaagagcatatacttatatcagatcaatgggagccaatggtttaaaagaagtatctgaagctgccgttcttaatgcgaattatataaaatctcgccttaaaaatcactttgaaattccgttcaatcaatattgtaaacatgaatttgtattaagtggaactttacaaaaacaatatggtgtcagaacattagatatggctaagcgactgttagattttggtgtgcatccacctacaatatattttcctctcaatgtcgaagaaggaatgatgattgagccaacagaaactgaatctaaagaaacacttgattactttattgatgcgatgattcaaatcgctgacgaaacaaaaaatgatccagataaagttttagaagcaccacatacgactataattgatcgattagatgagaccactgcagcacgaaaaccaattcttaaatttgaagaacttaaggacgaaaagtataaagaacacacaaatattgattctgaagataattaa

SEQ ID NO: 315 - DNA, 240 bp, Staphylococcus epidermidis
tgtgacagtaagctaatggttaagaattattcattttatcaatttattatgaccgtgcgcggaagaaaagacgataaaggtgtttttgctgagcaaatttttgaagaccttgcctttccaaaacacgaagatgattttaatacattatctgaatatattgagacacatagcgaattcaccctaccaatgtctgtatttgatgacttatatgatgactatacagaatggttgaagttttaa

SEQ ID NO: 316 - DNA, 1272 bp, Staphylococcus epidermidis
tattcaatccttatagggggtcaaaagatgggggaaaatacaaaacaagatttcaatcaaaaaggacaaaattttaaattcacaaaaaaacatagacgattattatatggttcagtttttttaatggctacatcagctattggtccagcatttctgactcaaactgcagtgtttactgcacaattttatgctagttttgcatttgcaatattaatttctattattatagatataggcgctcaaataaatatttggagaatattagtggtaactggattacgtggacaagaaatatctaataaagtattacctggacttggtactattatctccatactaattgcatttggtggtctcgcatttaacataggtaatattgctggtgcaggtttaggtttaaatgcaatgtttggtcttgatgtaaaatggggtgctgcaataacagctatttttgcgatacttatctttgttagtagaagtggtcagaaaataatggatgttattagtatgattctaggtatcgtaatgattttagtagtcgcttatgtcatggttgtttcaaatcccccttatggagatgcattagtacatacatttgcacctgaacatcctttcaaacttatattacctataattacattagttggtggtacagtagggggttatattacttttgcaggtgcacatagaattctagattctggtataaaaggtaagtcataccttcctttcgtaaatcgatctgctgtagcaggtattttaacaactggtgtcatgcgcaccttattgtttttagctgtactaggtgttgttgtaactggcgttacgcttagttcagaaaatccaccagcatcagttttccaacatgcattaggtcctataggtaaaaatatttttggcgtagtaatatttgcagcagcaatgtcctcagtaattggttctgcatatacaagcgcaacatttttaaaaacactacacaaatcgttactcaataaaaataatcttatcgttattacatttattgtaatttcaacttttgttttcttatttattggtaaaccggtgagtttacttataatagctggtgcgattaatggttggattctaccaatcacattaggtgcaattctcattgcaagtaggaaaaaatctatcgttggtaattaccaacacccaacatggatgcttgtttttggtattatagccgtaattgtcacaataatgactggtatcttttcattacaagatttagcaagtctttggaaaggttaa

SEQ ID NO: 317 - DNA, 849 bp, Staphylococcus epidermidis
atagaattcaaaattgaaggagttgagttgaatatgaaacttgtattttatggtgctggtaatatggcgcaggcaatttttactggaattattaattccaacaatttaaatgcaaatgatatttatttaactaataaatccaatgaacaagcattaaaaagctttgcagaaaaattaggggttaattatagttatgatgatgaagcattactcaaagatgccgattatgtatttttaggtacaaagccccatgattttgaaaatttagctaatcgtattagagaacacattactaatgataataggtttatttctataatggcaggtttatctattgattatattcgtcagcagcttaataccaataatccattagctcgtattatgccaaatacaaatgctcaagttggacattcggttactggaataagtttttcaaataattttgatcctaaatctaaaaatgaagtggatgaattaatcaatgcatttggatcagttatagaagtctccgaagaacatctacatcaagttactgcaattacaggaagtgggtctgcatttttatatcatgtatttgaacaatatgtaaaagcaggtacagaattaggtttagaacgaaatcaagtcgaagaatctatacgcaatttaattattggaacaagtaaaatgattgagcgttcagacttaagtatgtctcaattaaggaaaaatattacatctaaaggtggtactacacaagctggacttgatgcactatctcaatatgatattgtatcgatgtttgaagattgtttaggtgcagctgtgaatagaagtatggaattatcacataaagaagatgaataa

SEQ ID NO: 318 - DNA, 2694 bp, Staphylococcus epidermidis
ataatactcaactatgactatctaactgcgataacaaaaacgtatgaaggagagtttttatttatgaaaaaaatgaaagctagtgaaattaggcaaaaatatttgaatttctttgtagaaaaaggacatatgattgaaccgtctgcaccacttgtacctatcgatgatgattcattattgtggatcaattctggtgtagctaccttgaaaaaatactttgacggacgcgaaactcctaaaaaaccaagaattgtcaattctcaaaaagctatacgaacaaacgatatagaaaacgtcggttttactgctcgccatcatactttttttgagatgctaggtaatttttcaatcggtgactactttaaacatgaagcgattgaatttgcttgggaatttctaacaagtgataaatggatgggcatggaacctgagaagctatatgtgactattcatcctgaagatactgaagcttttagaatttggcatgaagacattggtttagaggaaagtcgcatcattcgaatagaaggcaatttttgggatatcggggaaggaccatctggaccaaatacagaaattttctatgatcgtggatcggcttatggaaaagatgatcctgctgaagaaatgtatcctggtggtgaaaatgaaagatatttagaagtttggaatctagtgtttagtgagtttaatcacaataaagacaatacttacacaccactaccaaataaaaatattgatactggcatgggattagaacgtatgacgtctatctcacaaaatgtaagaacaaattatgaaacagacttatttatgcctataattaaggaagtagaacatgtttcaggaaaaaaatatttaattgatgatgcacaagatgttgcatttaaagttatcgcagaccacattagaacgatttctttcgcaattgctgatggcgcattaccagctaatgagggtagaggatatgtattaagaagattattacgcagagcagttcgctttagccaatcattaggaattaatgaaccatttatgtataaacttgttgatatagtcgctgatatcatggaaccatattatccaaatgtcaaagacaaatccaactttattaaacgtgtcattaaatcagaggaagaacgcttccatgaaacgcttgaggaaggtcttacgattttaaatgaactgataaaagaagcgaagaatagtgatcaggttattaaaggtcatgatgcttttaagttatatgatacttatggattcccaatagaattaactgaagaattagcaactcaagaaaatttgtctgttgatatgcctacttttgaacaggaaatgcaacaacagagagatcgagctagacaagctcgacagaattctcaatcaatgcaagttcaaagtgaagtactaaaaaatattcaagatgaaagtcaatttgttggctatgaaactacggactatcaatcattaataactcatatcatatacaatggtgaagaagttaaacatgttgaagcaggagaaacaatttactttattttaagagaaacgcctttctatgcagtaagtggtggacaggtcgcagataagggaacagttggtaatgagagctttgaaataaatgtaactgacgtaactaaagcgcctaatggccaaaacttacacaaaggtattgtgcaatttggtgaagcaacacagaacgcgaaagtagaagcacgtgttaacaaagaggatagacgacttattcaaaaaaatcatagtgctacacatttattacatgctgcattaaaagaagtattaggagatcatgttaatcaggctggttcgttagtagaacctgaaagactacgttttgatttctcacattttggtcctatgacacaagaagaaattaatttagtagaacgtagagtaaatgaagaaatttggagagctatcgacgtccgtattcaagaaatgagtattgaagaagccaaatcaataggcgctatggctttatttggtgaaaaatatggagatattgttcgcgttgtcaatatggcaccattttcaatagaattgtgcggtggaatacatgtgaataatactgcggaaattggtctctttaagattgtgagtgaatctggaacaggtgccggtgttagaagaattgaagctttaacaggtaaaggtgcattcttacatcttgaagaaattgaaacacagtttaataatattaaaaatcatttaaaagttaaatccgataaccaagtagttgaaaaagttaaacaacttcaagaagaagaaaaaggactgcttaaacaattagaacaacgcaacaaagaaataacatcactaaagatggggaacattgaagaacaggttgagttgattaataatttgaaagttttagcaacagaagtagaaattccaaatccaaaagcgatacgttcaactatggatgactttaaatctaaacttcaagatactattatagtgttagtcggacaagttgatggaaaggtttctgtaattgctacagtaccaaaatcacttacaaatcaagtaaaagctggagatcttatcaaaaacatgacaccaattattggtggaaaaggtggaggtcgtcctgatatggctcaaggtggcggaactcaacctgaaaaaataacagaagcattacgctttattaaagattacattaaaaatctataa

SEQ ID NO: 319 - DNA, 366 bp, Staphylococcus epidermidis
agaatggtcaatgtagcagattattctcaatctaatttaggaaaaattgaaatagcaccagaagtattatctgttatcgcatccattgcgacatcagaagtagaaggtattacaggccattttgctgaactaaaaaaaacaaatctagagaagattagtcgaaaaaatttaaacagagatttaaaaatcgaagctaaagaagacggaatatacattgatgtattttgttctttaaaacatggcgtaaatatttctaaaactgcaaatcaaattcaatcagcaattttcaattcaattacgacaatgacagctattgaaccacagcaaattaatattcacatcagaagtatcgtcgcagaaaaataa

SEQ ID NO: 320 - DNA, 138 bp, Staphylococcus epidermidis
attttatccaaagtacccctaccaaaaaagcaagagcaatgtaaaacattggttattcttgagtcagatattgagcaacatattcaggtgaaaacggaatttttttatattcaattcctgattgcttcaataatttaa

SEQ ID NO: 321 - DNA, 195 bp, Staphylococcus epidermidis
cataaggccaagatttgcgccgaagtttacaggagcctctgtaaattctttcttgttcttagtcatttaacaccctccacaaaaatgatgaaacgcttacatggttatcatagcattatttcatatattgttaaagtacatttacctattattatacaaaataggagcaagacagaatttactccaaattcatag

SEQ ID NO: 322 - DNA, 498 bp, Staphylococcus epidermidis
aagaaggacaaaaaacatgtaaatccggtcagacaattagtattgcaaatggagaagcagttgccaattaaaaacattaaagcatttagtttagtcgagatgatttttactttatttattatcagttgcttgttgataacaactttatggtcacgaagcctgttcgacattcagctaattgatgaagaatatgaaattaaacaattaataacaaaatttaattactataaatctaaagctattagcaacaacgaatcaataactttattattttttaataattcaaatagagtacaagtaattgaagaaaatggagataaatatagttttaaacttaataaaggcaaagtgattaatatagctaaaattcaaacattaaattttgataaaaatggaaatataaatcattttggatcgctcattttacaatataattcacatgcttatagattaatcttccatattgaaaaggggcgtttgagatttgtcaaaatataa

SEQ ID NO: 323 - DNA, 399 bp, Staphylococcus epidermidis
ggaggatgcaagatgagtatctctttgtacattgcaattggtattattgttattatcattgcatatatgattatccaacaaattcttaataagcgagctgtaaatgaattagaccaaaatgaattccataaaggtttaagaaaagctcaagttattgatgtgagggaaaaagtggattatgattatggacatattaatggtgcacgtaatattcctatcacagtatttaagcaacgatatcaaggactaagaaatgaccaacctatttatttatgtgatgctaatggtatagcaagttatcgtgctgcacgtatattaagaaaaaatggatataaaaatatttacatgcttaaaggcggttacaaaaaatggacaggtaaaataaaatctaaaaagtaa

SEQ ID NO: 324 - DNA, 957 bp, Staphylococcus epidermidis
tggattagcaatatctataaaaggagaatgactatggttgaattattagttactcctaagtcaataactcatatggaaacactaatagataaaggtgcagacgcatttgttattggtgaacaaaaatttggtttaagactgccgggagaatttaatcgtgatgctatgcaagaagctgtagcattagcccataaaaataacaaaaaagtatacgctgctgtgaatggtattttccataattaccacttagatgccttggaagactatattaactttttacatgatattcaagtagatcgcattatatttggtgatccagctgtcgttatgtatgttaaacaacacgagcatccaattccattaaattgggatgctgaaactcttgtaacgaattattttcagtgtaattactgggggaaaaaaggtgcaaatagagcagttttagctcgagaacttagtttagatgaaataattcatattaaagagcatgctgatgtagagatagaagttcaagttcatggtatgacttgtatgtttcaatccaaaagaatgctattaggaaattattatactttccaagagcgacaaatgaagatagaacgccaacatgatcatggagacttattattatatgatgaagaaagagataataaatatccagtttttgaagattataatggtactcacatcatgtctccaaatgatatctgtttaatagaagaattagagcctttttttgaggcaggaatagatgcgtttaagatagatggtattttacaaagtgaagaatatataaatgtagtcacagagcaatatcgagaagctatagatttatttaatgaagatccggatgcatatgaagatgaaaaattcatgctcgttgatcctatagaagaaatacaacctgaacatcgtccattcgacgaaggtttcttgtataaacaaacagtatattaa

SEQ ID NO: 325 - DNA, 1035 bp, Staphylococcus epidermidis
tggtcaagcaattcatgtatagttggaggtaaaaaaatgatagattacaagtcagcaggccttacagaagaagacctcaaaaaaatatataaatggatggacttaggaagaaaaacagacgaaaggctatggttactcaatcgtgcaggtaaaattccatttgttgtcagtggtcaagggcaggaagcaactcaaattggtatggcatatgcaatgcaaaaaggtgatatctcatcaccttattatcgtgatttagcatttgtcacttatatgggaatttctccattggatactatgttatcagcttttggaaaacgtgatgacattaactcaggaggtaaacaaatgccttctcattttagtcacaaagaaaaaggcattttatctcaaagttctccagtagccactcaaataccacattctgtcggtgctgcattagcacttaaaatggataacaagccaaatattgctaccgcaacagttggagaaggcagttcaaatcaaggtgactttcacgaaggtatgaactttgctgcagttcacaaattacctttcgtctgtgtaataattaacaataaatatgcgatatctgtaccagattcactacaatatgctgctgaaaagttatcagatcgtgcattaggttacggtatgcatggaatacaggtagatggaaatgacccaattgcagtatacaaagcgatgaaagaagcaagagaacgagcgctagcaggtgaaggtccaacattgatagaagctgtcacttcacgtatgacaccacattcatctgatgatgatgatacatatcgtacaaaagaagaaagagacctattgaaacaagaggattgtaatataaaatttaaaacggccttactcgatcaaggcatcataaacgaaaattggttgagtcaattggaaaaagagcataaagaactcattaatgaagctactaaatctgctgaagcagcaccatatccttcagaagaagaagctttgacatatgtttatgaagagggaggtcaacgaaatgactaa

SEQ ID NO: 326 - DNA, 30612 bp, Staphylococcus epidermidis
atgaagagcaaaccgaaattaaacggtcggaacatctgctcttttttattgagcaaatgtatgagttattcattgtcaaaattatcaacattaaaaacgtataattttcaaatcacatcaaacaacaaagaaaaaacatcaagaataggagtggcaatagctttgaataatcgtgataaattacaaaaatttagtattcgaaaatacgcaattggaacattttctactgtgattgcaacacttgtgttcatgggtatcaatacaaaccatgcaagtgccgacgagttgaatcaaaatcaaaagttaattaaacaattaaatcaaacagatgatgatgattcgaatacgcatagtcaagaaatcgaaaataacaaacaaaattctagtgggaagactgaatcattacgttcatcaactagtcaaaatcaagcaaatgcacgactgtcggatcaattcaaagacactaatgaaacatcgcaacaattacctacaaatgtttcggatgatagtatcaatcaatcgcatagtgaagcaaatatgaataacgaaccattgaaagttgataatagtactatgcaagcacatagtaaaatagtaagcgatagcgatgggaatgcttctgaaaataaacatcataaactaacagaaaatgtacttgcagaaagccgagcaagtaaaaatgacaaagagaaagagaatctacaagagaaagataaatcgcagcaagtacatccaccattagataaaaatgcattacaagctttttttgacgcatcatatcacaattacagaatgattgatagagatcgtgcggatgcaacagaatatcaaaaagtcaaatctacttttgactacgtcaatgacttactaggtaataatcaaaatattccttcagaacagcttgtttcggcatatcaacaattagagaaagcattagaacttgcacgtacgttaccacaacaatctactacagaaaaacgtggtagaagaagtacgagaagtgttgttgagaatcgttcatcaagaagcgattacttagatgctagaactgaatattatgtttcaaaagacgatgatgattctggtttccctcctggtactttcttccatgcttcaaatagaagatggccttataatttaccaagatctaggaacatcttacgtgcttctgatgtacaaggtaatgcttatatcactacaaaacgacttaaagatggatatcaatgggatattttatttaatagtaatcataaagggcatgaatatatgtactattggtttggacttccaagtgatcaaacaccaactggtccagtaactttcactattatcaaccgtgatggttcaagtacatctactggtggcgttggatttggatcaggtgcaccactacctcaattttggagatcagcaggtgctattaattctagcgtagcgaatgattttaaacatggctccgctacaaattatgcattttatgatggtgttaataatttttctgactttgctagagggggagaattatacttcgacagagaaggcgctacacaaactaataaatattatggcgatgaaaacttcgcattgctaaatagtgagaaaccagatcaaataagaggattagatacaatatatagttttaaaggtagtggtgatgtaagttatcgtatttcatttaaaactcaaggagctccaactgcaagattgtattatgctgctggcgcgcgttctggtgaatataaacaagcaacgaactataaccaactctatgtcgaaccttataagaattatcgaaatcgagtacagtcaaatgtccaagttaaaaatcgtacacttcatttaaaaagaacaatcagacaattcgatcctacattacagagaactactgatgttcctattttggatagtgacggttccggaagtattgattcggtatacgacccattaagttatgtaaagaatgtgactggtacagtcctaggtatttatccatcttatcttccttataatcaggaaagatggcagggagctaatgcaatgaatgcctatcaaattgaagaacttttttcacaagaaaatcttcaaaatgcagcacgttcaggccgtccaattcaatttcttgtaggttttgatgttgaagatagccatcataaccctgaaactcttttaccagtaaatttatatgtaaaacctgagttaaaacatacaattgagttatatcacgataatgaaaaacaagatagaaaggaattttcagtatcgaaacgagcgggccatggtgttttccaagtaatgagtggaacgcttcataacactgtaggatcaggaatattaccttatcaacaagagatacgtatcaaacttactagtaatgaaccaattaaagatagtgaatggtctattacaggatatcctaacacgcttacattacaaaacgctgtgggtagaacaaataatgctactgaaaaaaacttagctcttgttggtcatattgatccaggaaattatttcatcactgttaagtttggtgataaagtagaacaatttgaaattagatcaaaaccaactccaccaagaatcattacaactgctaatgaattacgtggaaatcctaaccataagcctgaaataagagtaacagatataccaaatgatactactgctaaaatcaaacttgtgatgggcggaaccgatggcgatcatgatccagaaataaatccatatactgtccctgaaaactacacagtagttgcagaagcataccatgataatgatccaagtaaaaatggggtcttaacattccgttcatcagactaccttaaagatctaccattaagcggtgaattaaaggcaattgtttattacaatcaatatgtacaatcaaactttagtaatagcgttccgtttagtagcgatacaacaccacctacaattaatgaaccggcaggactagttcataagtattacaggggagatcatgtagaaattactcttccagtcactgataatactggcggttcaggtttaagagatgtaaacgtcaatttacctcaaggttggacaaaaacctttacaatcaatcctaataataatactgagggtacgcttaagttaattggtaatatacctagtaatgaagcatataatacgacatatcatttcaatattactgcaaccgataattctggaaatacaacaaatccagctaaaacctttattttaaatgttggtaagttggctgatgatttaaatccagtcggattatctagagatcaactacaattagtgacagacccttcttcattatctaattccgaacgagaagaggtaaaaagaaaaataagtgaagcaaatgctaatataagatcatatttattacaaaataacccaatactcgctggagtaaacggcgatgttacattttattatagagatggttctgtagatgttattgatgctgaaaatgtaatcacatatgagcccgaaagaaaatccattttcagtgaaaatggtaatacaaataaaaaagaagcagtaatcactattgctagaggacaaaactataccattggtccaaacttaagaaaatatttctcattaagtaatggttcggatttacctaatagagatttcacctctatatcagctattggatctttaccttcatcgagtgaaattagtcgactcaatgttggaaattataactatagagttaatgctaaaaatgcttatcataagactcaacaagaacttaatttaaaacttaaaatagtagaggttaatgcacctactggtaataatcgtgtatatagagttagtacttataatttaactaatgatgaaatcaataaaatcaaacaagcatttaaagcagctaattctggacttaatttaaacgataacgatatcactgtttcgaataactttgaccatagaaatgttagtagtgtgacagtaactatacgtaagggcgatttgataaaagagttttcatcaaatctcaataatatgaatttcttacgttgggttaatataagggatgattataccatttcgtggacttctagtaagattcaaggtagaaatacagatggtggattagaatggtcaccagatcataaatcacttatttataaatatgatgcaacattaggtagacaaataaatactaatgacgtgttaactttacttcaagcaacagctaaaaactcaaatttacgttcaaatatcaatagtaatgaaaaacagttagcagaacgagggtctaatgggtattctaaatctataattagagatgatggcgagaaatcttatttacttaactcaaatcctattcaagtattagacttagtagaaccagataatggttacggtggacgtcaagtcagtcattctaacgttatatataatgaaaaaaattcttctatcgtaaatggtcaagttccagaagctaatggggcatccgcttttaatattgataaagttgttaaagctaatgcggcaaataatggtattatgggtgttatctataaggcacaattatacttagcaccatacagtccaaaaggttacattgaaaaattaggccaaaatttaagcaataccaataacgtgattaatgtttattttgtgccttctgataaagtaaatcctagtataactgtaggtaattacgaccatcatacggtatattctggtgaaacatttaaaaatactatcaatgtaaatgataattatggattaaatacagtagcttctacaagtgatagtgcaattactatgaccagaaacaacaacgagttagtaggtcaggctcctaatgttactaatagcataaataaaattgtaaaagttaaagccacagataaaagtggaaatgaaagtattgtttctttcacagtaaatataaaaccattaaacgagaaatatagaataacaacttcatcaagtaatcaaacaccagtgagaattagtaatattcaaaacaatgctaacctttcaattgaagatcaaaatagagtaaaatcttcactcagcatgactaaaattttaggtacaagaaattatgtcaatgagtcaaataatgacgttcgtagtcaagttgtaagtaaagtaaatagaagtgggaacaatgctacagttaatgttacaactacattttctgatggtacaactaatacaataaccgttccagttaaacatgtgttattagaagttgtacctactactagaacaacagtaagaggacaacaatttccaaccggcaaaggaacttccccaaatgatttctttagtttaagaacgggaggtccagttgatgcgagaatagtttgggttaataatcagggacccgatataaatagtaatcaaattggtagagatttaacattacacgctgaaatattctttgatggtgaaacaacaccaattagaaaagatactacttacaaacttagtcaatctattccaaagcaaatatatgaaacaactatcaatggtcgatttaattcatcaggtgatgcatatccaggaaattttgttcaagcagtaaatcaatattggccagaacatatggacttcagatgggcccaaggatcaggcacaccaagttctcgtaatgcaggttcatttactaaaacagttacggtagtttatcaaaacggccaaactgaaaacgttaatgtactattcaaagtcaaaccaaataaacctgttattgatagtaatagtgtgatttcaaaaggacaattaaatggtcaacaaattttagttcgaaatgttccacaaaatgcacaagtcactctatatcaatcaaatggaactgttattcctaatacaaatacaactatagattctaatggtatagctactgtaacaattcaaggcactctaccaaccggaaatattactgctaaaacctcaatgacaaataatgtaacgtacactaaacaaaatagtagtggaattgcttcaaatacaactgaagatataagtgttttttcagaaaacagtgatcaagtaaatgttaccgctggcatgcaagctaaaaatgatggtattaaaataattaaaggtacaaactataattttaatgacttcaatagtttcataagtaatataccagcccattctactcttacatggaacgaggagcctaatagttggaaaaacaacatcggtactacaacaaaaactgttacagttactctacctaatcatcaaggtacgagaactgtagatattccaataacaatctatccaacagttacagctaagaatccagtaagagatcaaaaaggacgaaacttaaccaatggtactgacgtttataattatattatttttgaaaataataaccgtcttggaggaacagcttcttggaaagacaatcgtcaacctgataaaaacatagccggtgtacaaaatttaattgcacttgttaattatcctggcatatctacaccattagaagttcctgttaaagtgtgggtatataattttgatttcactcaacctatctacaaaattcaagtaggagatacattccctaaaggaacatgggcaggctattacaaacatcttgaaaatggagagggattaccaatagatggttggaaattttattggaaccagcaaagtacaggaactactagtgatcaatggcaatcattagcatatactagaactccttttgttaaaactggtacttatgatgtcgttaatcctagcaactggggtgtttggcaaacatcacaatcagctaaatttatagttacaaatgctaaacctaatcaaccaaccataactcagtctaaaactggtgatgtaacagtaacacctggtgctgtgcgtaatatactaataagtgggacaaatgattatatccaagcatctgcagataagattgttattaataaaaatggaaataaattaactacatttgttaaaaataatgatggtcgttggactgttgaaactgggtcacctgacataaatggtatcggaccaacaaataacggaactgctatatctttaagtcgattagcagttagacctggggattcaatagaagcaatagcgactgaaggttccggagaaactataagtacttcagcaactagtgaaatttatattgtcaaagctccacaacctgaacaagtagcaactcatacttatgataatggaacattcgatatattacctgacaattcacgtaattctttaaatccaactgaacgtgtcgaaattaattacactgaaaaattaaatggcaatgaaacacaaaaatcattcactattactaaaaataacaacggcaaatggacgataaataataaaccaaattatgtcgagttcaatcaggataatggtaaagttgtattttcggccaatacaattaaacctaattctcaaattacaataactcctaaagcaggtcagggtaacactgaaaacacaaatcctactgtaattcaagcacctgcgcaacatactttaacaatcaatgaaattgttaaagaacagggtcaaaatgtgactaatgatgatattaataatgcggttcaagtgccaaataaaaatagagttgcgattaaacaaggaaacgctcttccaacaaatttagctggtggtagtacatcacatattccagtagttatttattacagtgatggaagttctgaagaagctactgagactgttagaactaaagttaataaaaccgaattaatcaatgctcgtcgtcgactagatgaagaaattagtaaagagaacaaaacaccatcaagtatcagaaactttgatcaagctatgaatcgtgctcaatcacaaattaatacagctaaaagtgatgctgaccaagttataggcacagaatttgcaacacctcaacaagtaaattcagctttatctaaagttcaagcggcacaaaataaaataaatgaagctaaagcattattacaaaacaaggctgataatagtcaacttgtgagagcaaaagaacaattacaacaatcgattcaaccagccgcttcaactgatggtatgactcaagatagcacaaggaactacaaaaataaacgccaagcagctgaacaagcaatacaacatgcaaatagcgttataaataatggagatgcaacatcccaacaaattaatgatgctaaaaacacagttgaacaggcacagagagattatgttgaagctaaaagcaacttacgtgctgataagtcacagttacaaagcgcttatgatacgttaaatagagatgttttaacaaatgataaaaagccagcatctgtaagacgctataatgaagccatttcaaatattagaaaagaattagatacagctaaagcggatgcaagtagtactttgcgaaacaccaatccttccgttgaacaagttagagacgctttaaataaaataaatactgttcaacctaaagtgaatcaagcaattgctttacttcaaccaaaagaaaataattcagaacttgtacaagctaaaaaacgtttacaagacgctgtaaatgacatacctcaaacacaaggtatgacacaacaaacaattaataattataatgacaaacaacgtgaagctgaaagagcacttacatctgcacaaagagtgattgataatggggatgctacaactcaagaaattacttctgaaaaatctaaagtagagcaagcaatgcaagctttaactaatgctaaaagtaatctgagagctgataagaatgagttacagactgcatataacaaattaattgagaacgtatctaccaatggtaaaaaaccggcgagtatacgtcaatacgaaacagccaaagccagaatacaaaatcaaattaatgatgctaaaaatgaagcggagcgaattttaggtaatgataatccacaagtatcacaagtaactcaagcattgaacaaaatcaaagctattcaaccaaaattaacagaagctatcaacatgcttcaaaacaaagaaaataatacagaattagtcaatgctaaaaacagacttgaaaatgcagtaaatgatacagatccaacacacggtatgactcaagaaacaattaataattacaacgctaaaaagcgagaagctcaaaatgaaatacaaaaagcgaacatgattattaataatggagatgctactgctcaagatatttcttctgaaaaatctaaagtagagcaagtattacaagcattacaaaatgctaagaatgacttaagagctgataaaagagaattacagactgcatacaataaacttatacaaaatgttaataccaatggtaaaaaaccatctagtattcaaaactataagtctgcaagacgaaatatcgaaaaccaatataataccgctaaaaatgaagcacataatgttcttgaaaatacaaaccctactgtaaatgcagtagaagatgctttacgtaagataaatgcaattcaaccagaggttacaaaagctattaatatacttcaagataaagaagataatagcgaacttgttagagcaaaagaaaaattagatcaagcgattaatagtcaaccatcactaaatggtatgactcaagaatctattaataattacacaacaaaacgtagagaagcacaaaatatagcaagttctgctgacactattattaataatggggatgcatctattgaacaaataacagaaaataaaattcgagttgaagaggcaactaatgcacttaacgaagcaaaacaacatttaacggcagatacaacttctttaaaaactgaagtacggaaattaagtaggagaggcgacacaaacaacaaaaagcctagcagtgttagtgcttataacaatactattcattcgctacaatctgaaattacacagactgaaaatagagcaaatactatcatcaataagcctattcgttctgttgaagaagtaaataatgcattgcatgaagtaaaccaattgaaccaacgcttaacagatacaattaacttattacaacctttagcgaataaagaaagcttaaaagaagctcgtaatcgacttgaaagtaaaattaatgaaaccgttcaaacagacggtatgactcaacaatctgttgagaattataagcaagctaaaataaaagctcaaaatgaatctagtattgcacaaactcttattaataatggtgatgcatctgatcaagaagtttctacagaaatagaaaaattaaatcaaaagctgtctgaattaacaaattcaatcaatcacttaacagttaataaagaacctttagaaactgccaaaaatcagttacaagcaaatattgaccaaaaacctagcactgatggtatgacgcaacaatctgtacaaagctatgaacgtaaactacaagaagccaaagataaaataaactcaattaataatgtcttagctaacaatccagatgttaatgctatcagaacaaacaaagttgagacggaacaaatcaataatgaattaacacaggcgaaacaaggtcttactgttgataaacaaccattgattaatgcaaaaactgctttgcaacaaagtctagataatcaaccaagtactactggtatgactgaagcaacaattcaaaattataacgctaaacgtcaaaaagcagagcaagttatacaaaatgcaaataaaattattgaaaacgctcaacctagtgtacaacaagtgtctgatgagaaatctaaggtagagcaagcactcagtgaattgaacaacgccaaatcagcgcttagagctgataaacaagaattacagcaagcatataatcagttgattcaaccaacggatttaaataataagaaaccagcttctatcactgcgtacaatcaaagatatcaacaatttagtaacgaattgaacagcactaaaacaaatacagatcgcattttaaaagagcaaaatccaagtgtagctgatgtcaacaatgcactaaataaagtaagagaagtacaacaaaaattaaacgaagccagagcacttttacaaaataaagaagataatagtgcactagttcgagccaaagaacaacttcaacaggcagttgaccaagtcccttcaacagaaggtatgacgcaacaaactaaagatgattacaattcaaaacaacaagctgctcaacaagaaatatcaaaagcacaacaagttatcgataatggcgatgcgactacacaacaaatttctaacgccaaaacaaatgttgaacgcgctttagaagcattaaataatgcaaaaactggtttaagagcagataaagaggaacttcaaaatgcatataatcaattaactcaaaatattgatacgagcggtaaaacgcctgcaagtatcaggaaatacaatgaagctaagtcacgtattcaaactcaaattgattcagctaaaaatgaagcaaacagtattttaacaaatgacaatcctcaagtatcacaagtgactgctgcgttaaacaaaataaaagctgttcaacctgaattagataaagcgatagcaatgcttaaaaataaagagaataataatgcattggttcaagcgaaacaacaacttcaacaaattgttaatgaagtagatccaacacaaggcatgacaacagatactgctaataactataaatcaaaaaaacgtgaagctgaagatgaaatacaaaaagctcaacaaatcattaacaatggcgatgccactgagcaacaaattactaacgaaacaaatagagtaaatcaagcgattaatgcaataaacaaagccaaaaacgatttacgtgctgataagtctcaattggaaaatgcttataaccaattaatacaaaatgttgatacaaatggtaaaaaacctgctagtattcaacaataccaagctgctcgacaagctattgagacgcaatacaataacgctaaatcagaagcacatcaaattcttgaaaatagtaacccttcagttaatgaagtagcacaagcattacaaaaagttgaagctgtacaacttaaagttaatgacgcgattcatatacttcaaaataaagagaataatagtgcacttgtcacagctaaaaatcaacttcagcaatcagttaatgatcaaccattaacaacaggtatgactcaagattctattaataactatgaagctaagagaaatgaggctcaaagtgctatcagaaatgcagaagctgtcatcaacaatggcgatgcaactgcaaaacaaatttcagacgagaaatctaaagttgaacaagcactagcacatttgaatgatgctaaacagcaattaactgcagatactactgaattacaaacagcagttcaacaattaaacagaagaggcgatacaaataataaaaagccaagaagtatcaatgcatataataaagcaattcaatcattagaaacacaaattacttctgctaaagataatgccaacgctgtgatacaaaaacctatacgtactgttcaagaggtaaataatgcattacaacaagtaaatcagttgaatcaacaattaactgaagcaattaatcaacttcaaccgctatcaaataatgatgcattaaaagctgcaagattaaatttagaaaataaaattaatcaaactgtacaaactgatggtatgacacaacaatctatagaggcttatcaaaacgctaaacgcgtagcccaaaatgaatctaacactgctttagcattaattaataacggcgatgccgatgaacaacaaattacaactgaaacagaccgagtcaatcagcaaactacaaacttaactcaagcaattaacgggttaacagttaataaagaaccattagaaaccgctaaaacagcgttacaaaataacatcgaccaggtacctagtacagatggtatgactcagcaatctgttgcaaattataatcaaaaactacaaatagctaaaaacgaaattaacacaattaataacgttttagcgaacaatccagatgttaatgcaatcaaaacgaataaagcagaagcggaacgaatcagtaacgatttaacacaagctaagaataacttacaagttgatactcaacctttagaaaaaataaaaagacaacttcaagatgaaattgatcaaggtactaacacagatggaatgactcaagattcagtggataattacaatgatagcttaagtgcagcaattatagaaaaaggcaaagtaaataaattacttaaacgtaatccgacagtagaacaagttaaagagagcgttgctaatgcacaacaagtcatacaagatttacaaaatgctcgaacttcacttgttccagacaaaactcaacttcaagaagctaaaaatagattagaaaacagtattaaccaacaaacagatactgacggcatgactcaagattcgcttaacaattataatgataaattagcaaaagctagacaaaaccttgaaaaaatatctaaagttttaggtggtcaacctactgtagctgaaattagacaaaatacagatgaagcaaatgcacataaacaagcattagacactgcacgttctcaacttacattaaatagagagccatatatcaatcatattaataatgaaagtcatttaaataacgcgcaaaaagataattttaaagctcaagttaactcagcacctaatcataatactttagaaacgattaaaaataaggctgatactttaaatcaatctatgacagcattaagtgaaagtattgcagattacgaaaatcaaaaacaacaagaaaattatttagatgcatctaacaataaacgtcaagactatgacaatgcagtcaatgcggctaaaggtattttaaaccaaactcaaagtccgacaatgagtgctgatgtgattgatcaaaaagctgaagatgttaaacgtacgaaaactgcgttagatggaaatcaaagattagaagttgctaaacaacaagcacttaatcatttaaataccttaaatgatttaaacgatgctcagcgacaaactttaactgatactataaatcactctccaaacatcaattcagtgaatcaagctaaagaaaaagctaatactgttaacacagcaatgactcaactgaaacaaactattgctaactatgacgatgaattgcatgacggcaattacattaatgcagataaagacaaaaaagatgcttataataacgctgttaacaatgctaaacaactgattaatcaatctgatgctaatcaagcacaacttgatccagctgaaattaataaagttacacaaagagtcaatacgactaaaaatgatctaaatggtaatgacaaattggctgaagctaaaagagatgctaatacaaccattgatggtttaacttatctaaatgaagctcaacgtaacaaagctaaagaaaatgtaggcaaagcttctacaaaaacaaatattacgagtcagttacaagattacaatcaattgaatattgctatgcaagcattacgtaacagtgtgaacgacgttaacaatgttaaagcaaatagcaattatataaatgaagataatggtccaaaagaagcttacaatcaagccgttactcatgctcaaacattgataaatgcacaatctaaccctgaaatgagccgtgacgtagtaaatcaaaaaacacaagcagtaaatactgcccatcagaatttacatggacaacaaaagttagaacaagcacaaagtagtgctaatacagaaatcggtaacttaccaaacttaactaatactcaaaaagctaaagaaaaggaactggtaaatagtaaacaaactcgtacggaagtacaagaacaacttaaccaagctaagtcactagatagttctatgggcacgttaaaatcattagttgctaaacaacctacagtacaaaaaacaagtgtttatattaacgaagatcaacctgagcaatctgcctacaatgattccattacaatgggacaaactataattaataaaacagctgatccagtacttgataaaactttagttgataacgcaatcagtaacatttcaactaaagagaatgcactgcatggtgaacaaaaattaacaactgctaaaacggaagcaattaatgcacttaatacattagctgatttaaacacacctcagaaagaggctattaaaacagctattaacactgctcatacaagaactgatgtaactgcagagcaaagtaaggctaatcaaataaatagtgcaatgcacacgttgagacaaaacatttctgacaacgaatcagtaacaaacgaaagtaattatattaacgctgaacccgaaaaacaacatgcctttactgaggctctaaataatgctaaagaaatagttaatgaacaacaagccactcttgatgccaattcaattaaccaaaaagcacaagcgattcttactactaaaaatgctttagatggtgaagaacaattacgtcgtgctaaagaaaatgccgatcaagaaatcaatacgttaaatcaattgactgatgcgcaaagaaatagtgaaaaaggtttaatcaacagttctcaaactagaacagaagttgcttctcaattagcaaaagctaaagaactaaataaggtgatggaacaactgaatcaccttatcaatggtaaaaaccaaatgataaatagcagtaaatttatcaatgaagatgcgaaccaacaacaagcatattcaaatgcgattgcaagtgcagaagcgcttaaaaacaaatcacaaaaccctgaattagataaagtaacaattgaacaagcaattaataatattaattctgcaattaacaatctaaacggtgaagctaaactgactaaagctaaagaagatgctgttgcttcaataaacaacctaagcggattaacaaacgagcaaaaaacaaaagaaaatcaagccgttaatggcgctcaaactagagaccaagttgctaataaattacgtgatgctgaagcattagatcaatcaatgcaaacattacgtgacttagttaacaatcaaaatgcaatacattcaacaagtaattattttaacgaggattcaactcaaaagaatacttatgataatgcaattgataatggctcgacatatataactggtcaacacaatccagaattaaataaatctactattgatcaaacgattagccgaattaacacagctaaaaatgatttacatggtgtagaaaagttacaaagagataagggaactgctaatcaagaaattggacaattaggttatttaaatgaccctcaaaaatctggtgaggaatccttagtcaacggttcaaatacacgttctgaagtagaagagcatcttaatgaagctaaatcattaaataatgcaatgaaacaattaagagataaagtagctgaaaagactaatgtcaaacaaagtagcgattacattaatgattcaactgaacatcaacgtgggtatgatcaagcacttcaagaagcagaaaatattattaatgaaatcggtaatccaacattaaataaatcggaaattgaacaaaagttacaacaattgactgacgctcaaaatgcgttacaaggttcacatctattagaagaagctaaaaataatgcgattactggaatcaataaacttacagcattaaatgatgcacaacgtcaaaaagcaattgaaaatgttcaagcacagcagacaatcccagcagttaatcaacaattaactttggatagagaaataaatactgcaatgcaagctttacgagataaagtaggccaacaaaataacgttcaccaacaaagtaattatttcaatgaagatgaacaaccaaaacataactatgataattctgtacaagccggtcaaactattattgataaacttcaagatccaatcatgaacaaaaatgaaattgagcaggctattaatcaaatcaatacgactcaaacagcgttaagtggagaaaataaattacacactgaccaagaaagcacaaatagacaaatagaaggtttatctagtttgaacacagctcaaatcaacgccgaaaaagatttagtcaatcaagctaaaacaagaacagatgttgctcaaaagttagctgcagctaaagaaataaattctgctatgagtaatttaagagatggcattcaaaataaagaggacatcaaacgtagcagtgcatatatcaacgcagatccgactaaagttacagcttacgatcaagcactacagaacgcagaaaatatcatcaatgccacaccaaacgtagagcttaataaagctacaattgaacaagcgctatcacgcgttcaacaagcacaacaagatcttgatggtgttcaacaattagctaatgctaaacaacaagctacacaaactgtcaatgggttaaatagcttaaatgacggtcaaaagcgtgaattaaatctattaattaattcagctaatacccgtacaaaagtacaagaagaattaaacaaagcaactgaattgaaccatgcgatggaagctttaagaaacagtgttcaaaacgttgatcaagtaaaacaaagtagcaattatgtcaatgaagatcaacctgaacagcacaattatgataatgctgtcaatgaagctcaagctacaatcaacaacaatgctcaacctgttctagacaaattagctatagaacgtttaactcaaactgttaacactacaaaagatgcattacatggtgctcaaaaactgacacaagaccaacaagctgctgaaactggaatacgtggtttaacgagtctcaatgaacctcagaaaaatgctgaagtagctaaagtaactgcagcaacaacacgtgatgaagtgagaaatattcgtcaagaagcaacaacattagatactgcaatgcttggtttacgtaaaagcattaaagataaaaacgatactaaaaatagtagtaaatatattaatgaggatcatgaccaacaacaagcttatgacaatgctgtaaataatgctcaacaagttatcgatgaaactcaagcaacgttaagctcagatacaatcaatcaattggcaaatgccgtaactcaagctaaatctaatcttcatggagatactaaactacaacacgataaagatagtgctaaacaaacgattgctcaattacagaatttgaattcagctcaaaaacatatggaagattctttaattgataatgaatctacacgtacgcaagtccaacacgatttaacagaagctcaagctttagatggtttaatgggtgccttaaaagaaagtattaaagattatactaatattgtttcaaacggtaattacatcaatgcggaaccatctaagaaacaagcatatgatgcagctgtacaaaatgctcaaaatataataaatggaacgaatcaaccaacaattaataaaggtaatgtcactacagcaacacaaaccgtgaaaaatactaaagatgccttagacggtgatcatagattagaggaagctaaaaataatgccaatcaaacaatcagaaatctatctaatttgaacaatgcccaaaaagatgcagagaaaaatctagttaatagcgcatcaacattagaacaagttcaacaaaacttacaaaccgctcaacaattagataatgctatgggtgagttacgacaaagtattgctaaaaaagatcaagtgaaagcagatagtaaatatctaaatgaagatcctcaaattaagcaaaactatgatgatgcagttcaacgtgttgaaactattattaacgaaactcaaaaccctgaattacttaaagcaaacattgaccaagcaactcaatccgttcaaaatgcagaacaagctttacatggtgctgaaaaattaaatcaagacaaacaaacgtcttcgacagaactagatggattaacagatttaacagatgcacaacgtgaaaaactcagagaacaaattaacacttctaatagtagagatgatattaagcaaaaaattgagcaagcaaaagcactaaatgacgcaatgaaaaaacttaaagaacaagttgcgcaaaaagatggtgttcatgctaacagtgattatacaaatgaagattctgcacaaaaagatgcgtataataatgcacttaaacaagcggaagacattattaataacagctcaaatcctaacttaaatgcacaagacattactaatgctttaaataatattaaacaagcacaagataaccttcatggagctcaaaaattacagcaagacaaaaatacaactaatcaagccattggtaacttaaatcatcttaatcaacctcaaaaagatgcgcttatacaagctattaatggagctacatctagggaccaagttgcagaaaaacttaaagaggccgaagcgcttgatgaagctatgaaacaacttgaagatcaagtgaatcaagatgatcaaatttcaaatagcagcccattcataaatgaagactcagacaaacaaaaaacttataatgataaaatccaagctgcaaaagaaataattaatcaaacatctaatccaaccttagataaacaaaaaattgctgatacacttcaaaatattaaagatgcagtgaataatttacatggtgatcaaaaattagctcaatctaaacaagatgctaataatcaattaaatcatttagatgacttaaccgaagaacaaaaaaaccattttaaaccgttaattaataatgctgatactcgagatgaggtaaataaacaactagagattgctaaacaattaaatggtgatatgagtacacttcataaagtcataaatgataaagatcaaattcaacatttaagcaattacattaatgctgataatgataaaaaacaaaattatgataatgctattaaagaagctgaggatttaattcataatcatccagatacattagatcataaagcattacaagatttattaaacaagatagaccaagcgcataacgaattaaatggagaatccagatttaaacaggctttagacaatgctttaaacgacatagatagcttaaacagtctcaatgttccacaacgccaaactgttaaggataacatcaaccatgtgacaactctagaaagtttagctcaagaattgcagaaagcaaaagagcttaatgatgctatgaaagcaatgagagatagcattatgaatcaagagcaaattcgtaaaaatagcaattatactaatgaagacttagctcaacaaaatgcctataatcatgcagtagataaaataaatcacattattggtgaagacaatgcgacgatggatcctcaaataatcaaacaagcaactcaagatataaatacagctataaatggattaaatggagatcaaaaacttcaagatgcaaagacagatgctaaacaacaaattactaactttactggtttaactgaaccacaaaaacaagcattggaaaacatcattaaccaacaaacaagcagagcaaatgttgctaaacagttaagtcatgctaaattcttaaatggaaaaatggaagaattaaaagttgcagtagccaaagcgtcattagtaagacaaaatagtaactatattaatgaagatgtctctgaaaaagaagcatatgaacaagctatcgcaaaaggtcaggaaataattaattcagaaaataatccaacaataagtagtactgatatcaatcgtaccattcaagaaattaatgatgctgaacaaaatcttcatggtgataataaattaagacaagcacaggaaattgcaaagaatgaaatacaaaatctagacggattaaattcagctcaaataacaaaattaatccaagatataggcagaacaacaactaaacctgcagtaactcagaaactagaagaagcaaaagcaataaaccaagctatgcaacaacttaaacaaagtatagccgataaggatgctactctaaattctagtaactatctcaatgaagattctgagaaaaagttagcgtacgataatgctgtaagccaagctgaacaactcataaatcaacttaacgacccaactatggatataagtaatattcaagctattactcaaaaggtcattcaagcaaaagattcattgcacggtgcgaataaacttgcacaaaatcaagcagattcaaatttaataataaatcaatcaacaaatttaaatgataaacaaaagcaagcattaaatgacttaattaatcatgctcaaactaaacagcaagtggcagaaataattgcacaagctaataagttaaataacgaaatgggcacactaaaaacactcgtagaagaacagtcaaacgttcatcaacaaagtaaatatattaatgaagatccgcaagttcaaaatatttataatgactccattcaaaaaggtcgagaaatattaaacggcactacagatgatgttttaaacaacaataaaatagcagatgccattcaaaacattcatttaactaaaaacgatttacatggtgatcaaaaattacaaaaagcacaacaagatgcaaccaatgaattaaactatttaacaaatctaaacaattctcaaagacaaagcgagcatgatgagattaactctgctccttcaagaactgaagtttctaatgatttaaatcatgctaaagcacttaatgaagctatgcgtcaacttgagaatgaagttgctcttgaaaacagtgttaaaaaattaagcgactttatcaatgaagatgaagcggcacaaaatgaatatagtaatgcacttcaaaaagctaaagacattatcaacggcgttccaagtagcactttagataaagctacaattgaagatgctttattagaattgcaaaatgctagagaaagtttacatggtgagcaaaaacttcaagaggctaaaaatcaagctgttgctgaaattgataatttacaagcattaaatcctggacaggttcttgctgaaaaaacattagttaaccaagcatcaaccaaaccagaagttcaagaagccttacaaaaagcaaaagaacttaatgaagctatgaaagcactgaaaactgaaataaataaaaaagaacaaatcaaggctgatagtagatatgtaaatgctgacagtggtcttcaagcaaattacaattctgcgttaaattatggttctcaaattattgcaactacccaaccaccagagcttaataaagatgtaataaatagagcaactcaaacgattaaaactgctgaaaataatttaaatgggcaatctaaattagcagaggctaagtcagacggaaatcaaagcatcgaacatttgcaaggattaacacaatcacaaaaagataaacaacatgatttaattaatcaagctcaaactaaacaacaggtagatgatatcgtaaataactctaaacaattagataactctatgaatcaactacaacaaattgttaacaatgacaatacagtaaaacaaaatagtgatttcattaatgaagattccagccaacaggatgcttataatcatgcaattcaagcagcaaaagatttgataactgctcatccaactatcatggataaaaatcaaatagatcaagctattgaaaatatcaaacaagcacttaatgatttacacggtagtaataaactatcagaagataaaaaagaagcttcagaacaactacaaaaccttaatagcttgacgaacgggcaaaaagatacgattttaaatcatattttcagtgcaccaacaagaagccaagtaggagaaaaaattgcaagtgctaaacaattaaataatacaatgaaagcacttagagattctattgctgataataatgaaattttacaaagtagtaagtacttcaatgaagattctgaacaacaaaatgcttataatcaagccgtaaataaagctaaaaatataattaatgatcaaccaacaccagtaatggcaaatgatgagattcaaagtgtcctaaatgaagttaaacaaactaaagataatttacatggtgatcaaaaacttgctaacgacaagacagatgctcaagcaacattaaatgcgttaaattacttaaatcaagcgcaaagaggtaatcttgaaactaaagttcaaaactctaattctagaccagaagtacaaaaagtagttcaattagcaaatcaacttaatgatgcgatgaaaaaattagatgatgctttaactggtaatgacgcaataaaacaaacgagtaattatattaatgaagatacttctcaacaagttaactttgatgagtatacagatagaggtaaaaacatagttgctgaacaaacaaatccaaatatgtctccaactaatattaacactattgctgataaaattactgaagctaaaaacgatttacatggcgtacaaaaactaaaacaagctcaacaacagtccatcaatactattaatcaaatgactggtctaaaccaagctcaaaaagaacaattaaatcaagaaattcaacaaactcaaacccgttctgaagtacatcaagtaattaataaagcacaagctttaaatgattcaatgaatactttacgtcaaagtattactgatgaacatgaagttaaacaaacaagtaactacatcaatgaaactgttggtaatcaaactgcatataacaatgccgttgatcgtgtaaaacaaataatcaatcaaacatctaatccaactatgaatcctttagaggtggaacgtgcaacatcaaatgtaaaaatttctaaagatgcacttcatggtgaacgtgaattgaatgacaataaaaattcaaaaacttttgcagtcaatcacttagataacctcaatcaagctcaaaaagaagcattaactcatgaaattgaacaagcaactatagtttcacaagtaaataatatctataacaaagcgaaagctttaaataatgatatgaaaaaacttaaagatatcgttgctcaacaagataatgtgagacaatcaaacaattatataaacgaggatagtacacctcaaaatatgtacaacgatacaattaatcatgcacaatcaatcattgatcaagtagcaaaccctacgatgtctcatgacgaaatagagaatgcaatcaataacataaagcatgccatcaatgcactcgatggagaacataaattacaacaagcaaaagaaaatgcaaacttattgattaatagtttaaacgatttaaatgcaccacaaagagatgccataaatagattggttaatgaagctcaaacaagagaaaaagtagctgaacaacttcaaagtgctcaagctttaaatgacgctatgaagcatttaagaaacagcattcaaaatcaatcatccgtaagacaagagagcaaatatattaatgcaagtgatgctaaaaaagagcaatataatcacgcagttagagaagtcgaaaatattatcaatgaacaacatccaacattggataaagaaataattaagcaactaacggatggtgtaaatcaagcgaataatgacttaaatggcgttgaattattagatgctgataagcaaaacgcacatcaatcgatacctacattgatgcacttaaatcaagcacaacaaaacgcattaaatgaaaaaattaataacgcagttaccagaactgaagttgcggctattattggccaagcaaaactactcgatcatgctatggagaatttagaagaaagtatcaaagataaagagcaagtcaaacagtcaagtaactatattaatgaagattctgatgttcaagaaacatacgataacgccgttgatcatgtgacagaaatacttaatcaaacagtaaatccaactttatctattgaagatatagagcatgctatcaacgaagttaatcaagcgaaaaaacaactcagaggtaaacaaaaactttatcaaactatcgatttagctgataaagaattaagtaaattggatgatttaacatcacaacaaagcagttcaatatctaatcaaatatatactgctaaaacgagaacagaagttgcccaagcaattgaaaaagcaaaatcattaaatcatgcaatgaaagcacttaacaaagtatataaaaatgcagataaagtgttagatagtagtcgattcattaacgaagatcaacctgaaaaaaaggcgtatcaacaagctataaatcatgttgattcaatcattcatagacaaacaaatcctgaaatggatccaacagtaatcaatagcataactcatgaactcgaaacagctcaaaataacttacatggtgatcagaaacttgctcatgcacaacaagatgccgctaatgtaattaatggtctaattcatcttaatgttgctcaacgtgaggtaatgataaatacgaatacaaatgctacaacacgcgaaaaagttgcaaagaacttagataatgctcaagctcttgataaagctatggaaacactacaacaagtagttgctcataaaaataatatattgaacgatagtaaatatttaaatgaagattcaaaatatcaacaacaatacgatcgagttattgctgatgccgaacaactacttaatcagacaacaaatccaacattagaaccttataaagtcgatattgttaaggataatgtcctagctaacgaaaaaatactatttggcgcagaaaaactatcatatgacaaatcaaatgcaaatgatgaaattaaacatatgaattatcttaataatgcacaaaagcaatctataaaagatatgatttctcacgcagcattaagaactgaagttaaacaacttctgcaacaagctaaaatccttgatgaagccatgaaatcacttgaagataaaactcaagtagtgattacagatactactttgcctaattacactgaagcttcagaggataaaaaggaaaaagtagaccaaactgtatcacatgctcaagcgattattgataaaataaatggctcaaatgtaagtttagatcaagtacgacaagcactagaacaattaactcaagcatcagaaaacctcgatggtgatcagcgagttgaagaagctaaagttcatgctaatcaaacaattgatcaattaacacatcttaattcattacaacaacaaactgcgaaagaaagtgttaaaaacgcaacaaaactagaagaaatcgctactgttagtaacaatgctcaggcattaaacaaagtaatgggtaaattagaacaattcattaatcatgctgattctgttgaaaatagtgataattatagacaagccgacgacgacaaaatcatcgcttatgatgaagcacttgaacatggacaagatatacaaaaaactaacgcaacccaaaatgaaacaaaacaagcgttacaacaattaatatatgcagaaacatcgttaaatggtttcgaaagattaaatcatgctagaccacgagctttagaatatatcaaatcactagaaaaaataaacaatgctcaaaagtctgctttagaggataaagtaacgcaatcgcatgatttattagaattagaacatattgtcaacgagggcacaaacctcaatgacattatgggtgaattagctaacgcaatcgttaataactatgctccaaccaaagcaagtataaattatattaacgccgataacctacgcaaagataactttactcaagctatcaacaatgcacgtgatgcactcaacaaaactcaaggtcagaacttagatttcaatgcaattgatacatttaaagatgatatattcaaaactaaagatgcacttaacggtattgaacgtttaacagctgcaaaatcaaaagcagaaaaactaattgatagtttaaaatttattaataaagctcaattcacacatgcaaatgatgaaattatgaatactaattctattgcacaattgtctagaatcgtgaatcaagcatttgatttaaatgatgcaatgaaatctttaagagatgaacttaataatcaagcttttcctgtccaagcaagctcaaattatataaattcagatgaagatttaaaacaacaatttgaccatgctttaagtaatgctcgaaaagttcttgcaaaagaaaatggtaaaaatttagatgaaaaacaaattcagggactcaaacaagtgattgaggatactaaagatgctttaaatggtatccaacgtttatcaaaagctaaagctaaagcaattcaatacgtacaatctttatcttatatcaatgatgcacagcgtcatattgctgaaaataatattcacaactctgatgatttatcatctttagcaaatacattatctaaagctagtgatttagataatgcaatgaaagacttacgagatactatagaaagtaattcaacttctgttccaaatagtgtgaattatattaatgctgataagaatttacaaattgaatttgatgaggcgctacaacaagcaagtgcaacaagttctaaaacttcagaaaatccagcaacgattgaagaagtattaggtcttagtcaagccatttacgatacaaaaaatgcattaaatggtgaacaacgacttgcaactgagaagagcaaagatctaaaattaataaaaggattaaaagatttaaataaagcacaacttgaagatgtcacaaacaaggtaaattcagcaaatactttaacagagttatctcagctcactcaatcaacgttagaattaaacgataaaatgaaattattgagagataagcttaaaactttagtaaatcctgttaaagcaagtttaaattatagaaacgctgattataatttaaaacgtcaatttaacaaagctttaaaagaagctaaaggcgtattaaataaaaatagcggtacaaatgtcaatatcaatgacattcaacatcttttaacacaaatagataatgctaaagaccaattaaatggtgaacgacgtctaaaagaacatcaacaaaaatctgaagtatttattattaaagaattagatatacttaataatgctcaaaaagctgcaataattaatcagattagagcgtctaaagacattaaaataattaatcaaatcgttgataatgcaatagaattaaatgatgctatgcaaggtttaaaagaacatgtagctcaattaacagcaactacaaaagacaacattgaatatttaaatgctgatgaagaccataaattacaatatgattacgctatcaacttagcgaataatgttcttgacaaagaaaacggtacaaataaagacgctaatatcataattggaatgattcaaaacatggatgatgctagagcacttctaaatggaattgaaagacttaaagatgctcaaacaaaagcacataatgacattaaagatacgctcaaacgtcaacttgatgaaattgaacacgctaatgcaacatcaaattctaaagctcaagctaaacaaatggtaaatgaggaagctagaaaagcgctttctaatattaatgacgcaacatcaaatgatttagttaatcaagcaaaagatgaagggcaatctgcaattgaacacatacatgcagatgaattacctaaagcaaaactagatgctaatcaaatgattgaccaaaaagttgaagatataaatcacttaattagtcaaaatccaaacttatcaaatgaagaaaaaaataaactaatatctcaaattaataagttagtaaatggaattaagaatgaaattcaacaagctataaacaaacaacaaatagaaaatgctacaacaaaactagatgaagtcattgaaactactaaaaaattaattatcgccaaagcagaagctaaacaaatgataaaagagttatcacaaaagaaacgagatgcaataaataacaacactgatttaacaccttctcaaaaggcacatgctttagcagatattgataaaacagaaaaagatgcacttcaacatatcgaaaattctaattcaattgatgatatcaataacaataaagagcatgcatttaatactttagctcatatcattatttgggatactgatcagcaaccattagtttttgaagtacctgaattgagccttcaaaatgctctagtaacaagtgaggtggttgttcacagagatgaaactatttcattagaatctataaaaaaaaaaatgactttaactgatgaacttaaagtcaatattgtttcattaccgaacactgataaagtagctgatcacctaaccgctaaagttaaggttattttagctgatggctcatatgtcactgtaaatgttccagtcaaagttgtagaaaaagaattacaaatagctaaaaaggatgctataaaaacaattgatgttctggtaaaacaaaaaatcaaagatatagattctaataacgaattaacgtctactcaacgtgaagatgcaaaagctgaaattgaaagattgaaaaagcaagccatcgataaagtgaatcattcaaaatcgattaaagatattgaaacagtaaaacgaactgattttgaagaaatagatcagtttgatcctaaacgctttacgctaaataaagctaaaaaggatatcattactgatgttaatactcaaatccaaaatggtttcaaagaaattgaaacaataaaaggtttaacttctaatgaaaaaactcagtttgataaacaattaactgcactacaaaaagaatttttagaaaaagtcgagcatgctcataatttagtagaattaaatcaattacaacaagagtttaataatagatataaacatattttaaaccaagcacatttactaggtgaaaaacatatagcagaacataaattaggatatgttgtagtaaacaaaactcagcaaatactaaataatcaatctgcttcttactttataaaacaatgggcacttgatagaattaaacaaattcaactagaaacgatgaattcaattcgtggtgcgcataccgtacaagatgtacacaaagcattattacaaggtatagagcaaatcttgaaagtaaatgtaagtattataaatcaatctttcaacgattccttgcataactttaattatcttcattcaaaatttgatgctagattaagagaaaaggatgttgcaaaccatatcgtacaaactgaaacattcaaagaagttctaaaaggaacgggtgttgaaccaggtaaaatcaacaaagaaacacagcaaccaaaacttcataagaatgataatgatagcctattcaaacatttagttgataatttcggcaaaactgtaggtgttattacattaactggtttactttctagtttctggttagttttggctaaaagacgtaaaaaagaagaagaagaaaaacaatcgataaaaaatcatcacaaagatattcgtctttcagatactgataaaatagatccaattgtaataactaagcgtaaaatagataaagaagaacaaattcaaaacgatgacaaacattcaattccagttgctaaacataagaaatctaaagaaaagcaattgagtgaagaggatattcattcaatccccgtcgttaagcgtaaacaaaacagtgataacaaagatacaaaacagaagaaagttacttctaaaaagaagaaaacgcctcaatcaactaaaaaagttgtaaaaaccaaaaagcgttctaaaaagtaa

SEQ ID NO: 327 - DNA, 174 bp, Staphylococcus epidermidis
atcagaggcaacaattatctttatattatccatgtacttaccacctattctttaaataatgaaacgaataatttagtgattgttgttttagagatgcgacctattacttcaaatttgtcgttttctttaggtctaacaattggtaatgaatctatctctttatcaatcatttga

SEQ ID NO: 328 - DNA, 651 bp, Staphylococcus epidermidis
tttttattaaacataaaagaggtgaaatcaatgctagaatttagaaatgtgtataaatcttttaagaagaaagaagtattatgtgatgttaattacaaattatctgctggagaaaaggttggtcttataggttctaatgggtctggaaaatcaacattaatgaaacttatagctaaaactcaattaccatctaaaggaaatgtttattttaacaatatagatatacataaatctcacaatatgataaaagatttttctttcatgataggacaaatatattatcctgagttaaatgcaagacaaaatattgaaaattacctaaaaattaataataagattagctatataagtgaaattcaaaagatgctaaacattgtaggtttagaagatattgaaaagaaggttaaaaattattcgtatggaatgaaacaaagactttgtttagctatttgtttaattaccaaaccaaaagtagctgtattagacgagccattcttaggtttagatccgcttggggtaagggaattaaataatatcactgagaaatattcaaaagaaaaaaacactttatttttaatatctagtcaccagttaaaagaattagaagatctttgtgatagatttctattactcgaaaacccatcaaattag

SEQ ID NO: 329 - DNA, 570 bp, Staphylococcus epidermidis
aaccaattaaaaggaacgtgtttaaatatgagattaaacgaaaaaacaatcgatagaacagttatatataatggtagtattattgatttagaagtacatgatgttgaattacccgatggtagcacatctaaacgtgaacttgtatttcatcatggtgcggtggcagtgtgtgcaataactcctgaaaatgaagttttattagttaaacaatttcgtaagcctgcagatcaaccacttttggaaattcccgcaggcaaattagaaaagggtgaagatcgtaaagaagcggctattagagaactacaagaagaaacaggatatattgcttcagatttgcaatttgtcactaatatgtatgggtctcctggattttcaagtgaaaaactttctatatacttcacagaccaattaacggttggagaaaccaatttagatgatgatgaatttgtggagcttcacaaagtacctttaagtcaaatcgattcattgttaaaagataataaaattgaggatgccaaaacaatcattgcattgcaacatctattattaaattataatcattctaaataa

SEQ ID NO: 330 - DNA, 156 bp, Staphylococcus epidermidis
tatgaattaaaattgtattcatatcaaatgaaatccataaacatatttgactatgcgattgagttacttttaatactacgcaataaaagtatcgtaactaaaattatgtttaatcataaagaatatcatcttttattatatttatttaagaattga

SEQ ID NO: 331 - DNA, 138 bp, Staphylococcus epidermidis
atgatgttaaactttaatcacacatttaaatttacatttaagttgtcggtcccaattaaaaatttaaaacacatatttttattaaatatcgttttaaaactatgtccaattaaaaatagagatgaaatacttagctaa

SEQ ID NO: 332 - DNA, 1170 bp, Staphylococcus epidermidis
tgtcagttaaaatatatttatacaagtaaaaagggggtaccatatatgattaatcaaaaacgtttattagattgttttctagaattagtgcaaattgattcggaaacagggcacgaagaaacaattcaaccttatcttaaagatacgtttgaaaaaatggggctccatgttattgaagatgaagcttcaaaaaataatagattaggtgctaacaatcttatttgtacgttaaaaagtaatataagtcatcagaatgtgccgaaaatttattttacaagccacatggatactgtcgttccaggaaaaaacatccaacctgtagtaaaagaagatggatacgtttatagcgatggaactacgatactcggggcggacgataaagccggtcttgcggcaataattgaagcgattaaacaaattaaggaatcaaatttgccacacggacagattcaaataattattaccgtgggagaggaatctggattagtaggtgctaaagcaatagatactcgccttcttgatgcagatttcggctatgctgtagatgcaagtaaagatgttggaactactgttatcggtgctccaactcaagtaaagatttatacaactataaaagggaaaaccgcccatgcaagcacacctaaaaaaggtattagcgcaataaatattgcatcaaaagcaatcagtcgaatgaaattgggacaagtcgatgcattaacaacagccaatataggtaaatttcacggaggttctgccactaatattatagctgatgaagtcactttagaggcagaagcacggtcacatgatgatcaaagcattaataaacaagtgaaacatatgaaagagactttcgaaacgacagcaaatgaattaggcggtcaagctgaagtgttagttgaaaaaagttatccgggatttgaagttagtgaagctgacaaagtaacacaatatgctatatctagtgcattagccctcggtctaaaaggtgatacttgtattgctggtggtggttcagacggcaacatcatgaatcaatatggcattccttctgtgattttaggagtaggatatgaaaacatacatactacttcggaaagaatagcaataaaggatatgtatatgctcacaagacaaataataaaaattattgagctagtagctgaataa

SEQ ID NO: 333 - DNA, 1386 bp, Staphylococcus epidermidis
tcagagttaaataggaggaattcaatgatgtatcgatgtttgattgcaaatagaggcgaaatagcagtaagaattataagagcttgtagagagcttaacatagagacagttgccatttatgcaaaaggtgatgaaaatagcttacatgtaagtttagccgatcaagcaatatgcataggtgaagcaaatccattagacagttatttaaatattgatcgtattatatctgctgcaaaagttacagaatcaaacgtaattcaccctggctatggtttcttatcggaatctacgaattttgcgaaagccgttgaagacaatcatatacattttattggacctagtaagacaactatggaaatgatgggggataaaattactgccagacaaactgttaaacaagcaggagtacctgttataccaggttctaatgatgctgttcaaagtgtagatgaaattaaattattatccaaagaaataggatttccagttgtactaaaagcagctagtggtggtggtgggaaaggcatcagaattgttaaagaagcatctcatttggatcaggctttgaaagaagctaaaagtgaaggacaaaaatattttaatgatgatcgagtgtatgtagaggcgttcataccagtagcaaaacatgtagaagtgcagattatcggagacggtaaaaataactatgttcacttaggtgaacgcgattgttctgttcaacgaaagaatcaaaaattaatagaagaagcgccttgtgctgcattaactgaagaaagaagaacaagaatatgtggcgacgcagttaaagtagctcaagcttcaagatatcgtagtgctggaacaatagaatttttagttacagaagatgcacattattttattgaaatgaatgctcgtattcaagttgaacatacagttacagaaatgcgtgctgatagagacctattacaagctcagttatatttattaacacacggtgaattaccattcactcagaaagatattttatttaatggtcatgtaattgaggcgcgtataaatgctgaaaatcctgaaaaaaactttttacccactccaggaaaagttaataaattacacttaccacaaggatttaatatacgtgtagattctttactttacacaggttatcaggtttctccttattatgattcacttgtagctaaagtgattgtaaaggattctaatagacaaactgctattaataaattaaaagttgcgttagatgaaatggtcatcgaaggttttactactacagctgactttttatatgcggttttaaattatccaatatatgcaaaaggcgatgccagtaaagtagatataaaatttcttgaaaaacatcaaatcattaaagaggtgaaatga

SEQ ID NO: 334 - DNA, 162 bp, Staphylococcus epidermidis
gcccaaataaaaagcaaacttacgaacaccacagatgactatcttatgaaaatatcataccacaatttaaaaagagaagtaaattttaaagacttatcatttaactcaaatgtgtattattttctcgtgtattctaaactagttaccaaaattataatataa

SEQ ID NO: 335 - DNA, 348 bp, Staphylococcus epidermidis
caatcgataaaatcaacgcataatcgtatgattactgttgatattacggttaatgacgaaggtaaggtcacagatgtagtcatggatggtcatgctaatcatggtgaatatggtcatgatattgtctgtgcaggagcatcagcagtcttatttggaagtgttaatgctataatgggattaacatcagagaagccagatatcaactacgaagatgacggcggatattttcatataagaagtgttgatacgaataacaaagaagctcaattaattcttcaagcaatgttagtttctttacaaactatagaagaagaatataatgaaaatatcaaattaaattataagtga

SEQ ID NO: 336 - DNA, 1902 bp, Staphylococcus epidermidis
agagggataaaaatgagtgatcgttttataaaattcaacgatgaacaattagatgcaaaacaagtaatgatgttacaagacttagcacgtttacttttaaaaaatgagcaaacgcaagttaaaatacaaaaattcccttactataatccttatagtaatacactcattgcgagttggttttggtctcatagaccgaaacatattgaacaagctggactaaaaacagatgtcttactcgcaacgtatggatatctgaatatggatctttcaatcatcaatcaagttttacacaacaacgattttgaacaccctaagttctttcatcaattatttaaacttttagaggacgtacgtatatttgaacatattagacaacaaagacctagtactacaaaaatgattgatttacgcatagaaacacgattatcttttacagaatctcaaattaatttctacaaaactaaaactgtatatactgatttactttttctttatttagaacatgcatttttaagtcaaaacttttttaatattccatccatacatccagcatttgatgatattttagttcatatgtatcagtacttaccaaatatttttcagaatcaaacatcagaagataatatgtatttagcagaacgtattatgtatcaagtggatgatttattaaaggaagatatgctaaatgaatattactacttacctcaaaaattatatgaagatatttatgcagatagttttgaagacttaaagcgtacagatgcgagcaatactgatggtaaagataatcaacagacagacgaagatgtagaaacagctgaagctgaaacaaaagccgcagacagtgagtctaaaggcggggcatatttagaaatggagctacatgagggtgaaaacagtgaagttatggctgataatgatacggctcgagaaggcgacagcactgatgatatgactgatatgatgaccaaaaaaggaaaagggtcagaaaatacacttgatcatgatgaaggtggatttataggacaaaaccaagcttttgctttaaaaggcattaataaagacgtaagtattgaatggaatatccctgatattacacctcaaaatgtgatagattatcaatattcaaaaaatgatgtacagtttgaaattaaagatttaatacaaattatcaaaaagaccatcgacagagaacatgaagatgaaagacataatttaacaaagggccgtttacaaaaagaccttattaattggtttattgatgatcaatttaagttattttacaaaaaacaggatttaagtaagacattcgatgcaacatttaccttactcattgatgcatcagcgagtatgcacgataaaatggatgaaacgattaaaggtgtcgtcttgttccatgaaacattaaaatctttgaatattaaacatgaaatactagcatttaatgaagatgcttttgaagctgaccaacgtcaacaaccaaatatcattgatgaaatcattaattataattactctatctttgaaaaagaaggcccacgtatcatgacattagaacctcaagatgataatcgtgacggcgtagctatcagaattgcgagcgagcgtttattacaaagaagtcatgaacaacgctttttaatcgtattctcagatggtgaaccgtctgcatttaattacagtcaagatggtattttagatacgtatgaagctgttgaacgtgcgcgtaaatttggtatagaagtatttaatgtctttcttagccaagagccaattactgaagacattgaacaaaccattcataacatatatggccaatttgctttatttgtagaaggtgtggaacatttaccgagtcacttatcaccattactaaaaaaattgttacttaaatctttataa

SEQ ID NO: 337 - DNA, 180 bp, Staphylococcus epidermidis
attactgtaaaaataaataatgctaaattcccactattatgtgcaataggagtcacagtcatttcaaatgaagttgaagctgtacgtggtatcgcaaataatggtcctatagtgagatatatgataattaaaaagattaacgaaaatcgtggtgatattttattaaaagacccaatataa

SEQ ID NO: 338 - DNA, 411 bp, Staphylococcus epidermidis
agaggagtaaaagtaatggctaaaatatattttgatgctgcgactaaaggaaatcccggccgaagtgcttgtgcgattattattaaagaaaattcacaaagatatacatttacccatgatttaggtaaaatggataatcatagtgcagaatgggcagcaatgttacacgctttggaacatgcacgcgaattaaaagtatctaacgcgttactttatactgattcaaaattaattgaagatagtatgatgcaaggtaaagttaaaaatgctaagtttaaagtttattttgaaaacatagaaatcttagagcaaagttttgatttgatgtttgtgagatggattccacgaaagcgaaataaagaagcgaatcaacttgctcaacaaacactataccaacttacatcacaataa

SEQ ID NO: 339 - DNA, 189 bp, Staphylococcus epidermidis
ataacggtaaaaccttttctgaaccatacgcatagcgcatggttttctttatacaataaagaagccagtaatgaatttataaaaaattcatttactggctattttgctaggaattatatcccagactcattgaactcaaaatttatatatattactatccggaaccgagtttggaaagtacttcaatga

SEQ ID NO: 340 - DNA, 297 bp, Staphylococcus epidermidis
gatttgtcaaaatataaatttaaagggtctttaattattgatgcattgctagccttttttatagttagtacaataacaatgattttaatacctatgttttcaaacttaaacaatcagtatcttatcaatttaaataatataaaaatcaagcaaatcatgataactagccttcaacactataaaaagaaagaactttatcaaggggttgtaatagaaaattatgaaatacaattattcaataataaaatatgtggggaggataaagcatttaatacgcgaacatgtatttcaatttaa

SEQ ID NO: 341 - DNA, 759 bp, Staphylococcus epidermidis
ttaaccaaaaaggagagtcaaatgagtaaagaacaagagagattacaaaaaagaatcgctaatagcggatatacatctcgtcgaaaagcagaagtacttatcactgaaggacgagttaaagtcaatggacaaactgtaacagaattaggttccaaagtgatgccatcagatttagttgaagttgatggtattaaaatcgaacaagaagacaaaatttatattttattttataaaccaactcaagtcattacaagtgtctctgatgatcgtggacgtagggtggttacggattactttgatgatctagaatcacgtatttatccggttggacgattagattatgacacatctggagttttattattaactaatgatggagaatttactaatttgatgacacatcctcgatatcacattaaaaagaaatacgttgctaaattaaaaggttatttaatgagagaggaaattaagcaacttgaaaaaggaatagaattagaagatggttacacacaaccagcacaagttaaaataaaaaagcaagataaagaaaaaaatacgactttagttgaaattacaattagtgaagggcgaaatagacaagttagacgtatgtttgagtatttcggtcatcaagttaataagttaacaagaattcaatttggccctatagatttaaaaggtttgaacgccggtgaaggaagagttcttacaccacatgaagtaaaaatattaagacatttggcagaaaacggtaaataa

SEQ ID NO: 342 - DNA, 1020 bp, Staphylococcus epidermidis
agaaatcgaaaaataaaaaggagcgatttaatgtttagtattggttttataatcattgcagtcattatagtagttgcactactcattctgttttcatttgttccggtcggattatggatttcagcactagctgctggagtacatgttggaataggcacacttgtggggatgcgtttaagacgggtttcaccaagaaaagttatcgcacctctgatcaaagcgcataaagctggtttaaacttaactacaaatcaacttgagtctcattacctagcaggcggtaatgttgatcgtgttgtagatgcaaacattgcagcacaacgagcagatatcgacttaccatttgagcgaggcgctgccattgatttagcaggtagagatgtattagaagcagtacaaatgtcagttaatccaaaagttattgaaacgccatttattgcaggtgtagcgatgaatggtatcgaagttaaggcgaaagctcgtattaccgtacgcgctaacatagcaagacttgttggtggtgctggtgaagaaacaatcattgctagggtcggagaaggtatagtatctacaattggttctagtgagcatcatacagaagtgctcgagaatccagataatatctcaaaaacagtactaagtaaaggtttggactctggaactgcattcgaaattctatctatcgatattgccgatgttgatattagcaaaaacatcggtgctgatttacaaacagaacaagcacttgctgataagaacattgcacaagctaaagcagaagaacgtcgcgcaatggctgttgcttctgaacaagaaatgaaagcgcgtgttcaagaaatgagagctaaagttgttgaagctgaatccgaagtgcctttagctatggcggaagcattaagatcaggcaatattggagttaaagattattataaccttaaaaatattgaagcggatacaggtatgagaaatgcaataaataagcgcactgatcaaaacgatgatgaatcaccacaacaataa

SEQ ID NO: 343 - DNA, 990 bp, Staphylococcus epidermidis
ttcaggcgaaagagtacaagaggaggttttatcatgagtaaaaacaaaaaacaaagccttcaatccgctcatcaaaaacctttgttaaaaagaatgtgggaacacaaagtactttacttaatgattttaccttgtttactctttttcttgattttcaactatattccaatgacaagtcttgttctggcattcaaagatttccgcttcgatactggtatcatcggcggtgattggaaagggctatactattttaaacgctttttctctgaccctcgatgtattcaaattattatgaatacgctaattataagtggcatgaaattgattttagctctaccatttccaattattttagccattatgtttaacgaaattaaagattctaaattaggtaagatcagaggtttatttcaaggcgtactttacatccctcattttttatcttgggttgtagttatcagtattttcaagaaattactcgctccagatgatggacttatgaatcaactgatccatcaatttggtggcgacgggtcgacttactttatgatgaaccctgagtatttccacaccatcatgttttctagttatatatggaagaatgtagggtgggattccattatttattttgcagcaattatgagtattaatcctgaaatttatgaatcagctgcgattgatggcgcgaatcgtttcaaacaaattatacatattaccttacctatgttaacaccaacaattgttattttattcatcatttctctaggcgatattttaaaagcagggttcgatcaaatttacctactcaaaacaccaggtaacgctaacgtttcagaaatactggatacatttgtgattcgtactggtattgagcaaggcgatttcagttacgcaattgcgattagtctattacagggtgtgataggacttatcgctgtcgtcattattaataaattcgcagataagaaactggatacatcactatattaa

SEQ ID NO: 344 - DNA, 693 bp, Staphylococcus epidermidis
tcgtgtagaaatgagggagaaaagatgcacgaacaaagtaagatataccaaaatattaaagatggtaaattagataccgctttgaaagacttgtttgaaaatatagaagaaaatccggccattgttgaaaattatattaacgcaggtattgtattatcagatgttggagaaattgaaaaagcagaacgttttttccaaaaggcattaactattgaacctgaaaatggtgctgtttattataacttggcaaatatttattataatgaagaacgttataacgaagcgataaagctatatcaaactgcactacaatatgaagtagcgaaaaaagattgtaattatatgattggtatgtcgtttaatcaactaggtgcttttaaagaagctttaccatttttaatgactgcagctgaaatggacgatgatagagatttagaagtacagtttcaatatgggttagtactatgccaactcgaaatgtttgatgaagctattaaacaattaaataaggttctttctatcgattcacagcacgtagatggtatatataatcttggtttagcaacatatatgaaaaatgaaaatttagatgaagcaattgcatattttgaacaagcaatatcaattgatgaaaaacatttacttagtcaacatgcattaaagacattcaaaacaatgaaagaggaggaataa

SEQ ID NO: 345 - DNA, 126 bp, Staphylococcus epidermidis
aaaaacagaaagaaattaaaatcaatttccttctgtgatacggtatgtattgatataaaaaacaccttactgcttggtaaggtgttagttaaagtcaatgattacaatctatttattatagtttaa

SEQ ID NO: 346 - DNA, 246 bp, Staphylococcus epidermidis
ctagggggaaaaataagtatggcagaggtaaaagttccagaattagcagaatcaatcacagagggtaccattgcagaatggttaaaaaatgtaggcgataatgtagataaaggtgaagctatcttagaactagaaacagataaagttaacgtcgaagtagtttctgaagaagctggggtattatcagaacaattagccgaggaaggcgatacagttgaagtatgtcaagctgtagctgtagtatga

SEQ ID NO: 347 - DNA, 519 bp, Staphylococcus epidermidis
attaatttgaagagtattcaagtgcctattattttagttggtttcatgggaactggtaaaactactgttggaaaatatctttcagatttatataatttaagttatgtggatttagataattttattgaagtaaatgaatgtaaatctatacctaatatatttaatgatatcggagaaaaaggatttagatcattggagactagatacctaaaatcttgtctcaatactttcgatattatttcaactggaggaggtattatagaagatacgaattcattaaagctcttaaaaaatcaaaagcatgtagtttggctagactgtgacattgaaatcattttcaaacgagttaaaaatgattcacatagacccaatgctaaaagtaaaaatcttaaccaacttgatgccttgtattcttcaagactttcaagatataatgaaatcgcattcatgaaagttgatagtgcacagagtgtttctgaaatttgcactttaattaaaacaaaattattaagcgattga

SEQ ID NO: 348 - DNA, 240 bp, Staphylococcus epidermidis
tgcatattgaaagaatttagtcttggaggtttcagaattatgaaacaaggtacagttaaatggtttaatgccgaaaaaggttttggtttcatcgaagttgaaggagaaaacgacgtattcgtacacttctcagcaattaaccaagaaggatacaaatcattagaagaaggtcaatcagttgaatttgaagtagttgaaggcgatcgcggtcctcaagctgcaaacgttgttaaactataa

SEQ ID NO: 349 - DNA, 129 bp, Staphylococcus epidermidis
ataaaattgaatgctatcacacttattaagcttgttattaaaatatacataaaggaggagcgacgtgataggcaaacactttattataactggagcaacgagtgggttaggttttgcaataaccaatga

SEQ ID NO: 350 - DNA, 498 bp, Staphylococcus epidermidis
aaaattatgaaatacaattattcaataataaaatatgtggggaggataaagcatttaatacgcgaacatgtatttcaatttaatataaaagcatttacttacatcgaagcattatttgctttatttgtgactactttaattctcgctttattacctactatacttaaattgacttcgttttatcttaatactgctcaaaataacgaagatattcaatttgaattttttagaagagatttacttaaagagaaaatgacgactcaaaacaattatgagatagaaaatgcatatacaattaaacttaagaaagataaagatgttattagatatatttataaaaaccgtaaaatttacaaaaacattaatcaaaaaggtaatattacattgttaaatcacgtcttgtctactcgtatattaaaaacgaacgataatatagtaaaattattaataacaacaggagaaacgaacgatgaacacaaagaaatcctgtttatatag

SEQ ID NO: 351 - DNA, 126 bp, Staphylococcus epidermidis
aaaataatgaagaattttaaatggaaatattttataaaacccaaattaataaaactttcagaacaaaaagcaaaaaccatctacagtcaaagaaaatttggtctggaagcttttttggatttgtga

SEQ ID NO: 352 - DNA, 417 bp, Staphylococcus epidermidis
cgtttgatgaactcactgacttcatcaacgacttgcagtggtctcaagatcaaagtttcgaatgaggtggaaaaaaagatgtcagatgtttcattaaaattatcagcgaaagatatttatgaaaaagatttcgaaaaaactatggcaagaggctatagaagagaagaagtagacgcttttttagatgatatcattacagattatcaaaaaatggcggatatgaacaatgaagtagtaaagctttctgaagaaaatcacaaattaaaaaaagaacttgaggaattaagattacgtgttgctacatcaagaccacaagacaataaaaacttttcttcaaataattcaagcagtgcttcaaataatgtagatattttaaaacgtatttcaaaccttgaaaaagcagtattcggcaaataa

SEQ ID NO: 353 - DNA, 633 bp, Staphylococcus epidermidis
attatgatgaattatccaaatggtaaaccatactctaaaaataagcctttggacggacgtaagagttcgccattttcaagtaatattgaatatggtggacgaggtatgacactagagaaagatattgaacaatcgaatactttctatcttaaaagtggcatagcagttattcataaaaagccgactccggttcaaatagttaatgttcactatccgaaacgtagtaaggctgtaataaatgaggcttattttcgcactccttcaacaactgattataatggtgtctataatggatattacattgattttgaagctaaagaaactaagaacaaaacttcatttccactcaataatattcatgcacatcaagtagaacatatgaaaaatacatatcatcaaaaaggaattgtctttttaatgatacgttttaaatcacttgatgaagtgtatcttttaccctattcaaaatttgaaaaatattggcaaagatacattaataatattaaaaagtcgataactgttgaagaaattcggaaaaatggttaccatattccttatcaatatcaaccaagattgaattacctcaaggcagttgataagttgatattagatgaaagtgaggaccgcgtatga

SEQ ID NO: 354 - DNA, 1287 bp, Staphylococcus epidermidis
aaaggtgtgaaaaatgtgagtacagaaccattagcctctcgaatgagaccgaaaaatatagatgaaattatatctcaacaacacctggttggtccgaaaggtataataagaaggatggtagatactagacgtctttcttctatgattttttatggtccacctggaattggtaaaacaagtattgcaaaagcaatttcaggcagtacacaatttaaattcagacaattaaatgccgtaacaaatacaaagaaagatatgcagctaattgtcgaagaagctaagatgtcaggacaagttatcttactattagatgaaattcatcgtttagacaaagctaaacaagattttttattaccacatcttgaaaatggcaaaattgtattaataggtgcaacaacttcaaatccttatcatgcgataaatccagcgatacgatctagagcacaaatatttgagctttacccattagatcaagatgatataagattggcattagatagagctataaatgataaggaaagaggtttaagtacttatcatcctattgtagatgaagatgctatcgaatatttttcaacgcaaagccaaggcgacgttaggagtgcattaaacgctttggaattagctgtactaagtgctcatattggtgaagaaaacgaaagacatattacattagatgacgcaaaagattgcttacaaaaaggtgcttttgtaagtgataaagatggagacatgcattatgacgtcatgagcgcttttcaaaaatcaattagaggtagtgatgtcaatgcagcactccactacttagcacgtctaattgaagctggtgacttacctacaatcgtacgtcgattacttgtaattagttatgaagatgttgggttagcatcacctaatgctggtcagaggactttagcagcaatacaatcagctgaacgtctaggttttccagaagcacgaattccccttagtcaagctgtaatagaattatgcttatcacctaaatcaaattctggtatcacagcaatagataaagctcttggcgatataagaaatggacatataggtcaaataccggattatctgaaagacggtcattattcaggtgctaaaaagttaggacgggctataggttacaaatatcctcataactatgaaaatggtcatgttgtacaacagtacttaccagaaaaattaaaaaacagagtgtattatgaaccaaaaaccacatcaaaaagtgaacaacaatttaaaacaatttacgataacttacgaaataaaacataa

SEQ ID NO: 355 - DNA, 1857 bp, Staphylococcus epidermidis
atgactaagaacaagaaagaatttacagaggctcctgtaaacttcggcgcaaatcttggccttatgctagatttgtatgatgattatctacaagatccatcatccgtacctgaagatttacaagtcttgttcagtacaattaaaacaggtgaagctcatatcgaagctaaacctaccactgatgggggtggttcacaagcgggagatagcacaattaaacgtgttatgcgcttaatcgataatattcgtcaatacggacatttaaaagcagatatttatccagtaaatcctccagagcgtcaaaatgttcctaaattggaaatcgaagattttgatttagataaagaaactttggaaaaaatatcatctggaattgtctctgaacattttaaagacatttatgacaatgcctatgatgcaattgttcgtatggaaagacgttacaaaggaccgatagcttttgaatacactcacattaataataataaagaacgtgtgtggttaaaaagaagaattgaaacgccttataaagcaagtttaaacgataatcaaaaaaaagaacttttcaaaaaactcgcacacgtagaaggttttgaaaaatatttgcacaaaaattttgttggggctaaacgtttttcaattgaaggcgtcgacacattagttccaatgcttcaacacacaatcacattagcaggtaacgaggggattaaaaacattcaaatcggtatggctcaccgtggacgtttaaatgtattaacgcatgtcttggaaaaaccttatgagatgatgatttcagaatttatgcatacagatccaatgaagtttttacctgaagatggtagtttagaattaacctcaggttggacttcagatgtgaagtatcacctaggtggcgttaaaacgactaactcatacggaatagaacagcgtatttctttagcgaataatccaagtcatttagaaatcgttgcacccgttgttgctggtaaaacaagagcagcccaagataatacacatcaagtaggagctccatctaccgacttccataaagcaatgccgattattatacatggtgatgcggcatatccaggtcaaggtattaattttgaaacgatgaacttaggtagtttaaaaggatattctacaggtggttcacttcatattattacaaataatagaatcggttttacaactgaacctattgatggacgttcaacaacgtactcttccgacgtagctaaaggttacgatgttccaatactacatgtaaatgccgatgatgtagaagcaacaattgaagctattgaaattgcaatggaattccgtaaagaatttcataaagatgtcgttattgacttagtaggttatcgtcgctatgggcacaatgaaatggatgaaccttctattactaatccagttccataccaaaacattagaaaacatgattcagttgaaattttatatggtaaaaagttagttgatgaaggaattatttccgaagacgaaatgaatgaagtcattgacggtgttcaaaaagaaatgcgaacagcacatgataaaattgataaaaatgacaaaatgaataatccagatatggaaaaaccagaatcacttcaactacctttacaaagtgatacgaaagatttctcatttgatcatttaaaagaaatcaatgatgcaatgcttgattacccaaaagattttcatgtgctaaaaaagctcaataaagtactagaaaaacgtagagaaccttttgaaaaagaggaggggctcgtcgattgggctcaagcagagcaacttgcatttgcaaccatattacaagatggaacttcaattcgtttaacaggtcaagaatag

SEQ ID NO: 356 - DNA, 231 bp, Staphylococcus epidermidis
caggtcaagaatagtgaaaggggaacatttagccatagacatgctgtgcttcatgatgaagacaatggtaatacattcacaccattgcatcatgtacctcaacaacaggctacttttgatattcataattcgccattatctgaagcagctgtagttggatttgagtatgtttataacgtcgaaaataaaggtaactttaacatatgggaagctcaatatggcgacttttag

SEQ ID NO: 357 - DNA, 909 bp, Staphylococcus epidermidis
tgcaagaagaagttggtgataaaggaaatgaagaaactacagatgaataaattaataaatataattaatacatcactgaataagtcaatacaatcatcaccattaaaaactaatttagaagaaagtatgaaatattcattaaatgctggtggtaaaagaatcagaccagtcatattattattaacactaaaaatgcttaacaaagattatcaacaaggactaaatagtgctttagcattggaaatgattcatacttattctttaattcatgatgatttaccagcaatggataatgacgattaccgtagaggaaaattaacaaatcataaagtttatggtgaatggaaagccattcttgctggtgatgcattattaacaaaagcttttgaattagtttctaatgatactaccattgaagatagtgtgaaagtaagtattataaaaagactttcaaaagcaagtggacatttgggaatggtgggtggccaagcgcttgatatggaaagtgaagggaagtcaattcgtttagaaactttagaatcaattcatgaaactaagacaggcgctttactaaatttttcagttatggctgcggtagacattgctcaagtagaacaaaatattgctaagaatttagatgaatttagtcatcatttaggaatgatgtttcaaattaaagatgatttactggatgtgtatggtgatgaatcaaaacttggcaaaaaagtaggcagtgatatagtaaatcataaaagtacttatgtttctttacttggaaaagaaggagcagaagaaaagttaaacaatcatcaatatcttgctatgaactgcttaaatcaaatttctgatcaatatgatacttctgaattaagtgatattgtagatttattctataacagagaccattaa

SEQ ID NO: 358 - DNA, 210 bp, Staphylococcus epidermidis
caacaggagaaacgaacgatgaacacaaagaaatcctgtttatatagccgaaaagcgttcattagtttatatttaatagtaattttttcaatttatttatcaattatatctttttatatctctcaatatagtttaaaattaaagacaatacataacttagatgtttactacaataaagttatcgttaataagttaaaagaggtagattaa

SEQ ID NO: 359 - DNA, 123 bp, Staphylococcus epidermidis
aaaaggaggaaatttgaacaacaaaaaacctccattttctcccatccagactatactgtcggcttcagactctcactgaatcaagacaaagcaaaaattaatacgttgtcgtcgcaggcttag

SEQ ID NO: 360 - DNA, 2448 bp, Staphylococcus epidermidis
aagaggaggaataatatgtctgaccctacactttttgattattcaatgatcaaaggtacagttgatgctattttatttcaaaatacggataatttttatactgttctaaaagtagatactatagaatcaaatgaaaaatttgatagtatgccaactgtggtagggtttcttcccaatgtagttgaaggcgatgtttatacttttaaagggcaagtcgtacaacatccacgttatggtaagcaattaaaggctgaaacatttgaaaaagaattacctcaaactaaagaagccattattagttacttatcaagtgatttatttaaaggcatcggtaaaaaaacggctcaaaacattgtaaatacactaggtgaaaatgctataaatgatattttaactcgtccagaaatcttagaaagtgtacctagtttaccaaagaagaaacaaaagcaaattgctgatcagattaatgcaaaccaagaatctgagaaaattatgatacgtttacacgacctagggtttggtccgaaattatcaatggctatatatcagttctatatgggtgatactttaaatgtcttagataaaaatccttaccaattagtatatgacattaaaggtattggttttaataaggctgaccaacttgctcgaaatgtcggtattgagccacattcacctgaaagattaaaagcagcattattatttacgttagaagaagaatgtatcaaacaaggacatacatatctacctcgtacaattgttatagaaacaacacaaaatttactcaatgaagatattgagaaaccaattgaaacagagcaattactagaaatcattgacgttttatcagaagagaaaaaattaatatctgaagctgatcaggtatcaattccaagtttatactattcagaattgaaaagtgtgcaaaacttataccgaattaaaacaaacacatctaaattaaaagaaatagaacagtctgatttacaaatacatattggtgatattgagtcacaaaatgaggttaattactctgcctctcaaaaagaagcgcttgaaacagcaataaattctaaaattatgcttttaactggtggtccgggtaccggtaaaaccacagtcattaaaggtatagttgaattatatgcagaaatacatgggctctcgctcgattatgatgattacaatgaagatgattatccagtagtgttagctgcacccactggtcgtgcttctaagcgccttcacgaatcgacaggtttagaagcaatgacaattcatcgtttaatcggttggaaccaagatacacaaccacaggatattttagaaaatgagatcaatgcaagactcattatcatcgatgaaatgtcaatggtagatacttggttgttccatcaatttttaagcgctgtgcctttagaagcacaaattgtatttgtcggagatgaagatcagttaccatcagtaggtccaggacaggtatttaaagaccttattgattctgaaataataccgcgtgttaatcttaccgaagtatatcgtcagcaagatggttccagtattattgacttagctcaccgtatgaaattaaatgaacctatcgatattactaaacgttatcatgatcgtagttttattcgttgtggtacgaatcaaattccagacgttgttgataaagtagttaaaagcgctgtagctaaaggctatgatatgagtgatatacaagttttggctcctatgtataaaggtaacgctggtattaagagacttaaccaagttctacaatctattcttaatccgaagcaacaagatgatcgtgaaatagaatttggtgaagctgtgtttagaaaaggggataaagtacttcagttagttaatcgacctaatgataatatatttaatggggatataggtataatagtaggtatattttgggccaaagaaaatgctctaaataaggatgtgttagttgtagattttgaaggtaatgaaattacatttactaaacaagatttaatggaactaacacatgcatattgtacatctatccataaatcacaaggttcagaatttcctattgtaattatgcctattgttagacaatattataggatgttacaacgtcccattctttatacaggattaactagagctaaacaatcacttgttttgcttggtgaacaagaagcatttgatataggtttaaaaacaaatggacaaatacgattaacgcaattaaatgatttgttaaaatcgtattttggacaaaacaaagataatttaactacaaataaacaaacgattaacgaacaaaaagaaaataacaatcatctggatttgaaaaatgaaaaagaaaatgatatccaattaaacgagtcgacaattttccaaatcgatccaatgattaatatgggggaaatgacgccatatgacttcgttgaacgttga

SEQ ID NO: 361 - DNA, 270 bp, Staphylococcus epidermidis
gaaaagaacctagtgacaataactgaggttctttttattaattataggccattggtcgtatttattaaaatttatgcatttttatgtttaatcttcacaaatttgagatatatttatagtatatcaattagtaggtttagaaaaatattaacaagattcacattaacaattttgtttaattgtcgtgtgagtcgggaaaataatttaataattaaaacttttttgaaagcatattctttgttgcttataaatctacttgttatgatatag

SEQ ID NO: 362 - DNA, 210 bp, Staphylococcus epidermidis
ttaaatattgaagagagaaaagtaggtattattataaaacttattataagagaaagaatcatcgataaaaattcacaatattcagataatttaaggtatgatattattccaatgcttatatttagtacaatagtagtaataataacaatacttagtgatatgaataaattatttagttttaatttttcaattttaaaatttaccatttaa

SEQ ID NO: 363 - DNA, 228 bp, Staphylococcus epidermidis
gttataattgaaaaactaagtttgaatttatatcttataacatacaaaattatacttgagggaaatcttattaatagattagattctaatgactcattgagatgtaagattaaagcaaatagtaaagaaccaatagaaatagaagttaataaactgaagttatttagcaaaatgttaaatactacttccctaaataaaatttcttcccctaaagctataaagaaataa

SEQ ID NO: 364 - DNA, 615 bp, Staphylococcus epidermidis
aggagtactgacatgtatgcatatattaaaggaacattatctcagttgttccctacacatgtagtggttgagacatgtggcataggttatgagatacaaacgcctaattcctatcgttttcaaaaatatcttgaaaaagaagtccaaatttatacttcactaattgtacgagaagatgctcaactactatatggctttattaatgaagaggaaaaagaaatgtttcttagcttaataaaagtgactgggataggacctaaatcagctttagcgatacttgcttcaagtacaccacatgaagttaaattggctatcgaaaatgaaaatgatgcttatttaacacaatttcctgggataggaaagaaaactgcaagacaaattgtgttagatttaaaagggaaggttacaattactgaagaaaatagtgacgatttattacaaactcaagttaatggtaatgaacaaaaccaaataatatctgaagcactattagctttacaagcactgggctattctaaacgagaattaaccaaagtagaaaaatccttaaacaaacataatgtgaatagtgtggatgaagccgttaaaataggactacaaacactagtttcttaa

SEQ ID NO: 365 - DNA, 651 bp, Staphylococcus epidermidis
caacatgatgagaaaggaaattggctaatgaatcagacaacgattattggcattgcagggggttcaggctctgggaaaaccacagttactaatgcaatcatgaagaatttagaaggtcatagtgtcgcactcttagcacaagattattactataaagatcaatcacatttaacttttgaagaacggcttgaaacaaattatgaccacccatttgcatttgataatgatttacttattcataatttaaaagatttaagaaatggaaaaccagtagaggtacctacgtacgattattctcaacatacacgtagtaaagaaacaattgcatttgatccaaaagatgttattatcgtagaaggtatctttgctttagaaaacaacacattacgagacatgatggatgtgaaaatttatgtcgatactgatgctgatttacgaattttacgtaggcttacaagagatactaaagagcgtggtcgtacaatggaatcagtaattaatcaatatcttaatgtagtaagacctatgcatgagcaatttattgaacctacaaaaaagcatgctgacatcataattcctgaaggaggcagcaataaagttgccatagatattatgactactaaaatccagtcactcgtaagcaaaaaatag

SEQ ID NO: 366 - DNA, 1692 bp, Staphylococcus epidermidis
ggatgcgatgaatttatgttacaaaccttatcaataaaacaatttgccattattgacgaacttgatataaacttttctgacggtctaacagttatgagtggtgaaactggctcaggaaaatctatcattattgatgccattggacagttaatcggtatgagagcttcttctgattacgtcagacatggtgaaaagaaagcaattatcgaaggtatctttgatatagacgagagtaaagatgcaattaatatactagaatcattagctatagatgttgatgaagattttttattagttaaaagagaaattttcagttctggtaagagtatttgtcgtattaataaccaaattgtcactctacaggacttaagaaaagtgatgcaagaactgcttgatattcatggtcaacatgaaacgcaatctttacttaagcaaaaatatcatcttcaactattagatgattatgcagacaatcagtattcagatttacttaatcaatatcaactttcttataaccaatataaaaataaacgtaaagaattagaggaattagaatccgcggaccaagctttattacaacgattagacttaatgaaatttcaattagaggaactaaccgaagcttcactgaaagaaggcgaagtggaccaacttgaatccgatattaaaagaattcaaaactccgaaaaattaaatctagctttaaacaatgcacatcaagttctaactgatgaaagtgcaatacccgataggttgtacgaattaagcaactacttgcaaacgattaatgatatcgttccagaaaaattcgtaagattaaaagaggacattaatcaattttactatttgctagaagatgcaaagcatgaaatttacgacgaaatggctaacactgaattcgatgagcaagttttaaatgagtatgaatccagaatgaatttacttaataatttaaaacgtaaatatggtaaggatattactgaacttattgcttatcagagtaaacttgcaaatgaaattgataaaatagaaaactatgaacaaagtacatcacaattaagggaagaaattaaaacgctttataacgaagtgatagatataggaaaaaaactttctcaagaacgtaggcgtgtagcgagagagttaagggaccatattgtttctgaaatacaaaatttacaaatgaaagatgctaaccttgaaatttcgtttaaaccattagatgaacctacaattgaaggtattgaatttgtggaatttttaattagtccaaatcgtggtgaaccacttaaaagtcttaataaaatcgcttcaggcggtgaactttcaagaattatgctagctctaaaaagtatatttgttaaatcacgcggccaaaccgcgattctttttgatgaagttgactcgggtgtatctggtcaagcagcacaaaaaatggctgaaaaaatgcgagatattgctcaatatatacaagtcatttgtatttcacacttacctcaggtagcttcaatgagtgaccatcatcttctaataagcaaggcatccaatgccgatagaactacaactcaagtcaaagaattgaaagatgaaaacaaaatagatgaaatagcacgtatgatttcaggagcaagtgtgactgagctcacgagagaaaatgcaaaagaaatgattaagcaaaatcacaatatttaa

SEQ ID NO: 367 - DNA, 348 bp, Staphylococcus epidermidis
aggaggcgtgatgatatgattgaaaaacaggatttcaatcatatagaggaccaacttgatcaactagcaagtaataaacaactcaaaacaccagaagctagggaacttttagatagttatttcgatttaattattaattattttaaacaaataaataacatagatgaaattcattttaatcaactcgatacatatccagtagttccaatgaattttgatgaacgctatcattatatggttgcacgtaaacaccattttatgggctatcgtcaaatgaaaacattgaaatcagaattaataaaaatgaatgcatcttatctaattagaaagcaacgtcaacaaaaataa

SEQ ID NO: 368 - DNA, 780 bp, Staphylococcus epidermidis
aaggttggtgatcaactgatgctaatgaaacaaaagggcatcattatcaaatctgttgattatggtgaatcagacaaaattattacaattttaaatgaatacggagctaaaataccactaatggccagacgagcaaaaaaagttaagtctggacttcaagcaaatacacagcttttcgtatatggcttatttatatataataaatggcgaggcatgggaacactaaattctgttgatgtgattaatcaacattatgaactccaactcgacttatttgaaagtagctatgcatctttatgtgctgaaacaattgaccgatcaatggaagagaatgaggtttcaaaatataattatgacttacttcaatttgttctttccaaaattaacgaaggaacccctgcacaattaatgtctgtaatcgtcttattaaaaaatatgtctaaatttggattcacagcttcatttgatcactgtgcaattaccggcattcaagatcaatcaaaacttatagcgtatagttttaaatttgacggtgctatttcagaatctgcattatatcaggatcaacatgcttttcatctctctaatcgcaccttatatcttcttaatatcctgcagcaattacctataagtaagatgaatcatttaaatattcagcaagacatattaaatgaaatgtctgaactacttatcatgctttatcgtgagtatgctggtatgttttttaaaagtcaaaaattaataaatcaattaaatagattagaaaaagattcattgtaa

SEQ ID NO: 369 - DNA, 726 bp, Staphylococcus epidermidis
gggcgaggtgaaaaaatggataacttacatctaatacatatgctatttatggcaaaacctttaaatggaatgaattgggttgaaaaccttgcacagtttatcactcaaccttttgtttctcttattttcacttgtattatatttattggctttttataccaactatattcaaagcgcataaacttaatgggaataatagcattacttgctttactacttttatttttagcattcctaattaatggcgatgtcaatgtgatgtcagtattactgtttacaattggcctcatactactgattgttgaattatttgttataggcgctgtaataggtattattggtattattctaataacactaagtattattatacttggtgacaatattttattaatgcttggaaatgttatagttgcattaatattatcaattgtagaatgggtgattttagtgaaaatattcaatagaaaaattccatttttagataaagttattttaaaggattcaacaaattctgaagcaggttatcgttcacatgacgaccgctctcatcttgtaggaaaaactgcacatactgttaccgatttaagaccagcaggaattataacttgtgacaatgatcgaatagacgcagtatctgatggatcatttattttacgtaatcgacaagttaagattcttgaagttgaaggtacacgtgttgttgttagagaaatcgaaaaataa

SEQ ID NO: 370 - DNA, 213 bp, Staphylococcus epidermidis
aggaggagcgacgtgataggcaaacactttattataactggagcaacgagtgggttaggttttgcaataaccaatgaattacttcaaagaggggcccatgttactatacttgcaagaaatatagataagttcaatcgaatcaaagaaaactattttaaacctgaacatatcaatgtgattaaatgtgatttaatgcaacgaaaagaatattga

SEQ ID NO: 371 - DNA, 630 bp, Staphylococcus epidermidis
agacctatagaattaagtcaaagacaagaacaaataatagagattgttaaatcggaaggacctatcacgggcgagcatatagctgaaaaaatcaatttaactcgtgctacattacgtcctgacttggctatactcacgatgtctggttttatagaggcacgtcctcgagtaggttatttctattctggtaaatctaaaaataaaatcataaacgaaaaattacgaaaatatgttgtaaaagattatatgtcgcatcctgttgtcataaaagaaaacatgactgtttatgatgctatatgtaccatctttttagaagatgtcagtacattatttattacaaatgagaataacgattttgtaggagtatgttctaggaaagacttacttcgtgcctcaatgattggtgaggacatacatacaatgcctatcagtgtaaatatgactagaatgcctcatgtttcatatttaaaagaacaggaactcgttatttatgctgcaaatcaaatgattgataaagagatagattcattaccaattgttagacctaaagaaaacgacaaatttgaagtaataggtcgcatctctaaaacaacaatcactaaattattcgtttcattatttaaagaatag

SEQ ID NO: 372 - DNA, 1068 bp, Staphylococcus epidermidis
ttattaatagattatcagtatttactaaaatcgggaggccttttcatgtctgacaaccaagttaaaattaaaaagcaaacaattgatccgactttaacactagaagatgttaaaaaacaattaattgataaaggaaaaaaagaaggtcatttaagtcacgaagaaatcgctgaaaaactgcaaaattttgaaatggactcagatcaaatggatgatttcttcgaccaattgaatgacaatgacattacacttgttaatgaaaaagatagttctgacacggatgataaaatcaatcctaatgatttgagtgcccctcctggtgtcaaaatcaatgacccagtgcgtatgtatttaaaggaaattggtagagttaatcttttaagtgctcaagaagaaattgagcttgcaaaaagaattgaacaaggtgatgaaattgctaaatcacgattagctgaagcaaacttgcgtttagttgttagtattgctaaacgatatgttggtcgtggaatgttattcttagatttgattcaagaaggtaatatgggcttaattaaagctgtggaaaagtttgattttagcaaaggatttaaattttcaacatatgccacttggtggattagacaagctattacacgagcaattgctgaccaagcacgtacaattcgaataccagtacacatggtagaaacgattaataaattgattcgtgttcaacgtcaattattgcaagatttaggaagagatccagctcctgaagaaattggagaagaaatggatttaccaccagaaaaagtcagagagattttaaaaattgcacaagaacccgtttcattagagacgccaattggtgaagaagatgatagtcatttaggagatttcattgaggaccaagaagctcaaagtccatctgaccatgcagcatacgaattgttaaaagaacaattagaagatgttttagatacacttactgacagagaagaaaatgttttacgtttacgttttggtttagatgatggacgaacaagaacactagaagaagttggaaaagtattcggtgtaaccacgtga

SEQ ID NO: 373 - DNA, 852 bp, Staphylococcus epidermidis
cttttgatagatgcgttattaaattttgattttattagatattctttgattagcggtctgcttattggctttatcgcaccattaataggtgcatttattgtagttcggagactatctttaattgctgacgctttaagccacgtgacattaggtggtatttcctttggtatgtttttgcttaccattattcccgttttctcagtaataaaccctatgtggtttggtattctttttgctgttattggagcgttattaattgaaaaattaaggacttcgttttctaattatcaagaaattgcaattcctattataatgagcgctggtattgctctaagtgctatttttatttctctagcagatggttttaatcaagaaatcgtaggcctactatttggatcaattagtgcagtaaatattagtgatttaactacaattattatcattacaataattgttctcatatttattgttttattttataaagaattgtttattttatcatttgacgaagaatatagtaaggtcataggtataccaaagtggattcaatttttatttatagtaattgttgctatggtaatatctgcatcaatgagagttgtaggtatattattagtaagcgcgttaataactcttcctatagcaatttcaatgagaataactaaaggatttaaacaattaatagcattaagtgttatattaggagaattatctgtaattctaggattaattatagctttttatatgaatatatcacctggtggcgtcattgttgtactattggtattaatgctcatactaacgatgattattcagaagttaaaaattaagtttaaaaagggagtcgtttaa

SEQ ID NO: 374 - DNA, 741 bp, Staphylococcus epidermidis
gaggtagtagaaagtatgactaacgaaattttaatcgttgatgatgaagatagaattagaagattacttaaattatatttagaaagagaatcttttgaaattcatgaagcaagagatggtaaagaagcctacgagcttgctcttgaaaacaactatgcgtgcatcctcttagatttaatgcttcctgaaatggatggaattgaagttgcctctaaacttagagaacataaagatacacctatcatcatgcttactgcaaaaggtgaagaaacaaatcgtgttgaaggatttgaatcgggagcagatgattatattgttaagcctttctcacctagagaagtagtattgagagtaaaggcgttattaagacgtacacaaactgcaaacactgagcaaagcgaaccgcatgcacgcgatattattgaatttagtcatctagtgattgataatgacgctcatcgagtccttgcggatgatcaacaagtgaatctaacacctaaagagtatgaattactcatctatttagctaaaactccaaataaagtatttgatcgagaacagttacttaaagaggtttggcattacgaattttatggggacttgcgtacagtagacactcacgtcaaaagacttagagaaaagttaaatcgagtatcaagtgatgctgcacaaatgatacaaactgtgtggggtgtcggttataaatttgaggtaaaacctagtgatgaaccgactaaatag

SEQ ID NO: 375 - DNA, 354 bp, Staphylococcus epidermidis
atgaattcagaagaattattaaatattgctgtcgaagcggcagagaataagaaagcagaagatattatttctctcaatatgaatgaaattagtgatatgacagattattttgtagtctgtcacgggaacaatgaacgtcaagttcaatccattgctagatctgttaaagaagtggcacataaacatgatattgacgttaaacgtatggaaggctatcaagaagctcgatggatacttattgatttagcaaatgtagttgttcatgtttttcataaggatgaaagaagctattacaatttagagaaattatatcaagatgcacctattaaagaatacggtcaggcagtattttag

SEQ ID NO: 376 - DNA, 1425 bp, Staphylococcus epidermidis
accatgtcagaaaaacaatacgatttagtcgtgttaggtggtggtacggcaggatatgtagccgccatcagagcttctcaattaggaaaaaaagtagcgatagtagaaaaatcactcttaggtggtacgtgtttacataaaggatgtatacctactaaagcacttttaaaatcggctgaagtcaatcatactattaaaaacgcgcatacatttggaattgatgtcaatcattttaaaattaatttccctaaaattttagaacgtaaagatgctattgttaagcaattgcatgaaggcgtcaatcaactgatgaaacatcatcatatagatatttataacggtattggacgaattatgggaacatctatattttctcctcaaagcggtacaatttctgtggaatatgaagacggcgaatcagatatactccctaataaaaatgtgcttatagctactgggtcgtcaccacagtctcttccgttcattaaatttgaccataaacaaatactatcgagtgatgatatcctaaggttaaatacactaccacaaagattagcaatcataggtggaggtgttattggtttagaatttgcatctctgatgaatgatttaggtgctgatgtagtagtaatcgaagcgaatgacagagttcttcctaccgagagcacacaagttgcgtcattactaaaagaagaattaactaatcgaggcgttacattctacgaaaatattcaattgaccaaagatcattttaaccaaactgataagggtgtaactattaatatttcagatgagcccgtccaattcgataaagtacttgttgcaattggtagaaagcctaatacaaatgatattggtttaaataacactcaaattaagacttctgatgctggtcatattattacaaatgcttatcagcaaactgaagataaacatatatacgcagcaggagattgtatagggcaattacaattggcacacgtcggttcaaaagaagctatagttgcagttgaacatatgtttgattgttctcctatacctatcaattatgacctgataccaaaatgtgtttatacaaacccagaaattgcttcaattggtaaaaatttagaacaagcaaaaaaagcaggcatcaaagcaaaaagtatcaaagttccttttaaagctataggaaaggcaataattgaggatgtaacccaatcaaaaggattttgcgagatggtagttaacaaagatgacgatgaaatcataggtcttaatatgatagggccacatgttacagaattaataaatgaaatttcattgttacaatttatgaatggctcatctttagaacttggtttaacaacacatgcacatccttcattatccgaggtagtcatggaattaggtttaaaagctaatggtcaagcaattcatgtatag

SEQ ID NO: 377 - DNA, 912 bp, Staphylococcus epidermidis
gaggtggcagagacaatgaaagtttcacaagataaaagtgcgcttgtcattcgtattatctcattaatcattattattggcttagtaatcacaattatcctcccgatgattaatatctttgccttagcatttaactctggggtagatgctcaaaaaggtggcatcactttctacccgcgtaaattttcactagataattttaaggagatatttaaacaaggcacgttattaaatgcattatttattagtatcgcaaagacagtcataggaacgatactaagcgtcatattaacagctatggctgcatacgttctaacaatcaaaagtttaccgtttcgaagaatcatctcattcttcctagtctttacgatgttattcagtgtcggtgttgtaccactttatatcctattaaatcaacttcatttaactgatacattctgggtatacattttaccgtcactttatagcgtttataacattttaattatgcgtacattcttcaatcaattacctagtagtgtgattgaagccgctagagtagatggttgtaatgactttcaaatcttttggaaaattgtcttacccatgagtaaacccgtggtggcatcaattacattatttaacgccgtgagtcagtggaatgattggtttacaggtgcattcttcgtacgtaatccaaacctcaaaccgttagctactgttttacaagatatgttaacgaaacaagctgccattgcagatgctttaaaacaaaagtcaggttcatatgcgatgttagacaagttgacaattacaggggactcaatgcagatggcaatgattgtactattaacaattccagtattattcctcttcccatttgttcagaagcattttgtaaaaggtataactatcggttcgacaaaagagtaa

SEQ ID NO: 378 - DNA, 1380 bp, Staphylococcus epidermidis
ttgctgaaagataatttaaagagatggtttggttttgatgaatttaaagaggggcaagaagaaattattgatagtgtccttcatggaaggcatacacttggaattttaccaactggtagcggtaaaagcttatgttatcaactccctacatatatattagaaaaaccgacattaattatatcaccactcatttcgcttatggatgatcaagttatgcaaatgaagttaaaaggtgaaacacatgttgcatgtgtacattccggcatggacgaagtagaaaaaagagacaatattaaacgactaagtaaaagtcgatttatttatttaagtccagaatatatactgcaacctcataattttaagtacatcgctcatatcaactttggattaatagtattagatgaagcgcactgtttatcagagtgggggtatgattttagacctcactatgctttagttggtaaaattattcatcattttaattcagcaacagtgttagcactaacagctacagcaccacctcaattagaaactgatttatctcacattttatcactcaaattaaatgtagttcaaaaaagtatgaatcgagaaaatattagcttacaacactataattttaatgatgatgaggggaagattgaatggctgttaccatttttatctaattctgggcctacaattatatatgtttcttctaaaaaaagatgtttagaactagctcaaatgatttatgactcaggatatctaacaggtatatatcatggagatttaagttatcaggaacgccaaacagttcaacaacagttttttaataatgacatccccgttatagtagcaacaagtgcttttggaatgggaataaataaaaaagatattcgtacagtcatacattttcatttatcatcttcaccatctaactatttacaagaaattggtcgtgctggtagggatggtaaacaaagtcaagccattagtttatttcaacctgatgatagttttattctagaaacactactattcactgatattatcacagatgacgatattacaatgtttgagacgggaaaccacttaccagatgaaaaggaaaaaattttaagtactttaaatatacaattcacatttagccaacttaaagatatatttcatcaatcatatcaacgtaagcgactaggttatatgagaatgatgggctatactaatttagatcaatgtcgacgtaaatacttactagaattttttggcgaacatcctcaaagtccaaaacaatgttgtgatcaagattcaagattagagcctattcagatattgaatcgtaaaaaggtgaaaagaaaactaagttttaatgaaaaattatataatttgttcgaaacctag

SEQ ID NO: 379 - DNA, 1248 bp, Staphylococcus epidermidis
acaatggaagatatctacaaacttatagacgatatcaatctacaaaaaatagaaaacttagattctcgagtaaatgaggcattgagttcaaacaatgatgatgcattatttatacttggtgaaactttatataatttcggtcttacacctcaagggttagaagtttttagaacgttgtatcataaatacccagatgaaagtgaattactcatttactttatcgaaggtctcatgtctgaaaaccaaactgacgaagcacttgaatatttagcacaagtagaaccatctaccgaaaagttgatgctagaagccgatttataccaacaaataaatatgttagaagtagcaattgacaaattgcaagaagcattagatcttgaacctaatgatccaattattcacttcgccttagcagagctattatactacgatgggcaatacttacgagctacaagagagtatgaaacagtattagaaactggtgaatatgaagttaatggagtaaatattttttcgcgaatggcagattgtagtttacaaagtggtaattattcagatgctattagcttatttgatgaaattaatgaagaagagatgaattctgaagattactttaaaaaatcaattgcttatgaaaaaaacgatttaactcaagaagcaattaaaattatgcaaacattactttcaaaagatcctgattttatacaaggatatttttatcttcaatctctatttgaaaatgaaaaaaattatcctgatgctatagaaactggtaaggaaggattacgtttaagtcaattttacaaagaattaatggtttctacaggtagcttagaaattgagcatggagatgcaaatgaaggtgtagaattgctaaaacaagccttagaagtcgataatgcatatcatgaaccattgttgattttaagtgatttatatcgtaatgaagaagactatgaatcaattatacaattgttgacttatgtagatgaagaagatttagaccctattttcatgtggcatttagcatatgcatacggtcaagaagaacgagataaagaagcgcaacatttctttgaattagcatatccaacattacaaacccaagttgaatttttaagcgattattatttctatttattagaaattggacaaaaagaaaaagcaattttgattttaaatcaattattagaaattgatccaagcaatgaaaattggcatgacgagtcaatgagattgcaaatataa

SEQ ID NO: 380 - DNA, 444 bp, Staphylococcus epidermidis
caaatcatggatttaaactttgatttatatatgaatgatgttgttgaacaagcacgaaacgaaattgagcatgctggttatcaacaattaacttctgctgaggatgttgatcaagttttacaacaaaaggggacatctttagtcatggtaaattccgtatgcggatgcgcaggtgggattgcacgtcctgcagcgacacatgcattacattatgataaattacctcaacgattagttacagtatttgcaggacaagataaagaggcaacacaacaagctagagaatattttgaaggatatgcaccctcaagtccatcttttgctttgattaaagatggtaaaatcaccgagatgattgaacgacatcagattgaaggtcatgatgtaatggacgtaatcaatcagttgcaagcattgtttgataaatattgtgaagaaagataa

SEQ ID NO: 381 - DNA, 531 bp, Staphylococcus epidermidis
aatctaatggatcaatcattaatggattattattatcaatttcataagcatcaacattacttcctatgtcatgatattttagaagatgcttggaaatcacaaaatactttttcaaaacatgatgcagtagtaagtctcattttgtttgcaacagctaattatcactatcgtcgtgggaatttaaaaggcgcattaaaatcttttgaaaaagctttattaactattaaccacgctaaagatgacactcaattacaccttaatatcaatgaatttaaacaacttattgtgaaaatgattgaagcagtaaaattacaaaaacaatttactccgttacaattacctattgaaccagagtttcagacacttattaaacgtaaatatccggattatttgtttacctctcaaataattaaggaaccttatattgttgatcatcatattaaacgtgacagaactgaagtgataaaaaatagagaacgtgctttattccatagacagtatcgaaacaaaagcaataaaaaagaccagtaa

SEQ ID NO: 382 - DNA, 171 bp, Staphylococcus epidermidis
aaaggtaaggaggagaaactcatgcgcgtaaacgttacattagcttgtacagaatgtggagatagaaactatatctcaacaaaaaacaaaagaaataatcctgaacgtgtagaaatgaaaaaatattgttcacgtgataacaaacatactttacatcgtgaaactaaataa

SEQ ID NO: 383 - DNA, 672 bp, Staphylococcus epidermidis
aacaacaaggaaggttatcaaataatgagttcaattaatattgcactagatggcccagctgctgcaggtaagagtacaattgctaaacgtgtagccagtcgtctatcaatgatatatgttgatacaggagcaatgtatcgtgccattacatataaatatttacaaaatggcaaacccgaaaattttgattatctgattaataacactaaacttgagcttacttatgatgaagtaaaagggcaaagaatcttactagataatcaagacgtcactgattatttaagagaaaatgatgtaacacatcacgtatcttatgttgcttctaaagaaccagtgcgttcatttgcagtgaaaatacaaaaagaattagctgctaaaaaaggtatcgttatggatggccgagatattggtacagttgtattaccagatgccgaattaaaagtttatatgattgcatctgttgctgaacgtgctgaacgtcgacaaaaagagaatgagcaacgtggcattgaatcaaatttagaacaattaaaggacgaaattgaagcacgagatcactatgatatgaatcgtgaaatttcgccattacaaaaagccgaagatgctattacacttgatacaactggcaaatctatagaagaggtaacaaatgaaatattgtctctactttaa

SEQ ID NO: 384 - DNA, 1164 bp, Staphylococcus epidermidis
tttgacaaggagtgtccaaacatggaagtatacgcagattatgctgcgactacgccagtaaaaccagaagtaatagatgctatgatggaaatatatcaatctcattttggtaatccatcgtcaatacattctattggtagagatgcacgcaaatatcttgatcagtcacgtcgtacagttgcacaattgttgggagcgaatccgaatgaagtaatatttacaagtggtgcaacagaatcgaataacactgctattaaaggattagtgaaagcgaatgaacaattaggtaatcatattattactaccaaaattgaacaccattcagtattacacgtatatgagcaacttgaaaaagaaggttatgatgttacgtatctagatgtagatgatactggtgcagttgatttagaccaattaaaagaaacaattaatgatagaacaattttagtatcaattatgtttgtaaataatgagattggaacagtacaaaatatttatgatattgaagatattattggagacactcatgcgttattccatgttgatgctgttcaagcaattggacatttagatttagattttcataattttaaaattgatacaatgagtatttcagcacacaaatttggtggtcctaaaggtgttggtctactattagtaaaagagcatacaccaatagcatataatcaacttggtggtgaacaagaaaccaaacgtcgagcaggtacagaaaatttacctcaaattgttggattaacaaaggcacttgaattagctataaccaatcaagatgtaaataatgttcatttaatgaatttaaaagaattatttttagttcagttacaggaaagggcaattccatttgaattaaacggttcaatgacagattcaacgggtcatattttaaatatttattttccatttatagatgttgaaacaatgttaacattattggatttagcccatgtatatgtatcttcaggttctgcttgtacagcaggttcaacgactccatctcatgtacttgcagctatgtttgaagatgaagaacgagcaaaacattcagtacgttttagctttaatgaacaaacaacaacgcaagaaattaaatatattgtagctgaaattcataaaatctatcataaatttaaggaggaatcatag

SEQ ID NO: 385 - DNA, 996 bp, Staphylococcus epidermidis
tatatagaggaaggtgtacgtatgagcaacaatatcttcactgtctacggtgaagtaccagaattagtcgaaaagaaaacaaaagaaattgtaaatgattatctaggacaagagatagatgactttaattatgtaaaatacaacttgtatgagagtgacctaactccgattattgaagagacacttactatgccttttttctcaaataaaaaagcaattgttgtaaagaactcgtatgtttttacaggggaaaaattttctaaagatttaaatcacaattctgacgagcttataaaatttttagaaaaatatgatggtgaaaatctcattatctttgaagtgtatcagcctaaactagatgagcgcaaaaaactcacgaaaacgttgaagaaaaatgcacaacttaagaaaattgaacaaatgtctgaaaaggaattaaagcattggattaaaaatacactaaacaataattataaagatattaagcaagatgctcttgaattatttattgaattaactggtgttaactataatattgtttctcaagaattagaaaaattaattttattcataggtgagagacctataattaataaagaagatatcgatttaattattaatagaagtttagaacaaaatgtatttctactaactgaatacattcaaaaaggtaataagaataaagctatacaattagtcaatgatttaatcattatgaaagaagaacctataaaattactggcattaattactagtaattatagattatattatcaatgtaaaattcttagtcaaaaaggctatagtgggcaacaaattgcaaagactgtaaatgcacacccttatagagtaaaactagcactcaatcaatcccgacattataaactagaaagtttgtttaacatcataaacgcttgtgcagagactgactacaaactaaaatcatcttatatggataaacaactcattttagaattattcatactatctctataa

SEQ ID NO: 386 - DNA, 1332 bp, Staphylococcus epidermidis
aaaagagaggaagtttatcctatgactaaaccgatagtagcaattgtaggaaaaccaaatgtaggaaaatctacaatttttaatagagttgtcggcgaacgtgtatctatcgtagaagatacgccaggcgttactcgtgatcgtatttattcatctggcgagtggttaactcatgaatttaacatcattgatacaggtggtattgaaattggagatgctccttttcaaactcaaatccgtgcacaggcagaaatagcaattgaagaagcagatgtcatcatttttatggtcaatgttagagaaggacttacacaaagtgacgaaatggtcgcacaaatgctttataaatctaagaaacctgttgtattagctgtgaataaagttgataatcttgaaatgcgtaatgatatctatgatttctattctttaggctttggagatccatatcctatttctggttcacatggattaggacttggagatttgctagatgcagttgttgaaaactttaataaagaatcagaagatccttatgacgaagatacgatacgtctttccatcatcggtagacctaatgttggtaaatctagcttggtcaatgctattttaggcgaagaacgtgttattgtgtctaatgttgctggtacaactcgagatgccattgataccgagtactcttatgatggacaagattatgtattgattgatactgctggaatgagaaaaaaaggtaaggtgtatgaatcgactgaaaaatattctgtattacgtgcattaaaagcgattgagcgttcagaagtagtattagtagttatcgatgctgaacaaggtataattgaacaagataaacgtgtagctggctatgcacatgaggaaggtaaagctattgtcattgtagtaaataaatgggatacaattgaaaaagatagtaagacaatgaaaaaattcactgatgatgttagaaatgaatttcaatttttagattatgctcaaatcgcgttcgtatcagcaaaagaagggctaagattaaaaacattattcccttatatcaatcaagccagtgaaaatcataaaaagcgtgtccaaagttctacactaaatgaagttgttactgatgccatctctatgaatccaacacctactgacaaaggtagaagacttaatgtattctatacaactcaggttgcaattgaaccaccgacatttgtagtatttgtcaatgatgttgaattaatgcatttttcttataggagatatttagaaaatcaaatacgtaatgcttttggttttgaaggaacacctattcatattattccaagaaaaagaaattaa

SEQ ID NO: 387 - DNA, 183 bp, Staphylococcus epidermidis
gacttactactgcatcatgttttgaaaaagtattttgtgatttccaagcatcttctaaaatatcatgacataggaagtaatgttgatgcttatgaaattgataataataatccattaatgattgatccattagatttcacccataatttaaaagttgtatgtattcatgctataataatttag

SEQ ID NO: 388 - DNA, 159 bp, Staphylococcus epidermidis
gttctttgttctaattcacttagtgtcatacccaatctttcacgtctacttttcaacacttcaccaatcgttttcactcaaagtcctcctagacattattcaaagaaaccaaaccctccaccaaatggatctccaaaatctaaattattcttgctttga

SEQ ID NO: 389 - DNA, 636 bp, Staphylococcus epidermidis
agaagaatctctatgatagttaaattttgtggttttaaaaccgaaagtgatattaagaaaattaaaaaattagaagttgatgcagtagggtttatacattatcccgatagtaagagacatgtctcactgaaacaattaaaatatttggctaaaatagtgccagatcatatagagaaagtagtggtcgtagtaaatcctcaaatgtccaccataaagagaataattaatcaaactgatattaacacaatccaattacatggaaatgaaagcattcaattaattagaaatattaagaaacttaattcaaaaataagaatcataaaagcaattccagcaacaagaaatttaaataataacattcaaaagtataaagatgagatagacatgtttattatagatacaccatcaatcacatacggagggacaggtcaaagttttgactggaaattattaaaaaaaataaagggcgttgattttctcattgcgggtggtttggattttgaaaagataaaacgattagaaatatattcatttggacaatgtggttatgacatctcaactggcattgagtcatataatgaaaaagattttaataagatgactcgaatattaaaatttttgaaaggagacgaatga

SEQ ID NO: 390 - DNA, 195 bp, Staphylococcus epidermidis
cgttcattatccaaaacgagacctcctactacagaaagttatctgtataatatcttatacttactatacaagcattttaagcaaaatacaagtcttttgcgaatatttgttcgcatttattgtgtgatagctgatacaaaaacgaacaaacgtacttatattttttgcaaaaatttaaaatatactatttattaa

SEQ ID NO: 391 - DNA, 2121 bp, Staphylococcus epidermidis
gagaggagattcataatgtctcaagagaagaaagtttttaaaactgaatgggctgggcgttctttaactattgagacaggacaattagcaaagcaagctaatggtgctgttttagtgcgttatggagatacagttgtcctatcaactgcaactgcttctaaagaacctagagatggcgattttttcccattaactgtaaattacgaagaaaaaatgtatgctgctggtaaaataccaggaggattcaaaaaaagagaaggtcgccctggtgatgaagcaacgttaacagctcgtctcattgatagacctattcgtccactgtttccaaaaggatatagacatgacgtacaaatcatgaatattgtcttaagtgctgatccagattgctcaccagaaatggcagcaatgattggttcttcgatggcgttaagtgtttcagatattccattccaaggtcccatcgcaggtgtaaatgtaggttatatcgatggcaaatatgtcattaatccttccgtcgctgataaagaaatttctagattagatttagaagttgctggtcataaagatgcggtaaacatggttgaagcaggcgcaagtgaaattactgagagtgagatgcttgaggctattttcttcggacacgaggaaatcaaacgacttgttgcattccaacaagaaatcatcgatcacattcaaccgataaaacaagaatttgtaccggtggaaagagacgaagatttagttgaaaaagtaaaaagtttaactgaagataaaggacttaaggacacggttttaactttcgataagcaacaacgagatgaaaacttagatgctctgaaagaagaagttgttggtcattttctagatgaagaagatcctgaaaatgaaacgcttgttaaagaagtttatgcaattctaaatgacttaattaaagaagaagtaagacgtctaattgcagatgaaaaaatacgacctgatggacgtaaagtagatgaaataagacctcttgaatcagaagttggtttgttaccaagagctcatgggtcaggtttatttactcgtggtcagacacaagcactttcagttttaactttaggcgcacttggagattatcaattaattgatggtttaggacctgaggtagaaaaacgttttatgcatcattataactttcctaatttctctgtaggagaaactggccctgtacgtgcacctggtagacgtgagattgggcatggtgcgcttggtgaaagagcattacgttacattatacctgatactcaagatttcccttatacaattcgtattgtaagtgaagtattagagtctaacggttcatcatctcaagcatcgatttgtggttcaacattagcattaatggatgccggtgtaccaattaaagcgccagtcgcagggattgcaatgggactagtaacgcgtgacgatagctatacaattttaactgatattcaaggaatggaagatgcattaggtgatatggacttcaaagtagcaggtactaaagacggtattactgcgattcaaatggatattaaaattgatggtttaactcgagaagttattgaagaagcactagaacaagcgcgtcaaggacgattagctattatggatcatatgcttcacacgattgaacaaccacgcgaagaattaagtgcttacgcaccaaaagtggtaactatgagtattaatccagataaaattcgagacgtgattggaccaggtggtaagaaaatcaatgaaattatcgacgaaactggagttaaattagatattgaacaagatggtacaatctttataggtgctgtagatcaagcgatgattaaccgtgcaaaagaaattatcgaagatattacacgcgaagcggaagttggacaagtatatcatgctaaagtaaaacgtattgaaaagtatggtgctttcgttgaattgttccctggtaaagacgcgttattacacatttctcaaatttcacaagaaagaattaataaagtagaagatgttcttaaaattggagatacaattgaagtgaaaattactgaaatcgataaacaaggtcgcgttaatgcgtcacataaagtattagagcaatctaaaaattaa

SEQ ID NO: 392 - DNA, 948 bp, Staphylococcus epidermidis
ttagatacatcaaaggggcaatctagtatggaggaagttttaaaacttaaaatccctgcatcaaccgcgaatctaggtgtaggttttgactcaattggtatggcattggataaatatttgcatatgtctatacgtaagattgaaagagctaattgggaatttctatattatagttcagaactagaaggtttacctaaagatgagaataattatatttatcaaactgctctaaatgttgcgcgtaaatacaatgttacacttccaagcttgcaaattgaaatgagaagtgatattccattagctagaggactaggttcatctgcttctgcattagtcggtgctctttttattgctaattactttggtaatattcaattatctaaatacgaattgttacaactagcgactgaaattgagggacaccctgataatgtagcacctacaatatatggaggtttgattgcaggtttttataatccaataactaaaataacagatgttgctagaatagaagttccgcacgtagatataattttaactatacctccatatgagcttcgtacagaagactctagaagggtcttacccgatacattttcacataaaggtgctgtgcaaaatagtgccattagtaacactatgatttgtgctctcattcagcataaatataaacttgctggaaagatgatggaacaagatggttttcatgaaccatataggcaacaccttattccagaattcaatcaagtacgtaaactatcacgtcaacatgatgcatatgcaactgttataagtggagctggacctacgatactcactctttgtccaaaagaaaaaagtggtaaattagttagaacactacgtgagaaaattaataattgtgcttcagaactagtaacaattaatgaaataggtgttaaagatgaagtggtgtacctaaagtcctaa

SEQ ID NO: 393 - DNA, 189 bp, Staphylococcus epidermidis
attcagacatcatcgtggcttaatataagaaaagtaacagctcaacgagctgaaaataatcaaaaaaattataaaaaagacaatttctatattttttcaatagaaattgtcttttttacttatcttgaacctttttgtcccagcctcttcagggattcattttttaattatcttcaaagaaatttttga

SEQ ID NO: 394 - DNA, 906 bp, Staphylococcus epidermidis
tggaggggattgattttggataaaatccaagaaacatttttatatatgttaaaggttgaaagaaacttttcagagtatacgttaaaatcttatcatgatgatttagttcaatttaacaactttttagaaagagaacatttacaacttgagacttttgaatataaagatgctagaaactatttggcttttttatattctaatcaattaaaaagaactacggtgtcaagaaagatatcaactttacgtaccttctatgaattttggatgactcaagataattcaattattaatccctttgttcaactagtgcatcctaaaaaagagaagtatttacctcaattcttttatgaagaagaaatggaagcactttttcaaactgtagagcatgataataaaaaaggcatacgagacaaagttattattgaattgttatatgcaacaggaatacgtgtgtctgaattaataaatattaaactaaaagatatagatatgaacttaccaggtgtaaaagttttaggtaaaggaaataaggaaaggtttatcccttttggagagttctgtagacagagtatagaaagatacttagaagaattccaacctaaacaattagccaatcatgattatttaattgtaaatatgaaaggtgatcctatcaccgaaagaggagtaagatatgtacttaatgatgtcgttaaaagaaccgctggcgtcaatgacatacatcctcataaattaagacatacttttgctacacatttattaaatcaaggtgctgatttaaggactgtacaatctttacttggtcacgtcaatttatcgactactggacgttatacacatgtttcgaatcaacaactgagaaaggtgtatttaaacgcacatcctcgagcaaaaaaaggagagtaa

SEQ ID NO: 395 - DNA, 879 bp, Staphylococcus epidermidis
gtagtaatgtctttaacgattatcttatctataataattattattttgattatggctatggttcttaatcaaaaatttatgaaagatagggttgaaacagaagaatatgctagaaatcaattaatctctaaaaattcaattttaagtgaagaaaatttatcattgaaaaaccaaatgttaagtacaaacaatgacgtcggtcaacacgcttttaaaaacgccaagcgtgaattaagaaaaatattaaatagatttaaagaagagggtcgtttacgatcatatacaattgttcctacgagtaatttggctgttaaacatccccttttcgaatatgcacgttcattcgattttattatcattactgatgttggtttgataaatgtggatgttaaaaattggaaccaaaaaacgttttatcattttgatgtgccagatcaacatcttgaagaaggacaaccacaatataataccgaaaaagttgtcggtcattatattagcaatcgatatcatagtcagtttaaaacaacacgttctggtgtctatacttttattgagattttacaggataatcgtgtaatatatgaattttatgaccacgatccatacgataaagccgcaaacaatgcaaaagcattaaaagataaaattgaaaatgattataattttaaaattcaaagtattggcgtcatatattttagtgatggtagcgttaatattattgaaggatccgacgagagtgataaatacgtcgacaccgtatctacaccgatatcacttgaaaaagtaattgaggaagctatcgatttatctaagcacccccttactgataaacaaatcgaagaaatttctgaaaactttaaacaacatatgaataattaa

SEQ ID NO: 396 - DNA, 132 bp, Staphylococcus epidermidis
ttcgaattgtttctttgcttgttctttaatattagaagccattttatatcccccttgatatttatatatatttatatgccgttaattaaattgtattattatatgtttatcaaaacaactatgtaccgttag

SEQ ID NO: 397 - DNA, 129 bp, Staphylococcus epidermidis
tttcgccctcctacaaacgtacgttcgttattaaaactatacaatagttattcttatataaattcacctaaattgcaagtgtcatttaaattactaagttgtttgagtaactttattgaattaaattaa

SEQ ID NO: 398 - DNA, 447 bp, Staphylococcus epidermidis
aagcggttgttgaagaacttggtggcgaaaaaatcgatatcgtccaatgggatgaagatcccgaaagtatttgttcgtaatgctttaagtccatcacaagttttagaagtaattgttgatgaagagaatcaatcaactgtagttgtagttcctgattaccaattatccttagctataggtaaaagagggcaaaacgcacgtttagctgctaaattaacaagttggaagatagatattaaatcagaatctgatgcccgagaagctggaatttatcctgttattgaatcagaagaagttgcagatgaaattgttaattccggtgacgaagatgttgagtttgataatgttaacttggaagagacaaacttaactagtacagaattagctgctgaaaatgatgaagataaaaaagataaaacagaagaagataatgacacagaatcatag

SEQ ID NO: 399 - DNA, 327 bp, Staphylococcus epidermidis
atagctgctcctaaaccaatcggaactgctacgattgtagcaataacagtaattttcaatgtgccgatgatgagtgcccaaattccaaattctggtgatgaaccagttgggttccaagtaccagataaaaagaatttagataatggcactcgtgtgaaaaacgtaatcgtctcggttaaaagtgtaaataaaatagcaattgtagttaatatagatatagctgaaataatggctaaaataattgggacaattttatcacttagcccgccctttttagcattattcttagctatcatttctctcacctttgtttgtgaagccatgtaa

SEQ ID NO: 400 - DNA, 171 bp, Staphylococcus epidermidis
attgacgatccgtttgagcatgtacaccgattaatacagcagtttctcgtttattttttgttttataagtcgcatgctgtgtcacgttatacatctccttttaaaagttactcaagacattttatcatagagtgtgaacaaagactaactacacaaattgtgttaaattag

SEQ ID NO: 401 - DNA, 336 bp, Staphylococcus epidermidis
agaagagatcccaaaataatgactaaaatgaaaatttttaatttgcttggtttagctatgagagctggtaaaatcaaaagtggcgaatcggtcatcttaaatgagcttaaaaagaatcaaataaaacttgtcatattagctagcgatgcatctagtaacactctaaaacaaatgaataataaatgtaatagttaccaagtgccattaaaagtgtttggtactagaaatgaattagggttagcaataggtaaaagcgatagagttaatattggtataacagataatggttttgcaaaaaaattgttatcaatgatagatgaatatggtaaggagtga

SEQ ID NO: 402 - DNA, 213 bp, Staphylococcus epidermidis
tacatgatgttaggagtgaaagaaatggatacatctaatgaaaataaaataacaatcattgccgttatagtagcaataattgttggtgtcgtactacaaattgtctttaaactacccttaatcgtgagtttagtggggtcagtatttttaggtatgttcgttggttttatcgtctacctaattcaatcatttcgtcgtaaaaaaaagaattaa

SEQ ID NO: 403 - DNA, 192 bp, Staphylococcus epidermidis
acgataaaaccaacgaacatacctaaaaatactgaccccactaaactcacgattaagggtagtttaaagacaatttgtagtacgacaccaacaattattgctactataacggcaatgattgttattttattttcattagatgtatccatttctttcactcctaacatcatgtattatatcatgctcttataa

SEQ ID NO: 404 - DNA, 159 bp, Staphylococcus epidermidis
gattctgaaccactaaacggtccagaatggtttacaaactggaaaataattacaagtattcctatcatcgctactactaaaagcgatgacattttcttagatttcaataatgtcaccttatttcacttaatatcccgatttatactaaagaaaatttga

SEQ ID NO: 405 - DNA, 3033 bp, Staphylococcus epidermidis
gatttgaagcctttacatatagttatggagaactttggcccttttattaaagaaactattgattttgagcaagttgaaactgatcaactctttttaattagtggtaaaactggatctggtaaaacaatgatttttgatgctatagtatacgcattatacggtatggcttcgaccaaaactagaaaagaaggagatttaagaagtcattttgcagacggtaaatcgccaatgtctgtaatttatcaatttaaagttaataatcaaacttttaaaattcatagagaagcgccatttattaaagaggggaatataactaaaacacaagccaagttaaatatatatgaattagttgataatcaatttgaattaagagaaagtaaagtgaatcaaggtaatcaatttatcgtacaattattaggcgttaatgctgaacaatttcgtcaattatttattttgcctcaaggagaatttaaaaagtttcttcagtcaaatagtaaagacaaacaatcgattcttagaacactttttaatagtgagcgatttgatgagattagacatctacttgtagaaaatgtaaagcaagaaaaagtacaaattgaaaatagatacactcaaattgaaaatttatggaatgatatagatacatttaataatgatgaattggccttatataaagaattagagagttctcagacagataaaatgattgaaaaattcccacaatttaatgattatggatgcaaaattctcaagtcatttgaagaagctaagaataaaataactaaggaattagatgatttaaatcataaatataaagtgaatgttgaattaagtgagaatactaaaaaattaaaagcggaaaaaatcaaatttgacgatttgaaaaaagaacaaaattatattgataaattaaagcaagaattaaaaatgattcaggaatctaaagtattaatcacttattttactaggttacaaagtttaaaaaaagataaagatgaattagtgtcacttcatgagcaatcaaaattaaacgaaacaaactatcacaatgaaattaaaggttttcaaaaacaactcgaacatttatcaacacgagaaaatgaaataactcaatttaatcagtatctagaaaaaaaccaagttttcttcaatcaattagataagattattagtagttatcaacaaaaaccggtaattgaagaagaaataaaaagattatacagtgaatataatgatttaataaccaaaaaagaagaattgacgaaagaaatgaacaacaagaacaaagattttgcaattattgaacattacactgaagagatttataagctgaaaaagattatagatgaatctgaaagacaaaaaaaggatgagaaattatttgataaattacaactagataaatcatcttatcttagcaaattaaaagagaagaaagaacagttaaatgaaattgaatcatcaatcaccaatatagatgcgactttaattgatttgaatgacaaaaaggattttgtaaatgaaataaagtccgctatgtcaattggagatacctgtccaatttgtggtaatgaaatacattcattgggagaacatattgattttgaatcaattgctcaaaaaaataataaaataaaacggttagaaagtaagaaggtaaaaattcgtgatgaaataatcaaaatagaaactcgaattgaagaattaaatcatagagaaaatgaattaaattttgagaaacaagaaaagaaggatattagtgagcttcaaaaacagcttaatcatttgaatcaactaaaagacgagcaacaaagcataaataagttagtagaaaattttgagaaacaagaaaaagaaatagttaataaaatacatcagtttgatttagatttgagtcgaaagaacacgcaaaaagaaaaactggaaattcaaattaatgattttgaacgacattcacaattttcatcagtaaatgattttgaaacttattattctcatgctaaaaaacaagttgagacgtatgagtatgagaatgagaaaactaaagataaattgaacgagttgaataataagttaaagatagaaatgaatgatcaaaaacatttaactgagaatttaactcaaacaagtaaggaaataaataatttagaattaaaaatggaaaaagaaatgcaacaacttggttttgagtcttatgatcaagtcaaaagcgctgcagatttaagtgctcaaaaagatgaaatagaaagagaaattaatatttataataagaactatcaaagttatgaaatagagattaacagactcaaagaattggttaagggcaaaaaattattaaatttagaagaattacgacaatctatagaaaaaacaaacttgaaactagatgaaacgaattcacaaatagctacgattagctataaaatagataataactctaacaaatttaataaaataaaaaatataattcagattctcgatgatgaattaaaagtgcaaaaagaaattttcttgctatcagaaatattagctggtaaaaatgattataaattaacactagaaaattatgttttaatttattacttggaaaaaataatttttcaagcgaatcaacgactttcatttatgagtggaaatagatatcaactgattagaagagagaccatttccttagggttaagtggattggaaattgacgtgtttgattttcattcaaataaatcgagacacataagttcactttcaggaggagaaacatttcaagcatcactagctttagctttaggattaagtgaagttgtacaacaagaatcaggtggaatcactttagattctatgtttatagatgaaggatttggcactttagatcaagaaacactcgaaactgcgatagatacattaattaatttaaaatcatctgggcgcatggttggtataatctcacatgtaagcgaacttaagcaacgcatacctttgattttagaagtgacaagtaaccaatacgaaagtcatacacaatttagaaaaaattaa

SEQ ID NO: 406 - DNA, 132 bp, Staphylococcus epidermidis
agaaaagggccatatagaataaatgacaatatacaactaactaaaacgattagtgtaaaacgtttaataggtttattccatatatttttaatcatggcgaatcctcatctttcttttccttatattctttaa

SEQ ID NO: 407 - DNA, 270 bp, Staphylococcus epidermidis
gcgaataagtttatgtcaaaagagggtgtcaatttgacttatttagtcttttccattgtatttgcatttctaatgggtgctgtcgttatagtgataagaatgaaagcacaacagtttccagtcaatgaaaagaaaattatcttaccacctttttccatgctaccgtgcattgatgtattgtacccatactttcgattaactggtatggacaatgttagaatcattgatattaggtgttttgttttctactgttttaatctggacttctag

SEQ ID NO: 408 - DNA, 159 bp, Staphylococcus epidermidis
tatttatttactaattcttgtcttttttgttcttttgctattttagatttcttcgccatatattataacctctttctacaaatcgtaataattacgttttatagaataacatatatttcaaaatatacaagtgaaaattcttctaagtacaaactataa

SEQ ID NO: 409 - DNA, 564 bp, Staphylococcus epidermidis
aagatatttactctggtaaagctaaaacatggaaagaccgttaactctagttggccagataaaaaaatcaatgctgtttcacctaactcaagtcatggtacttacgacttctttgaagaagaagttatggacaaacaagatatcaaagctgagaagaacgctgatactaacgcgatcgtatcttcagtaactaaaaacaaagaaggtatcggttacttcggttataatttctacgaacaaaataaagataaattaaaagaagttaaaatcaaagatgacaatggcaaagttacagaaccaactaagaaaacaattcagaacggttcatacgcactaagcagaccattatttatctacgctaaagacaaatcattaaaagacaataaagtaatgtcagaattcatgaaatttgtacttgaagatgaaggtaaagcagctgaagacgctggttatgtagcttcacctaagaaaacttataaatctcaattagatgacttaaaagattttttagataaacatcaaaaatctgataagaaagacgacaaaaaatcagaagataaataa

SEQ ID NO: 410 - DNA, 135 bp, Staphylococcus epidermidis
tcctcccttacaaaaacattatataagaacacgtgttctatttcaatatttataagaacatttgttcttattcattcttctcattttcatgctatactaaaagagccaacgttatatagcaaaggagaatgttga

SEQ ID NO: 411 - DNA, 309 bp, Staphylococcus epidermidis
ttaaatcatactctaatcttaaatcttcttggaatctttttaactgatttattcttaatttgctatgttgttattttttctgtgaaatttaattctgggataactattattagtatgattttatgttacgtggtcataaagattacagacaatattaataaaatcaagttttccccttcaaatttcacaaatttagataccgataaaagttttattttcaacttatcaataatgagctctattactattgtttatatattcattatttacctcttagcaattacgattttcagaaaaattcaattttaa

SEQ ID NO: 412 - DNA, 1023 bp, Staphylococcus epidermidis
cggcttgatacatatcccttgatgtatcaagccgctttatttttggcaagatttaaagtattgatgtcattgattcaatctctatataacagtaaaaaatttcaaaatagattccttttcaatttaggtattaagcattataattttaataatgatattagaaaggtgattatgatgagcaagtatgtaataacgaaaacactcaataacaatgtcatcatatgcacaaaaaatcatcaagaggttgttttaattggtaaaggtattggttttaataaaaaggttggtatgacagttcaagagaatgcttcaatagaaaaaatttataaattagaacaacaagagcaacaagaacactacaaaacacttttggagctcggagaagatcatgttgttcaagcggtgatagaatcagttaatattatcaatgaatctggtctaattacagatgataaaaatttggttgttgcacttacagatcacatcatttatgcctataaaagacttaagcaacatcaaatgattacaaatccatttgtgattgaaacaaaacatctctatagtaatgcatacaatgttgctcgaaaggtaatcgataaattaaataaaaccttagacgtacattttccagaagatgaaattggattcatcgcattacatattgcatccaactctgaaaaattatcaattcacgatatttcagtaataaacaagttaatcaataagagtattacaattattgaaactgatttacaacattcaattgataaacaaacaatacaatatcagcgttttataagacacatacaatttttaatatatcgattaactaaaggtgagtatttagaagcacaggagaattttatatcgatgataaaaactatgtatcctcgtagttttaatacggcttataaaatattaaaaatgattcaacgtgagtttagtgtgtatgtatacgaagcggaaatagtttatttaacattacatatcaatcattttgaagttcaaattagtagtgaataa

SEQ ID NO: 413 - DNA, 309 bp, Staphylococcus epidermidis
ggtgataacactatgaatataaaattaactcaaaaggcagtagaatggtttaaaaacgaattggatttacctataagcaataaagttcttcaattttatgtaaaatatggaggagaattccaattaaaacaaggatttagtccagcgttcaccgtagaaaataaagatgctattgatataggttttgaacaaacattctatgaaataaatgtcgttattgcggaaaaagatttatggtattttcaagatgaaaaactaactgtagatgcaatcgatcatgaagatgagatcatctacaaacgaaattaa

SEQ ID NO: 414 - DNA, 135 bp, Staphylococcus epidermidis
cttgacttaacatactctatggaaacttcagttcttatccccacaaatgatatttcacgacatgtaaatgatattgtagaaacaattcccgatactgaatttgatgaattcagacatcatcgtggcttaatataa

SEQ ID NO: 415 - DNA, 183 bp, Staphylococcus epidermidis
gaattcctaacaacattagaaagggtgtttaacgtgcgcgtaaatattacattagcttgcacagagtgtggcgatcgtaactatattactactaaaaataaacgtaataatcctgaacgcattgaaatgaaaaaatattgtccaagattaaataaatatacgttacatcgtgaaacaaaataa

SEQ ID NO: 416 - DNA, 942 bp, Staphylococcus epidermidis
gagagagggttttacatggcttcacaaacaaaggtgagagaaatgatagctaagaataatgctaaaaagggcgggctaagtgataaaattgtcccaattattttagccattatttcagctatatctatattaactacaattgctattttatttacacttttaaccgagacgattacgtttttcacacgagtgccattatctaaattctttttatctggtacttggaacccaactggttcatcaccagaatttggaatttgggcactcatcatcggcacattgaaaattactgttattgctacaatcgtagcagttccgattggtttaggagcagctatctaccttaatgaatatgcatctgatcgttcacgtagaatcattaaaccaatattagaaattttggctgggattcctacaattgtatttggcttctttgctttgacatttgttacacctatattgagaaatctaattcctaacttgggagagtttaattcaatcagtcccggtattgttgtgggtataatgattgtccctatgattacaagtatgagtgaagatgcaatgtcatctgtacctgataaaattcgtgaaggtgcatttggattaggcgcaactaaatttgaagtcgctacaaaagttgtattaccagctgcgacttctggcgttgttgcttcaattgtattaggtatatcaagagcaataggtgaaacaatgatcgtttctttagctgctggtagttcaccaacatcatctctaagtttaactagttcaattcaaacgatgacaggatatattgttgaaattgctacaggtgatgcagcatttggttctgatatttactacagtatttacgctgtaggttttacacttttcattttcactttaattatgaatttattatcacaatggatctctaaacgattcagagaggagtattaa

SEQ ID NO: 417 - DNA, 204 bp, Staphylococcus epidermidis
ttgttgcaaactcatatttatgtgaaagtccgttttgaattaaccaaattgcatagttataacaataaacacaatttccatcataataaattattggcatgtgtatacactcctttttcattgcttaattatttatattcccatttaggtataataaataaacctatttttctcaattttaactcttttagaattacgcattga

SEQ ID NO: 418 - DNA, 282 bp, Staphylococcus epidermidis
aataacagaacgaatttagtaaaatgcataaggataaagaaagcgggtgaaacaatggcaatttgggtagcaattattctaatcgttatagcacttattgcaggtttaattggtggtttcttattagctagaaaatatatgaaagattacttaaagaaaaatccacctatcaatgaggaaatgctacatatgatgatgatgcaaatgggacaaaaaccatctcaaaagaaaattaatcaaatgatgacaatgatgaataaaaatatgaatcaaaaaatgtaa

SEQ ID NO: 419 - DNA, 933 bp, Staphylococcus epidermidis
acgttattgacctataacatcacatctaggtctcaatatataaaggagtttttaattatggctaattcacaagtagcagaaaaagagaaactagacgcacaaacaaataatcaagactcagttgccacaatagtaactactgaaaacaataagaaaaatacaattccagacagtgaaaagaagattgtttattcaactcaaaatctagatttatggtatggagaaaatcatgcgttacaaaacattaatttagatatattggaaaataatgtaactgcaataatcggaccttctggatgtggtaaatctacatacatcaaagctttaaatagaatggtcgaattagttccatctgtgaaaactgcaggtaaaattttgtatcgtgaccaaaatatatttgatgcaaagtattctaaagaaaagctacgtactaacgttggaatggtctttcaacaacctaacccattccctaagtcaatttatgataatattacttatggccctaagactcacggtattaaaaacaaaaaaattctagatgaaatcgtagaaaaatcattacgtggcgctgcaatatgggatgaattaaaagatagattgcatacaaatgcttatggattatcaggtggacaacaacaacgtgtttgtatagctagatgtttagcaattgaaccagatgtcattttaatggatgaacctacatcagcattagatcctatttctacgttaagagttgaagaacttgtacaagaattaaaagaaaattactcaattatcatggttacgcacaacatgcaacaagctgcgcgtgtttcagataaaactgctttcttcttaaatggatatgtcaatgaatatgatgatactgataaaatcttttcaaatcctgccgacaaacaaactgaagattatatatctggtcgttttggataa

SEQ ID NO: 420 - DNA, 996 bp, Staphylococcus epidermidis
gtaaatatgactgaacagaaggatattaaagaaacagagtatcgacgacagaaaggaacaacttcgacaccttttaggcgaagaaataaaaaaagaatgcggaagttaccttttatcattttagtcatccttattattttaatttctatcattgtgtatattacccatcagtataacagtggtatgaagtatgctaaagaacatgctaaggatgttaaggtgcataaatttaatgggaatatgaaaaatgatgggaagatttcagttcttgtccttggcgcggataaggctcaaggtggtaaatcacgtactgactcgattatgattgttcaatatgattacgtacataaaaaaatgaaaatgatgtctgtcatgagagatatttatgctgatattcctggttatgataaatataaaattaatgccgcatattcacttggaggcccggaattgttaagaaaaacacttaacaaaaatttaggtgttaatcctgagtattacgctgtagtagattttactggatttgaaaaaatgatagatgaactacagcctaatggtgtcccaattgatgtggaaaaagacatgtctgaaaatataggtgtgtctttgaaaaaaggacatcataagttaaatggtaaagaattacttggttatgctagattccgtcatgatccggaaggcgattttggtcgtgtgagaagacaacaacaagtgatgcaaacattaaagcaagagttagttaatttcaatacagttgcgaaactaccaaaagttgctggtattttaagaggttatgttaatacaaatatgcctaactctgcgatttttcaaacaggtataagttttggaattcgtggagataaagatgtgcaatctttgacagtccctattaaaggaagctatcaagatattaatacaaataatgatggtagtgcgcttcaaatagactctgagaaaaataagcaagcaatcaaaaatttctttgaagataattaa

SEQ ID NO: 421 - DNA, 552 bp, Staphylococcus epidermidis
aataaggtgacattattgaaatctaagaaaatgtcatcgcttttagtagtagcgatgataggaatacttgtaattattttccagtttgtaaaccattctggaccgtttagtggttcagaatctcaacatcaatcagataattccaatttaaatggtaaagacaaagtatatgtgaaacgagttgtagatggtgatacatttgttgctcaaaaaaatggagaggaaattaaagtcagattaattggtgtagatacgccagagactgttaaacctaatacgccagttcaaccatatggtaaacaagcatctaattatacgaagaagtatctcacgcatcaaaatgtttatttagaatatgataaagaaaaaactgataggtatggtcgtactttggcgtacgtatggttaaaaaatggagatatgtttaacgaatcgctggtgaaaaaaggtctagccagagaaaagtatttttctccaaacggaaaatatagggataccttcgtacacgctcaagaagaggcaaaaaagagaaaattaaatatttggagctag

SEQ ID NO: 422 - DNA, 300 bp, Staphylococcus epidermidis
ctggtatggacaatgttagaatcattgatattaggtgttttgttttctactgttttaatctggacttctagattcgaagttaaagatgataatatttatatgaaacggtctaaagcatttccaattattttaatatcattattaataataagaacagttattaaaatatttataagtagcgaaattgatccaggtgaaattgctggtatgttttttttactcgcattttgtatgatagtaccttggagatgtgcaatgctttataaatataaaaaattgcaaaagaatcttattaagtaa

SEQ ID NO: 423 - DNA, 732 bp, Staphylococcus epidermidis
aagcaagctgcaaaaggaggacaacatctaattatgattcaatttgatcatgtagattattcatatcatcgaaaacagcctgttttaaaagatattaatataagtattcaacgtggtgaaaaaataggggttttaggggaaagcggtgctggaaaaagtactattggttctttaatattaggtcaattaaagccaacaaaaggaaaaataagtatcgattcaggaaaggttctacctatttttcaacatgcgacagaaagttttgatcgtcaattcacgattgaacagtctttgagagagccacttttattttatcgacaattaatacgacaaaatatcaaaaatatcattcttaactatttaattgaatttaatttgtctacagatctaataacaaagtttcctcaagaggtaagtggtgggcaactacaaagattaaatattatacgttctctcttagcacaaccagatatattggtttgtgatgaaataacttcgaacttagacgtcatggccgaacaaaatgtaatcaatattttacttaacgaaaaaaacattcaaaataaaacactaatcgtcatctcgcatgatttatctgttttacaaaggttaacgaataggataatagttatcaaagacggtcaaatagtagatgattttaaaagtaaagatttatttagccataaaagacatccatatacaaaactattaattcaaacgtatgaatattga

SEQ ID NO: 424 - DNA, 132 bp, Staphylococcus epidermidis
tatgtacatgcgacaattgctttattaaatatgataaaaatattaatcttaaaaaatataatctcaataatcaaatggtataacagtgcaataatagtgtacatcaaggtcgttttaacttataataaatag

SEQ ID NO: 425 - DNA, 243 bp, Staphylococcus epidermidis
gttggtaacgcagagaattggtcgagtaatccacttggtgttgctaaaagtatcgtaggtatacctatcattacaagtggtgctgtttctcctaatgcgcgtgataaagataaaatgaaacctgttaaaataccaggtaatgctgcaggtaaaacaactcttctaattgtttgccatttattagcaccaagaccatatgatgcttctctgactgaactaggaactgctctgatagcttcctga

SEQ ID NO: 426 - DNA, 468 bp, Staphylococcus epidermidis
gggatatattttaagatagatgggagacggcatatggaagataataatatgaaacgtggtctcaattcgagacatatatccatgatagcaataggtggcgctataggtactggactttttgtggcaactggaagtgtcatttctcaagctggcccaggaggagctatattagcttatatactaattggtattatgctttattttttaatgtcatcaataggagaattagcaactttctatccggtttctggttcttttagttcatactctaccagatttgttgattcgtcacttggttttacaatgggttggttgtattggggtatgtggtcacttgtaacaagtgtagatatcattgttgcttccaatgtattacaatattgggatgtatttaaagttttaaatccacttacatggagcttaattttcttcactctgttgtttttaattcatatttttttctgttaa

SEQ ID NO: 427 - DNA, 654 bp, Staphylococcus epidermidis
gatgcaatggcaattattagacaaaaatatgaaggtcagctagatggattaattaaagatttacggcgtcttggtcttcgtgtatattttaatattaacaatgcactagtatctttaggggaagaaaagaaatcattcgcaagacaaaccattgagaaagacaaagaaattaaccatttagatcatgaaattaacgagaaggtaatcatgctaattacgagacaacaacctattgccaaagatttacgtatgatgatggcagcactcaaaatctctactgactttgaacgaatgggggataatgctgctagtatcgctcatatacgtttaagagttaaaataaatgataactatgtgtttacacgtttaaaaaccatgggtaaattagcgatgctcatgttagaagatttaaataacgctattagaaataaagatttaccactgataaaagaagtcattgagagagatgaagatattgatgatttatacgttaacatcgtcaataccagttacttaattgataatgacccattcgtagctggtcaagcacacttagcagctagacacttagaacgaataggtgatcatataagcaatattgctgaaagtgtttattattatttaacaggccaacattttgaaacttttgattaa

SEQ ID NO: 428 - DNA, 123 bp, Staphylococcus epidermidis
cacatgtgggcaattggcgagatagattctttactgagcgtaaaggtaagtatcagacagagaataaagaatcataaaaagaaaaaaatacaagaaaaagcaaaaaagaaattcctgatgtga

SEQ ID NO: 429 - DNA, 129 bp, Staphylococcus epidermidis
acgttcaatttttatcatttaaatacatatatagtatttaattcattactagaacatataattaatatattaataataataaaaaaagagcgctacagttattcgataagtttctgtaacactcgttaa

SEQ ID NO: 430 - DNA, 132 bp, Staphylococcus epidermidis
ccatcaaatttggttagtaaccttttagattttaaaatagaatttaataatatctttggctttgttatgataataattggagtactaatcgttattattcaagaatgtcttgaaataacagaacgaatttag

SEQ ID NO: 431 - DNA, 438 bp, Staphylococcus epidermidis
gtattgttttatctatcattgcattattgcttatcgcttctttgctttgttacttcagctgactcagcaacattcgtattaggtatgcaaactacatttggatcattaaatccaagtagtctagttaaagtaacctggggagttgcgcaagcacttattgcctttgtactattattagctggtggaggagatggctctaaagccttgaatgctattcaaagtgctgccattataagtgccttcccattctcattcgtcgtcataatgatgatgataagtttctacaaagatgcaaataaggaacgtaaattccttggattaacacttacgccaaataaacatcgcttacaagaatatgttaaatatcaacaagaagattatgaaacagatattcttgaaaaaagagaagttagaagaaataaagaaaaagaagaatag

SEQ ID NO: 432 - DNA, 1272 bp, Staphylococcus epidermidis
gaagggaattatctaattatgaaatttacagagttaacagttaaagaatttgaaaactttgtacaaaatccatcattagaaagtcattatttccaagtgaaggaaaatattgctacacgtgaatcagatgggtttcaagtagtgttattaggtgtaaaagacgacgacaatagagtgatagcagctagcctgttttctaaaatccctacaatgggcagttatgtgtattattccaatagaggccctgtaatggactattcagatttaggtttagtggatttttatttaaaagagcttgataaatatttacatcaacatcaatgcttatatgtaaaattagatccttactggttgtatcaagtttatgataaagatattaatcctttaacagaaaaaaatgatgctttagtaaatctatttaaatcacatggttatgatcatcacggatttacaacccaatatgattcttccagccaagttagatggatgggggtattagatttagaaggcaaaacccctgcatctctaaggaaagagtttgatagtcaaagaaaacgaaatattaataaagcgataaactacggtgtgaaagttagatttcttagtaaggatgaatttgatttattcttagacttataccgagagactgaagctagaactggatttgcttctaaaactgacgattatttctataactttatagagcattatggcgataaagtattagttcctttagcttacatagatttaaatgaatatatacaacatttgcaagaatcactaaatgataaagaaaatcgacgtgatgatatgatggcgaaagaaaataaaacagataaacagttaaagaaaatagctgagttagataaacaaattgatcacgataaaaaagaattgcttcaagctagtgaattacgtcaaacagatggcgaaattttaaatttagcttcaggagtatactttgctaatgcatatgaagtgaactatttctctggagggtcttcagaaaaatataatcaatatatgggaccatatgcaatgcattggcacatgattaattattgttttgataacggttatgatagatataatttctatggcttatcaggtgattttactgaaaacagtgaagactatggtgtttatcgctttaagagaggttttaatgttaggattgaggaattaatcggtgatttctataaaccaatcaataaagtgaaatattggttattcaatacattagatcgcatacgtaataaattgaaaaagtaa

SEQ ID NO: 433 - DNA, 1581 bp, Staphylococcus epidermidis
aataatgattatgggcatatagaaaggattttcaaagtgaatgaagagcaaagaaaggctggaacgataaatattctagcagaacgtgatcgtaaagctgagaaagattatagtaaatactttgaacaagtgtatcagccacctagcttaaaagaagctaaaaaaagaggaaaacaagaagttcaatataacagagattttcatatagatgaaaaatacaaaggtatgggtaaaggtcgcacttttttaattaaaacatatggatgtcaaatgaatgcacatgacactgaagttatggcaggaatattaaatgcattaggatatagtgctacttcggatattaatgaagcggatgtgattttaattaatacatgcgccattagagaaaatgctgaaaataaagtctttagtgaaataggaaatttaaaacatttaaaaaaagaacgcccagattgtttaattggggtgtgtggttgcatgtctcaagaagaatcagtcgtaaataaaatattaaaatcttatcaaaatgtagatatggtttttgggacacacaacattcatcatttacctgagattttagaagaggcatatttatctaaagcgatggtagttgaagtatggtctaaagagggagacatcatcgaaaatttacctaaagtgcgtgacggtcacattaaagcttgggttaatattatgtatggttgcgataagttttgtacttattgtattgttccatttactagaggaaaagaacgtagtcgtcgtccagaggacatcattgatgaggttagagaattagcaagagaaggttatcaagaaattaccttattaggtcaaaatgtaaattcatatggtaaagatatcgaaggtctggattatgaattaggtgacttattggaagatatttctaaaattgatatacctcgtgttcgttttacaacaagtcatccttgggactttacagatcgaatgattgaagttatagctaaaggtgggaacatagtaccgcatatccatttaccggtacaatcaggtaataaccaagtattaaagataatggggcgtaaatatacaagagagagttatcttgatttagtttcaagaataaaggaagctatccctaacgtagctctaactactgatatcatagtaggttatcctaatgaaactgaagaacaatttgaagaaacattatcattatatgatgacgttcaatttgagcatgcatacacatatttatattcacaaagagatggaacaccagcagctaaaatgaaggataacgtacctttagaagtgaaaaaagaacgtttgcaaaggcttaataagaaggttggaatatattctcaacaagcaatgagtcagtatgaaggtaagattgttacggtattatgtgaaggttctagtaaaaaagatgagaatgttctagcaggctatactgataaaaataaacttgtgaattttaaaggaccaagagagagcattggtaaactcgttgatgtcaaaattgacgaggcaaaacaatattctttaaatggaacatttatacaagaacatcaacgttcaatggtgacacaataa

SEQ ID NO: 434 - DNA, 1347 bp, Staphylococcus epidermidis
ccccttatctatattttttcaacagtacaattgtttttctcaaaagcacaaacggaggtaatttacatgaaagagttaaatatcgcattacttggtttgagaacagtcggatcaggtgttgtaaagattattgaagagaatagacaacagattaaagacaccatcaataaggatattgtcattaaacatattctagtccgagataaatctaagaaacgtccgttaaatattagtcaatatcatcttacagaagatattaatgacatcttaaatgacaattctattgatatagtcgttgaagttatgggtggtattgaacctactgttgattggttaagaacagcccttaaaaataaaaaacatgtgattacagcaaataaggatttactagctatccatttaaaattattagaagacttagctgaagaaaatggcgtcgctcttaaatttgaagcaagtgtggcaggtggtatccctattgtcaatgctattaataacggactgaatgcaaataatatttctaaatttatgggaatatttaacggaacttctaactttattctctcaaaaatgactcatgaacaaacaacttttaaagatgcgttagaagaagcacaaagattaggatttgctgaagctgatccaacagatgatgtagaaggtgtagatgctgcaagaaaggtagttattacatcttatttatcttttaaccaagtcattaaactgaatgatgttaaatcggtaggaattagtgacattacattagcagacatcaatgcagcaagcgcattaaattataaaattaaatcaataggtaaaggtacatatgaaaatggatatgtgaatgcttctgtggaaccgacactgatacataagaatcaccaacttgcagctgtagagaacgaatacaatgcaatatatgttataggtgatgctgttggcgatacaatgttttatggtaaaggtgcaggtagtttagcaacaggaagtgcagttgtaagtgatttattaaatgtggcacttttctttgaatcaaacttacacactttaccacctcattttgaattaaagacagaggaaactaaagaaatgatggatggtgcagaaccagtggttattcaagagaaatctaattactatatagtaattagtaacaataataaatctttggagaaagttgaatatgacattaaaaagaaattaccattccataaatcgttgcaacttgttgagagggatcaagatacttatgcaattatcgttactggaatagaaacatctccagaaaaagttctaaatcaatcaggatttaatatcaagaaagtttatcctgtagagggagtttaa

SEQ ID NO: 435 - DNA, 654 bp, Staphylococcus epidermidis
aatagatactacatagtaatcaatattaaatataaaagtgagggggagcttgctatgtcaaaacaggatggaaaattaactggactttttggtgcgccagtttcggatagagaaaatagtatgacagcaggacaacgtggaccattattaatgcaagacgtttattatttagaacaaatttctcacttcgatagagaagtgattcctgaacgtcgtatgcatgcgaaaggttcaggtgcatttggtacgttcacagttacaaatgacatcacacaatatacaaatgcgaaaatattctcagaagtcggaaaacaaacagagatgtttgcacgtttttctactgtttcaggagaacgtggagcagcagatttagaacgtgatatacgtgggtttgccttgaaattctacactgaagatggaaactgggatttagtaggtaacaatacgccagttttcttctttagagatcctaaactatttattagtttgaatcgtgctgtaaaacgagatccacgtacaaatatgagaagtgcacaaaataactgggacttttggacaggtctaccggaagcattgcatcaagtgacaatattaatgtcagatagaggtatgcccaaaaggattccgaaatatgcatggattcggttctcataa

SEQ ID NO: 436 - DNA, 207 bp, Staphylococcus epidermidis
gtacgtcactacaagttacgagaaactttggtaatttgtatactgttaataagaatgtatttaagtttgttaatcaaggtattatcattttttcataggacgagtgaatttgaataccgaaagattaataacttaaagtgcattcttttttttatgaataaaaaagaagaatgtacttttaaaagaattgttaaaccttttatttag

SEQ ID NO: 437 - DNA, 1041 bp, Staphylococcus epidermidis
tattttttatattcgttgaaagtgaaaggatgccaacatatgtttaaaatgataatttataaactttcacaaatgattgtcgtactatttatattaactacaatcacatttatattaatgaaactctctccaggtaatcctgtagacaaaattttacatcttgatatttcgcatgtatctaatgagcaaatagaaacgacagagaataagcttggcttaaataatcctatttttattcaatggtgggactggttaaatcaattgtttcattttgatttaggaacaagttatcaaacaagcgagcctgtaattagggaaatagcaaattatcttggtcctacacttattattacttttggtacgcttatagtgtcattagttatttctataccattagggattatagcagcggtttactaccataaaatttgggataggataatccgtgttatgacatcattatccgtaagcctaccatcattttttatcggtcttatcttattatatatatttagcttgaagttgaatattttaccaacttcagatgaggggcgtttcgtttcatatattttaccaataattaccatgagtattggaatgtgtgcttattatattcgatttattcgttctactttattagaacaatatcaaacacctatagttgaatcgtctcgtctcagaggtatgcccgaaagatatatactttttcaagatatccttaaacctacgatactaccaatcatacctctattaggattatccattggtagtttgataggtggaacagtagtcattgaaaatttatttgatattcctgggttaggctattttttagttgacagtataaagtcgagagattatccagtcattcaaggttgtgtattatttattggtttctttgtagtgattataaacacaattgcagatttactttcattacttatcgatcctaaacaacgttatgctattactcagaaagaaacatcaaagtttaaatggtttaattcacatagaaaagaaggtcgtaacgatgaagtttaa

SEQ ID NO: 438 - DNA, 147 bp, Staphylococcus epidermidis
tgcatcatatataaattaatcattggattccaccttgaacatatttttttatctacacaattattctatgtcgttattcattatttaatttacgcagtgcagacacaatctcacgttttgagtcttgaacttctgaagtttgtttaa

SEQ ID NO: 439 - DNA, 183 bp, Staphylococcus epidermidis
acggaggtatatctcatggagaacaatcaaagtaatattactgaagaaacgaaacacaatgataatttagaaacaacttatgaacaaacgcaacaaaaagagaaaacattctctcaagaagaagtatctcaaatgattaaggatcgtttagctagaaaaaaaagaaatctgaataacgtatga

SEQ ID NO: 440 - DNA, 810 bp, Staphylococcus epidermidis
ctattgtcatatatgttaaaaatttatatttgtattttaaaatcatccaatatcactcctagaacatttgtttgtataagtaatttatcagaacataaattctgtgtcaacaacattacgaacaaatgtgtgttagaaaatgtaattaatgatataataatctcaaacaacaataaggagtgcctatttatgagagaactcactaagcgacaaagtgaaatatatgattatattaagaaaattgttcagacaaaaggttatccaccaagtgttcgagaaattggcgaagctgtcggtttagcttcaagttctacagtacatggacatttatctagattagaagaaaaaggatatataagaagagatcctactaaacctagagctatcgagatagttagtgaacaattagatgaggtaaatgtagaggaaacaatacatgttccggttatcggtaaagttacagccggcgttccaattacagctgtagaaaatatagaagaatattttccactaccagagcacttaacttcaacacataacagcgatatatttattttaaatgtagttggggaaagtatgattgaagctggaatattagatggcgacaaagtaattgtacgaagtcaaactattgctgaaaatggtgatattatagtagctatgactgaagatgaagaagctactgttaaacgcttctataaagaaaaaaatcgttatagactacaacctgaaaatagtactatggagcctatttacttagataatgtcattgtagtaggtaaagtaataggattatatagagaaatgtaa

SEQ ID NO: 441 - DNA, 2676 bp, Staphylococcus epidermidis
atttatacatataatataaataaagatataagaataagggttgtgaaaatagaaatggctaacattacaccaatgatgcaacaatatttaaagataaaatctgaatatgatgattgtttgctattttttagactcggagatttctatgaaatgttctttgatgatgctaaagaagcatcaagagtacttgaaataacattgacgaaaagagatgctaaaaaagaaaatcctattccgatgtgtggcgtaccatatcattctgctgataattacattgaaacattgattaataatgggtataaggtcgctatatgtgaacaaatggaagatccaaagcaaacaaaaggaatggttagaagagaagttgtaagaatcatcacaccaggaactgttatggatcaaaatggtatggatgaaaagaaaaataattatattttaagttttatcgaaaatgaagaatttggattatgctattgtgatgtttctacaggcgaactcaaagtaactcatttcaaagatacagcaaccttgcttaatgagattacaacaattaatcccaatgaaatcgtcataaagcaagctctatctgaagaattaaaaagacaaatcaacatgataactgagacgattactgttcgcgaagatatatctgatgaagattatgatatgaatcagttgacacatcagttaatgcatgacacaactcaattattgttagattacattcatcacacacaaaagcgagatttatctcatattgaggaagtaattgaatatgctgcagttgattatatgaagatggattattatgcgaagcgaaatttagagctgacagagagcatacgattaaaatcaaaaaaagggactttgttatggttaatggatgagacaaaaacaccgatgggtgctagacgtttaaagcagtggattgatcgtccattaattaataaacaacaaatcaacgacagattaaatattgttgaagagtttatggaccgttttattgaaagagatacattacgtaatcatttaaatcaagtgtatgacatagaacgactagtaggaagagtgagttatggaaacgtaaatgcaagagatttaatacaacttaagcattctatatccgaaatacctcacattaaagcattactcaatgaattgggtgcacaaactaccacgcaatttaaagaattagaacctttagatgacttgttacaaattttagaagaaagtttagttgaagaaccacctatttccatcaaagatggaggattatttaaaaatggcttcaacgcgcaacttgatgaatatttagaagcttcaaaaaatggtaaaacttggcttgcagaattacaagctaaggaacgtgaacgtacaggtattaagtcattgaaaattagttttaataaagtgtttggttattttattgaaattacacgtgcaaacttaaataattttcaacctgaagcgtttggctataatcgaaaacaaacattatctaatgctgaacgatttattacggatgaattaaaagaaaaagaagatataatacttggtgctgaagataaagcagtagagttagaatatgaattatttgttaaattacgagaacacattaaaacgtacactgaacgtttacaaaagcaagcgaaaatcatttcagaacttgattgtttacaaagttttgctgaaattgctcaaaaatataattatgtcaaacctacatttagtgatgataaagttttacatttagaaaactcaagacatcctgttgttgagagagtgatggattataatgattatgtacctaatgattgccatcttgatgatgaaacgtttatttatctcattacgggacctaatatgtcaggtaagtcaacatatatgagacaagttgctataataagtatcatggctcaaatgggagcatatgtaccatgtgattcagcaacattacctatatttgatcaaatttttactaggattggtgcagcagatgaccttgtatcaggtaaaagtacatttatggtagaaatgttagaagctcaaaaagctttaacttatgctactgaaaatagtttaattatctttgacgaaataggaagaggtacatctacttatgatggtcttgcgttagcgcaagcgatgattgaatatgttgctcaaacttcccatgctaagacacttttctcaacacattatcatgaattgacatcacttgatcaaatgcttaagtgtttaaaaaatgtacatgttgctgcaaacgagtatcaaggtgaactgatatttttgcataaagtcaaagatggcgctgtggatgatagctatggtattcaagtggcaaaattagcggatttacctaatgaagtcattgatagagcgcaagttatattaaatgcatttgagcaaaaaccttcgtatcaactctctcatgagaatactgacgatcaacaaacggttccgtcgtataacgattttggtcgaacagaagaagagcaatcagttatagaaacacatacatcaaatcataattatgagcaagcgacctttgatttatttgatggttacaatcaacaaagtgaagttgaatgtcaaattcgagaattgaatctatccaatatgacaccattggaagccttaatcaagctgaatgaattacaaagtcaattaaagtag

SEQ ID NO: 442 - DNA, 231 bp, Staphylococcus epidermidis
tttaatcaatataatgaaaggggtatgggatttatgcaacaaataaaatttaaaactttaactgaggaaacactggagagcttagagaaaagtgttaattcgtttttaaagtctcaagagggtaatggttacaaattattaaacattactattaaacaaatcgaagaacgtgcatttccgcataatgacgaggactttaatgctattttaacattggtaacggaagcatag

SEQ ID NO: 443 - DNA, 1029 bp, Staphylococcus epidermidis
ttttataaatatagcaacgagaggaagttgaaaatgacccttcttgagaaaattaaacaaaataaatctttatctaaaaaagatatgcaatcatttattgttacactgtttgattcaaatatagaaaccaatgtaaaggttgaattattgaaagcttatacaaataaagacatgggtcaatatgagctaacgtatttagttgaatattttatccagacaaactatccaaaccaaccattttataataaagctatgtgtgtttgtggcacaggtggagatcaatcaaatagctttaatatttctacaactgtagcttttgttgtagcaagtgcaggagtgccagtcattaaacacggtaataaaagtattacttcacattcaggaagtacagatgtattacatgaaatgaatataaaaacaaacaaaatgaacgaagtagagcaacaattaaatttgaaaggattagcattcataagtgcaactgattcttatccaatgatgaaaaagcttcaatcaattagaaaatcgattgcaacacctacaatttttaacttgattggaccattaattaatcctttcaaattaacttatcaagtgatgggggtatatgaagcttcacaacttgaaaatatagcacaaacattaaaggatttaggtagaaaacgagcaattttaattcatggtgcaaatgggatggatgaggccacgctttctggtgaaaatatcatttatgaagttagcagcgaaagagcattaaaaaaatatagtttaaaagcagaagaagtcggtttagcttatgcaaataatgacacgttgataggtggttcacctcaaacaaataaacaaattgcattgaatatcctaagtggcacggatcactcaagtaaacgagatgtagttttgttaaatgctggaattgctttatatgttgctgagcaagtggaaagtatcaaacatggcgtagagagagcgaaatatctcattgatacaggtatggcaatgaaacaatatttaaaaatgggaggttaa

SEQ ID NO: 444 - DNA, 1758 bp, Staphylococcus epidermidis
aatcacaaatatcatggaaagtgggcggtcagcaagggcgaaggtattgaatctaccggtgaaatctttgctactgcgatgaatagaaaaggttattttttgtatggatatagacacttttctagtcgtataaaaggtggccatactaataataagataagagtttcaaaatcgcctgtgcatgcgattagtgatgatttggatatactcattgcttttgaccaggaaacgattgaattaaatcatcatgaaatgagagaagatagtattataattgcggatgctaaagcaaaaccccaaaagccagagaactgtgtggctcaattaattgagttaccattcactagcacggcaaaggaacttggaacagcattaatgaagaatatggtggcaattggtgcgacatctgcactgatggatttaaatacatcaacttttgaaactttaatcgataacatgttttcaaaaaaaggtaataaagtcgttgatatgaatatacaagcccttaatatgggttatgatttaatgaagcaacaagttaccaacgttaatggagactttacattagagaatggtagcggtcatcctcatttatatatgataggtaatgacgcaatcggattaggagcaatagcagctggatcaagatttatgtccgcttatccaattacgccagcttctgaaattatggaatacatgattgccaatctacctaaagttgatggtactgttgttcaaactgaagatgaaatagcagcagcaacgatggcgattggagctaactatgctggcgtacgaggctttacagcgagtgcgggtccaggtctttctttaatgatggaatctattggattgtctggtatgactgaaacgccattagtcattattaatactcaaagaggtggtccttctactggcttaccaacaaagcaagaacaatcagatttaatgcaaatgatttatggtacccatggtgatattccgaaaattgtcgttgctcctacagatgctgaagatgcgttttatcttactatggaagcatttaatttagctgaagaataccaatgtccagtcattctgttaagtgatttacaattatcattaggaaaacaaactgttaaaacactcgattataataaaatcgatattcgtcgtggagaaataatacagtcagatatcgagagagctgaagatgataaagcatactttaaaagatatgcattaacagctagtggcgtatcaccacgaccaataccaggtgttaaaggtggtatacatcatgtaacaggtgttgaacataatgaagaagggaagccaagtgaggcgcctatgaatcgtcagaatcagatggaaaaacgaatgcgcaaaactgaaagcttggttatcaataatcctgtgttactcaatgaacatgaagacgaagcagatatactgtatataggatttatatctactaaaggtgctattggagaaggtgcagaaagactagaacgacatggtgtaaaagtgaatacgatgcatattcgacaattacatcctttccctaaagatattgttcaacaagctattaataaagcttcgaaagtaatagttgcagaacataattatcaaggacaattatcaagtattttaaaaatgaacacacaagttaatgataaattagttaatcaaacaaaatacgatgggaaacctttcttaccttatgaaattgaagaaaaaggtttggaaattgctaaagagttaaaggagttggtgtaa

SEQ ID NO: 445 - DNA, 1332 bp, Staphylococcus epidermidis
atgagtgattttaggaggggcaaaatgacgcaaaaagtaaacgttgtaggagctggtttagctggctctgaagctgcatatcaattagctcaacgtggaattaaagtgaatttaattgagatgcgtccagttaaacagacaccggcgcaccatacagataaatttgctgaattggtatgttcaaattcattgagaggtaatgcacttacaaatgctgttggtgttcttaaagaggaaatgagacatttagactcgttaattatcacatcagcagataaagcacgtgtgccagcgggtggtgctttagcagtggatagacatgattttgctggctatattacagataccttaagaaaccaccctaacatcactgtattaaatgaagaagttaatcatataccagaaggttatacgattattgcaactggccctctaactactgagcatttagctcaagaaattgttgatattactggtaaagatcaattgtatttttacgatgctgccgcaccaataatagaaaaagattcaattaatatggataaagtatatttgaaatcacgttatgataaaggtgaagcagcgtatcttaattgtcctatgactgaagaagagtttaaccggttttatgatgcagtattagaagctgaagttgcaccagtcaatgagtttgaaaaagaaaaatattttgaagggtgtatgccttttgaagtcatggctgaaagagggcgaaaaactttgttatttggtccgatgaaacctgttggacttgaagatcctaagactgggaaacgcccttatgcagttgttcaattaagacaagatgatgcagctggaacattatataatattgttggctttcaaacacatttaaaatggggtgcgcaaaaagaagtcattcgtttaattccaggattagaaaatgttgatattgtaagatatggtgtgatgcaccgaaatacctttattaattcacctgatgttttaaacgaaaaatatgaattaaaaggacatgataatttatattttgctggacaaatgactggcgttgaaggttatgttgaaagtgctgccagtggattagttgcaggtattaatcttgcgcataaaattttagacaaaggtgaagttattttccctagagagacaatgataggtagtatggcttactacatatcacatgccaaaaatgagaagaattttcaacctatgaatgccaattttggtcttttaccatctctcgaaaaacgtattaaagataaaaaagaaagatatgaaacacaagccaaaagagcgttagagtatttagataattacaaacaaacgctgtaa

SEQ ID NO: 446 - DNA, 1257 bp, Staphylococcus epidermidis
aaggagatgtataacgtgacacagcatgcgacttataaaacaaaaaataaacgagaaactgctgtattaatcggtgtacatgctcaaacggatcgtcaatttaattttgaatctactatggaagagctcgatgctttatcacaaacttgccaacttaatgttaaaggacaaatcactcaaaatagagagcaatttgaccataaatattatgttggaaaaggaaaaatcgatgaaataaaatctttcatagaattccatgatatagatgttgtcgtaaccaacgatgaattaacgacggcacagtctaaaacgttaaatgataatttgggcattaaaatcatcgatagaacccaattaattttagagatattcgcgttgcgagcgagaagtagagagggaaagctacaagtagaacttgcacaactcgattatttgttaccaagactacatggtcatggtaaaagcctatctcgtcttggtggtggcataggaacaagaggcccaggtgaaacaaaattagaaatggatcgtcgccatattagaacacgtatgaatgagattaaacatcaattaaaaacggtcgtggatcatcgggaaagatatagaaataaacgtgaacaaaatcaagtttttcaaatcgctttagttggttatacaaatgcaggaaaatcgtcatggtttaatgttttagctaatgaggagacctatgaaaaaaatattttgtttgcaacattagatcccaaaacacgacaaatacaagtgaatgaaggatttaatttaattatttctgatacggtaggatttattcagaaattaccaacgacattggtggctgcgtttaaatctacactagaagaagctaaaggtgcagacgtacttatgcatgtcgtcgatgcaagtcattcggaataccgtactcaaattgacactgtaaatcaaattattaatgatttagatatggaccatattccacaagtagttatttttaataaaaaagacttatgtaacgaacagatggatgtacctgtatctaaatctgcgcatgtttttgtatctagtcgtgatgaaaatgataaacaaaaggtgaaaaatttagtaattcaagaaataaaaaatagtctcagcccatacgaagaaattgtagatagtgctgatgcagatagattatattttcttaaacaacacacgcttgttactgaattaatatttgacgaaacacaagcatcttatcgtatcaaaggatttaaaaaattataa

SEQ ID NO: 447 - DNA, 153 bp, Staphylococcus epidermidis
aatccaacgtacccacgaaaatttcatcaatcatgtgaagaagcattaaatatacgcaggacaactaaaatggataataaacttaatcccgtaagcatagatactaaaataataaaaatatattgtacaagttttttcgtgtcattagtataa

SEQ ID NO: 448 - DNA, 180 bp, Staphylococcus epidermidis
gactttaggtacaccacttcatctttaacacctatttcattaattgttactagttctgaagcacaattattaattttctcacgtagtgttctaactaatttaccacttttttcttttggacaaagagtgagtatcgtaggtccagctccacttataacagttgcatatgcatcatgttga

SEQ ID NO: 449 - DNA, 954 bp, Staphylococcus epidermidis
atttattatcacaatggatctctaaacgattcagagaggagtattaatatgtctacacattcaaatactgctaacaaaacattgattgataaagatgccgtagaaaaaaatatttcttctcgtgataggaaaaactcggtaaacaaatggttatttttattatgtacattaattgggctcattgttttagtagcactattaattcaaactttcgttaaaggggcgggacatctaactcccgaatttttcactaatttttcatcttcaacaccagcagatgctggtattaaaggggctttagtaggttctatttggttaatcttaagtattattccaattagtatcattttaggaataggtacagcaatttatttagaagaatacgcaagagacaatatttttacacaaatcgtaaaggtgagtatatctaatttagctggtgttccttcaattgttttcggtttactaggttatacattatttgtaggcgcggcaggtttaggtaatagcgtgctagccgctgcgcttacaatgtcactactaatcttgcctgttattatcgttgctagtcaggaagctatcagagcagttcctagttcagtcagagaagcatcatatggtcttggtgctaataaatggcaaacaattagaagagttgttttacctgcagcattacctggtattttaacaggtttcattttatctttatcacgcgcattaggagaaacagcaccacttgtaatgataggtatacctacgatacttttagcaacaccaagtggattactcgaccaattctctgcgttaccaactcaaatttatacatgggcaaaaatgcctcaagcagaattccaaaacgttgcatcagcaggtattatcgttctactcgttatcttattattgatgaacactgtagcgatacttcttcgtaataaatttagtaaaaaattctaa

SEQ ID NO: 450 - DNA, 708 bp, Staphylococcus epidermidis
gaatgtagtcaggaggactatgctatgcaacaagaacgacaatcgtggtaccaaaaatcttggtttattattctcacattgctatttatttttccattaggtctctttctaatgtggaggtatgcgcattggaagaattggttaaaattgactgtttcatcagtctatattattagtttagttttaacacttttatttcaagttagtctattaaatgagaataaaacaaatcaaatagaacatgcatcaactatgaaagaaaagtctaatataaataatgtaaaaacaactaaaaataaaaatatggaaaaatcaacgcagacagacaaacaaaactctgtgaacttaaagcaaaacacaaaagatcaaaataataacgcaaatgatgaagcagcttctccaactagcgaacaaaatgcagctatagcacaagcaaagtcatatgcaaatacattacctatctctaagaaaagtttatacaaacaattaacttcggaatacggagagaaatatccggcagacatagcacagtatgctgttgaccatatcagtgtagattataaaatgaatgcactgagattagcaaaaagttacgtaaaaaatataaacatttctaatcaagcgttatatgatcaactcgtttcagaaaatggagaaggatttactcctgaagaagcacaatatgcaatgaatcatttagataggtaa

SEQ ID NO: 451 - DNA, 420 bp, Staphylococcus epidermidis
tacttaatccattattttgatttttatttaaatcaacctacctggttcctcaccaaattctctgcactaagattttccgttaccattctgttctcatatttatattttcaattgaaatatctatcaaaaattaaactattcttctatttaagtattcaacaaatgatgatacacctatatgggatggaatacttaccaacatatgtatatacctttgcttcaattattttacaattttccactcacatcattgacacaagggatttcctataccttatttcttttccatatatcactagcctgctatatctgggctcaaaaacaatgtgctacttacaatttcattatgtatgtgctaaactgtttgtgtcggatgacattaaaaagcatctcttcgtgttgaatattttggttggctga

SEQ ID NO: 452 - DNA, 147 bp, Staphylococcus epidermidis
tgtaaatgtcttctgtgcaatgtaacgaattctaactcgttcataaaattatccatcccttatataactatttctttaatatttcaatgtgtatcattctataataaaaaggcgaaattaatgattaatgcatcatatataaattaa

SEQ ID NO: 453 - DNA, 150 bp, Staphylococcus epidermidis
tataaaatacaaaatgaagttataaaaactgtatcactacaggcagctaagaatgtagtcaggaggactatgctatgcaacaagaacgacaatcgtggtaccaaaaatcttggtttattattctcacattgctatttatttttccattag

SEQ ID NO: 454 - DNA, 2397 bp, Staphylococcus epidermidis
gtattgccacaagcaaaaaaaagaacatcgacgaagagaaagggtaataaaaaaacgaataaaaaaaagcaaaatgaaacgcctttaagatatatattctcaataattgtagtaattcttattatactaggcgcttttcaattaggaatcattggtagaatgattgatagcttttttaattatctttttggtatgagtcgatatttaacttatattttagtacttattgcaacaatttttataacatactctaagcaaatacctagaactcgacgtagtatcggtgcaatagttttacaattagctttgttatttatagcgcaattgtattttcatttttcacataatatcacttctcaaagagagcctgtactgtcctttgtttataaagcttatgaacaaacacattttccaaattttgggggaggcttaataggtttttatttacttaaactatttatacctctcatatctattgtaggtgtaataataattactatcctattactagcttcgagtttcattttattacttaatttaagacatagagatgttacaaaaagtttattcgacaacctcaagtcatcaagtaatcatgcatctgagtcaataaaacaaaaaagagaacaaaataagattaaaaaagaagaaaaagcccaattaaaagaggcaaaaattgaacgaaaaaaacaaaaaaaatcacgtcagaataataatgtcattaaagatgttagtgattttccagagatttctcagtcagacgatattccaatatatggtcataatgagcaagaagataaaagaccaaatactgctaaccaacgtcaaaaacgtgttttggataatgaacaatttcaacaatcattaccaagtaccaaaaatcaatcaataaataataatcagccatctacaaccgctgaaaacaatcaacaacaaagtcaggctgaaggctcaatatctgaagctggtgaagaagccaatattgagtatacggtgccacctttatccttattaaaacagcctactaaacaaaaaactacttcaaaagctgaagtccaacgtaaaggtcaggttttagaatctacactaaaaaactttggagttaatgctaaagtaacacaaattaaaatcggtcctgcagttacgcaatatgaaattcaaccagcgcaaggtgttaaagtaagtaaaatagtcaatctccataatgacattgcattagctttggctgcgaaagatgtacgaatagaagcacctattccaggtcgctctgcggtaggaattgaggttcccaatgataaaatctcacttgtcactctaaaagaagttttagaagataagttcccatctaagtataaattagaagtcggcattggtagagatatttctggtgatccaatatcaattcaattaaatgaaatgcctcacttactcgttgctggttcaacaggaagcggtaaatcagtttgtattaatggtattataacgagtatattactcaacacaaaaccgcacgaagttaaacttatgttaatcgatcctaaaatggtagagttaaatgtttacaatggtattcctcatttacttataccggttgtaacaaacccacataaagcgtctcaagctttagaaaaaattgtttcagaaatggaacgtcgttatgatttgtttcaacattcatcgacacgaaatattgaaggatataaccaatatatacgcaaacagaatgaagaacttgatgaaaaacaacctgagttaccgtatatcgtcgtaatagtggatgaattggctgatttaatgatggttgcaggtaaagaagtagaaaatgctatccaacgtattactcaaatggctagagcagcgggtatacacttaattgtagctactcaaagaccttccgttgatgttattactggtattattaaaaataacattccatcaagaattgcgttcgctgtaagttctcaaactgactctagaacaataattggtgctggtggagctgaaaagctacttggtaaaggtgatatgctatatgttggtaacggagaatctactacaacccgaattcaaggtgcttttttaagtgatcaagaagtgcaagatgttgttaattatgttgtagagcaacagaaagcaaattatgttaaagaaatggaaccagatgcacctgtagataaatcagaaatgaagagtgaggatgctttatatgatgaagcttatttatttgtaatagaaaagcaaaaagctagtacttctttattacaacgacaatttagaatcggttataatcgagcttcaaggctcatggatgatttggaacgtaaccaagttattggtccacaaaaaggaagtaaacctagacaaatattagttgatttagaaaatgacgaggtgtaa

SEQ ID NO: 455 - DNA, 165 bp, Staphylococcus epidermidis
agcattgcacatctccaaggtactatcatacaaaatgcgagtaaaaaaaacataccagcaatttcacctggatcaatttcgctacttataaatattttaataactgttcttattattaataatgatattaaaataattggaaatgctttagaccgtttcatataa

SEQ ID NO: 456 - DNA, 873 bp, Staphylococcus epidermidis
ttgatacaacatacgatgttaaaactatattgggcaaatttcactacggcacaacttcatcatcttacaagtacatatcctgactttctatcagaaaacgtatttcatcaacatgacatgataaaaaggtggcttacagagcgtaattctgaaaggctatggaacaaatatgaacgtttcaaagaattaaagctgatggacattattaaagaaatgaaaaaagcaaatgttagttttacaacatactttgatgataactacccttctctttgcaaagaaatgtatgattatccttatgtgatattctacaaaggaaatccacagttctttaatcattctcactctttagctgtaattggctcacgtaatgccacacaatatacaagtcaatctttaaactatctttttccttcatttagacaattaaatatggcgattgtttctggattagcgcgcggtgcagatagtgtagcacatcaaaccgcacttaaatacctattaccaactattggcgtacttggatttggccattgttatcattatcctaaagcaaccttaaatttaagaactaaagttgaaaggaatggcttagtgataagtgaatatccaccattttctcctataagtaagcataaatttcctgaaagaaacaggcttataagtggtctgtccagaggggtacttataactgaggctgaagaaagaagtggtagtcaaatcactatcgattgtgctttagagcaaaatagaaatgtttatgttctacctggttcaatgttcaacaaaatgactaaaggtaatttaagaaggataaatgaaggtgctcaagttgttatagatgaaagtagtatattatatgattatctattttag

SEQ ID NO: 457 - DNA, 138 bp, Staphylococcus epidermidis
ttaattaaacaatcatctatcattttatcatactcatttattccattgaataagcaaataaaaaaactgtaccaaagtcttagttggtacagtttagactatgaagatattcaatgtctaacagatgtttcattttag

SEQ ID NO: 458 - DNA, 810 bp, Staphylococcus epidermidis
gaggatgaacagagaatgagaatattgtttataggcgacatcgttggtaaagtgggcaggaaaatgattactacttatttacctaaaattaaacaaacttatcacccaacagtttctatagtaaacgctgaaaatgccgcacacggtaaaggattaacagaaaaaatttacaaacaacttttgagagaaggcgtggatttcatgactatgggtaatcatacatatggtcaaagagaaatttacgattttattgatgatgctcatcgaatggtgagacctgcaaattttcctgatgaagctccaggaacaggtatgagaataataaaaattaacgatattaaattggctattattaatttacaaggccgttcatttatgcaagacattgatgatccatttaaaaaggctgaccagctaatcgaagaagctcaaaaatctacaccatatatatttgtagattttcatgctgaaactacatctgaaaaaaatgctatgggttggtatttagatggtagagtgagcgctgttgttggtactcacacacatattcaaacttctgatgatcgtatattacctcatggcacaggatatatcacagatgtcgggatgacaggttattacgatggtattttaggtatcaatagagatgaagttattcaacgttttattactagtttgccacaaaggcatgttgttccagatgatgggcgaggcgtattatcaggagttatcatagatttagataaagaaggtaaaacgactcaaataaaaagactgttaataaatgaggaccatcctttccaaatttaa

SEQ ID NO: 459 - DNA, 1254 bp, Staphylococcus epidermidis
aaaggaagacagattatgcaagattttagcaatttagttgaagaagttgaaaacacacttattccttactttagaaaaattgaaaagcgtgcattatttaatcaggaaaaggtcttaaatgcttttcaccatgttaaagctagcgaaagtgatttacaggggtctacgggttatggatatgatgattttgggagagaccatttagaacaaatttatgcgcacacatttaaagcagatgacgcacttgtaagacctcaaattatttcaggtactcatgctattactttagctttacaaagtacgttaaaaaacaatgatgaactactttatattacaggtagtccatatgatacacttctagaagtcattggtataaatggcaatggtgttgaaagtcttaaagaatatggtgttcgctataatgaagtcgaattacgtgacggtcgaattgatattcctaaagtcatcactgcaattaatgacaatacaaaagttgtagcaattcaacgatcaaaaggatatgatcaacgtccatcaattacaattaatgaaattgaacaagcaataacatctattaaagaggtttatcccaatatcattatttttgttgataattgttatggagaatttgtagaagataaagaaccgattgaagtaggtgctgatttaatcgccggatcattaattaaaaatccaggtggaggtttagctaaaattggaggatatattgctggtagacaagacttaattgaacgctgtggttatcgtttaacagcaccaggcattggtaaggaagcaggagcctcacttaattctttacaagaaatgtatcaaggattctttctagcgccacatgtggttagccaaagtttaaaaggtgcactgtttactagtttgttattagaaaaaataaacatgaagacctcccctaaatataatgtttatcgtacagacttaattcaaacggttcaatttgagaccaaagagcaaatgatttcattttgccaaagtatacaacacgcttcaccaattaacgcacattttagtccagaacctagctatatgcctggatacgaagatgatgtcatcatggctgcaggtacatttattcagggctcgtctattgaattatccgcagacggacctatacgtccgccttatgaagcatatgttcaaggtggtttaacttatgaacatgtcaaattagctgttacacgtgcggtgcaacatatgcaagaaaacaatttactataa

SEQ ID NO: 460 - DNA, 972 bp, Staphylococcus epidermidis
acacaattgcagatttactttcattacttatcgatcctaaacaacgttatgctattactcagaaagaaacatcaaagtttaaatggtttaattcacatagaaaagaaggtcgtaacgatgaagtttaagttgtcaaagaaaaacactatatttttcatttttacggtctatattatatgtcttattgtattgcaatttataatcaatgatgaagctgcgtatcaggtacatttgtcaaactcatttgaacctatgagtatgaatcatttacttggcacagatgattacggacgtgatttattcagtcgtttagtcgtgggctctcgtgcaacattgtttgttacactacttactttacttttcactgtagtggttggagtacctttagggttacttgcaggctataaaaaaggttggattgatacgattatcatgcgaattattgatataggattaagcataccagaattcgttattatgattgccttagcaagtttttttcatcctagtctttggaatttagtaatagctattacaatcataaaatggatgaattatactcgcgtgacaagagggattgtcaataccgaaatgaatcaatcgtatatacagatggcacaattttttaatgtctcaactttgaatatcttatttaaacacttattaccaaaagttttaccatctatatttgttattatgatagttgattttggaaaaatcattttatacattagttcattatcatttttaggtttaggtgcacaaccaccatctccagagtggggggcaatgttacaagcagggcgtgaatttattacttcacatcctatcatgattatcgctccagcatctttgatatcaggtacaatattgatatttaatttaactggtgatgctgtaagagatcgtttattagaacaaagaggtgtaaaagttgaaacttttaacaataaaaaatctaaacatcaatga

SEQ ID NO: 461 - DNA, 1596 bp, Staphylococcus epidermidis
tatacaaagcaaaccctagataaaggaggtgtttatgtgaatttattaagcctcctactcattttgctggggattattctaggcgttgttgtagggtatattgttgcccgaaatttattacaccaaaaacaagttcaagcaagacaaactgccgatgatattgttagctatgctaataaagaagcagacaatattaaaaaagaaaaattacttgaggcaaaagaagagaaccaaattttaaaagaacaagctgagaatgaactgcgtgaaagacgtggtgaacttcaaagacaagaaacccgacttcttcaaaaagaagaaaatttggatcggaaatctgatcttttagataaaaaagatgagattttggaacaaaaagaatcaaaacttgaagaaagacaacaacaagtagatgcaaaagagagtagtgttcaaacattaataatgaagcatgaactagaattagaacgcatctccggtctcactcaagaagaagctgtgaaagaacagcttcaaagagttgaagaagaactgtcacaagatattgcaatacttgttaaagaaaaagaaaaagaagcgaaagaaaaagttgataagacagctaaagaattacttgctacaactgtacaaagattagcagccgaacatacaactgaatcaactgtttcagtcgtaaatctgcctaacgatgaaatgaaaggtcgtatcataggtagagaaggtagaaatatacgcacattagaaacacttactggcatagatttaattattgatgacacaccagaagcagttattttatcaggttttgacccaattagacgtgaaattgctagaactgcactagttaatttggtttctgatggacgtattcatcctggacgtattgaagatatggtcgaaaaagctagaaaggaagtagacgatatcattagagatgctggagaacaagctacctttgaaataaatgtacacaatatgcatcctgatttagtgaaaattttgggtcgattaaattatcgaactagttatggtcagaatgtacttaaacattcaattgaagttgcccacctttcaggtatgcttgcagcagaattaggagaggatgttactttagctaaacgtgctggattattacatgatgttggtaaagccattgatcatgaagttgaaggtagtcacgtagaaataggtgttgaattagctaagaaatataatgaaaataacataattattaatgctattcactcacatcatggtgatgttgaaccaacctctatcatttctattttagttgcagcagctgatgcattatcagcagcgcgaccaggtgcacgtaaagagacacttgaaaattatattagaagacttgagagactcgaaacgttatctgaaagttatgatggggtagaaaaagcatttgctatacaagctggtagagagattcgtgtagtcgtctcacctgaagaaattgatgatttaaaatcatatagattggcaagagatattaagaaccaaattgaagaagagttacaatatcctggacatatcaaagtgacagttgttcgagagactagagcaatagaatatgctaaataa

SEQ ID NO: 462 - DNA, 801 bp, Staphylococcus epidermidis
gaggaatttaaaatggcagtaatttctatgaaacaattacttgaagccggtgttcacttcggtcaccaaacacgccgttggaacccaaaaatgaaaaaatatatcttcactgaaagaaatggtatttatatcattgatttacaaaaaacagtgaaaaaagttgaagaagcatacaactttgtaaaacaaatctctgaagaaggcggaaaagtcttatttgtaggtacaaaaaaacaagcgcaagaatcagttaaagctgaggcagagcgtgctggtcaattctacgttaaccaaagatggttaggtgggattttaactaactacaaaacaatctcaaaacgaattaaacgtatttctgaaattgaaaaaatggaagaagacggattatttgaagtattacctaaaaaagaagttgttgaacttaaaaaagaatacgaccgtttaattaagttcttaggcggtattcgcgatatgaaatcaatgcctcaagcattattcgttgttgatcctcgtaaagagcgcaacgctattgctgaagctcgcaaactaaatattcctatcgtaggtattgttgacactaactgtgatcctgatgaaattgattacgttatcccagcaaacgatgatgctattcgtgccgttaaattattaactggtaaaatggcagacgctatcttagaaggtcaacaaggtgtatctaatgaagaagtagctgcagaacaaaacatcaatttagatgacaaagaagaatctgaacaagcagaaacaactgaagaaaacacttctgttgaatcaaactaa

SEQ ID NO: 463 - DNA, 417 bp, Staphylococcus epidermidis
ttaatcattaaatctgatatttcacatttatttgtgagtaaagtaaaaataaagagaggtgagatgatgaataatataagagcagaacgtgtaggagaacaaatgaaacaggaaatcatggacattgttaataataaagttaaagaccctagagttggttttttaacaattactgatgttgaactaaccaatgacctttcacaagcaaaggtatatttaacagtgttagggaatgataaagaagttgataatacgtttaaagctttgcataaagcaactgggtttataaaatctgaacttggttctcgaatgcgcctaagaattatacctgagttaacattcgaatatgatgaatctatcgaatacggtaataagatagaacgcatgattcaagagttacacaaaaatgataaataa

SEQ ID NO: 464 - DNA, 1266 bp, Staphylococcus epidermidis
atggtagttaattataatgataatggcgaactgacaatgggaggtacaagcttaaaaactattgcacaaagttttggtacaccttcgattgtttacgatgaagaccaaattcgtaatcagataagaagatatcataaagcatttgaagcaagtggtttaagctacaatatatcttatgcctcaaaagctttcacttgtattcagatggttaaattaattgatgaagaaaatttacaattagatgttgtttctgaaggtgaactttatactgctcttgaagcaggatttgattcgaaacgtattcacttccatgggaacaacaagacgaaacgcgagattcaatatgcattagataatcagattggttattttgtagtggatacgctcgaggaaatagagcttattgataaatatgctgatagtaatgtagatgttgtattacgtgtaaatcctggggttgaagcccatacacatgaatttattcaaactggacaggaagatagtaaatttggattatcaatcaaacacggtctagcattaaatgcagttaataaagtaaaagcaacgaaacatttgcaacttaaaggtatacatttccatattggctctcaaatcgaaggcactgagccgatgattaagacagctaaaattgtgcttaattggttagcaagtgaacgaattgaagtgagtttactaaacataggcggtggtttcggaattaaatatgtcgaaggagatgaaagtttccctattgagcaaggaatatctgaaattactgaagctattaaagaaactgcgcaagcattgcagtacaatattcctgaaattgggatagaacctggccgttcaattgttggagaagcaggtatcactttatatgaggttggtacaattaaagatatccctggagttaataaatatgtatcagttgatggcggaatgagtgatcacatacgaactgcactttatggtgcacagtatgaggcgttgttagttaacagaaatgaaaaagctaatgaatctgtaacaattgcaggtaaactctgtgaatctggtgatattatcgtacgagatgccccattaccctcttctgttcatagaggtgattacctagcaatactttctactggtgcgtatcattattcaatggcttcaaattataatcaaatgcaaaaacctccagtatttttcttgaaagatggaaaagcacgtgaagtgattaaacgtcaatcattgagacagttaattattaatgatacgaaataa

SEQ ID NO: 465 - DNA, 255 bp, Staphylococcus epidermidis
tatgaaactaataaaaatataggagttgtttattcattcatgtctattaatattgatcctgaaaaatttgctgaattagttgtaacttcaaatccagccaaatctgatgacgctgaagatatcgctaaagaaagtttaattttatacattaatgcttatcgtttagcagagaaatatgcaaatatcgctacaaattgctatgatacagctgaaattttaaaagaaataaatgaagttgatttacaattaaaataa

SEQ ID NO: 466 - DNA, 534 bp, Staphylococcus epidermidis
acaaagactaactacacaaattgtgttaaattagatgtatatcgaaagggtgataaaatggaaagtatttatgattttgttgtacaaaaaaacaatggtgaaagttataaattagagcagtataagggtgacgttatgcttattgtcaacactgctagcgaatgtggttttacacctcaattcgaaggtttacagaagttatatgatgagtataaggatcaaggatttattattttaggatttccatgtaaccaatttggcggtcaagaaccaggatcgggagaagaagctgctcaaaattgcaaaattaactatggtgtgactttccctattcatgaaaaagttgatgttaaaggtgataatcaacatccattatttcactttttaacaaacgctgctaaaggtatgataaacgaaaaaatcaaatggaatttcactaaattcctaatcgaccgtgaaggtaatgtgattaaacgtttctcccctcaaaagaaaccggaacaaattaagactgaaattgaaaaattactataa

SEQ ID NO: 467 - DNA, 144 bp, Staphylococcus epidermidis
ataacctataatggtatatgtatttcttacagttctcatgttacatatcttttattaaatcaaaatagagttattgtaaattttttgttaagaatgggatttgaattaatgaaacgtgtattaaaatttaatttgctaacatag

SEQ ID NO: 468 - DNA, 258 bp, Staphylococcus epidermidis
gctaaaaataagacaacgagtaataccatcattgaggtacgtgttaacaacgatttatatttaataaatataaataacactatgattaaaatcaatgcaacaaacatccactttactgatctttccgacagtgcgataaatatgaaaccgtatatgaatactggtatagcaacaaaggtgtattctttaattgatatttcacttaaatgttgtatgaacaatgcaattaatacacttgttgataatgctaaaaagtaa

SEQ ID NO: 469 - DNA, 987 bp, Staphylococcus epidermidis
aggagaaataatattatgaaagtgatagaagttacacatcccatacaaagtaatcaattcataactgaaaatgttgctatggcttttggtttcttcgatggtatgcatagaggtcacgacaaggtgtttcaagtgcttgatgaaaaagcaaaagagcatcaacttaaaaaggctgttatgacgtttgatccacacccctcagtcgtattaaaccctgagcgtaaacgtacaacctatcttacaccactttcagataagttagaaatgatagcagaacacggtatagactattgtatcgttatcaatttttcatcaagatttgctaatgtgacatctgacgatttcataaaaaattatattattaataatcatgttaaagaagtgattgcagggtttgatttcacctttggtaaatttggaaaaggaaatatgacggtacttcaggaatcaaaagcttttaatacgactattgtaggaaaacaagagatggattctgaaaaaatttctacaactgcaatacgccaagcgcttacagatggtcatttacagaaagcaaatgacgaattagggtatatatataggattaaaggaactgtagtacaaggtgaaaaacgtggaagaacaattggttttccaacagctaatgtgcaacccagtgatgattatgtactaccaaaaaaaggtgtttacgcagtgagtatggaaattggtccagagagtaaattacatcgtggtgtagctaacgttggagttaaaccaacattccacgatccaactagggctgagttagttattgaagtgaatatatttgattttaatgaaaatatttacggtgaacgtgtgactgtgtattggcatcactttttaagaccagaagttaaatttgatggtatcgatccattagttaaacaaatgaatgaagataaagcgcaggctaaacatttattatctattgatttcgatgatgatatatcatataatatataa

SEQ ID NO: 470 - DNA, 546 bp, Staphylococcus epidermidis
tttatggataattctttacacgctacaacaatttatgctgtacgccataatggtgaagcagctatggctggtgatggtcaagtcacattaggtcaacaagttattatgaaacaaactgctagaaaagtaagacgtttatacgaaggaaaagtattggctggttttgcaggtagtgttgctgacgccttcacacttttcgaaaaatttgagacaaagcttcagcaatttagtggtaatttagagcgcgcagctgttgaactagcacaagaatggcgtggagataaacaattacgacaattagaggcgatgcttatcgtaatgaataaagatgccatacttattgttagtggtacaggtgaggttattgcacctgatgatgatttaattgccattgggtcaggtggtaactatgcacttagcgcaggtcgagcactaaaaagacatgcagcacaactttctgctagtgaaatggcatacgaaagtttaaaagttgcagctgatatttgtgtgtttacaaatgacaatataattgtagaaacgctataa

SEQ ID NO: 471 - DNA, 1167 bp, Staphylococcus epidermidis
gggatggataattttatgaacgagttagaattcgttacattgcacagaagacatttacatcagtatccagaattaagtttacatgaatttgaaacgacatcgtatataacatcatttttagaggatttaggcgtaccttacgaccgaccacttaaaactggtgttattgcttatttggaaggtaatagtcaccacactattgcattcagagcagatatagacgcgttaccaatttatgaagaaaatgatattgattttaaaagtaagaatgataatgtcatgcacgcgtgtggtcatgatggtcatacgacagcacttatgctttttgttaaaaggtgtaaagcattgtatgacaaatctgaattacctcataatgtagtgtttatatttcaacctgccgaagaaaccggtggaggagctaatcgtttaatcaaagctggcgcttttgacaagtaccctattgaagcggtgtttggttttcacgttaatccgtttgaaaaagaaggtaaaattgtaattcgagatgaagaaatcactgcaagtgccactgaatatcgcttctttttaaaaggattatctagtcatgttgctgataaggagcaaggtcattcatgtggtgaggggttacagcatgtcttaagtcaaatcggccaaatccaacaatttcatttgaatggattgaaacgtaacattattcatatgggtcattttgaagctggtgaagctattaatacagtaccgagtcatggttatcttgaaggtacaattcgtacatatgacacagaagatttagctattgtaaaacaccaaatgcataaaattgcgaaaagtgttcaattattatttaatgttgaatgtgaggttaaatttgaagaaggatatccaccaacaatgaatcatccacaattacgtcaagccgttgagaacgctataaaaggtgcaaatttagaaatagttgaaaaaaaactacccttcctgttcggtgaagattttagtttttatggtcaacaacttgccccttcatattttgtatttgttggtacacaaaacaatgaaaaaggttttgtgactggtcttcatactgcccatcttaattttgatgagaaaatattaattgacgttgtaaattattacgagcatttgttaagaaattataaagaggtgtaa

SEQ ID NO: 472 - DNA, 1287 bp, Staphylococcus epidermidis
tgtttttgtaagggaggatcagttatgtatgattacaatttattagaagatagggatgtactctgcatagaccaaaaaagcttttttgcgagtgtatcatgtatggaaaaaggattggacccattaacaactaaactagcagttgtagcagatacgaaaaggcaaggttcggtcgttctagcagcaactccaaagttaaaagaattaggtattaaaacgggatcaagactttttgagataccacatcgtaatgacatttatattattaatccaagtatgagaaagtatttaaatgtatctgttgcaatttcaaagattgcactgcggtacgttccacctgaagatttacatcagtatagtattgatgaatttttcatggatgtaacggatagttaccatagatttaattcaacagtttttgctttttgtaaaagatttcaaaatgaaatattagaagaaacaggtattcactgtaccattggaataggctcgaatatgctattgagcaaggttgcaatggatattgaagctaagcattcggaaaacggtatagctgaatggcgttatcaagatgtacctgaaaaattatggccaattcaaccacttagagatttttgggggattaataagcgtacagaaaagaaattgaataaaagaggaatatttacaataggagatttagcaaagtatccatatcattatttaaaaagagattttggagttttaggtatagatatgcatctacatgcaaacggtattgatcaaagtaaagtaagagaaaaatataaagtaacaaatccttcaatatgtaaaagtcagattctaatgcgagattatcaatttgaagaatccaaagttgtcatgcaagaattgatagaagatgtagcaagtcgtttaagagcagaaaagaagcttgctcgaacaattcatttttctttcggttatgctgaaggtggtggcatacataagcaatatactttggaggatcctacaaatttagaaagagatatattcaaagtcattaattattttgcaaatcgtctgtgtgacaaaaaagcattgtatagaacgttaagtgtatcgttaactcagtttattaaagaaagcgatcgacaactcaacttattcattgatgaatatgaacgtaagaaagatgtaaaacttgctaaaaccattgatcacttacatttaaaatatggaaaaggaattgtgtcaaaagcgacttcatacaccgaagctggtacaaagcatggtcgattaggactaatggctggtcataaaatgtag

SEQ ID NO: 473 - DNA, 1002 bp, Staphylococcus epidermidis
ttctattgtaaggggttaaaaaagatgaaaatttttgattatgaagatatacaattaattcccaataaatgtattgttgaaagcagatctgagtgtaatacttcggttaaatttgggcctcgtacttttaaattgccagttgttccagcaaatatgcaaacagtcatgaatgaagaacttgcacaatggtttgcagaaaacgattatttttatatcatgcatagatttaatgaagaaaatagaattccatttataaaaaaaatgcatcatgcagggttatttgcttctatttctgttggagttaaagaaaacgaatttaattttattgaaaaattagcttcttcatcgctcataccagaatatataacaattgatattgctcatggtcactcaaattcagttataaatatgattaagcatataaaaaaacatttaccaaatagttttgtgatagctggtaatgttgggacgcctgaaggagtaagagaacttgagaatgccggtgcagatgctacaaaagtaggtattggtccaggaagagtatgtattactaaaattaaaactggatttggtacaggaggttggcaactttctgcgttaaatctttgtaataaggcagctagaaaacctattattgcagatggagggttaagaacccacggtgatatagccaaatcaattcgttttggtgccactatggtaatgattggctctttatttgctgcccacgaggaatcaccgggtgaaaccgtcgagctagatggcaaaaaatataaagaatattttggtagtgcctcagaatatcaaaaaggtgaacataagaacgttgaaggtaaaaaaatgtttgtagaacacaaaggatctcttaaagatacccttactgaaatggaacaagatttacagagttcaatttcatatgcaggaggaaaggacttgaagtcattaagaacagttgattacgtcatagtaagaaattcaatctttaatggtgatagagattag

SEQ ID NO: 474 - DNA, 456 bp, Staphylococcus epidermidis
agagtaggtaatattatgtttaaatttaacttcttttatatttcaaagattcgtgcaacttggatgctttacctcattgggatttatcctctcttgatattcctagctgaattacttaatagtaattttctttcattatcagcaactcataagaatagtgtaagctttttagaattatttatcgcaatatatgatactcaacaaaaagtaatgctatcacttataattattggatatttatcttctttattattttatagcgaaattagcacaggaagactattgttttataaggatcaaagtcgctacaaaatttttaattctaaattaacatctattatttctagttactttatattcttattcattttattattatcaacgttagtagtttatgtgttttatgttaacaaccatgaatattcatctcattcttttatgttaaataactcataa

SEQ ID NO: 475 - DNA, 516 bp, Staphylococcus epidermidis
atgaatatcaatactgcatactttgctggtggctgtttttggtgtatgactaaaccttttgatacattcgatggtatcgaaaaagtcacgtcgggatatatgggaggaaacttagttaatccttcttatgaagaagtaaaaactggatctactgggcattatgaagtggttaaaattgagtatgatgttgctctattttcatatcataaattattagaaattttcttttcagttatcgatcctttggatgatggtggtcaatttcaagatagaggttctcaatataagactgctattttctattcaaatgaacatcaaagacagttagcagaacaatatatatgtgaactccaagatagttttaacgctgataaagcaattgcaacaaaaattttaccggcatcaactttttatgaagcggaagcataccatcaagatttctacaaaaagaaccctgaacgttatgaacaagaacaacaagatcgtgctagttatgtcaaaaataatcatatgtaa

SEQ ID NO: 476 - DNA, 378 bp, Staphylococcus epidermidis
ataataaccaaggtggaggcccacattattatcctaataatcaaggtatatatgagtcacagcctgaacacaagaaacccaccattcccgacagatggtgatggttatgaatataattatcgccaggatgatgacaattactttgaacagccaggtaaattattcagattacagtctgaagatgcaaaagagcgtatcttcacaaatacagctaatgcaatggatggggtttctaaagatgtcaaagttcgccacattcgccattgctataaagctgatccagaatatgggaaaggtgtagcaaaagctttaggtattgatatcaatcaaatagatttagagacaaatcaagacgaaacatatgaaaactttaaataa

SEQ ID NO: 477 - DNA, 129 bp, Staphylococcus epidermidis
aaaagatacaagaagagaaacacaataaataaaacaatagagctcgacccatcattgatatataagttgaaaattttcgtagtcattgatgatttacttagaaataatttatttttaattaacttttag

SEQ ID NO: 478 - DNA, 405 bp, Staphylococcus epidermidis
attaataacaagttcaaaagtagaggagaggttcaagtaatgtctaatgattcaatcagacgaaacatggccgttttctctatgagtgtggttagtaaattgacagatttatcaccaagacaaattcgttactatgaaacacatgaacttgtgatgcctgaaagaacagatggaaataagagattattttctatgaacgatttagagaggttgttagaaataaagtctcttatcgaaaagggatttaatattagaggtattaaacaaattatattcgatgagcaagggcatttaactactgatgaacaagagacaagaaagagaatgattgttgacgcaacgcagaaaccacgtagtgaaacattaccaataaatcgtggcgatttatctcgatttattaaatga

SEQ ID NO: 479 - DNA, 930 bp, Staphylococcus epidermidis
aggtgtgacaacatgtataatggcatactaccggtatttaagaaacgaggtttaacaagtcacgacgtcgtttttaaattacgtaaaattttaaaaatgaaaaaaattggtcatacaggaacattagatcctgaagttaatggtgtgttaccaatttgtttaggcgatgcgacaaaagtcagtgattatatcatggaaatgggaaaaacttatcacgctatgataacgctaggaaagagtacgactactgaagaccaaactggagatattttagaaactagggctgttgataagaatgatattaatgaagatacgattgaccaagtgttgcagcaatttgaggggcatattcaacaaattccgcctatgtattcttctgttaaagtaaatggaagaaaattatatgaatatgcgagaaataatgaaactgtcgaacgccctaaacgacaagtttttattaaagatatacatagaatatctgaagttactttccaggagcagacatgtcattttgaagttgaagtaacatgtggtaaaggaacttatattagaactttagctacagatattggacttaaacttggttttccagctcatatgtcacgtctaactagaattgcttctggcggttttcaattagaaagtagtttaacgattgatcaaattaaagaattacatgagcatgattcattacataatgaattgtttcctatagaatatggcttaaaaggtctgaaatcattccaagtgaaagattcaaattttaaaaagaaaatctgtaacggtcaaaaatttcataaaaaagtgttaagtcaaaatgttaaagaaccttttatatttgtcgatagtagcactcaaaaagttttagcaatatatatagttcatccagataaaccttatgaaataaaacctaaaaaagtttttaattaa

SEQ ID NO: 480 - DNA, 450 bp, Staphylococcus epidermidis
gtttctcgcaagaaagtgcaccaatttactgaaaattatgatacattattaatagggattgacatgtcccgtgacacattatatttaagaataaataaacgtgttgatattatgttgggccacggattatttaatgaagtgcaacatctcgttgaacaaggttttgaagcgagtcaaagtatgcaagccattgggtataaagagcttgtacccgttattaagggaaatataagcatggaaaatgctgtagagaaattaaaacagcattctcgacaatatgctaaaagacagttgacttggtttaaaaataaaatgaatgttcattggttaaataaagaaaggatgtcacttcaaatgatgttagatgagattacaacccaaataaataaaaggagttctaaccatgattgcaaacgaaaacatccaagaccaagcactagagaactttaa

SEQ ID NO: 481 - DNA, 159 bp, Staphylococcus epidermidis
aatatcttaaattgtaattttacattccaacttattaaattatctattatcaacaatgttgtcatatatatttttaattttaacgttttaatacgattcagtagtcatagcacacatttatatgacaacacttatagcaattatttcatgaataaataa

SEQ ID NO: 482 - DNA, 894 bp, Staphylococcus epidermidis
tttttattaaacataaaagaggtgaaatcaatgctagaatttagaaatgtgtataaatcttttaagaagaaagaagtattatgtgatgttaattacaaattatctgctggagaaaaggttggtcttataggttctaatgggtctggaaaatcaacattaatgaaacttatagctaaaactcaattaccatctaaaggaaatgtttattttaacaatatagatatacataaatctcacaatatgataaaagatttttctttcatgataggacaaatatattatcctgagttaaatgcaagacaaaatattgaaaattacctaaaaattaataataagattagctatataagtgaaattcaaaagatgctaaacattgtaggtttagaagatattgaaaagaaggttaaaaattattcgtatggaatgaaacaaagactttgtttagctatttgtttaattaccaaacccccagtagctgtattagacgagccattcttaggtttagatccgcttggggtaagggaattaaataatatcactgagaaatattcaaaagaaaaaaacactttatttttaatatctagtcaccagttaaaagaattagaagatctttgtgatagatttctattactcgaaaaccatcaaattagagaaattgacttacataatagaatattcactcaaaagttaatattcaaaaatactttaaacaatgctccagaactaaaggctaatttcaatttcattaaaaaaattgatagcaattcaataacaattataaataaagatgaagaagtagatcttacaaatttacttaatttagtaggtaaaaatcccttaataaaaattgaaagtaatgataatctattatcttcatatttctataaagagtag

SEQ ID NO: 483 - DNA, 318 bp, Staphylococcus epidermidis
gtattattaaaactaacagaatatttgttaattattatgatagcaataataaaatttaatgcattaagaaagaggtttcaaatgagtaaagaaaatttaaatattgatagaataaatgaattagccagaaaaaagaaagaacatggcttaaccaatgaagaggctaaagaacagactaaattaagaagacagtatttagaagaatttagaaaagggtttaagcaacagatagaaaatactaaggtcattgaccctgaaggaaatgatgtgacacctgaaaagttaaaaaagatacaagaagagaaacacaataaataa

SEQ ID NO: 484 - DNA, 2745 bp, Staphylococcus epidermidis
cggcatataaatatatataaatatcaagggggatataaaatggcttctaatattaaagaacaagcaaagaaacaattcgaattaaatggccaatcatatacttactatgacttacaaacattagaagaaaaagggctagctaaaatttctaaattaccatactcaattcgcgtattgttagaatctgtgttacgacaagaggatgattttgttataacagatgatcatatcaaagcattaagtaaattcggaaatgcaggtaacgaaggtgaagttccattcaaaccttctagagttattttacaagactttacaggtgtgccagcagtagtagatttggcttctttacgtaaagctatgaatgatgttggtggggatattaataaaatcaacccagaagtacctgtggatttagttatcgaccattcagttcaagttgatagttacgctaatccagaagcattagaacgtaatatgaaattagaatttgaacgtaactatgaacgttatcaatttttaaactgggcaacaaaagcttttgataactataatgcagtacctcctgctacaggtattgtccatcaagtaaacttagagtatttagcaaatgtagtacatgtaagagatgttgatggtgaaaaaacagcatttcctgacactttagtaggtactgattcacatactacaatgattaatggtattggtgttctaggttggggcgttggtggtatcgaagccgaagcaggtatgttaggacaaccatcatatttcccaattcctgaagttatcggagtgcgtttaactcactctttaccacaaggctcaacagctacggatttagctttacgtgtgactgaagaattacgtaaaaaaggtgtagttggaaaatttgttgaattcttcggtccaggtgttcaacatttaccattagcagacagagctacaattgctaacatggctccagaatatggtgcaacgtgtggtttcttcccagtagatgaagaatcattgaaatatatgaaacttacaggccgtgacgaagaacatattgaattggttaaagaatatttacaacaaaaccatatgttctttgatgtagaaaaagaggatcctgaatatacagatgttattgatttagacttatctacagtagaggcatcactttctggtccaaagcgtccacaagacttaattttcttaagtgatatgaaaaaagaatttgaaaaatcagtaactgctcctgctggtaatcaaggacatggacttgatcaaagtgaatttgataaaaaagcagaaattaattttaatgatggatctaaagcaacaatgaaaacaggagatatagcaattgctgctattacctcatgtactaacacttctaatccatatgttatgttaggtgctggtttagttgctaaaaaagctgtagaaaaaggattgaaagtaccagagtttgttaagacgtcacttgctccaggttcaaaagttgttacaggatatttaagagattctggattacaacagtatttagatgatttaggtttcaatcttgttggttatggttgtactacatgtattggtaactcagggccactattaattgaaattgaaaaggcagttgcggatgaagatttattagtaacttcagttttatcaggtaatcgtaattttgaggggcgaatccatccattagtgaaagcaaactatttagcctcaccacaacttgttgtagcttatgcgcttgctggtacagtagatattgatttacaaaatgaaccaattggtaaaggtaaagatggtaaagatgtatatttacaagacatttggccttcaatacaagaagtttctgatactgtagataaagttgttacacctgaactattcttagaagaatataaaaatgtatatcataacaatgaaatgtggaatgaaatagatgtaaccgatgaaccattatatgatttcgatcctaattcaacatatattcaaaatccaacatttttccaaggattatctaaagagccgggtaaaattgaaccacttaaaagtttgagagttatgggtaaatttggtgattctgttacaacagaccatatttctccagcaggtgctatcggtaaagatacaccagcaggaaaatacttattagatcatgatgttgcaattcgcaactttaactcttatggttcccgtcgcggtaaccacgaagttatggtacgtggtacatttgccaatattcgtatcaaaaaccaacttgctccaggtactgaaggcggatttacaacatattggcctaccggagaaataatgcctatatatgatgcagcaatgaaatataaagaagatggaactggcttagttgtcttagctggtaatgactatggaatgggatcttctcgtgactgggctgcaaaaggtaccaatttattaggagttaaaactgtcattgcacaaagctatgaacgtattcatcgctctaacttagttatgatgggtgtactaccgcttcaattccaacaaggagaatctgcagaagcactgggtcttgatggaaaagaagaaatatctgtagatattaatgaagatgtacagccacatgatcttgtaaatgtgactgcaaaaaaagaaaatggtgaaatcattaatttcaaagctattgtacgttttgattcactagtagaattagattattatcgtcatggtggtattttacaaatggtactaagaaataaacttgcgcagtaa

SEQ ID NO: 485 - DNA, 177 bp, Staphylococcus epidermidis
attgcaataaatactggcaatcagtttacaatagcgcttacattttttataattaaagggcaacttaacctaagaaacaggaggatggaagatgaatatccacgagtatcaagggaaagaaatatttcgttcaatgggcgttgcagttccagagggacgagtagcatttactgctga

SEQ ID NO: 486 - DNA, 726 bp, Staphylococcus epidermidis
cgaggtgtaaaaatgtcggaaatgagtgcaatctatagagtaaaacaatacattttaaatttaatcaaagatggtgaactaaccaatggaagtaaattacctagtaatttgtcaattgcgagagcattaaatgttaaaacagatgatgtttatgatggtatagatgagttgattactgaacaagtagtaacggataattttgaagaggggactagcgtaaaagtaaagccccctttctattacccgttaaataaaattattagtatagggactatgattaaagaagcgggttatgaagcaggaacagaatatctgaatcttgacgagcaacctgcaactattttagatgctgaacatttaggtatagaaacaaaagaacctataacaattattgagagactaaggactgctaatcataagcctgtcgtatattgtttagacaaaatagcaaaaacttatctaacttgtacagattatcaacagagtagtggttcaatgttagaagctattaaagcatctacaaatcatcaaatcatgcatgcagaaatggatttagaagcaattagttacgaaccccatatctctgaagtgcttaatgcttcacctcacgaagggcttatgttacttaaagtagtacattatgacgaaaagcatcaaccaattttgtattctttaaattatattaagagtagtttagttaaattcactattactaaaagtgaataa

SEQ ID NO: 487 - DNA, 1089 bp, Staphylococcus epidermidis
agaggtgtaaagcaattgacagcaatttggtcattagacacagaagcattttatcagaatgcagtaaaagtaaaaaataacgaaccaataatggcagttgtaaaaaacaatgcatatcattatggacttgagtttgcagtgaaaacatttttaaaagcggaaattaatacatttagcacaacttcattaaatgaagctatacgagttagaaaaatagcacctgaagcaactatatttttaatgaatcctgtttatgattttgatttagtaaaacgttatgatattcatatgacactcccctctttaaactattattataaatataaacaagatttaaaaggcattcatgtacatttagaatatgaaaatttattacatcgttccggttttagaaatatcgaagaaatacgtgaagttttaaaagatcatgatcaaaataatcaagataaaatgattatttcaggaatatggacgcattttgggtatgcagacgaatttgacgtagatgaatataaaatggaacgtgatgcttggttaaacttgataaatacacttttaaatgaaaattatcattttgatatgatacattcacaaaatagtgcaagttattttcgtgagaatcaaatgttacttcctcatcacactcatgctagagttggaattgccctttatggttcaagaccatatagtcttataaatgaagaacgcattactcaatctttgactgttaaaggtaatgttatacaagttcgtgatgtaaataaaggtgattattgtggatatagtttcgcctttgaagtaaagaatgaccacactcaattagctgttgttgatataggttatggcgatggtattctaaaatcaagagcaaaacacgaagctataattaatggcaagcgatatccaattagagcactaatgatgagtcatatgtttattgaagttgatgacgaagttcatgcacaagacgaagtcatattatataataaggatatacgtatagatgaatttacatttaaaggtgttggcgcaaattcagaacaattaagcgcaatgaatcacgattctcttatgaaggagtatttataa

SEQ ID NO: 488 - DNA, 144 bp, Staphylococcus epidermidis
agtttggtaaatatgaaagtgaatctaaataatctaagttgttcttgcctctttcatcttattaaaaatacatataagtatatattcaaatgggatgaatactctaaatatagtaatgatgagagattaaaaaagaaggtgtag

SEQ ID NO: 489 - DNA, 1095 bp, Staphylococcus epidermidis
ttgagagcaaatcaacacttttcatcgaataaattaataaatatcgatttaacattggagggaacgcttgtgatttcatttgaaaatgattatttagaaggtgcacatgaaaaagttttaaatcgattagtagagacaaatcgaatacaagctgctggatatggcttcgatgacttttcggcacaagctgcagataaaattagacaacgtattgactgtccagatgctaccattcgttttttagtaggtggtacgcaaaccaatcaagtagttattaactcaatgcttgatagttatgaaggtgttatatccgctgatacaggacatgtggcagtccatgaaggtggtgcgatagaattcagtggacataaagttctaaccataccctcccaagaaggtaagattactgctcaagacgttgagaattatatagaaacttttgaaagtgattttaaaaaagaacacatggtgtatccagggatggtttatatttcacatccaaccgaatatggaactttatacacgaaagaagaattacaatctttatctagagtttgccgtagacatcagattccactatttatggatggtgcacgtttaggctatggccttatgagcaatcaaactaatgtaactatcgaagatgttgcaaaatactgtgatgtgttttacataggaggtactaagattggagcactttgtggtgaagcaattgtcttcactaaacaaaatgaacctaaaaacttcactacaattataaaacatcatggtgctttattagcaaaaggccgtctaactggtgttcaatttttagaattattcactgatgatttatattttgatataagtcgacatgctattaaaatggctgaaaaggtaaaaaaaggatttatagataaaggatatcaagtctattttgattcaccaaccaatcaacaattttttattttaagcaacgataaaattgaagaactaaaacaaaaggtaaaattcgcagtttgggagaaatacgataatcaacatcgtgtagttcgcttcgcaacaagttgggccacaactgaagaaaatgttaatcaactacttgaactaatataa

SEQ ID NO: 490 - DNA, 129 bp, Staphylococcus epidermidis
gctaataaaaaggaaacgtgtgaggtgtcttcttccttgttaaactttatgacagattatttcatttgtcctttaacttcttcagcaaagttttcttcacgtttttccataccttctccaacttcataa

SEQ ID NO: 491 - DNA, 957 bp, Staphylococcus epidermidis
caaataaaaaaaggaataggggcagatgttgtgagtcaaagtcattttaaaataacagttgaagatggaacaatgttagaggtgaaaattgataaagcaaaaaagagtactattggtattgttcatcttttccatggcatggctgaacatatggaccgttatcaagagttagttgaggctttaaatacacaaggttatgacgttgttagacataatcaccgtggacatggtaaagaaatagatgagaatgaacgtggtcattttaatagcatgaatcaaattgtagatgatgcttatgaaattattgagacattatatcttgaagagctcaatgtaccctatattatcataggtcattcaatgggctccattattgctagatcatttgttgaaaagtatcctgacattgctcaaggtttaattcttacaggaacaggtatgttccccaagtggaaaggtgtaccaatacgtttagcaatgaagttagttacatttatttttgggaaacgacgtcgactcaagtgggtgaatcaattattgaataaaactttcaataaaaaaatcactcaacctcgaacagatagtgattggatttctacacgtcaggatgaagttgataaatttgtggaagatgaattttgtggattcaaagtatctaatcagctcatttatcaaactttaaagaccatgatgaagacagtagaacgacaacaactaaaaagaatggacaaagaactacctatactatttatttctgggaaagatgatccttttggtgaatatggtaaaggtataaagcatttagctagattatataaaagagcaggtattaaacatataacagtacaactatataaacataagcgtcatgaaatattatttgaagaagattatttgaaaacatggcaacacatgtttgaatggatggaaaagcaaattttgaaaaaacaaaagtga

SEQ ID NO: 492 - DNA, 396 bp, Staphylococcus epidermidis
aaagaaaaaaatacaagaaaaagcaaaaaagaaattcctgatgtgatacgtagtggtaaaataaaattagatataaatcctgaaaaacaaaatagacattccttaaatcatagtttatatttgaaaaataaaaattttgcattaaaaaataatgaaagattaccaagttatactacgttatctatcaatgaattaaatagattagtacaacagtactcaacttctggtaaaatcttaataaataaaaacggttttaaccataaaaaagtaataaattttgagaggattataggaaaagcatttatagatggaaaatatattgagactacatttggtaaagtgcattattcaaaaacagactctcatataataccttttataagtaaggagaaataa

SEQ ID NO: 493 - DNA, 870 bp, Staphylococcus epidermidis
ggaggaaaaaacgtgtcaagtaatgaattattattagctactgaatatttagaaaaggaaaagaaaattcctagagaagttttaattgatgcaattgaagcagctttaattactgcgtacaagaaaaactatgatagtgccagaaatgtaagagtagaattaaatatggacgaaggttcatttagagtgattgcacgtaaagaagtcgtagaagaagtgtttgatgacagagatgaagttgatttaagtactgctttagtcaaaaatcctgcctatgaagtaggagatatttatgaacaagatgtaacaccgaaagacttcggacgtgtaggagctcaagcagctaagcaagctgtgatgcaacgacttagagacgcagaaagagaaattttatatgatgaatttatcgataaagaagaagatattctaacaggtgtgattgaccgtgtagaccatcgctatgtatatgtgaatttaggaagaattgaagctgtgctgtcagaagctgaaagaagtcctaatgagaaatatattcctaatgaacgtatcaaggtgtacgtaaataaagttgaacagactacaaaaggtccacaaatttacgtatcaagaagtcatcctggattactaaaacgcttattcgaacaagaagttccagaaatttatgatggtactgttattgttaaatcagtagcgcgtgaagctggagatcgttctaaaattagcgtgtattctgataatcctgatatagatgctgttggcgcatgtgtaggttctaaaggagcacgagtagaagcggttgttgaagaacttggtggcgaaaaaatcgatatcgtccaatgggatgaagatcccgaaagtatttgttcgtaa

SEQ ID NO: 494 - DNA, 153 bp, Staphylococcus epidermidis
gcaatgaaaaaggagtgtatacacatgccaataatttattatgatggaaattgtgtttattgttataactatgcaatttggttaattcaaaacggactttcacataaatatgagtttgcaacaattaaaggtcaaataggtaaacaatttttt

SEQ ID NO: 495 - DNA, 135 bp, Staphylococcus epidermidis
aattggaaaaagagattcgcaaatatgatgatgaagagtcacttcgtcgtcataaataacaacttttcaactttgctaccatcttatcttaagcaaagttgttttttatttcttttttatctcttttcctattaa

SEQ ID NO: 496 - DNA, 138 bp, Staphylococcus epidermidis
ataagtcgaaatctgacttctattgaggtgatgcattatgaatgcactttgattacaactttttattcttcactattcacttcagttgcttcagacgattcattatctacagtgaaagtgctgatcgcatgtttgtaa

SEQ ID NO: 497 - DNA, 126 bp, Staphylococcus epidermidis
attatacgaaagggctttatttttataaagtattttggcgagactcttgagggaacaggacaagctgaagactacaggctgaagctgtcccctaagaaagcgagccaacaatacgaagtattgtaa

SEQ ID NO: 498 - DNA, 129 bp, Staphylococcus epidermidis
gcaattagaaatttgagttacatccatttaattttaggttcttctcctttaaaaattctaactatattagatttgtgtcgaattattaatatgattgaaacaattccgctaacagcaagtaaaatataa

SEQ ID NO: 499 - DNA, 2601 bp, Staphylococcus epidermidis
atgagaagaaaagcatgtttcattatattattaattacattatcattaattggtcatagttatattatttttcgcttccatcatgatggtgttctttcaactggcccaaatgatggtatggaacagatgattcctattcaaatgtatctttatcatcaatggactcaagggaacttattttattcaacacatttgggtcttggcggagattttttcactgacttaagttattatttttcaacaaatttaatatttattttaaatgtccctatcatcaaattatgtgaaatattcttttcattgaacacaaatcaaattcttctttggatgtacaacgcactaattgtttcaattattaaatcaactattgctctgttttgcacttatttatttagttattatatttctaaaaataaaataatcagtttattgatttcatttatctttgttatgtcacctttgtactttagatttacaatttactggccattctttagtgatactttcatttggttaccactcttattattagggattgaacgtttattaagggattttaaagcaggtttatttatactaactgtaagtctaattctaattaataacttttattttgcatattatttcctcattattggtataggttataccctgattagaattatttacagacatcctaaagatagtttaactcgttggcaagcttctcttacaattatatgtagtgctctgctcgctttaggaaatagtatgtttgtgttctttcatggtgttcaaagttttcttaataatcgtcgacaatcatttacaggacaagtgaattggattgaacatttaaataaagataccaatatatttttcgataattacttgattgttgtgatatttttatctattcaagctcttttgacaatcaaattatacaaacatttttattataaattatttgcattgttattattggcaacaattatttttgcatttctcccatttgttgaccaactatttaatgggttttcagcacctcaaaaacgatggcattttatcttagcttttaatagttcaattttaattgggttatttgtaaaatattttaaaacaattcgaccaaagacttatatttatactaatctgatagctcaaagtgtcatctacataagttcaattagctacaatacttttttaccttggctctctttagttccagtagtgtcagtgattggactattaattttattaataaaagagaaaaaagtacgttattatcttacttacctttatagtatttcaatcgctgctctcagtcttatgattactttcgtattcataaaaaatcaaattttctttcaagatcatatcaatcgtgcgaacaagcgatacattaattcaagtttctataactcggctatacaaagatcgttagtaaaagaaatgaaccaaactaagaatgacgatcaacgaataaattggcgtgtcgatgaacaagataatacccctatgtatcaaaattttaaaggacttagtatttactctagtatatttcatcacaacattctcgatttctattatgatgccttaaaaattaatttagctgaagaatctgtcagtcgataccagtctactaatgctcggcaaaatatcgagagtctgttttcagtaaaatatttaatgatgaaagattatcaaaattttattccatcttattttaagaaagttaagtcacgtggacaatatattatttataaaaatcaacttccactaccaagtgtaaaagtaacacaaaacatttataatcataaaagtttaaaaaaacctatagatagagagcatgcaatgattaatggtgctattgtgacatcaaaaggtacagcatatcactcaaaagttaaaaatttgttagaccaaacacgtgtatcaacacaaaatataacacgatattcaaacaatgaactaaccgttaataaagagagcggaataatcaaattacatttacctaagaatataagagacaaatacaaagatttttatctcactatgaatattaaacgaggcgatcctgacagtaattacactgtgagcatcaatcaatatcataatcatcgtctatacaatgattctatatatcgcacgggaataagcaaagtgctttatcgaagtttaccagacaaaaatggtgatattacgattcaactatcaccgaaaggtaagttcaatttggaactgttagaattaaacggtgaaaattatgatacgctaaaacaagcacaccatcatgctaactttaatatgcgttataaagatataaaaaacggggtaaaagttaacttagatcaccattctaaaggacttgcagtcattaatattccatatcgtaaaggtatgcgtgcatacgtggatgaccgacaaagcaatatcaaaaaggtgaattatatgatgacaggtgtcccagttaataaaaatgataaaacaattacgattcaatatcgaccaccttttctaaaaacgatgttttctatctcaatatttagtatagtggtgagtattgtattcattagattaaagaatataaggaaaagaaagatgaggattcgccatgattaa

SEQ ID NO: 500 - DNA, 210 bp, Staphylococcus epidermidis
gtaaggagaaataaaatgttaattaaagatgcttatcgtaaaaatgttattgtcacacttaaaaataatgaaaagtttaaaggttttgtgtttgattatgaaaacccattagaaagtgatactggaaactattccctggatttagagacagatttaggaatatattcaattgatgaatcggaaataaaaagtataaaattaatatcttag

SEQ ID NO: 501 - DNA, 174 bp, Staphylococcus epidermidis
agcataacccttcttttaaaatatatttctgattatacaacatataaatattttagcaaatactataattatgtaaatttgataatgttgaagacctttgttaatctattaaagtgtattggtaaagttaaaaattttaaaataaaatttaattttttgattttactgccttga

SEQ ID NO: 502 - DNA, 708 bp, Staphylococcus epidermidis
aatgtactgaagaaatcttgtgatgaggcaaacaaagcacttaaactttataatttgtctatgaaagtatctagagaaaagctattaaagcagcaattagatttgatagtcaaagactccgctttagacattcatgatgaaatagaaaataagttggttgatagagaagttgaaagacaagcacatatacttggtgaacatgtgaaaattgatgacactgaagtaaaagcggttgttaacagtaactttaaaggtgtgaactggtctacaagattatgtcaagatatggctgtagttcaaaaagaagtagaaaaaacaacgagtaatgtattacttagagggagacatcctaatgagtacgtagctaagtttaaaaagcaaacaaataccacaacatataatgcaagtagattgttagttactgaatcagcatgtgtgcaggctgaatcacagaagttaacttatcttaaagatttaggtgaagatggcgaatataaatacgtggccaaaatcgacaagaaaacatctaaaatatgtcactctttaaatggcaaagtatttaaagttaaagatatgatgcctggagttaatgctccacctatgcacccttggtgtagaagtactacagtaacacatgtgggcaattggcgagatagattctttactgagcgtaaaggtaagtatcagacagagaataaagaatcataa

SEQ ID NO: 503 - DNA, 1272 bp, Staphylococcus epidermidis
ttaattatgaattcttcttcacaagagaagaaaaataaaaagttttcttcggttttcatctatagttcaattattgcagctatagtagtgattatcggtgctgtttggcctgagaaattcgatagcgttactaatacggctaagatgtggattactaataatttgggttggtattaccttattttaacaacagtaattgtattcttctgtgttttcttgattttcagtccaattgggaaacttaaattaggtaaacctaatgacaaaccagaatttaatacaatttcttggttcgcaatgctattcagtgctggtatgggtattggtttagtattctatggtgcagctgaacctatggcacattttgctgctccaccaacagctgatcctgaaacgacaaaggcctacactgagtctttaagatctacatttttccattggggattccatgcttgggcaatttatggcgtggtagctttagcacttgcttattctcaattccgtaaaggtgaacctggattaatttctagaaccttacgtccattattgggagataaagttgaaggaccaataggtactcttattgatgtactttctgtttttgctacattagttggtgtagctgtgtctctaggtatgggcgcacttcaaattaatggtggcttgcattatttatttggtgtgccgaacaacacttttgttcaaggtattattattgttgtcgtaacaattttatttattgctagtgcttggtcaggtttaagcaagggaattcaatatttaagtaatttaaatataggtcttggtacgatattaatgattgtaaccttaattgttggaccaactgttttaatcttaaatatgatgacaagttctacgggtagcttattaaattcattcttatttaacagttttgatactgctgcgttaaacggtcaaaagcgtgattggatgtcaacttggacattatactattggggttggtggctaagttggagtccattcgttggtgtattcatcgcacgtgtatctaaaggacgttctataagagaatttatttcaggtgttttattagtaccggcacttgttagctttatatggttcagtgttttcggcgtattaggcattgaagctggtaaaaaagattcgggtctctttaaaatgtcacctgaaacacagttatttggtgtattcaaccatattccgttaggtattgttttatctatcattgcattattgcttatcgcttctttgctttgttacttcagctga

SEQ ID NO: 504 - DNA, 771 bp, Staphylococcus epidermidis
ctaataatgaattttatttttgatattgatggtacgatttgttttgatggatgttccatcgattcatctattaagcaacgacttttcaagctacgtcaagctaatcacaatgtaatatttgcttcagcacgtcccattagagacttgcttccagtcattcctgaatttgcggatgataccttgattggtggtaatggctcaattatctctaaaaatggacaaatcgaaattgtttcggtaatcaatgagcatgatatcagtctaattaaaaaaattataaagaaatatcaattatcatacatcattgatgataaatttaattatgcttcaaatttggatagtaataatgaactgtatcaacgcattgatcctgatggtaaagcacaatctctagatatggatgagattcgaaatcctataaaagcaattctattaaatatagataacaaagattttgacatgattgctcatcaattagtaagtcagtctcatggtattgaattaattcgtcattacagtgagtcctatattgatgtaacggcacgtggcgttgataagtatactactattcaatatattttaggaactaatagtgattatatcgcttttggtaatgatcacaatgatgttcatatgcttgaacatgcgagccaaggttattttgtgactaatcaatttatagaacacacatcattttttaaaaataaaaatattacagttattgatgacacaatatatgcaatatgtgaggttttagatcgatatctgtaa

SEQ ID NO: 505 - DNA, 729 bp, Staphylococcus epidermidis
acaataatgaacatactattaattggatatggtgcaatgaatcaaagagttgcacgattagctgaagataaaggtcatgaaattgttggagttatagatagaacttcaaaagcgtcgacaccttattcacaatatcaacacattagtgaatgtaaagaagctgatgttgctattgacttttcaaatcctgaattgctctttcctctattagaagaacaattcaatttgcctcttgtcatagcaactacaggtgaaaaagaaacgttaatacaaaaattggaaacgctaagtcaaagaacacctgtattttttagtgcaaatatgagttacggtgtccatgcattaactaaaatattagaaactgcagttcccctactacaagatttcgatatcgaactaacagaagcgcatcataataaaaaagtcgatgctcctagtggcacattagttaaattgtatgatgtcattaaagaattacgtgacaatgtctcacctgtttatgatagacacgaaaaaactgagaagagaactcatgatgagataggtatacatgctgttcgtggtggtacgattgtcggggaacatgacatattatttgcaggtactgatgaaacaattactatctcacataaagcacaatcaaaagatatctttgcaaatggtgccattggcgctgcagaaaaattaattcacaaaaacccaggtttttatacttttaataatctataa

SEQ ID NO: 506 - DNA, 126 bp, Staphylococcus epidermidis
actttcgtgaatttttatgagagccctatcatatgcgtagcgaatagtgatatagtaactttttatgaaaataattttattgaaaataaaataaattttactaaatgttcacatttatttgtttga

SEQ ID NO: 507 - DNA, 1233 bp, Staphylococcus epidermidis
ggcgtggtgaatttaatgaaaaatgaaaaagaaataaatggaaaaaaaagccatttttttagtttgtcagagtctagatttatgaggtttttaggcggaaatgaccttatttatgctttaattgcattggttcttttaggtattgtcatttttatctttgataaaatttcatatgtctttcaaccatttattattgtatttaatacaatagcagcacctattattgtttcattagtgctattttatttattcaatcctattgtaaatatgatggagagatatcgtattccaagactattaggtataacaattatttatgttgcaattgttggtattattacattaatagttaatttacttattccaattattggatcacagatagaaagttttatcaaaaatacacctaattatttacataaaattacgcgttcacttgataaacttaataataataccattttatctggttacatgggacaagtgaacgaatggttagaatctgctcagaaaaagataccatctatggtttcagattactcagacggatttggatctaaactcgcaacttttgctgaggcagtcgcaaatatcggtattgttattgggactacaccttttgtgttattctttatgttaaaagatggtcataaatttaaagattatactacaaaaattatgccacctaaatttagaaaagattttcatgacttgttagaaaagatgagtgtacaagttggttcatacattcaaggtcaaattattgtgtcattttgtattggattattactatttattggctattcaattattggtcttaagtacgccttagttttagcaagtattgctgcagtaactagtgtggttccttatttaggaccgacaatagcaatatcacctgcgattgttatcgcgattattacttcacctttaatgttattaaagttagctgttgtatggacgcttgtccaattctttgaaggccactttatctctcctaacgttatggggaaaacattgaaaattcatcctttaacaattattttcattttattatgtgcaggaaatttaatgggcattgttggtgtgattattggtattcctctatacgctgtacttaaggtattggtttcacacatatttatgttatttaaacgaagatacaatcgctactatggaaatgatgctggtgagtacattatcactgaagaagaaaaaggaattaaacaataa

SEQ ID NO: 508 - DNA, 273 bp, Staphylococcus epidermidis
tatatggcgaagaaatctaaaatagcaaaagaacaaaaaagacaagaattagtaaataaatattacgagttacgtaaagaattaaaagcaaaaggggactatgaagcattaagaaagttgccaagagattcatctccaactagattaactagaagatgtaaagtaactggtagacctagaggtgtgttacgtaaatttgaaatgtctagaattgcatttagagaacatgcgcataaaggtcaaattccaggtgtaaaaaaatctagttggtaa

SEQ ID NO: 509 - DNA, 528 bp, Staphylococcus epidermidis
ctcaggcagaagagtgggcataaacccgctcttttctatttgccaaaaaaggaggcctgtatgagtaaaattactgagcaagttgaagcattgattcaaccagttttaaatgatttgaactttgaattagtagacattgagtatgttaaagaaggtaaagaccattttttaaggatttccattgataaagaaggtggcgtagatcttaatgattgtactatagcttcagaaaaaattagtgaagttatggatgaaaatgatccaatacctgaaatgtattatcttgatgttgcatcgccaggggcagaaagaccaataaaaaaagaaacagatttttataatgctatcaatcaacccatttttgtatctctttatgcaccaattgaaggagataaagaatggttaggtgttttaaaatctgtaaatgatgaatcaattaatatggaagttaaagaaaaggcaaaaacaaaagaaattgaaattccaagaaataaaatagcaaaagcacgtcacgctgtaatgatttaa

SEQ ID NO: 510 - DNA, 912 bp, Staphylococcus epidermidis
attaaggagaatagaatggcactagataaagatatagtaggttcaatagaatttttagaagtcgtaggattacaagggtcaacatatttacttaaagggccaaatggtgaaagtgtcaaactcaatcagtcagaagttgctgatgaagataattttgaattaggtgaggaatatagttttttcgtttatccaaaccgttcaggagatttatttgcgacgcaaaacatgcctgatattacaaaagataaatatgattttgctaaagttataaaaaccgatagagacggtgcacatattgacgtaggacttcctcgtgaagtcttagttccatgggaagatttaccgaaacttaaagaactttggcctaaagcaggtgattacttgctagttactttgagaatagacagtacgaatcaaatgtttggacgattagctagcgaaacgattgttgagtcaatgttcaccccagtaaatgacgatagcaaacaaaacgaatatatttctgcacgcgcttatagattactcagagtaggtagcttcttattaagtaatgagggttataaaatctttgttcacgaatctgaacgtaaacatgagcctcggttaggtgaggcagtagaggtccgaattataggtcataatgaaaaaggtgaattaaatggttcgtttttaccattagctcatgaacgccttgatgatgatggacaggtcatatttgatttacttgttgagtatgatggtgaattacctttttgggataaatctagtcctgatgcaatcaaagaagtctttaatatgagtaaaggctcgtttaaacgtgcaatcggacatttatataagaaaaagataatcaatatagaaacaggaaaaatcactcttaccaaaaaagggtggagccgtgtagatgattaa

SEQ ID NO: 511 - DNA, 1392 bp, Staphylococcus epidermidis
aaaggtaggaaaattatgaaagttgctaagtttggtggaagttctgtatcaactgcagaacaaattaaaaaggtattaactatagtgaatgaagaccctgaacgtaaaatcattatcgtttcagctccaggcaaaaggcataatgacgacattaaaactactgatttattaattcgtctctatgaaaaagtacttaataaattaaattatgaaagtaaaaaacaagaaattatccaaagatatgctgatatagtagaagaattaggtataggaaatgacattttaataacaattaatgacactttagaggaatacattaaacatctttctgacaaacctaaccgtttatatgatgctttattatcttgtggcgaaaattttaatgctcaattaatagcccagtataataatagtcaaggtattcctactcgttatatttctcctaaagaagctggattaactgtaactgatttaccacagcaagctcaaattttagattccgcatataatgaaatatacaaattgcgtgattatgatgaaaagctaattattcctggttttttcggagtttcaaagcaaaattatatcgttacgtttccacgcggtggttctgacataactggtgctatcatagcacgtggcgtccgagcctcactttatgagaacttcactgatgtatcaggaatatataaagctaatccgaatatcataaataatcctgaactcatagaggaaataacttatagagaaatgcgagagctatcttatgcaggatttggagtttttcacgatgaagctctacaacctttatacaaagatcgaattcccgtagttatcaaaaatactaatcgtccaaatgataaagggacctacattttacatgaccgtgaaatcgattctaaaaatgtcattagtggaattagttgtgataaaggctttactgtgattaatattaaaaaatatttaatgaatagattagttggatttacacgaaagattcttggcgttttagaagaatttaatatatcatttgaccacatgccttctggtattgataacataagtattatcatgcgtacaaatcaaattcaaggtaaagaaagtcaagttcttaatgccatacgcaaacgttgtgaagttgatgaattaagtatcgaccatgatttagcagtactaatgattgttggtgaaggtatgaatcaagttgttggtacagctagtaaaattactcacgccctttcagaatcaaacattaatttaataatgattaaccaaggtgcttctgaaatttcaatgatgtttggaattcatgaagcagatgctgaaaaagcagtattatctacgtacgaattttgttacaacggtgtttgtttaaaaaatttgtgtaaataa

SEQ ID NO: 512 - DNA, 288 bp, Staphylococcus epidermidis
ttaaggaggaaattgataatggcaatttcacaacaacgtaaagatgaattaattaaagaatatcgtgtgcacgaaactgatactggttcaccagaagtccaaatcgctgtattaactgcagaaattactgcattaaatgagcatttacgtgaacacaagaaagaccaccattcacgtcgtggtttattgaaaatggtaggtcgtcgtcgtcacttattaaactacttacgtagtaaagatattcaacgttaccgtgaattaattaaatcattaggtattcgtcgttaa

SEQ ID NO: 513 - DNA, 1722 bp, Staphylococcus epidermidis
atagggaggaaaaagagaatgaaacaatctaaagtatttataccaacgatgagagaagtccctgcagaggcggaagcattaagccatcgtttattattaaaagcagggttaattaaacagagtacaagtggtatatatagttacttaccacttgctacacgtgtactaaataatatatctaaaatcatacgtgaagaaatggaaagtatagatgctgtagaaattcttatgccagctttacaacaagcagaattatgggaagagtcaggacgttggagtgcatatggtccagaactaatgcgtttaaaagacagaaacggacgtgaatttgcattaggacctactcatgaggaagtagtcacttctttagtaagagatgaattaaaatcatataaacagttaccccttactttatttcaaattcaatccaaatatagagatgagaaaagaccacgctttggattattaagaggacgcgaatttcttatgaaagatgcatattccttccattcagatgaagcttcattagatgcaacttatcaagatatgtatcaagcatatagtcgcatattcaaacgtgtaggcatcaatgcaagaccggttgtggcagattcaggtgcaatagggggaagtcatacacacgagtttatggcattgagtgaaattggggaagatacaatagtttatagtaatgagagtgactatgcagcgaatattgaaaaggctgaagttgtttatcatccttctcataagcattctgcacttgcggaattgactaaagttgagacgcccaatgttaaaacagctcaagaagttgcagaatatttaaagagaccattagatgaaattgtaaaaactatgatctttaaaatagatggcgaatttattatgtttctagttcgtggacatcatgaattaaatgaagtgaaattaaaatcatatttcggcacggaacatgttgaaatggctactccagatgaaattgttaatcttgtagatgccaatccggggtctcttggtcctatttttgataaagatattaaaatttatgccgataattacttacaagatttaaataactttgttgtaggagctaatgaagatcattatcactatataaatgtcaatattggtagagactttgatgtaacagaatacggtgactttagattcattacacaaggtgagatgttaagtgatggctcgggagtagcacaatttgctgaaggcattgaagtaggacaagttttcaaattagggacaaaatattctgaatcaatgaatgcaacttttctagataatcagggaaaagctcaaccactcattatgggctgttatggtattggagtatcaagaacattaagtgcaattgttgaacaaaacaatgacgagaatggaattatttggccaaaatcagtaacgcctttcgatatccatctaattactatcaatcctaaaaaggatgatcaacgtactttaggtgatcaactttatcaaaaattaatggattcatacgatgttttatatgatgaccgaaaagaacgtgctggtgttaaatttaatgattcagacctaattgggttaccggtacgagttgttgttggtaaaagagctgaagaaggtattgttgaggtaaaacaacgcattaacggtttaagtgaagaagtgcaaattgatgaattagagtattacttacaagaattatttaagaatattaagtaa

SEQ ID NO: 514 - DNA, 981 bp, Staphylococcus epidermidis
acgatggggaaaataaaagaacttgagacgtctctagctaataaaatagctgcgggtgaagtggttgaaagaccaagttccgtagttaaagagctcttagaaaatgcaattgatgcacaagcgacagaaattaatattgaagttgaacagtctggagtttcatcaataagggttgtagataatggcactggtattgctcaggaagatttagggttagtatttcatagacacgcaacgagtaaaatagtcgcagatgatgatttgttccatattcgtactttaggttttaggggagaagctttagctagtatttcatcagtagcaaaggtgacattaaagacctgtactgataatgaaaatggacatgaaatatatgctgaagatggtaaaattattcatcaaaaacctgcaaaagctaaaaagggtacagatatacaagtggattcattattctacaatacacctgctcgattaaaatatataaaaagtttgtataccgaactgggtaaaattacggacattgtaaatagaatggcgatgagtcatcccgaaattagaatttctttagtttcagatggtaaaaaacttttaagtacgaatggctcaggaagaacaaatgaagtaatggctgaaatttatggaatgaaagtagcaaaggatttagtgcatatttcgggtgatactagtgattatcatcttgaagggtttgtagctaaacctgagcattctagaagtaataaacattacatttctattttcatcaatggtagatacatcaaaaactttgtactcaataaagcaattttagagggatatcacacattgcttacaataggaagatttcctatatgttacattaatatccaaatggatcctattttggttgatgtaaatgttcatccaacaaaattagaggtgagactttctaaagaagatcaactttatgatcttatcgtaaccaaaatcagagagggcttttaa

SEQ ID NO: 515 - DNA, 495 bp, Staphylococcus epidermidis
gttaaagttgaaagaaggattattccaatgatatacagtttgactgaaattgaagcaagatatcaagaaaccgataaaatgggggttatctatcacggtaactacgcaacatggtttgaagttgcgagaacagactatataagaaagcttggcttcagttatgcctctatggaagaacaaggtgttatttcaccagttgtagatttaaaagtgcaatataaaaaatcaatttactatcctgaaaaggtgacagtaaaaacatgggtggaaaaatattctagattacgttcaacttattgttataaggtttataatgaaaatggagagttagctactactggttcaacagaacttatctgtattaaagcagatacatttaaacccatacgcttggatagatattttcctgagtggcatgagacttatagtaaagttaaccagttaaataaagaaggtaaagatgctgaggttacgtttggcattaatcatttataa

SEQ ID NO: 516 - DNA, 249 bp, Staphylococcus epidermidis
caaagggttgagaaggaatatagcccttcgctcatgacatcattgtttactgaatcgaatccattaactcataaagaacaagttgttttaagagaaataggcaatgggttaagtagcaaagagattgctagcaaattgtatttatcgaacgggactgtgcgtaactatacgagtactattatagacaaaatgaattcagatcatcgttttgaggcatggaaaaaagcaaatgaaaaggggtggatttaa

SEQ ID NO: 517 - DNA, 132 bp, Staphylococcus epidermidis
tgttttaatgaattatacgagaatgcttttattctatattcttatattgagcccaaccttttatactttgatctcaatctcttaaaaattatagtaaattgttttcttgcatatgttgcaccgcacgtgtaa

SEQ ID NO: 518 - DNA, 786 bp, Staphylococcus epidermidis
agagtgaatgatagtatgtctctaacaattaaagaaatcaaagaaaaactatctcgaattgaaacgttggaagagttacataaacatgaagcaaataatgattcacgtaaaggtgttataaatgcgattaagtctagggaaaaaaatattcttaagcaacaagcattagaagagcactatttatccatgaatcaatacgaaaacaacattatgtcctctaacagggatgcattaatttgtggaattgatgaggtagggcgtgggcccttggctggaccagttgtggcttgtgcagttattttagagaagaatcatcattatattggtttagatgactctaaaaaagtgtctcccaaaaatagagcacgacttaatcaaaatttaaaagaaaatgtctatcaatatgcatatggcatagcgtcctcagttgaaatagatgaattgaacatttatcgggcaactcaattagctatgctacgtgctataaatcaattagatgttacaccgacgcatttattaatagacgcaatgacactagatattgatattccacaaacctcaattattaaaggtgatgctaaaagtgtgtctatcgcagcagcaagtatcatggctaaagaataccgtgatcaatatatgagacaactatctaaacagtttccagaatatggttttgataaaaatgcaggttatggaactaagcaacatttaaaggctattgatcaagtgggcataatcaatgaacatcgtcaatcatttgaaccaattaaatcaatgatgaaataa

SEQ ID NO: 519 - DNA, 153 bp, Staphylococcus epidermidis
ttacttgatgacttgaggttgtcgaataaactttttgtaacatctctatgtcttaaattaagtaataaaatgaaactcgaagctagtaataggatagtaattattattacacctacaatagatatgagaggtataaatagtttaagtaaataa

SEQ ID NO: 520 - DNA, 636 bp, Staphylococcus epidermidis
tttgattgtgaaagcgcttgctataggggtggtaacatgtttgttaaagaagaaaaaccagtgaataaaatagtcgaaattttaaggaaaacatcatctcatttattcaaatttcacggcgaggtagcgatgcatctatttctgaatgatgattttatattaccatcgaaaatagatatttgtgttgagcgcaaaaagttattggaaattatcagggtgattcctgaagaatttacgattcactattatgataatcagttatatgaaagattaagagaatctttatctttatcagatgttgaacatgttaaagtctttaaaaacgatacagaagtcatgacaatatttgtttatgatgttgtaaatgatgaatggctatttaggttagatcatcatatacgtttaccaaaaaataatatatattttcattctttaagttggaacgtagattatattaagccagaaatagttcttatgtatgatttaatgagtgaacaaaaatatcatcagtttagtaattataaagctgttattgattctcttagttattatcaattctatattttaaaattggtagtaggtgaacagcgtattaaaaaagctatagtaaatagttccactaaaaagatatcttaa

SEQ ID NO: 521 - DNA, 495 bp, Staphylococcus epidermidis
aatcgaagtgaaaacatgacacaagaattaaaaagtaaattactttctttttttaaatttattttcgccactgctttatttatctttgtaatttttacactctatagagaattatcacatatcaattttaaagagacattcatacagttcggcaaaattaatagattatggctcgtactactatttgctggtgggggactgtcactcatcttattatcactgtacgatattattttagtaaaggctcttaaacttaaaatgccgttgattagagtctttagagtgagttatattatcaacgcccttaattctataattggttttggagggtttataggtgcaggcgtaagagcttttgtgtataaaaattatactaatgacacgaaaaaacttgtacaatatatttttattattttagtatctatgcttacgggattaagtttattatccattttagttgtcctgcgtatatttaatgcttcttcacatgattga

SEQ ID NO: 522 - DNA, 558 bp, Staphylococcus epidermidis
aaaatgagtgacataatcaaagatacaaagtctagaatgcaaaaatcaattgataacttatctcgtgaacttgctaacattagtgctggtagagcaaactctaatttacttaatggtgttacagttgactactatggtgcacctacaccagtgcaacaattagcaagtatcaatgtgcctgaagcacgtctattagttatttcaccatatgataagtcatcagttgctgatattgaaaaagcaattatcgcggctaatcttggggttaatccaacgagtgatggtgaggttattcgtatctctgtaccagctttaactgaagaaagacgtaaagaattagttaaagaagttaaaaaaattggtgaagatgctaaagtctcaattagaaatattcgtcgtgatattaacgatcagcttaaaaaagacgaaaaaaatggtgacattactgaagacgacttaagaagtcaaactgatgatgtacaaaaagctacagataattcgattaaagaaatagatcaattggttgccgacaaagaaaaagatattatgtcagtatag

SEQ ID NO: 523 - DNA, 174 bp, Staphylococcus epidermidis
aagaaacgtttgcagttaaagaaatttgatgtggaacttgttgatggatttacgaaagttattttaagtttcatcagaatgtcgattcgaaacataattaaagtcaaaagagaaattgcatttgtattaatgctaatgaatataaaaaaagtagttgctcaacaatttaaataa

SEQ ID NO: 524 - DNA, 2415 bp, Staphylococcus epidermidis
ggaggaaacgaattgagtgagataattcaagatttgtcacttgaagatgttattggtgaccgatttggacgttatagtaaatatatcattcaagaacgtgcattacctgatgtacgtgatggtttaaaaccagtacaacgacgtatactattcgcaatgtattcaagtgggaatacgtatgataaaaatttccgtaaaagtgcgaaaactgtcggtgatgtaataggtcaatatcatcctcatggagactcttcagtatatgatgctatggtgcgcttaagtcaagattggaagttacgtcatgttctaattgaaatgcatggtaataatggtagtatcgataacgatcctccagctgctatgcgttacacagaagctaaacttagtcaattatcagaagaactattaagggatattaataaggaaacagtatcatttattccaaactatgatgacacaactttggaaccaatggtattaccagcgagattccctaatttattaattaatggatctacggggatttcttcaggatatgctactgatatcccgccgcataacctcgccgaagtaatacaaggcacattgaagtatatcgatcaacctgatattacaattaatcaactgatgaaatatatcaaagggcctgactttcctacaggtggtatcattcaaggaatagaaggtataaaaaaagcgtatgagaccggtaaaggaaaggttgtcgtgcgttcacgagtagatgaagagcctttaagaagtggacgtaaacaattaattgtgactgaaattccgtatgaagtgaataaaagtagtttagttaaaagaattgacgaattacgtgccgataaaaaggttgatggtattgtagaagttcgagatgagactgatagaactggattacgaattgcaatcgaattaaaaaaagatgctaatagcgaatcaatcaaaaactatttatataagaattcggatttacaaatttcatataattttaatatggttgctattagtgaaggtcgccctaagttgatgggattacgtgaaattatagaaagttatttaaatcatcaaattgaagtggttacaaatagaacgcgttatgacttagagcaagctgaaaaacgtatgcatattgtggaaggattaatgaaagctttatctatacttgatgaagttattgcattgatacgtaattctaaaaataaaaaagatgctaaagataatttagttgcagagtatgactttactgaagctcaagcagaagctattgtcatgttacagctgtatagattaacaaatactgacattgaagctttgaaaaaagaacatgaagagttagaagctttaataaaagaattaagaaatatcttagataatcatgaggcacttttagcagtaattaaagatgaactaaatgaaattaaaaagaaatttaaagtggatcgactatctacaatcgaagctgaaatttccgaaatcaaaattgataaagaagttatggtgcctagtgaagaagtgattttaagtttgacgcaacatggctatataaaacgtacatctacacgtagttttaacgcaagtggtgtgactgaaatcggtttgaaggacggcgaccgtttattaaaacatgaaagcgtgaatactcaagatactgttcttgtatttacaaataaaggtagatatttgtttatacctgttcataaattagccgatatccgttggaaagagcttggtcaacacatatcacaaattgtgccaatagatgaagatgaagaagtggtaaatgtatacaacgaaaaagattttaaaaatgaagccttttatattatggctacaaaaaacggcatgattaagaaaagtagtgcttcacaatttaaaactactcggtttaataaaccactcataaatatgaaggttaaagacaaagatgaacttattaatgtcgttcgattagagtctgatcagttaattactgttctaacccataaaggcatgtcattaacttattcaactaatgaattatcggatacaggcttaagagcagctggtgttaaatcaattaatcttaaagatgaagactatgttgttatgacagaagatgtgaacgactcagattccataataatggttacacaacgtggtgctatgaagcgtattgattttaatgttcttcaagaagctaaacgcgcacaacgtggaattactttactaaaagaattaaagaaaaaaccgcatcgaattgtggcaggtgcagtagttaaagaaaatcacacgaaatatattgtattctctcaacatcatgaagaatatggtaatatcgatgatgtacacttatctgaacaatatactaatggatcatttattattgatactgatgattttggagaagtagaaagtatgattctagagtaa

SEQ ID NO: 525 - DNA, 336 bp, Staphylococcus epidermidis
aatggtatagaggtggataacatggttggacaaacaaatttattcgatgatgttataaagaaagaggaacgctttgttatagttgttcaagcacttgaagaaaaaaatggtaagctcttaaaacggactttgagagaatatccaagcttagagcacacgcaaatgaatgaccttttctctcatcttaaagaagtatttcttgaagaaccttttggggtcaatcaatcagcatatagcattactgtttatacaaacctagattatgccgcagatcaagtatatgcacatgttaaacgctataaaggaaaacatgactggacacatactgcgaaatag

SEQ ID NO: 526 - DNA, 2028 bp, Staphylococcus epidermidis
ttaaaaatagatattaattgtagaagggaagacacaacgatgtttaatgaaaaagatcaattagctatagatacgatacgtgctttaagcattgatgcaatcgaaaaagcaaattcaggacaccctggattacctatgggagcagcacctatggcgtatactttatggacgcgccaccttaattttaaccctcaatctaaagatttttttaatagagatagatttattctatcagcaggtcatggttcggctttattgtatagcttattacatgtctctggtagtttagaacttgaagaacttaaacaatttacacaatggggttcgaagacgcctggacatccagaatatatacatactgatggcgtacaagttactactggtccattaggtcaaggttttgccatgtctgtacggatggcgttagcagaaagtcatttagcaggtaaatttaataaggaccaatttgatatagttaatcattacacttatgtattagcgtcagatggtgacttaatggaaggtatctcacatgaagctgcatcttttgcaggtcataatcagttagataaattaattgtcctttatgattcaaatgatatatctttagatggagatttatataaatcattttctgaagatacaaaacagcgtttcgaagcctatggttggaactatattctagttgaaaatggtaacgatttagatgagattgataatgcaatcactcaagctaaatcacaacaaggacctactattatcgaagttaaaactattatcggttttggttctcctaataaagctggttcaaatggagttcatggtgccccacttggtgaagaagaacgtgcacttacatttaaagaatatggattagatcctgaaaaacgttttaatgttcctgaagatgtatacgaaatatttaaatcaacaatgttaaaacgtgcaaatgaaaatgaagaggcttggaataatatgcttaaaaattatagtgaagcctatccggaattagctgaagaatttaaattagcaatgagtggtaagttaccaaataattacgctgatgccttaccagaatatgatttaaatcacagtggtgcttctagagctgattcaggagaaataattcaaaaattaagcgagtttgtaccttcattctttggtggatcagcagacttagcaggttcaaataaatctaacgttaaagaagctaaagattataataaagatactccagaaggtaaaaacgtatggtttggtgtacgtgaatttgcaatgggagcagcaataaacggcatggcagcacatggtggacttcatccatatgcagcaacattctttgtattcagtgattacctaaaaccagctttacgattatcatcaatcatgggactcaattcaacgttcatctttactcatgattcaattgctgtaggtgaagatggccctacacacgaacctattgaacaattagcaggtcttcgtgctattcctaacatgaatgttattcgtccagctgatggtaatgaaacacgtgtagcttgggaagttgcacttgaatcagaacacacaccaacatcattagtgttaactcgtcaaaatttaccaactttggatgttgataaacaaacagttgaaaatggtgtgagaaaaggcgcatatattgtttttgaaacagaacaacaacttgaatatttattattggcatctggatcagaagttaatttagctgtagaagccgcaaaagaattagagcaacaaggtaaaggtgtacgagttatttctatgccaaactggtacgcatttgaacaacaatcttctgaatataaagaatcaattttaccttctgatgttactaaacgtatagctatcgaaatggcatcaccacttggttggcataaatatgttggaattgaaggtaaagtcattggtataaatagttttggcgctagtgctcctggagatttagtagttgaaaagtatggattcactaaagaaaatattttaaaacaagtccgttcattataa

SEQ ID NO: 527 - DNA, 699 bp, Staphylococcus epidermidis
tgtcagatagaggtatgcccaaaaggattccgaaatatgcatggattcggttctcataagtattctatgtataatgataaaggtgaacgtgtatgggtaaaatatcatttccgtacacaacaaggaattgaaaactatactgacgaggaagcagctaaaattgtaggtatggatagagattcttcacagagggatttatataatgctatcgaaaatggagattatccaaaatggaaaatgtacattcaagttatgacagaggaacaagctaaaaatcatccagacaatccttttgatttaacaaaggtatggtataaaaaagactatccactgattgaagtgggagaatttgaattgaatcgtaatcctgagaattattttcttgatgtagagcaggcagcgtttacgcctacaaatattgttcctgggttagattattcaccagataaaatgctacaaggacgtttattctcatatggagatgcccaacgttatcgtttaggagttaatcattggcagattcctgtcaatcaacctaagggagttggagttgagaacttatgtccatttagtcgtgatggacaaatgcgtttcttagataataaccaaggtggaggcccacattattatcctaataatcaaggtatatatgagtcacagcctgaacacaagaaacccaccattcccgacagatggtga

SEQ ID NO: 528 - DNA, 984 bp, Staphylococcus epidermidis
ccaaaatcagagagggcttttaaagacaaaatcctcatcccacaaaacgatttaaatcacgcgcccaaaaagaataaggttttagatacatttgaacaacaaaaaattaatttcgtgaagcaacaatcacaaattggagaaacatctgcaccatatgtacatgatcacaaagataagaatcatgacgtagagtcgcataagaataatttagattcaacttcatcgacaaataatgaaagtacggaagtttctaatgaattacacaattacattgatgatagttacttacaaagtcaaaaagaagtattttttgatatggaacaaaacacatctaacgaatatgagatatcaaatcagcaatcaaacgatattaaaggaacagtgagtcagacacctcatcgtagggtgccttatatggaaattgtaggtcaagtacacggtacgtatatcattgcacaaaatgaaaatggaatgtttatgattgaccaacatgctgctcaggaaagaattaaatatgaatattttagagaaaaaattggcgaagtgaccaatgaagtgcaaaacttattaataccacttactttccatttctctaaagatgaacaaatgattattgatcagtacaaagatgaattagataaagtaggagtacatcttgaacattttggtgggcatgattatattgtaaatagctatccagtatggtttccgaaagaagaagcggaagaaattattaaagatatgattgaacttgtcttaaaacacaaaagtgttgatgtgaagaaaataagagaagatgcagcaatcatgatgtcttgtaagaaatcaattaaggctaatcactatttaaaaaataatgaaatggcagatttaattgatcaactaagagaagcagaagatccttttacttgtcctcatggtagaccgattattatcaatttttcaaattatgaattagaaaagttatttaaaagagtaatgtag

SEQ ID NO: 529 - DNA, 2073 bp, Staphylococcus epidermidis
actttggcagataatttagtcattgttgaatcgcctgcaaaagctaaaaccattgaaaaatatttaggcaaaagatataaagttattgcttcaatgggacatgttcgtgacttaccaagaagtcaaatgggtgtcgacactgaagataactatgaaccaaaatatattacaattcgtggcaaaggtcctgtagttaaagatttaaaaaaacatgcgaaaaaagcaaaaaaaatatttttagctagtgaccctgaccgtgaaggtgaagcgattgcttggcatttatcaaaaattttagaattagaagatagcaaagaaaatagagtagtatttaatgaaattacaaaagatgctgttaaagatagttttaagcatcctcgtggtattgaaatggatttagttgacgcgcaacaagcacgtcgtattttagatagactcgttggttataatatttctccagtattatggaagaaagttaaaaaagggctgtctgctgggagagttcagtcagttgctttacgtttagtcattgatcgtgaaaatgaaattcgtaattttaaacctgaagagtattggtccattgaaggtgaatttagatacaagaaatctaaatttacagctaaatttctacactataaaaataaaccttataagctaaacaacaaagacgatgttcaaaggattactgaagcattaaatggtgatcaatttgaaatcacaaatgtgaatcgtaaagaaaaaacacgttatcctgctcatccatttactacatcaaccttacaacaagaagctgcacgtaaactaaattttaaagcacgcaagacaatgatgttagcacaacaattatacgaaggtattgacttaaagcgtcaaggtacagtaggtttaattacgtatatgcgtaccgattctactcgtatctcaacttctgcaaaatcagaagcgcagcaatatataaatgataaatatggtgaacagtacgtgtctcagcgtaaatcatcgggtaaacagggcgatcaagatgctcacgaagctattagacctactagtacaatgcgaactcctgatgacatgaaagcttttcttactagagatcaacaccgtctatacaaattaatttgggaaagatttgtagcaagtcagatggctccagctattttggatacagtagctttagatgtaactcaaaacgacattaaatttagagctaatggtcaaactattaaatttaaaggttttatgacactatatgtagaagcaaaagatgataaagagaatgataaagaaaataagcttcctcaactagataaaggagataaggtaactgcgacaaagattgaaccggcacaacactttacacaacctcctcctcgttatactgaggcgcgtttagttaaaacgcttgaggaacttaaaattggaagaccttcaacatatgctccaaccattgatacgattcaaaagcggaactacgtcaagttagaaagtaaacgcttcatcccaactgaattaggagaaattgtttatgagcaagttaaagaatacttcccagaaattattgatgtagaattcactgtaaacatggaaacattacttgataaaattgccgaaggtgacatgaattggcgtaaagtaataggagacttctacaacagttttaaacaagatgttgaacgcgcagaatctgaaatggaaaagattgagattaaagacgagccagctggtgaagattgtgaagtctgtggttctccaatggttattaaaatgggaagatatggtaagtttatggcatgttcgaactttccagactgtcgtaacaccaaagcaattgtcaaaacgattggtgtcacatgtccgaagtgtaatgaaggagatgtcgtagaacgtaaatcaaagaaaaatagaattttctatggttgttctagatatccagaatgtgattttatttcttgggataaacctgttggaagagattgtcctaagtgtcatcattaccttgtgaacaagaaaaaaggtaaaagtagtcaagttgtgtgctccaactgtgattatgaagaagaagttcaaaaatag

SEQ ID NO: 530 - DNA, 294 bp, Staphylococcus epidermidis
agcatgcaagatacattaatgagtattcaaattattccaaaaacaccgaacaacaacgatgttattccatatgttgatgaggcaattaaaattattgatgattcaggtttgcattttagagtgggaccgttagaaacaacagttcaaggtgaaatgagtgaatgtcttattttaattcaaaaattaaatgatagaatggttgaattagaatgtccaagtattattagtcaagttaagttttatcacgtacctgaaggaatagaaattgagacgcttacaggaaaatacgactaa

SEQ ID NO: 531 - DNA, 900 bp, Staphylococcus epidermidis
aaggagcaagataatatgacacacatgtttgaaggcgttggtgtagcattagcgactccctttaccaataatgaggttgatttcaacgcattagaaagacatgttcaatttcttttaaataacaatattcaagcaattatagtgaatggcactacagcagaaagtcctacattaagtgacgaagaaaaagagaaagtattggcgacagtagttaaactcgtgaatcatagcgttcctgttattgcgggtactggcactaataatacgtataaatcaattcaagcttcaatacgtgctaaagaaattggtgcagatgcagtcatgttgattacgccctactacaacaaaacgaatcaacgtggtttaattcaacattttgagacaatcgcaaatgaagtgaaattaccagtaattctttacaatgtgccatcacgaacaaatatgacgatagaaccagaaacagttggaattctcagtcataatccatatatcgttgctttaaaagatgcgacaaatgattttgattattttgatcaagtaaaacaacgtattaatacaaatgaatttgcattatatagtgggaatgacgacaatgttgtgaagttctatcaacgtggaggtaatggtgtcatctctgtaattgcgaatgtaattccacaagaatttcaatatttatatgaccaaagacaaaatgaaaccgatattactaattactttaaacctatcgagaaattgttagaagcgttgtcacttgacgttaacccaatacctattaaagttcttaccgcatatttgggttatggtcactacgaagtgagattaccattagtgcctttagaagaagcacaatgtaaacaagttgaacgagcatttgaacaatttaaagcaggtgaacaataa

SEQ ID NO: 532 - DNA, 387 bp, Staphylococcus epidermidis
cgtatgaaagatgcaattcaagaagctgaaaaactagccaagatgaataaagaccaaaagaatcaatatgagttggaaaagctgttaaaagaaaatgaagaactaaaagcagaaaaagctttatctcaaatgaagaatgagactcgttcaatgcttaatgagtcaggtttagaaaacttcgatgatcaaattgttaatatattagtaaatactgatgctgaaaaaacaaggaaaaatgttgaatcatttactaacttacttaatcaaatggtaaaatcaaatgttgaaaaagcattaagacaagactcaccagtaagcactcaatcaaataaaatgacaaaagatgaagaatcagattatcttgtttcagggagaaaatgtctataa

SEQ ID NO: 533 - DNA, 792 bp, Staphylococcus epidermidis
ctgaaaggagacaatcgtgtcttctttacttatatatttacatatttttacgatagagaggataagaaaatggcacaaacttctaaatataaacgtgtagtattaaaattgagtggcgaagctttagcaggtgataaaggattcggcataaatcctatcattatcaaaagcgttgcacagcaagttgctgaagttgccaaaatggattgtgaaattgctgtcattgtcggcggtggaaatatttggagaggcaaaactggtagcgacctaggtatggatcgtggtacggccgattacatggggatgcttgctactgttatgaatgctttggcattacaagacagtttagaacaattagattgtgatacacgtgttttaacttctattgaaatgaaacaagttgctgaaccatatattcgtcgacgtgcaattagacatttggagaaaaaacgtgttgttatatttgccgctggaattggtaatccttacttctcaactgacacaactgctgctttacgtgcggctgaagtagaagcagatgtaattttaatgggtaaaaataatgtagatggtgtttattcagctgatccaaaagttgatgcaaatgcaattaaatatgaacatttgacacatattcaaatgcttcaagaaggtttacaagtgatggattcaacagcttcatcgttctgcatggataataatattccgttaaatgttttctctattatggaagaaggtaatattaagcgtgctgtaatgggtgaaaaaatcggaacattaattacaaaataa

SEQ ID NO: 534 - DNA, 168 bp, Staphylococcus epidermidis
acatcattggatatgttacaactgctcataaagtcactaaataaattcgtttcatattatactactgattgcacgtattttcatgaaaaacaaatagtaaataatacaataaagaagagcaggttagatttaaaattatgtttcatcatctttcctgctctttattaa

SEQ ID NO: 535 - DNA, 156 bp, Staphylococcus epidermidis
aacagactggaaagtaagacacctatcatacttcctggaaaagcaaatgcgcttccagttccaaatgaaattcgtagtacagaagaaataaaagcttgcgctaaaccataccatggtccaacaaatacagcacataatacatttacaaaatgttga

SEQ ID NO: 536 - DNA, 126 bp, Staphylococcus epidermidis
gtcgttttacttcaccttttatatttaacattcggttcatttaatactatttatatttctaatctaaacaagtatacaatagttgtagtgaaaactaaaatattatcctgcaaaacttttatataa

SEQ ID NO: 537 - DNA, 1722 bp, Staphylococcus epidermidis
atagtgagtttatatatggacgggtcactatttataggaggtaacattttgagtttaataaagaaaaaaaataaagatattcgtattattccactcggtggagtaggcgaaatcgctaaaaatatgtacatcgttgaagtagacgatgaaatgtttatgttggatgcaggattaatgttcccagaagatgaaatgcttggggtagatatcgttattcctgacattcaatatgtcattgaaaacaaagaaagattaaaaggaatatttcttacacacggtcatgaacatgctataggcgcagtaagttatgtgttagaacaaatcgatgcaccagtttatggttctaaattgacaatcgcacttgttaaagaagcaatgaaggcccgaaatattaaaaagaaagtacgttactatactgtaaaccatgattcaattatgagatttaaaaatgttaacgtgagtttctttaatacgacacatagcattcctgatagcttaggcgtatgtattcatacttcgtatggttctatagtttatactggagagtttaagtttgatcaaagtttgcatggacattatgctccagacttgaaacgaatggcagaaattggtgatgagggtgtgttcgcattaatcagtgattcaacagaagctgaaaagcctggatataacacgcctgaaaatattattgaacatcacatgtatgatgcttttgccaaggttaaaggtagacttattgtatcatgctatgcttcaaacttcgttcgtattcaacaagtgcttaacattgcaagtcaacttaatcgtaaagtgtcatttttaggtcgttcacttgaaagttcgtttaacatagcacgtaaaatgggatactttgatataccaaaagatttattaatacctattaacgaagtggaaaattatcctaaaaatgaagtgattattattgctacaggtatgcaaggtgaaccagtagaagcattaagtcaaatggctcgcaaaaagcataaaattatgaacatagaagaaggagattcaatattcctagcaattactgcttcagctaatatggaggttattattgcagatacattaaatgagttagtgcgtgctggagcacatataattccaaacaacaagaaaattcatgcgtcaagtcatggttgtatggaagaattgaaaatgatgttaaatattatgaaacctgaatattttgtacctgttcaaggtgaatttaaaatgcagattgcacatgccaaattagcagcagaaaccggtgtagcacctgagaaaattttcttagttgaaaaaggcgacgtgattagttataacggtaaagatatgattttaaatgaaaaagttcaatcaggtaatatacttattgatgggattggcgttggtgacgtaggtaatatcgtattaagagacagacatctattagccgaagacggtatttttattgcggttgtgacattagatcctaaaaatcgacgtattgctgcaggacctgaaattcaatcaagaggcttcgtctatgttagagaaagtgaagaacttttgaaagaggctgaagaaaaagtacgtaaaattgtagaggaaggtcttcaagaaaaacgaatagaatggtcagaaatcaagcaaaatatgagagatcaaatcagtaagttactatttgagagtacaaaacgccgtccaatgattattccagtcatatcggagatctaa

SEQ ID NO: 538 - DNA, 780 bp, Staphylococcus epidermidis
aagttgaaacttttaacaataaaaaatctaaacatcaatgataaagaagggcaagcaattattaaaaatgtcgacttaaatatatataatcaatctctaaatgtcattataggtgaaagtggtgctggaaaaagtttgactgttaaagcaatattaaatcatttacctactcagttacatatgagtttcgatgaatttaaaatgcaaggtcaaaatacttctggtatcaagcaacttttaggtaaacatatcggctatatctctcaaaattatgctcaaagttttaatgaatatactcgtttggataaacaacttatagctatatatcgttatcattttaatgtttctaaggataatgcattgaaaaagataaaaaaagctttaacttgggttaacttaaatgatgaatcaatcattaataaatatagtttccaactttcaggaggacaattagagcgagttaatattgctagcgttttaatgttagatccagaattaattattgcagatgaacctgttgcatctttagatgtagtgaacggtcatcaaataatgcaactccttcaacacattgttaaagatcatcataatactgtattacttatcactcataacatgaatcatgtcctcaaatatgctgattattttaatgtaatgagaaatggcatgatgattgaatctggagaaatagacaaattatttaatcaccatcatcttcatcggtatacagaacaattattaaactatagaagcaagctgcaaaaggaggacaacatctaa

SEQ ID NO: 539 - DNA, 855 bp, Staphylococcus epidermidis
gggtctccctgttttttgggaggaatgtatatgaatgcttatttagcagaatttttaggtactgcaatccttattctttttggtggtggcgtttgtgcaaacgttaacttaaagagaagtgctggtaacggtgcagattggattgttattgcatttggttggggtttggcagtaacaatgggcgtttatgctgttggaacgttttctggtgcacatttaaatccagctgtaacagttgctttagccatggatggtggatttagctgggcgcaagtaccgggctatattgtttgtcaaatgcttggcggtattgttggtggagtttttgtatggttaatgtatttaccacactggaaagttacagaagatccagcagtcaaattaggtgtattttcaacagcaccagccattaaaaattattttgctaactttttaagtgagattatcgggactatggctttaacattaggaattttatttatcggggttaataaaattgctgatggtttaaatccaattattgttggtagtcttatcatagcaattggtttaagcttaggaggtactactggttacgctattaatccagcccgtgacctagcaccacgtattgcacatgctattttgccaattcatggtaaaggtaaatctaactggtcttacgcaattgtacccgttctgggacccatggcaggtggtatgttaggtgcgattgtttacgaagtgttttataaacaaacattcaattttagttgtttcattggtttaattgtacttatattcacacttatacttggcgtgatactaaataagatatctcaaaataaaaacaacgatattgaatcaatttattaa

SEQ ID NO: 540 - DNA, 135 bp, Staphylococcus epidermidis
catgagaactgtaagaaatacatataccattataggttatttacattaggaggatgtttcaatgaaaaagtggcaattagtcggtactactgtattaggagcttcggttttacttggcgcttgtggcggaaatga

SEQ ID NO: 541 - DNA, 1113 bp, Staphylococcus epidermidis
gaaaggagatgtacactaatggaatcaagaagttggggagtgagaataggggaattaagtactttaatatatttaatatttccgattttagctatatttgttgacaaacgtggtaatttcttaacttatttaattgtttgtactatttttataatcagctatgtgacgatgattatattttataaataccttagtgatagtattttatattcattactggttattcattatttaggaatcttttattttgtctatagtgtcaatcctatgaatagtttgtttttcttctatagtgctttcgccttaccttttatttttaatgttcgtgttgtatcaaaagaatttataacctttttaatagctatgataagttgtttaatactaacttatatatttaatccaacatttgtggttccattaagtgcattttatttggttatattaattgttgctgtaggtaattttaaaaatagagacgaacgaattatgaaagctaaacttgaagaaaagaataagtatattaatgtactaatagctcaacaagagcgtaatagaataagtcaagatcttcatgatacattaggacatgtatttgctagtcttactttgaagtctgaattagctgttaaactcatagatactaatcctaaagaagcaaaaaatgaaatgcaggcaataaatcaactttcaacagaagccttaaataaagtcagactcattattgatgatttgaagatacaatcttttgaagatgaaatttcatcattggaacacttattgcaaaatgctaatctacattttaaatttaacaataaaagtgcggctaaatcattaaatccagcgaaacaatcaatattatctatgatttttagagaagcaattaataatgttattaaacatgcgcatgcgactgaagtaataggtgaattgaaggtacatgagcatcaaatcattttaaaaattaaagataatggtgtgggaatagaaaatgaagatgcttcaaatttgaaaagtattaaagaacgtgtagattatttaaatggtaaattaattgtacaatcaaataatggaacacttattattgttgaaatacctagaggtgatttattatga

SEQ ID NO: 542 - DNA, 822 bp, Staphylococcus epidermidis
agatttaagtgcatttattttataaatatatatagaaggagaaaaattatgagcttattatctaaaacaagagaattaaacactttattacaaaaacataaaggtattgcagtagattttaaagatgttgctcaaacaattagtaatgttacagttactaatgtatttattgtgtcgagaagaggtaaaatcttagggtcttgtttgaatgaattattaaaaagtgaacgcattaaagatatgttagaagatcgacatataccgcgtgaatatactgaagagttgatgaatgttaaacaaacagaatcgaatatcgatattgataatgaattaactgtatttccgccagagaatagagaggtatttttaaatagtagaacaactattttcccaattttaggtggtggcgaaagacttggtacgctagtcttaggtcgagttcaagacgacttcaatgaaaatgacttagtattaggagaatatgcagccactgtaattggaatggaaattttacgagaaaaacataatgaagtcgaaaaagaagctagagataaagctgctataacaatggcaatcaactcactttcatattcagaaaaagaagcaattgaacatatatttgaagaacttggtggtacagaaggtttacttatagcttcaaaagtagctgacagagtgggcattacacgatcagtcattgtgaatgctttacgtaaacttgaaagtgctggtgtcatagaatcacgttctcttggaatgaaagggacatttattaaagtaaaaaaagataaattccttgatgaacttgaaaaaaataagtaa

SEQ ID NO: 543 - DNA, 171 bp, Staphylococcus epidermidis
ttctttattttagtttacataatatatattataggaagttgtatatataatcataaaagcccttcactcaatttacagttaaatctacatggcatttatatttattatctacagagttttctcttatttacttttttagttgagttcattatagcaatctatatttgttaa

SEQ ID NO: 544 - DNA, 522 bp, Staphylococcus epidermidis
ataattattttagaggagttaagtacaatgaatattagaaagttgaccatcacagcattcttaatagctattaatgtcgtgttaagtagtttaattgtcattcctttaggtccaattaaagccgcacccgttcaacattttgtaaatgtattatgtgctgtatttgttggaccatggtatggtttagcgcaagcttttatttcttctgtactacgaatttcatttggaactggaagcgcatttgcttttccaggaagtatgataggtgtcttactttccagtctgttttatatgtataggaagcatatttttatggcttcagttggtgaagtattagggactggtgttattggtagtttaatgtgtatacctttagcatggtttttaggacttcaagatttctttattaaaccattaatgcttatgttcatagtatcaagttttattggggctttaattagttatatattgcttattattttgaaaagaagaggtttactagatagatttaacaaaaattaa

SEQ ID NO: 545 - DNA, 315 bp, Staphylococcus epidermidis
ctcatggtccgtactgatttaactagtttccgttcaggagacactttacgtgtacacgtaagaatcgttgaaggttctcgcgaacgtatccaagttttcgaaggtgttgtaattaaacgccgtggtggaggaatttcagaaactttcacagttcgtaaaatttcttctggtgtaggtgtggaaagaactttcccattacacacgcctaaaatcgaaaaaattgaagttaaacgtcgtggtaaagtacgtcgtgctaaattatattacttacgtagtttacgtggtaaagctgctagaattcaagaaattcgctaa

SEQ ID NO: 546 - DNA, 153 bp, Staphylococcus epidermidis
tattcataccgaataaagattaaactttatataaacaaagagcccgggacattgataaatatcccagactcttgtgtaaatgttaaaacaattattaattattttgtaatacaccaatttcttgtaagtattcctcataaggtacttctttag

SEQ ID NO: 547 - DNA, 138 bp, Staphylococcus epidermidis
gccactgaccgtatttacggccagtggcttattaaatataatataaaaaaccgagcgtataaacgctcggatataatgatttattttaattgtaaatcaacttcatttatttcttttaaaatttcagctgtatcatag

SEQ ID NO: 548 - DNA, 138 bp, Staphylococcus epidermidis
gtgcatacgcttataagttttagtcattcaatatgtatgaagaaaccgaatagtagtttgagatttaaaatgatgttcattattgataaccattctcaattaataacattttcttattgcacaaatattttaagataa

SEQ ID NO: 549 - DNA, 705 bp, Staphylococcus epidermidis
atgaaagcgctagtcataggtggttctggaacaataggtcgtgccattgtaaaacgactgctatttgaaggttatgaagttttcttacattatcattcagctcaatattctgatttaagtaatcaatttaaaaatagcaaagttacatttattcaatgtgatttaaccaaagatatagagctcgaagattactttggacacattgacgagctagattgtctaatttataccagtgggacagcattatatggcatgttacaagatatgagtgattgtgacatcgataatagttatgcattaaatgtaagacaatttatacgtttgactcgctactttattgatattttaaggcagagtaacaatggacgtatcattgttatttcatcaatttggggagaaactggagctagtttagagacaatctattcagcgatgaaaagtgctcaaattggttttgttaaagcattaagtcaagaattagctttaacttcagtaactgtaaatgctattacaccaggtatggtaaaagggaaaatgagcgatgtatggtcgaaagatgagttatcgaatatagtatcagagttacctcagcaaagaatgattgatccttctgaagtggcacatgcttgtgcatacttgtgtagtactatgtcaaaaagtattacgggtacagtacataaagtgaatggcggatggtatatttaa

SEQ ID NO: 550 - DNA, 294 bp, Staphylococcus epidermidis
acaagtaagcgaagaagaatcaatcatgaaagagaagtattaaaacaacaagcattaaacgaaggtaaaccagagaaaatcgttgaaaaaatggttgaaggtcgtttacgtaaatatttacaagaaatttgtgctgtagatcaaaacttcgttaaaaatccagacgaaactgttgaagctttcttaaaagctaaaggtggtaaacttactgatttcgttcgttatgaagttggagaaggtatggaaaaacgtgaagaaaactttgctgaagaagttaaaggacaaatgaaataa

SEQ ID NO: 551 - DNA, 1338 bp, Staphylococcus epidermidis
agctgttctagatacaatttatgtactaacgaaaggagaccaacactgatgaaaacacatcaatatgaacttatagatgagaaagttttcgaacatgagtttgataatggattgaaattatttatcattcctaagcctggttttcaaaaaacgtatgtgacctacacaacacagtttggttcattggacaatcattttaagcccataggtagtcagcaatttgtaaaagttcctgacggtgtggcacattttttagaacataaattgtttgaaaaagaagatgaagatttatttactgcatttgccgaagagaatgcgcaagctaatgcttttacaagctttgatcgtacgagttatttatttagcgcaacaagtaatattgaaagtaacattaaacgtctcctcaatatggtagaaacaccttattttactgaagaaacagttaataaagaaaaagggattatagctgaggaaattaaaatgtaccaggaacaaccaggatataaattaatgtttaatactttaagggctatgtattccaagcacccgatacgggtggatatcgctggtagtgttgaaagcatttatgaaataacaaaagatgatttatatctatgctatgagacattttatcatccctctaatatggtgttgtttgtggtaggcgatgttagtcctcaatcgataattaaacttgtagaaaagcatgaaaatcaaagaaataaaacttatcaaccacgtattgaacgtgcgcaaattgatgagcctagagagataaatcaacggtttgtttctgagaaaatgaagttacagtcaccacgattgatgctaggttttaaaaatgaaccattagatgaaagtgcaactaaatttgttcaaagagatttggaaatgacatttttctacgaattggtttttggagaggaaacggagttttatcaacaacttttaaataaagatttaatagatgaaacattcggttatcaatttgtattggaaccgagctacagtttttcaattattactagtgcaacacaacagcctgatctatttaaacaattaataatggatgaattaagaaaatataaaggaaaccttaaagatcaagaagcatttgatttgttgaaaaagcaatttattggagaattcatatcaagtttaaattctccagaatatattgctaatcaatatgcaaaactctatttcgagggagtgagtgtatttgatatgcttgatatcgtagaaaatattacgttagagagtgtaaatgaaacttccgaattattcttgaactttgaccaacttgttgatagtcgtttggagatggaaaatagatga

SEQ ID NO: 552 - DNA, 165 bp, Staphylococcus epidermidis
tatattcatagctcacttgttcaatttatgttaagttgttccacaaaacccaatttcactaaagacggtgttagttctcatctaccactaactttctggtgctacctcaactttagttacttcactttgcttcaaaaaaaccacaataacgctatcattctataa

SEQ ID NO: 553 - DNA, 123 bp, Staphylococcus epidermidis
tgttccaggctatatttatggatgtttagagataaatgtttaaaatattcattatttatggcgtatgactctcatcactttaagcatactctcccacagagaataatgcttttgataaactaa

SEQ ID NO: 554 - DNA, 900 bp, Staphylococcus epidermidis
cataaatcaagaggtgtgacgataatgattgaactacgacatatatctaaatctttcaaggaacataaagttttagaagatataagtattgatataaaaaataattgttgtacggcattaataggtaaaaatggagcaggtaagtcaacgttaattgatattatcgttggaaataatcactatgatagtggtcaaatcgctgataaatcaaatttgttaaatagacataagatgggtattctttttcaaaaaacagagtttcctaaatacataaaggtttgcgaattattacatttatatcaatccttttatcaaacgtttatttcttttcatcagtttaaagaaatcacacaatttagtgaccgacaaatgaatcagtttgcatgtaatttatcaggtggacagcagaggattttagattttgctttagcattggtaggtaaacctgaactgttaattttagatgagcctacgtcagctatggatgtagaaatgcgtcaacatttttggaatgttatagataaattaaaaatgaataacactacgatactatatacctctcattacattgaagaagttgaaagaatggcagatcaagtaatgatgttagataaaggtaaaatacaattagatgattcacctgaaaatataaaaaggaatcaaagttattctgtaattcgaattccttgcaaatatcaagaacttatcaatcaactgaaacataaatacgaaattgaattaataaaaaatagatatgaaataaaaacaactgatgtgagtgatgttttacaattattgaaacaatatcatgtcaatttcaataagattgaaattcttaaaaaatctttattagaagtcatgttttctaatgatttgtctaaaggagggaattaccagtga

SEQ ID NO: 555 - DNA, 1104 bp, Staphylococcus epidermidis
tatcaagaaagtttatcctgtagagggagtttaataattatgaaaagatggcaaggattagttaaagaatttaaagaatatttaccagtcaatcaatctacaccagcactaacactcaatgaaggacatacaccacttatttattgtgaaaatctttctcaaaaattagatattgaattatatgttaaatatgaaggagcaaatccgactggctcatttaaagatcgtggtatggttatggctgtaacaaaggcaaaagaacaagggaaaaaagttgttatttgtgcttcaactggtaatacttcagcatcagcagctgcttatgctgcaagagctggtttaaaagcaattgtcgtaattcctgaaggtaaaatagcattaggtaaattatcacaagcagttatgtatggtgcagaaattgtttctatagaaggaaacttcgatgaagcactagaaattgtaaaagagattgctgaagaaaatgatgaaattgaattagttaattctgttaatccatttaggattgaaggacaaaagacgggtgcctttgaaattgttgaacagttagatggtcaagcccctgacattttagcaataccagtgggaaatgcaggtaatataactgcttattggcaaggatttgttgaatatcataataaaaagaatacacaattaccacaaatgtttggcttccaagcagaaggagcatctccaattgttcaaaataaaataatcaaaaatccagaaacaatagctacagctatccgaatagggaatcctgctagttggcaaaaagctgttaatgcactagatgaatcaaatggtttaattgatagtgtgatagatgaagaaattttagaagcttatcagttaatgacaacaaatgaaggtgtttttagtgaaccagcgagtaatgcttcaattgcaggtctaatcaaacttcatcgctctggtaagttacctaaaggtaaaaagatagttgcaatattaactgggaatggacttaaagatcctgacacagctatttctctcttagataatcctattcaacctttacctaataataaagaaagtataattagatacatcaaaggggcaatctag

SEQ ID NO: 556 - DNA, 123 bp, Staphylococcus epidermidis
agaaaaagaagaatagtgtgtaattgctttattaacctgagacaaacaaaattgtctcaggtttttttaatgaaaatcattaatgtctcacaactaaaattttattatcatatctgcatatag

SEQ ID NO: 557 - DNA, 1275 bp, Staphylococcus epidermidis
attttgaagagattcaatcaagataacacaaaagttcgagtcaatgttttgcctaccgataaatttaaaacaacgacaattacatttaaatttatggcaccattaaactataaaacaattacttcacgttcaattttaagtaaagtattagttcgtgcaacacaacaatggcccaccgataaaactttaaataaacagttatcagaattgtatggcgcctatgttaatagttttgtttctaagtttaaagataagcatgttattacaatctcattagaagtagttaatgaaaaattcttaaaagataaaacccctttatttgaaaagggattagatacgttaaaagaaataatttggaatccattaatcaaagatagatgctttgatcatacatatgtagctcaagaaaagtctttacttagcaaaaaacttgaagcaatggaagataataaagcacagtattcatttcttcagttaatgaattatatgtttaaacaagaaccctatcgatatatagcgacaggtcaattagaacaaattccacaagtgacttctgaaagtctatacgatacatatctatccatggtacaaaatgatgattgtgccatatatgttgtaggaaatattaacaaagaggaagtaacgcaactaattctagataagtttgcaattaagcctttctatttagaaaataaagaaagtactgaaatcacaccttcttttgatcaaccgcaatatataattgaaaaagacgatgttgaccaagctaaattgaatttgggatatcgctttccatcttattatgggaaaagtaattactatgcatttatagtattaaatatgatgtttggaggagatccttcctcagtactatttaatgaagtcagagaaaagcaaagtttggcatactctatacattcacaaattgatggtaaaaacggatttttatttgttttaagtggtgtttctgctgagaaatatgagcaagcaaaagatactgtcatcaaagagtttgataagataaaaaatggagattttgattctaataaaattgaattagctaaaaaaatcattatttcccatagacacgaagcatcagatagacctaaaagtataattgaaatactacataatcaattattattaaaccgacagcaaactgatcaagattttataaatgcagttaatcaagtgacgaaaaaagatgttattaaattggcaaatgaagctgttctagatacaatttatgtactaacgaaaggagaccaacactga

SEQ ID NO: 558 - DNA, 1167 bp, Staphylococcus epidermidis
atatcagggagtatatcattgatgaatatttcaattgtagctgttggctctgaattattactaggtcaaatagctaatacaaatgggcaatatctttcaaaactttttaatagtattggtaaaagtgtagtagaacacacagttattggtgataaccctcaaaggttagaatatgtaataaagcaatgtctatctagatttgataccattgttttaacaggtggcttaggaccaacaaaagatgatttaactaaacatactgtagctaaagtattaggaaaaaatctagtgacggatgaagcatcgttaaactttatcaaaaactattttaaagaacaaggtcaagatatgacctctaataataagcaacaagcattagtaattgaagatgccatagttttaccaaataaaaatggtatggctcctggtatgcttgtagaattaggtaaacaaaaaataattctactaccaggtccaccgaaagagatgcaacctatggcgaagaatgaattattaccttatcttatggataaagatgaagttattttttctgaattacttagatttgctggtataggagagtcgaaattagaaacactattaattgatctaatagatgatcaaactaatccgacaatcgcacctcttgcaggtacgcatgaagtatattttagattaacagccaatgctgaaagtaaggaacgatgtcaactgcttattaagcctattcgagatgaaattttaaatagggttggtacttattattttggctcagacgaagttaatattgaagaatcggttataaatagtgcaaaacagaattttgctatttatgacggtgtaactaatggagctttgtttactcgattaaaaaatgctgacagtaaaaatctagttaaaggtatgctaccacattctaatcaatttattgatgtgacttctgagtttaatgccgtgttattcaatgcagcacaatatgtcagggatttgtaccaaacagatttgggtattgtacttttaaataaagataacattgtatatttaggaatttatgatggaaataatttcgatatcgaaacatttaagatgtctcaaagtcgtaatttattgagaagcagaagtcaaaattatgcaatgattagattattaaattggtttaataaatag

SEQ ID NO: 559 - DNA, 588 bp, Staphylococcus epidermidis
aagtttattggaggtaactccatgatattaataatagataactatgattcttttacctacaatcttgtagatattgtagaaaaacaatgtgaaacgattgttaaatatcccgatgatacagatatatgtaatctgaaaggtattacagcagttattatttcaccaggacctggacatccattagacaatcaattattaattaaattaattgaaaatttcgaaaatttacctattttaggtgtttgcttaggtgcacaagcgctcacttgttattacggtggcgatgttatacaaggtagttgtgtcaaacatggaaaagtagatactttaactattgttaatcagtcaccactatacaaaggaattaagtcaagtttcaaagttatgcgttatcattcattaattagtgatccatgctcatttccagaaagtttattaatcactggccaaacatatgatagtatacaatctttccaacacaaaaacagaaaacattatggcatacagtttcatccagagtcattcgctacagaaaatgggaaacaaatcattattaattttataaatatagcaacgagaggaagttga

SEQ ID NO: 560 - DNA, 930 bp, Staphylococcus epidermidis
ggaaaggatgggagcactaagatgagtgtatttattgataaaaatacgaaagtaatggtacaaggtatcacagggtctactgcccttttccatacaaaacaaatgcttgattatgggacacaaattgttgcaggggtaacacctggtaaaggtggacaagttgtagaaggtgttccagtatataacactgttgaagaagctaaaaatgaaacaggagctaatgtatctgttgtatacgtaccagcaccattcgctgctgattcaattattgaagcagctgatgccgatttagacatggttatttgtattactgaacatatacctgttgttgatatggttaaagtaaaaagatatttacaaggtcgtaaaacacgtttagtaggaccaaactgtcctggtgtgataactgccgacgagtgtaaaatcggtattatgccgggatatatccataaaaaaggccatgtcggtgtcgtgtctcgttctggtacattaacgtatgaggcagtgcatcaattaactgaagaaggtatcggtcaaacaactgctgtaggtatcggcggtgatccagtaaatgggactaactttattgatgttttaaaggcgttcaatgaagattctgaaactaaagccgttgtaatgattggagaaattggtggtaccgcagaagaagaagcggcacaatggattaaagaaaatatgaacaaacctgtagtaggttttatcggcggtcagacagcacctccaggtaaacgtatgggtcatgctggagctattatttcaggaggtaagggtacagcatctgaaaagattaaaacattaaacgattgtggtgttgaaactgcagatacaccttctgaaataggaacaacccttattgatgcagctaaaaaagcaggcatttatgaagagttattaactattaaaaaataa

SEQ ID NO: 561 - DNA, 1275 bp, Staphylococcus epidermidis
aacaagttcggcattccgaacttgttcttttttatactgtgtatgtctcctctaattataggaggactgaaattgaatagaagtgttttaaaatttggcggttcttccgtcagtgattttaaaaaaataaaaaatatcgctgaaatgcttaaaacacgcattgaagatggtgaagaattaatcgttgttgtcagtgctatgggtaagacaactgatcaattgatgaataatgtatcaagtcttacttctacccctaaagatcaagaacttgcattgctattaacaacgggtgaacaacaaacggtttcttacctttctatggtactcaatgatataggtgtaaatgctaaagcgatgacaggttatcaagctggcattaagactgtaggacatcacttaaaaagtaaaatagcagaaattaatcctaatatttttaatgaggcttttaaaaatcatgacattttagttgtagctgggtttcaaggtataaatgaagatttcgaacttactacacttggacgaggtggttctgatacaacagctgtagctttagcagcaagtaatcagacaccttgtgaaatttacactgacgttgatggtgtgtatgcaacagatcctagaatacataatgaagcgaagcgtttagaatatgtctcttatgaggaaatgatggaaatgagcgcgcttggtgcaggtgtacttgaaacgagaagtgttgaattagctaagaattatgatattccactttacttaggaagaacgttatcaaatgtgaaaggaacatggattatgtctaaaagtgatttattagagaaaaaagcagtaactggtgtcgcattggatacacacatgatgcacgtcacgataagttatcccctaccggataatcagttactgacacaattgtttaccgcattggaagaagaatctgtaaatgttgatatgatttctcaaattgtaaatttagaaggtttacaattatctttttcaattaaagatagtgatgcacatcaaatttcttcaattctggaaaatttatcaacacacttttcagcacttgattataaaattaatgaagcatatgtcaaaatatctttaattggatcaggtatgagagatatgtcaggagtagcatcaaaagcttttacgacacttatcaattcagatattccattttatcaaacgacgacatcggaaattagcatttcttatgtaatagacgaagaaaatggtgaaaaagcagtagaagaattgtatcatgccttcgaaatttag

SEQ ID NO: 562 - DNA, 831 bp, Staphylococcus epidermidis
ctcttgaaaggagttctatactatatgactcagtataaaatggtagttttagatatggatgatactttaatgaatagtgataataaattatccattgagacaaaatcttacttattagatattcaaaagcgtggttattatgtggtattggcctcaggtagaccaacagaaggtatgttacctactgcgagagaattagagttaaataaatataacagcttcattattagttataatggaggtaaaactataaatatggctaatgaaaatgtagaggtcgatcagcctgtttcaaaggaagatttcgataatattgtagattattgtagagataagaactttttagtacttacttatgataatggatatatcattcacgatagtagtcatgaatatatgaacatagaatcacaacttaccggattaccaatgaatcgtgttgctgatttgaaggaatatattaatcatagtgtacccaaagttatgggtgtggattatgtaggtcatattaccgaagcacgtattgaattggatggttacttcaataatgatattgatgtgacaacgagtaagccttttttcctagagtttatggcaaagaatgtttcgaaggggaacgcaataaaagcactttgtaaaagattacaaatttctctagaagaagttatagtattcggggacagtttgaatgataagtcaatgtttgaagttgctggatattctgtagcaatgggaaatgctagtgatgaactcaagaaaattgctgacgaggtaactttagataataattctaacggtattccttatgctttaaaagaacttttggtttaa

SEQ ID NO: 563 - DNA, 1812 bp, Staphylococcus epidermidis
atgagtgaaggtttacctttgagagaagaagttccggtaaaagaaacttgggatttgaaagatttatttacaagtgatcaagcattctatcaaacattggaacaagtagtacaaatgtctttagattttaatcatacatattatcagaaacttaataacatagaaacaatagaaaaggcattagatgaatatgaaaggatacttatagaaatagatcgtttatataattatccagaacttagattaagcgttgatacgtctaatgaagaagcacaaaaagttaacgcaaaacttaatacgacttctggaaaacttgctggtttattatcttttgttgattccgagattttggagttacccgatgagataataagcgaattgaggtctcaaacaaaataccctcattttattaaacaacttcaagatcgtaagccttatcaattatctgctgatgttgaaaaagtattagctacattaacaccaacattgagaagtccgtttgaattgtatggtactacaaagagtttggatattaattttgaatcgtttgattatgagggtgttacctatccattggattatgcaacatttgaaaatgaatatgaagatcatccatctcctgaatttagacgtaaaagttttagagcttttagtgatgcattacgacaatatcaacatacgacggccgcaacatataatatgcaagtccaacaagaaaagattgaagcggatttacgaggatatgattctgttattgattatctactacaagatcaagaagtaacaaaagatatgttcgatagacaaattgatgtcattatgagtgatttagccccagttatgcaaaagtatgcaaaaattattcaacgtgtacataacctggataaaatgcgatttgaggatttaaaaatttcaatagaccctaactttgaaccagaaatatcaattgaagaatcgaaaaaatacatttatggagcgctcaaagtacttggtgatgattatgtcaaaatgttagagtctgcctatgattaccgttggattgattttgctcagaataaaggaaaagatactggagcatattgtgcaagtccatacattacacattcatatgtatttatttcatggactgggaaaatggctgaaacattcgttcttgcgcatgaattaggacatgcaggtcattttacattagcgcagaatcatcaaaatttgttggaatctgaagcgtctatgtattttgtagaagcaccttccacaatgaatgaaatgttgatggcaaattacttatttaatagtagtaataatcctcgatttaaacgttgggttattggttcgattttatctcgaacttattatcataatatggttacccaccttttagaagcagcttatcaacgtgaagtgtatagccgagtcgacaatggagagtcattaactgccccactgctaaatgaaataatgttgaacacttataaagcatttttcggtgacactgttgaaatgacagatggggttgaattaacatggatgagacaaccacattattatatgggattgtactcatatacgtactctgctggattgacaattggtacagttgtatcacaatgtatcaagaaagaaggtcaacctgctgttgatcgctggttaaaaacgctacaagctggtggtagtcaatctccaattgaattggcgcaaatagctggcgttgatattacgactgacgcccctttaaaagagacaattaactatatttcaaatttagtagatgaattagaagtattaacatatcaaataaaagaaaattcataa

SEQ ID NO: 564 - DNA, 1425 bp, Staphylococcus epidermidis
caatatggaggaatgttaaatatggatacaaatggaattaaattaaccccaaaagacatcgtatctaaattgaatgagtatattgtaggacaaaatgacgcaaaacgtaaggtggctattgcactaagaaatcgttatcgtagaagtcttttaaaagaagaagagaaacaagagattgcgcctaaaaatattttaatgataggtccaacgggagttggtaaaactgaaatagctcgacgcatggcaaaaattgttggagcaccatttattaaagttgaggcaactaaatttacagaagtcggttacgtcggaagagacgttgaaagcatggttagagatttagttgatgttgctgtacgtttagtaaaagacgggaaaaagtcattagttaaagatgaggcaactaagaaagcaaacgacaaattagttaaattacttgttccgagtttaaaaaagaaggcagcacaaggtaacaaccctttggaaaatttattcggtggagcaattccaaacttcggtcaaaatcaagatgaagaggaagaaccgccaactgaagaaattaaaaccaaacgttctgaaataaaaaaacaacttgaacagggcaaacttgaaaatgaaaaagtaagaattaaagtagaacaagatcctgcatcaatgggtatgttagggactaatcaaaatcaacaaattcaagatatgatgaatcaattgatgcccaagaaaaaagtcgaaagagaagtttcggttgaaacagctagaaaaatcttagctgatgattttgcagatgaattaattgaccaagaaactgcgaatcaacaagccttagagcttgcagaacaaatgggtatcatatttattgatgaaatagacaaggttgctactaacaatcaaaatagcggtcaagatgtgtcaagacaaggcgtacaacgagatattcttcctatacttgaaggtagcatgattcagacaaaatatggtactgtaaatactgaacatatgctatttataggtgctggtgcattccacgtatcaaaaccaagtgatttaattcctgaattacaaggtcgatttccaattagagttgaattagaaagtctttcagtagaagatttcgtgagaattctgacagaaccaaaattatcgcttgtcaaacaatatgaagcattgcttcaaactgaagaagttacagtaaatttctcagaagatgccattcaacgattagctgaaattgcatatcaagttaatcaagatactgataatattggtgctcgtagattacacactattctagaaaaaatgcttgaagatttatcatttgaagcaccaagcatgccgaatgctgttgtggatattactccacaatatgtagatgacaaattaaaatcaatctcaacaaataaagatttaagtgcatttattttataa

SEQ ID NO: 565 - DNA, 1185 bp, Staphylococcus epidermidis
gaaacaggaggatggaagatgaatatccacgagtatcaagggaaagaaatatttcgttcaatgggcgttgcagttccagagggacgagtagcatttactgctgaagaagcagtggaaaaagcgaaagaattaaattcagacgtatatgtggttaaagcgcaaattcacgctgggggtagaggtaaagcaggcggcgtgaaaattgctaaatcattatctgaagtcgaaacgtacgcaaatgaactgctaggtaaacaattggtcacacatcaaactgggccagagggcaaagaggtcaaacgtttatatatcgaagaaggatgcgatatccaaaaagaatattatgttggttttgttattgatcgtgctactgataaagtgactttgatggcatcagaagaaggtggaactgaaattgaagaggttgcagctcaaacacctgaaaagattttcaaagaaacaattgatccagtagtaggattatcaccttaccaagcgcgacgtatcgcttttaatattaacattccaaaagaatcagttggaaaagcaactaaatttttattagcactatataatgtctttatcgaaaaagattgttctattgttgaaattaacccacttgttacaactggagacggtcaggtattggctttagatgctaaattaaactttgatgataatgcattatttaaacataaagatattttagaattacgagatttagaagaagaagatcctaaggaaatagaagcttctaaatatgatttatcatacatcgctttagatggagatattggttgtatggttaatggcgcaggtttagccatggcaacaatggatacaattaatcattttggtggaaatccagccaacttcttagatgtaggtggcggtgctacaaaagaaaaggtaactgaagcatttaaaattattttaggtgatgacaatgttaaaggtatctttgtaaatatttttggtggaattatgaaatgtgatgttattgccgaaggtattgtagcagcggttaaagaagttgaactaacattaccattagttgttcgtttagaaggaactaatgtcgaacgtggtaaagcaatattaaacgaatcaggtttagctattgagccagcagcaactatggctgaaggtgctcaaaaaattgtgaaacttgttaaagaagcataa

SEQ ID NO: 566 - DNA, 135 bp, Staphylococcus epidermidis
acaccatttatttataataaatcagttgataaaagtcttttatatcatattttcagtgtgataatgtatggcgtctatagcataccaatattttcatacaaaattttaagagccttaaacactatggcatgttag

SEQ ID NO: 567 - DNA, 360 bp, Staphylococcus epidermidis
atattacttataggagcacgtgcaatgacaatatttgatatgccaaactatttgtggattaccattcttggtatgattttattaactgtattttacacacttgtattaaataaatggttccagtctgcaatcattacttttgtagttttagcagtacttgccttttttataccaaattttcaaaacatttcatatcaaccactgcttggatatgcaggattcttaggcataatgagcttaatcataagctttcttatttggtatttttctagaaactggagaaaaaatcgtagaaaaataaaattggaaaaagagattcgcaaatatgatgatgaagagtcacttcgtcgtcataaataa

SEQ ID NO: 568 - DNA, 999 bp, Staphylococcus epidermidis
ctatttattatgacaagattagcagtagccggagcaaccggattagttggaacaaaaatgttagagacactagatcgaaaacaaataccttttgatgaattagtattattttcttctgctcgctcagcaggaaaaaaagttgaatttcaaggacaattgtatactgttcaagaattaactgatgaagcagcaagtgaacattttgattatgttttaatgagtgcaggaggtagcacaagtgagcactttgctccactatttgaagcggctggagccattgttattgataattctagccaatggagaatggctgaagatgtcgatttaattgttccagaagtgaatgagcctcaatttacacgtggtattattgctaatccaaattgctctacaattcaatcagttgtacctcttaaaattttacaagatgcatatggtttaaaacgtgtcgcttatacgacttatcaagccgtatcaggttctggtgttaaaggtaaaagagatttagctgaaggtgctaatggaaaagaacctgaagcatatccgtatccaatttacaataatgtattaccacatatagatgtttttcttgaaaatgggtatacaaaagaagaacaaaaaatgattgatgaaacgaaaaaaattctcaacgaccaagacttaaaagtgactgccacatgtgtacgtgtaccagtacaagatagtcacagtattgaaatcgatgtgactttaaatcaagacactacagttaaagagatacaagaattatttgcacaagatcaacgtgttgttcttgtagataatccaagtaaaaatgaatatccattagccattcattctactggcaaagatgaagtatttgtaggacgtatccgccgagatgactctcttgaaaatacgttccatgtatggtgtacctctgataatttgctcaagggcgcagcattaaatgcagttcaagtgttagaacaaattttaactttgaaaggagcaagataa

SEQ ID NO: 569 - DNA, 1269 bp, Staphylococcus epidermidis
atgggagttatgaagatgaagtttacgaatttgacagctaaagaatttagtgactttactgatcgtatgacatatagtcattttacacaaatggaaggtaattacgaattaaaggttgctgaaggtaccgagtcacatttagttggaattaaaaataatgataacgaagtgattgcagcttgtttattaacagctgttcctgtaatgaaaatatttaaatatttttattccaatcgcggtccagtaatagattataataataaagagcttgtacattttttctttaatgaattgagtaaatatgtaaaaaaatataattgtttatatttaagagttgacccataccttccatatcaatatttaaatcatgagggagaaataactggaaatgcaggtcatgattggatttttgatgaattagagagtttaggatataaacacgaaggattccacaaaggatttgatcctgtattacaaatccgatatcattctgttctaaatttagcaaacaaaagtgctaatgatgttttaaaaaacatggatggtttaagaaagcgtaatactaaaaaagttaagaaaaatggagttaaagtccgctttttatctgaagaagagttacctatatttaggtcatttatggaggatacctctgaaactaaagattttgcagatagagaagatagtttttattacaacagattcaaacattataaagaccgtgttttagtaccactagcctatattaactttgatgagtatatagaggaactaaataatgaaagaaatgtgcttaataaagattataataaagctttaaaagacattgagaaacgtccagagaataaaaaagcacataacaaaaaggaaaatttagaacaacaactcgatgcaaatcagcaaaaaattaatgaagctaaaaacttaaaacaagaacatggcaatgaattacccatctctgctggcttctttataattaatccgtttgaagtagtttactacgctggtggaacttcaaatcgttatcgccattttgcagggagctatgcggttcaatggaagatgattaactatgcaattgaacatggtattaatcggtataatttctatggtattagtggtgactttagtgaagatgctgaagatgctggcgtagttaagtttaaaaagggctatgatgccgatgttatagaatacgttggtgactttattaaacctattaataaaccaatgtataacatttatagaacacttaaaaaactaaagaaatag

SEQ ID NO: 570 - DNA, 792 bp, Staphylococcus epidermidis
gtaatgactattttaaatgaaattattgagtataaaaaaactttgcttgagcgtaaatactatgataaaaaacttgaaattttacaagataacggaaatgttaagaggagaaagctgattgattcacttaactatgatagaacattatcagttattgctgaaataaaatcgaaaagcccatctgtacctcaattaccgcaacgtgatcttgttcaacaagttaaagattatcaaaaatatggtgctaatgctatttcaatattaactgatgaaaaatactttggcggtagttttgaacgattaaatcagttatcaaagataacatcgttaccagttttatgtaaagattttattattgataaaattcaaatagatgttgcaaaacgagctggtgcatctattattttattaatagtaaatattttaagtgatgaccaattaaaagaattgtattcatatgcaacaaaccataatttagaagctctagtagaagttcatacaattagagaacttgaacgtgcacaccaaattaaccctaaaattattggtgttaataatcgtgatttaaaacgatttgaaaccgatgttctacatacaaataaattacttaagtttaaaaagtctaattgctgctacatttcagagagtggcattcatacaaaagaagatgttgagaaaatagtagattcaagtattgacggtttacttgtaggggaggcattaatgaaaacaaatgacttaagtcagtttttgcctagtttaaagttaaagaagaatctctatgatagttaa

SEQ ID NO: 571 - DNA, 405 bp, Staphylococcus epidermidis
aatatttatatgttgtataatcagaaatatattttaaaagaagggttatgctttatgttaaaagaatttaaagagtttgcactcaaaggcaatgttttagacttagctattgctgtagttatgggagcagcgtttaataaaatagttacatccctagtccaatacatcatcatgccattaattggtaaattatttggttcagttaattttgctgaagattggtctttttgggggattaagtatggacttttcatacaatcaataattgacttcatcataattgcttttgctttatttatctttgttaagatagctaatacagttatgaaaaaagaagagaaagaagaagaagtagaagaaaatactgttttattaacagaaattagagacttgcttaaaaaataa

SEQ ID NO: 572 - DNA, 1497 bp, Staphylococcus epidermidis
atatattatattctgctaataaaggtggtaccgcgcgtcagcgtccttataacgaaggaggctgatttttttcggaaaaggaggaaatcaatggatattgtatacaaaaaggtgaatgctcaaattacgccagaagctttagcaaaattaaaacaaaaaaagatcatttttgaaagtacaaatcaacagaaacttaaaggtaggtactcgatagtagtattcgatcattatggcaaaattacattagataattctcaacttttaattaagttagacaatcattgtgaaatagttaagaatcaaccgtatcaacgacttaaggaatttgtagataaatattattttgaaatcaaagataaatatttaaaagatttaccttttatttcgggctttatagggacatgtagctttgatttagtacgacatgaatttaaaaaattacaagatattaaattagaagatcatcaaactcatgatgtccaattttatctagtggaagatgtatttgtttttgatcattataaagatgaattatatattatcgcaagtaacttattttctgatagaacaaaagagagattaaaggaatctattgaacgtaaaattgaagatttaaaaaacatacatttttcggttgaggatataaattataaatccatccctcgacatataaccaccaatatatcagagcaacaatttgttcaaactattagaattttaaaaaagaaaattactgaaggagatatgtttcaagtagttccttcaagaatttatagttataaacaccattttcaacacaatttacatcaattaacttttcagttatatcaaaatttaaagcgacaaaatcctagtccatatatgtattatattaataaagatgtaccgattgtaataggaagttctcctgaaagttttgtaaaggtaaaagatggaaaagtttatacgaatcctatagctggaacaattaaaagaggtcaaaataaaaaagaagatgaaaataatgaaaagacattaatgaaagatgaaaaggaattgagtgaacatcgtatgctcgtagatttaggaagaaatgatattcatcgaataagtaaaacaggcacttcacaaattaccaaactaatgacaatagaacgttatgaacatgtcatgcatatcgttagtgaagttattggagaattaaaaccccatctatctcctatgagcgtcatcgcaagtttgctaccaacgggtactgtctcaggtgcacctaaacttagagctatacagagaatatacgaatcttatccttataaaagaggtatctatagcggtggtgttgggtatatcaactgtaatcatcatttagattttgcattggctatacgtaccatgattatcgatgaggaaaaagtcagtgtcgaggcaggatgtggagtagtatatgattctattccagagaaagaacttgaagaaacaaaacttaaagctaaaagtttattggaggtaactccatga

SEQ ID NO: 573 - DNA, 4089 bp, Staphylococcus epidermidis
caattgatttttcaattaaagataccaacaatcaagatgagtttcgctttaaaatatttcggacattgtattgatcaaacacgattgtcgccaaaagtgaaaggtcaattgaaacaaaaaaaactcattatgagtggaaatgtgttaaaagtcttagtttcaaatgacattgagagaaatcattttgatagggcatgtaatggtagcttggttaaagcatttagacagtgtggctttgaaattgataaagtcgtttttgaaacagattcaacaaatcacgatgatgaccttggctcgttagaagcacatattccacaagaagatgaacaaagtgcaagagaagcaactgaaaaattagaaaaaatgaaagcagaaaaagcgaaacaacaagataataatgaaagtacagtggaaaaatgtcagattggaaaaccaattcagattgaaaatataaaaccaattgaatcaattattgaagaagaattcaaagtagctattgaaggtgttatatttgatattaacctaaaagaacttaaaagtggacgtcatatagttgagcttaaagttactgattacacagattcacttgtattaaaaatgtttacaagaaaaaataaagatgacttggaccactttaaggcacttagtgttggtaaatgggttagagctcaaggtcgtattgaagaagatacttttgttagggatcttgtcatgatgatgtcagatattgaagaaattaaaaagacacctaaacaagataaagcagaagataagcgtgtagagtttcatttacatacgtctatgagtcaaatggatggtattcctaatattagtgcatatgttgaacaagctgctaaatgggggcaccaagctttagcagtaacagatcacaacgtagtacaagcttttcctgatgcacataatgctgccgaaaaacatggtattaagatgatttatggtatggaaggtatgctagtagacgatggtgttcctatagcttataaaccaacagaccgtaatttaaaagatgcaacatatgtggtgtttgacgtagagacaacaggtctttctaatcaatatgataaaattattgaattagctgcagtaaaagtgcataacggtgaaattatagataagtttgaacgttttagtaatccacacgaaagattatctgaaaccattatcaatcttacacatatcactgatgatatgttaactgatgctcccgaaattgaagaagtgttaactgaatttaaagagtgggttggagatgctatatttgtagctcataatgcttcatttgatatgggatttattgacacaggatatgaaaggttaggctttggaccttctacaaacggtgtaattgatacacttgagctttcacgtacaattaataccgaatatgggaaacatggtttgaatttccttgccaaaaaatatggtgtcgaattaacgcaacatcatagagcgatttatgatacagaagcaacagcttatatttttataaaaatggttcaacaaatgaaagaactaggtgtgaacaaccatctagaaattaataaaaaattaactaatgaagatgcatataaaagagctcgtccatctcacgttacactcattgttcaaaatcaagaaggtcttaaaaatttatttaaaatagttagtgcttcattagttaagtattattaccgtacgccaagaattccacgttctcttttaaatgaatatcgagaagggatcttgattggtacagcttgtgatgagggtgaattattcacagcagtaatgcagaaggatcagtcggaagtagaaaaaatagcaaagttctatgattttatagaagttcaaccgcctgcgctttatcaagatttaatggatagagaattaatacgagataatgaaacgttaacacaaatttacaagcgattaatagatgctggtaaaagcgctaatatcccagtgattgctactggtaacgcgcattatctatatgaacatgatgctatagccagaaaaattttaattgcatcccaaccagggaatccattaaatcgttcaacattaccagaagctcactttagaaccactgatgaaatgttagatgattttcacttcttaggtgaagaaaaagcatatgaaatcgttgtaacaaatacaaatgagctcgctaataaaattgaaaaagtggttcctataaaagataaactatttacgccaagaatggatggggctaatgaagaaattcgtgagttgagttattctaatgcgaaaaaactatatggtgaagatttaccacaaattgttatagatcgccttgaaaaggaattagatagtattattggtaatggcttttctgttatttacctcatatctcaacgtttggtgaagaaatcgctagatgatggttatttagttggatcgcgtggttcagttggttctagtttcgtagcaacaatgactgaaattacagaagttaatccgcttccaccacactacatttgttcacattgtaagacaagtgagttctttgatgatggttcggttggatctggattcgatttaccagataaaaaatgtcctacttgtggtaatgaattaattaaagaaggacaagatatcccttttgagacattccttggatttaaaggagataaagttccagatattgatttgaactttagtggtgaatatcaacctaacgctcataattacacaaaagtattgtttggtgaagataaagtatttcgtgctggaacaataggtactgttgctgaaaaaacagcttttggtttcgtaaaaggttacttaaatgatcaaggtattcacaaacgtggtgctgaaattgatcggttggttaaaggttgtacaggggtcaaacgtacaactggtcaacatcctggaggaatcattgttgtaccggattacatggatatttatgattttacaccgattcaattcccagcagacgaccaaagtgcagcgtggatgacaacccatttcgacttccattcaatacacgataatgtcttaaaattagatatattaggacatgatgacccaacgatgattcgtatgttacaagacttatcaggaattgaccccaaaactataccagtagatgataaagaaacaatgcaaatatttagtggtcctgagagtttaggtgttacagaagacgaaatattatgtaagacaggtacatttggtgtaccagaatttggtactggatttgtacgtcaaatgcttgaagatactaagccaacgacattctcagaattagttcaaatttcaggtttatctcatggtacggacgtttggttaggtaatgcacaagagttaattcgtcaagggatatgtgacttatctagtgtgataggctgtcgtgatgatatcatggtatatctgatgtatgctggacttgaaccgtcaatggcttttaaaacgatggaatttgtacgtaaaggtcgtggcttaacagatgaaatggttgaagcgatgaaggaaaataacgtgccagattggtatttagattcttgtcgtaaaattaaatatatgttccctaaagctcatgccgctgcttatgtactgatggctgtaagaattgcatactttaaagtacatcatccactatattattatgcagcatactttaccataagagcttccgattttgaccttataacaatgattaaagataaaacgagtattcgtaatacagttaaagatatgtattcacgatatatggatttagggaaaaaagagaaagatgtattaactgtattagaaataatgaatgaaatggcgcatcgaggttttcgattgcaaccgattagtttagaaaaaagccaagcttttgacttcatcattgaaggggatacattgattcctccattcatttcagtgccaggacttggagaaaacgttgcacaaagaattgttgaagcgagagaagagggaccatttttatccaaagaagatttaaataaaaaagccggcttatctcaaaaggttattgactatttagatgaattaggctcattgccagatttacctgacaaggcacaattgtcgatatttgatatgtaa

SEQ ID NO: 574 - DNA, 162 bp, Staphylococcus epidermidis
ttaacatatatgttcactttaatgattaagttaaaatttgaaagcccatttcatctattatcatgtgctaatttacatctaccattagctttctgcttgctacaaaatataatgattactctatcaatcaaattatctgatttttctaattatttagtataa

SEQ ID NO: 575 - DNA, 1515 bp, Staphylococcus epidermidis
aggagtcatatacctatggaaaaatatattttatcaattgatcaaggaactacgagttcacgtgcgatactttttaataaagaaggagaaattaaaggtgtttctcaaagagaatttaaacaacactttccacatccaggctgggtagaacatgatgctaatgaaatatggacatctgttctatcagttatggctgagttacttaatgaaaacaatattaatgcaaatcaaattgaaggtattggtattacaaaccaacgtgaaacgacagttgtatgggataaaaatacaggtcgtccaatctatcacgctatcgtttggcaatcacgtcagacacaagatatttgtacaaatttaaaggaacagggttatgaagaaacatttagagaaaaaacaggtttacttttagacccgtactttgcgggaactaaagtaaaatggattcttgatcatgttgaaggtgctagagaaaaagctgaaaatggtgatttactcttcggaacaatcgattcatggttagtatggaaattgtcaggacgtactgctcatattacagattacactaatgcaagtcgtacattaatgtttaatatttatgacctaaaatgggatgatgagttgttagaacttttaaatattcctaaacaaatgttacctgaagttaaagaatcaagtgaaatttacgggaaaactatcgactatcacttctttggtcaagaagtacctattgctggtattgccggtgaccaacaagcagcattatttggtcaagcatgttttgaccgtggtgatgtaaaaaatacatacggcacaggtggatttatgctaatgaatactggtgaagaagcagttaagtcagaaagtggcttgttaacaaccattgcatacggtttagatggaaaagttaattatgcacttgaaggttcaattttcgtatctggttctgctatccaatggctacgagatggtttgagaatgattaattctgcgccacaaaccgaaaactatgcttcaagagtagagtcaactgagggtgtttatatggttccagcatttgttggtttaggtacaccttattgggattcagaagcaagaggtgctattttcggattatctcgtggtacggaaaaagaacatttcattcgtgctacattagaatctttgtgctatcaaacaagagatgttatggaagctatgtctaaggactcaggtattgaagttcaaaatttacgcgttgatggtggtgctgtaaaaaataacttcattatgcagttccaagcagatatcgtaaattcatctgttgaaagacctgaaatccaagaaacaacagcacttggtgctgcatatttagctggattagctgttggattctgggatgataaagaggatatccgtgaacgttggaaacttcaaactgagttcaaaccagaaatggatgcagatcaacgtcataaactttatagtggttggaaaaaagctgttaaggcgactcaagtatttaaattagaagattaa

SEQ ID NO: 576 - DNA, 1176 bp, Staphylococcus epidermidis
aaaaagcatatagaattaaaacgaacaaacgttcttatcaggaggataattatgaaaattgtacataccgctgattggcatctgggtaaaattttaaatggaaaacaattgcttgaagatcaaaaatatattttaactcagtttaaacaacatatggagaaagaacagccagatttaatagtaattgcaggtgatttgtatgatacctcatatccaagtaaagaagcgataggtttacttgaagagactattgaatacctaaatatagaacttaaaattccaataatcatgataagcggtaaccatgatggtagggaaagattgaattatggctctaaatggtttgagaataatcaactttacataagaactcaactagaaaatattgatgatccaatagaattgagtggtgttcaatttttcactttacctttcgcaactgtgagtgaagtacaaaattattttaaagataagcaaatagaaacatatcaacaagcattaaacgaatgcttagagcaaatgtctagttccatagataataataaggtgaatatattaattggtcatttaactattgagggcggtaaaacttcagattcagaaagaccattaactattggaacagtagaatcagttgatatgcattcttttcggttgtttgattatgtaatgctcgggcacctacatcatccatttagtataaataactcttttatcaaatatagcggttcgattttgcaatactctttctctgaagtaaatcaatctaaaggatatagagttcttgatattgaaaacaaccaactattaaatgaaaccttcgttcctttaaaacctctaagagaactagaagttattgaaggtgattatgaggatattattcaagaaagaattaaagtaaaaaataaaaataattattttcattttaagttaacgaatgtttctcatattactgatccaatgatgaaactgaaacaaatttatcccaatatattagcactatcgaatgtagtatttgatcatagtgagaattttagccatgttgaaatcaaaaaacaagatgatcagacaattatagaaaatttttataaaaatatgacagatcaacatctgagtcaagttcaatcagacaaaataaagcacttgttaagttttatattggatagggaggggtaa

SEQ ID NO: 577 - DNA, 591 bp, Staphylococcus epidermidis
ggatttaatatgaatataccgaatcaaataacggtatttagagttattttaataccattttttattttatttgctttagttgattttggttttggacaaatttcaattttaggtggaaatcatattagaattgaaatattaattagtgctatcatatttgtggttgcatcattaagtgattttgctgatggttatcttgcccgtaaatggcaattagttactaatatggggaaattcttagatccacttgcagacaaattattggtcgcgagtgcattaattgttatggtacaacttggttttactaattctgtcgttgctatcataattattgctcgagaatttgccgtcacaggattacgattactacaaattgaacaggggtttgtaagtgctgcaggacaactagggaaaataaaaacagcagtgacaatggttgcaattatatggattttattgggcgatcctttcttacactatctacatttcccaattggagtgtggttattatacattggagtattctttactattctttcaggtattgaatatttttataaaggaagagatgtatttaaacattctaaataa

SEQ ID NO: 578 - DNA, 375 bp, Staphylococcus epidermidis
cacaataatatgtatagtgaaaaagaaatcatacgaaaagtcgaaagtttagcagagaaaattggaaaactagaagttgttcaagattatcataatgtagaaaaacaaattcataataatcaagcaataaaacaaaagatgaatcgtttgaaagcgcaacaaaaacaatcggttaattttcaaaattatggaaaacaaaatgcactcgagcaatctgaagttaaaattcagaatctaaaagatgaaattaatgaattacctattgttgaagaatttcgttcagcacaatatgaagcgaatgatttactacaaatgatggtcaaaacaatggaagatagactcaatgaatataataaaaaagaacacaatgaataa

SEQ ID NO: 579 - DNA, 135 bp, Staphylococcus epidermidis
gctttaatcataaaagtagtttctttgactggcgtaaaaataacgatgcaaagtaaaactgtaatcaataaaagaaatcttttaattgtattcacctactactttttactaatctctatcaccattaaagattga

SEQ ID NO: 580 - DNA, 315 bp, Staphylococcus epidermidis
cacagaatcataggttggagtgataaattaatgagaaagaaaaaaattccaatgagaaaatgtattatatctaatgaaatgcgtccaaaaaaagatatgattcgagtggttattaacaaagaaggcgaaatctttgcagatgcgacaggaaaaaaacaagggcgcggtgcatatgtgtctaaagatgtagctttagttgaaaaggctcaacaaagagaagttttagaaaaatattttaacgctactaaagatacacttgatcctgtttataaagaaataataagactgatttatagagaagagatcccaaaataa

SEQ ID NO: 581 - DNA, 132 bp, Staphylococcus epidermidis
ttaagaaccatagccataatcaaaataataattattatagataagataatcgttaaagacattactactcacccaaatcttttaatattaaattctatttgcaagataaattataaacttcttaaattttga

SEQ ID NO: 582 - DNA, 2613 bp, Staphylococcus epidermidis
ggattcgccatgattaaaaatatatggaataaacctattaaacgttttacactaatcgttttagttagttgtatattgtcatttattctatatggcccttttctctatcaatttataactaaaggtatagtatttagtggtagtggagatggcttcagacaaatgatgccttttcaaatgtacctttatgaacacttcacatcattaaaaggattttatgatgcttcatttggattgggaggcgactatgttaaatcactggcatattattattcactatctccattgatgtggatcaacttctccatgatatggatattagaacaaactatcaatgtgaatcctcatgacatcagcttttggccaataaaccaattaatcatggcatatgtgcgcactgtaatcacatttattttttcattttatttatttagttatttgcgacttaaacccgcaccaatgtttatcgcaactattttatatggtatgtctactgttgttacatattataattttacttggtctttttacggtaatcttttaattatgttacctatgtcactttgggctatagaaagattctttaaagaacgtaaaataggttggtttattttcgcgattgcttatacattattctcaaacttttattttagttactatgaagcaattgtcataggtttctattttatttatcgattcgctattcctcatgagaaagatattgtgaatcgttggcagaaattatacatactcgtatgtgccactttgttaagtgtattagtaagtatttatggactatatactggtatatcttcctttttagataatgaccgagcgcaaaatcctaatttcaaaattacttttttcacaaatttatttgaaaccaattataatatttttgctgatggtttttacattacaatttcttttattgctatcattgcattattttgttttaaattatatcaacactattattataaattgttcgcaattgcaacttggattttacttatcggttccttttctcaatggtttgacagtgcatttaatggtttttcattaccccaaagacgttgggtttactttttagcattatcaacaagtgtattaattgcattgttcatacaacatttaagtgaaatatcaattaaagaatacacctttgttgctataccagtattcatatacggtttcatatttatcgcactgtcggaaagatcagtaaagtggatgtttgttgcattgattttaatcatagtgttatttatatttattaaatataaatcgttgttaacacgtacctcaatgatggtattactcgttgtcttatttttagctcaacaagtcttaatgactaatgattccagaaaaattactatcgaaccttatcaaacgactatcaaaacaattaatgattcgagctatagaagccctgtcctaaataaaaaaattaagtatatgcatcaaagctctacagatccattgaaaagattagattatttttcatactatgcattaaactcacctttgatatatcactacaacggcacatcattgtattccagtattttcgatggagatatattgaaatactatgaccagacgttacaaattaatatgcctgtagataaaaatagtacttatcgatatttaaataatcgtgcaaacttaatgtctctttgggatgttcaagatcgattacgacatcctgatgatttaaatatgccttatggttttaaaaagaaagaacttataactgataaaaaagatcaatggattcactctgttaatacaataaattatcctagtgcacacattactaataaaatttatgatgcaagaaaactaaaatctccccttgatagagagcaagctatgcttaaaggtgtcgtattgaatcataaatcccaagccaatactgattttaaacctaatcctaatttactttctaatgcaaaacaaaacttaaatcatgcgaattggattgatagtaaacatttaaaagttaaacagcacaatggtggcgtcaccctcaatttacttcgcaatatagttaaaaattataaagatatgtatattgaaatggatgttgaattactgtctcttgacaaagagcataaagtaggggttaatgaatattcgcaagaaagaaaccgtttgtcatacaaataccgtcgttttgtttcgccagtgacgatgcgtgctaaagcttcaaatcaacttaacattaagatgtcaaaaggagtttatcgttttaaagtaaaaggaatttatggtgaaaactatcaaacattaaaaaaagcttctcaacagctccaaccagttaaagtaaaaaaagaaagaaatggtttcacaattattaaaaagaaaaaagaacatggttatcttgtcttgccaatggtatatgctaaaggaatgcatgcaatggcaaatggaaagcctctaaaggttcaacaaggaaacggtattatgactactattcctgtaaaagagggacaaacaaagataaaattaagttatacccctccttatttttatttattaatcactgtcagttgcattgggatcattttaagcattcttttcactcattacgtaaaaagaaaataa

SEQ ID NO: 583 - DNA, 123 bp, Staphylococcus epidermidis
gaatcatacatactaattgtacgtttatcgacagatatgtgtcaagatatgaaattgcactacactcattttaaattgctttttttaaagaacaaatcaaaaactacaaaaaaggatggctaa

SEQ ID NO: 584 - DNA, 156 bp, Staphylococcus epidermidis
ctggtggtcttatcgatgaacaatcggaaattagagaagcaatttccaatggcgctaagtacgtcactacaagttacgagaaactttggtaatttgtatactgttaataagaatgtatttaagtttgttaatcaaggtattatcattttttcatag

SEQ ID NO: 585 - DNA, 147 bp, Staphylococcus epidermidis
gtcttgaacataggtttcagttcgacaccgacaattgatgttaaaaacaaagcactaaaatgtttagatctttgttttaactttgtaaataaaatcgaaaaaattgatagttttctatcaattaaaaatcatcataatgaactatga

SEQ ID NO: 586 - DNA, 1290 bp, Staphylococcus epidermidis
aacatgagcattttaattacgattatttcatttatcatcgtatttggtgtactcgtaactgttcacgaatatggacacatgttttttgctaagcgagcaggaattatgtgtcctgaatttgcgattggtatgggtcctaaaatttttagttttcgtaaagatgaaacattatatacaattcgtctattaccggtgggtggttatgtcaggatggctggtgatggtcttgaagaaccaccagttcaaccaggtatgaacgtaaaaataaagttaaataaccaagacgaaatcacacatataattctagatgaccaacataaattccaacaaattgaagccatagaagttaagaaatgtgattttaaagatgacctatatattgaaggtatcacttcttatgatgatgaaaggcatcacttcactatagcgaaaaaggcattttttgtcgaaaatggaagccttgttcaaattgctccaagagatagacagtttacacataagaaaccattgccaaagtttttaacattatttgcaggtccgttatttaattttattttagctttagttctatttattggattagcatactaccaaggtacgccaaccaatgtcataggagaagttgtgaagaaatctccagctgatgaagctggattgcacaaaggtgataaaatagttcaggtaggtaatcataaaattaaaaattttgatgatatcaaacatgttcttgaccaaaataaaacggcgaaaacaactgtaaaaattaaaagggatggccaaaacaagtctgtagatctccaacctaaaaaagtagagagaaagataactaaaactaaaactcaaacaacttatcaaattggttttgcccctactacagaacacagcgtttttaaaccaataagctacggtatttataactttttcgataaaggtaagcttatttttacagctgttgttggtatgttagctagtatatttacaggagaattttcatttgatatgttaaatggccctgttggtatttatcacagtgttgattctgttgttaaatctggaattattaatttagtaggatacaccgctttattaagtgttaacttaggaataatgaatttgctacctattccagcgcttgatggtggtcgcatattatttgtactatatgaggctatttttagaaaaccagtgaataaaaaagcggaaacaggaattattgctgtaggcgcactttttgtggttattattatgattttagtcacttggaatgatatacaacggtatttcttataa

SEQ ID NO: 587 - DNA, 165 bp, Staphylococcus epidermidis
ttgattttaatagttttgaataagtttacaaatagtcatcgtagattttttatgaatagaaaaatgatttttatactaaatgatgcacgtgttaaacttaaagtggttgggttagctattataaagtataattatgaagttatagataaaagtttaagaaaataa

SEQ ID NO: 588 - DNA, 174 bp, Staphylococcus epidermidis
catattataatatttaatattatctatcgatttaattacttagatgattttttaattaaacataaattcattagaggtgtagaacatgagcattttaattacgattatttcatttatcatcgtatttggtgtactcgtaactgttcacgaatatggacacatgttttttgctaa

SEQ ID NO: 589 - DNA, 126 bp, Staphylococcus epidermidis
acaatagtaatagagctcattattgataagttgaaaataaaacttttatcggtatctaaatttgtgaaatttgaaggggaaaacttgattttattaatattgtctgtaatctttatgaccacgtaa

SEQ ID NO: 590 - DNA, 1026 bp, Staphylococcus epidermidis
gtgaatacaattaaaagatttcttttattgattacagttttactttgcatcgttatttttacgccagtcaaagaaactacttttatgattaaagctcaaaatgatatacgtcatcaaattaatcgatggattgattctgattcaaatgacgataatactcaattagcgattcctaaaaagcaagaatttgcaatcaacaatatacagatgaatatgactaaaaaagatgttgaagcacaattgggacaacataagcgtatgacttcgagtgtgtatggcacaaattggtacacatattattcaaatgattataatcaatttttgatggtgagttatattaacaatcatgttaatgcactgtatacaaatcaaaatcttatttcatcaaaatctcaaattaagtatgatactcctaaagatgttgttagggaaagatatgggcccccgattcaagttataaaaaaagggaaagttggttttgatgtaaaaagtaatgaatatgatgttttccataaagaccatatttataccacagtattttatgataagcacagagataatggtgtgaagtcattattacaagttagtgagaaaatggaaaatcgattaagatatcaatatgggaaaccatctaaattacttgcaaagagttttgagttgcaaaattttgacattgtcaatgctgaaagaaaacagcatggcttaaaaacattagattattctaaggatgtttctcatactgcgcgtaagcatagtgttgacatggttaagcataattattttgaccatgtaaatcaaaagaaactttctccttttgatagattaaaaaaagatggaatagaatttaatgctgctggagaaaacttagcatatggacaattgaatagtatctatgcacatgaaggtttgatgaattcattggggcatagaaagaatattttaaacacccattttgattatttgggcgtaggtgtatatttcaatgatcgaagacaacccttttggaccgaaaattatacaagttaa

SEQ ID NO: 591 - DNA, 1212 bp, Staphylococcus epidermidis
ttaatgaaaattcaaacagaagtagatgaattgggctttttcggtgaatatggtggccaatatgtacctgaaacattgatgccagctattattgaacttaaaaaagcatatgaggacgcgaaatcagatactcacttcaagaaagaatttaattattatttaagtgaatatgttggtagagaaacgcctttaacatttgctgaatcatacacaaaattgttaggtggtgccaaaatatatcttaaaagagaagacttaaatcacactggtgctcataaaattaataacgcgataggacaggcactattagctaaaaggatggggaaaactaaattagtagccgaaacaggtgctggtcaacatggtgtagcaagtgccaccatcgctgctttattcgatatggatcttattgttttcatgggaagtgaagatatcaaacgtcaacaacttaacgtatttagaatggaattgctaggagctaaagtagtgtctgtgtcagatgggcaaggaacactatcagatgctgtaaataaagctttgcaatattgggtgaatcatgtcgaggatacacattatttattaggctcagcgttgggacctgatccgtttccaactatggtcagagattttcagagtgtgattggtaatgaaattaaaagccaaattttaagtaaagaaggacgatttccagatgcgttagtcgcgtgtgttggtggaagatccaattcaataggtacgttctatccatttatacaagatgatgttaaattatatggggtagaagctgcgggaaaaggaagtcatacgcataatcatgctttagctatagggaaaggtaaaccaggtgtattacatggttccaaaatgtaccttattcaaaatgatgatggacaaattgaattggcacactctatatcagcgggactagattatccaggtattggacctgaacattcgtattataatgatattggtcgtgtatcatatgtaagtgctacagataatgaagctatggaagcacttataacattctcaaaagttgaaggtatcattccagcaattgaaagtgcacatgcattgagttatgttgaaaaattagcgccaaatatggatgaaaaagaaattattgttgtgactatttcaggtcgtggagataaagatatggaaacaattaaacaatacaaagaaaacggtggtgaacaaaatgagtaa

SEQ ID NO: 592 - DNA, 1152 bp, Staphylococcus epidermidis
atacttgaaatgactcatatacaatattgttattctgaaaattctgaaacaaggaggcgctctatgcgaaatattttatttgtagggttaggccttattggcggtagcttggcgagtaatttaaaatatcattacagtaatttcaatattcttgcatacgattcggactacacacaacttgatgaagccctttctataggtattattgatcaaaaagttaatgattatgctactgctgttgagatagcggatataatcatctttgcaactcctgttgagcaaacaattaaatatctatctgaacttacaaattacaatacaaaaactcatttgattgtaacagacacaggtagtaccaaacttactatacaatcattcgaaaaagaattattaaaacatgatattcatttaattagtggtcatcctatggcaggaagtcataaatctggtgttttaaacgcgaaaaaacatttatttgaaaatgcttattacattcttgtatttaatgaaatcgaaaataatgaagccgcgacatatttaaagaaattacttaaacctacgttagcaaaatttatcgttactcatgcaaatgaacatgatttcgtaaccggtatagtgagtcatgttccacatatcatcgcttcaattttagttcatctaagtgctaatcatgtcaaagaccattctttaatcgaaaaattagcagccggtggctttagagatataactcgtatagcaagtagtaatgctcagatgtggaaggatatcactttaaataatcaaaatcatattttatctttacttaacgagattaaagaacaaattactggtattgaaaatttgatacgagaacaaaatagtaatagtatttacgatttcttcgttaaagctaaagattatcgtgatcaacttcctgttaaacaacacggtgcaatatctactgcgtatgatctttatgttgatatccctgataagccgggtatgataagtcaaattacaaacatcataagttcacataatatttctattataaacttaaagattttagaagtacgggaagatatttatggagctttacaaatcagttttaaaagtcccgaagatcgagagaatgctataaaagccctcgcaaattttgatacttattattaa

SEQ ID NO: 593 - DNA, 582 bp, Staphylococcus epidermidis
atgactgaaatgacaaagccttttttaatcgttattgtaggtccaactgcttcaggtaaaactgagttaagtattgaagttgctaaaaaatttaatggagaaattattagcggagattcaatgcaggtctatcaaggaatggatattggtacagcaaaagttacaactgaagaaatggaaggtataccacattatatgatagatattttgcctccagatgcttccttttctgcatatgaatttaaaaaaagggcagaaaaatatattaaagatattactagaagaggcaaggtgcctattatagcaggaggaacaggactatatatacaatctctcttatacaactatgcttttgaagatgaatccatatctgaagataaaatgaaacaagttaaattaaagttaaaagaacttgagcatctaaataataataagctccacgaatatttagcttcattcgacaaagaatcagccaaggatatacatcctaataacagaaaaagagtgttgcgagcaatagaatattatttgaaaacaaaaaaacttttaagtttctcgcaagaaagtgcaccaatttactga

SEQ ID NO: 594 - DNA, 123 bp, Staphylococcus epidermidis
atgaaccgaatgttaaatataaaaggtgaagtaaaacgacctatttttctaaaaataaaaagaaatagatataaagatataaatgggagttatgaagatgaagtttacgaatttgacagctaa

SEQ ID NO: 595 - DNA, 204 bp, Staphylococcus epidermidis
caaaggagaatgttgattatgccaatcattaatgtgaaattattagaaggccgttctgatgaacaacttaaggatttagttacagaagtcactcatgctgtagaaaaaactacaggtgcaaataaagaagcgattcacgtggtcattgaagaaatgagaaaagatcattatgctgtcggtggcgtaagaaaatctgatcagtaa

SEQ ID NO: 596 - DNA, 615 bp, Staphylococcus epidermidis
gtttttatgatgatcatcgtcatgttaatcttgagttatctgattggtgcattcccaagcgggttaattattggtaaattattttttaaaaaagatataagacaatacggtagtggaaatactggagcaactaacagttttcgtgttcttggaagaccagctggatttatagttacgtttttagatattttcaagggatttattacagtcttttttccactatggttcccagttcatgcggatggtgttataagcaccttctttacaaatggtttaatagtaggattgtttgcaatactcggtcacgtgtatccaatatatctgaaatttaatggcggaaaagcagtagctaccagtgcaggagttgtattaggtgtcaatcctattttacttcttatcttggcaattatcttttttagtgtattaaaaatctttaaatatgtttctttatcaagtatcattgcagcaattagttgtgtgattggttcaatcatcattcatgattatattttacttgctgttagcggaattgtttcaatcatattaataattcgacacaaatctaatatagttagaatttttaaaggagaagaacctaaaattaaatggatgtaa

SEQ ID NO: 597 - DNA, 372 bp, Staphylococcus epidermidis
tttattatgatatcgcttgttataactgaggatcaattgatgttaagaaaagctatggtacaactgatagaaatgcatgaagaaatgaatgtaataaaagattttgaaaatggtgtagaggcactcgaatttattgaaaataatgaacccaatgtagccattttagatattgaaattccgggtttaacaggcttggaaatcttatcttatgtaagaaaaaaacaactcaatacaagaataatcatagtgactacatttaaacgtccaggttattttgaaaaagccgtagcaaatgatgttgatgcttatgtactaaaagagcgttcaattgatgatttaattaaaactatttataaagtgacaaagggttga

SEQ ID NO: 598 - DNA, 240 bp, Staphylococcus epidermidis
tattggatgattttaaaatacaaatataaatttttaacatatatgacaatagtcatagtatgttgtattattttttcaaatttctttttaagcgttaaccaaggtgttcaatcagaacaaacgtacgaaatgactgaccacaagattcatcaacataatcaacaaggaactactcaaaactataaagacaaacaaaatagcgaacagaatgatcagtctgtgttcgcattagttaattaa

SEQ ID NO: 599 - DNA, 393 bp, Staphylococcus epidermidis
gtgaaaacgattggtgaagtgttgaaaagtagacgtgaaagattgggtatgacactaagtgaattagaacaaagaactcagttaaagcgtcaaacgttaatacatatagaaaataatgattttaatgaactagccaagagtgattatactgaaggttttattagaaaatacgctaaagttgtaaatatcgaaccaaatcaacttattgaagcacatcaagatgagattcctgaaacacaatatcaaattgatgatgtgatacaaacattttctaatgggtatgaacccccttaccgacgtcaatctaaggaagcgtttcaattgttgatgtggatgggtttcattattttaatatctttaatcgtttggatactcgcagtattaattatataa

SEQ ID NO: 600 - DNA, 801 bp, Staphylococcus epidermidis
acagagacgatcaggctcggaggaaagaccatgtttaaaaagctgaaaaataaaaataaaactgagacaaaccataataatgacttagacatacataatatacctgaacatgtggctattatcatggatggaaatgggcgttgggcaaaaaaacgtaaaatgcctagaattaaaggccattatgaaggtatgcaaacaatcaaaaaaattactcgcgaagcgagtgatataggtattaagtatttaacattatacgcattttcaacagagaattggtctagacctgaaagtgaagttaattacattatgaatcttccagtgaatttccttaaaacatttctaccagaattaattgaaaagaatgttaaaattgaaacaatagggttttatgaaggtttaccacaatctacaattgatgctattgattttgctaaagctaagactcagcacaatactgggttaactcttgtgtttgctataaattatggtggacgagctgagattattcagagtatgaaagcaatatataacgaattacaattaaacggacaaggatctgaagtgattgatgaggcgttaataaagcgtcatttaatgactcatagttatccagatccagacttattaatacgcacttcaggagaacaaagaataagcaatttcttaatatggcaagcttcatatagtgaatttatttttaatgaaaagctatggccagattttgatgaaaaagagttaagagagtgtttgaaaatatatcaatcacgccaaagacgttttggaggattaagtgaggagtaa

SEQ ID NO: 601 - DNA, 867 bp, Staphylococcus epidermidis
ctcatggcgatacaatggtatccaggtcatatggctaaagccaaaagacaagttagtgaacaactgaaaaaggtagatgtagtttttgaactcgtcgatgcacgtattccatacagttcgagaaaccctatgattgatgatgtcattaaacaaaaacctcgagtagtaattttaaataaaaaagatatgacgaatttaaaagaattagaaaaatgggaaatttattttaaaaatgaaggtttctatccggtagctgtagatgcaaaacatggcaagaatcttaaaaatgttgaagttgaagctataaaagcaactcaagaaaaatttgatcgtgaaaaagccaaaggtttaaaacctagagcgataagagctatgattgtaggcattcctaatgtaggaaaatcaacacttatcaataagttagcaaaacgtagtatcgccgaaactggaaataaaccaggagtaacaaaacagcaacaatggattaaagttggaaagtctcttcaattactagatacaccaggtattttatggcctaaattcgaagatgaagaggtcggtaaaaaattaagtttaactggtgcaattaaggatagtatcgttcatttagatgaggtagctatttatggtttgaattttatgattaaacatgatgtttcagctttaaagagacattataatattgatacacatgaagacgctgagatactcgattggtttgatgcaattggaagaagaaagggattgttacaaaaaggaaatgaagtagattatgaatctgtcattgagttgatcatcaatgatatgagaaatgcaaaaattggaacttattgttttgatattttaaaagaaatgaagagtgaatga

SEQ ID NO: 602 - DNA, 1359 bp, Staphylococcus epidermidis
aattggaggatttataccatgccaaaacgtagttttacaaaagatgatattcgtaaatttgctgaagaagaaaacgtaagatatttaagattacaattcactgatattttagggactattaaaaatgttgaagttccagtaagtcaattagaaaaagtattagataatgaaatgatgtttgatggttcatctattgaaggtttcgttcgtatcgaagaatcagatatgtatttacatcctgatttagatacttgggttatcttcccttggactgctggacaaggaaaagttgcacgactaatctgtgatgtatttaaaacagatggtacaccatttgaaggtgatccacgagctaacttgaagcgtgtattaagaagaatggaagatatgggctttactgattttaatctagggcctgaaccagaatttttcttatttaaattagacgaaaaaggcgaacctacattagaattaaacgatgatggtggttatttcgatttagctcctacagatttaggtgaaaattgtcgccgtgacatcgttttagaattagaagatatgggctttgacattgaagcaagccaccatgaagtagcgccaggtcaacatgaaattgactttaaatatgcagatgccgttacagcatgtgataatatccaaacatttaaactagttgttaaaacaattgcacgtaagcataatttacatgcaacatttatgccaaaaccattatttggtgtaaacggtagtggtatgcacttcaacgtatcactatttaaaggaaaagagaatgcgttctttgatcctgaaggtgatttacaattgactgatactgcatatcaatttacagctggtgtccttaaaaacgctagaggattcactgcagtatgtaatccaattgtcaactcatataaacgtcttgtaccaggttacgaagcaccatgttatattgcatggagtggtaaaaaccgttcacctttagtacgtgttccaacatctagaggtctatcaactcgtattgaagtacgctcagttgaccctgcagctaacccgtacatggcattagcagcaatcttagaagcagggttagatggaattgagaataaacttgaggttccagaacctgtaaaccaaaatatctacgaaatgaatcgtgaagaacgagaagcggttggtatccaagacttaccttcaactttatacactgcgttaaaagcaatgcgtgaaaataaatcaattaaaaacgcattaggtaatcatatttacaatcaatttattaactcaaaatcgattgaatgggattactatagaactcaagtatccgaatgggaaagagaacagtatattaagcaatactaa

SEQ ID NO: 603 - DNA, 153 bp, Staphylococcus epidermidis
tcgatatacttcaatgtgccttgtattacttcggcgaggttatgcggcgggatatcagtagcatatcctgaagaaatccccgtagatccattaattaataaattagggaatctcgctggtaataccattggttccaaagttgtgtcatcatag

SEQ ID NO: 604 - DNA, 1470 bp, Staphylococcus epidermidis
gagggattcgttttgcaagattttgataacttaattcctggctggtttaaaacatttgttcaagtcgggaatgacttaatttggtctcaatatcttattggattattattaacagcaggttttttctttacaattagttctaaatttattcaactcagaatgttaccagagatgtttagagcattaactgaaaagccagaaactttaagtagtggtgagaagggtatttcaccatttcaagcttttgcgattagtgctgggtcaagagtaggaactggaaatattgccggtgttgcaactgctattgttcttggtggccccggtgcagtcttctggatgtggattattgcttttattggtgcagctagtgcatttatggaagcaacgcttgctcaagtttataaggtacatgacaaagaaggtggattccgtggcggaccagcctattacataacaaaagggctaaaccaaaaatggcttggaattgtatttgctgttttaattacagttacatttgcttttgtatttaatactgttcaagcgaatacaattgctgaatcattaaatacacaatacaatattagcccggtaattactggaatagtacttgcagttattacaggtattatcatctttggtggtgttcgtagcatagctacactatcttcacttattgtgcctattatggctattgtttatataggtatggttttaatcattttattactcaatatagatcaaattgtacctatgattggcactattattaaaagtgcattcggagttcagcaggttactggtggtgctgtaggagctgctattcttcaaggtattaaacgtggtttattctcaaacgaagctggtatgggatctgcacctaatgctgctgctacatctgctgtgccccatcccgttaaacaaggtttaattcaatcattaggtgtattctttgacactatgcttgtttgtacagctacagcaattatgattttattatattctggtttgcaatttggtgatagcgcgcctcaaggtgtagcagttacgcaatcagcgttgaacgaacatttaggttcagcaggaggtattttcttaactgtagcagttaccttatttgcattttcatctgttgtaggtaactattactatggacaatccaatattgaatttttatctaacaataagatgatattatttatttttagatgttttgtagtacttttagtatttgtaggtgctgttgctaaaacagaaacagtttggagtactgccgatttatttatgggtcttatggcaatagtaaatatcatatcaattataggtttgtcgaatattgcgtttgcagtgatgaaagattatcaaagacagcgtaaagaaggtaagagacctgtgtttaaacccgaaaacttagaaataaatttatttggcattgagacttggggacaacatgcaaaaatgccaaaaaaatag

SEQ ID NO: 605 - DNA, 2031 bp, Staphylococcus epidermidis
cgaacgtacgtttgtaggagggcgaaatcattggcaatgaataaacaaaataattattcagatgattcaattcaggtacttgaaggactagaagcagttaggaagagacctggtatgtacattggatcaactgataaacgaggattacatcatcttgtatatgaagttgtcgataactccgtcgatgaagtattaaatggttatggtgatgcgattacagtaacaattaatcaggatggtagtatttctatagaagataatggtcgaggtatgccaacaggtatacatgcgtctggcaaacctactgcagaagttatatttactgttttacatgctggaggtaaatttggacaaggaggttataaaacatctggaggtctccatggggtgggtgcttctgtagtaaatgcccttagtgaatggcttgaagttgaaattcatagagatggtaatatctacacacaaaatttcaaaaatggtggtattccagcgacaggtttagtaaaaactggaaaaacaaaaaaaactggtactaaagttacatttaaaccagactcagaaatatttaagtcaacgacgacttttaattttgatattttaagtgagcgtttacaagaatctgcatttttacttaaagatttaaaaattacacttactgatttacgtagtggaaaagaacgagaagaaatttaccattacgaagaaggaattaaagaatttgttagttatgtcaatgaaggtaaagaagtattacatgatgttactacatttgcagggcattccaatggaatagaggtagacgtagcattccaatataatgatcagtactctgagagcatattaagttttgtaaataatgttcgtacaaaggacggaggtactcatgaagttggtttcaaaacggcgatgactcgtgtttttaatgaatatgcacgtcgtataaacgaactgaaagataaagataaaaatttagacggtaatgatatacgcgaaggtttaacagcgataatttcagtacgtataccagaagaacttcttcaatttgaagggcaaacgaaatcaaaacttggcacttcagaagcaaggagtgctgtagactctgttgtttcagaaaaattaccatattacttagaagaaaagggccaattatctaaatcattagttaaaaaagcaattaaagctcaacaagcacgcgaggctgctcgtaaagctagagaagatgcacgctccggaaagaaaaataaacgtaaagatacattgttatcaggtaagttaactcctgcgcaaagtaaaaatactgataaaaacgagttatatctagttgagggtgattcagcgggaggttctgcaaaattgggacgcgaccgtaaattccaagctattttacctcttcgtggaaaggttattaatacagaaaaggcacgtttagaggatatttttaaaaatgaagaaattaatacgattattcatactattggtgctggtgttggtactgactttaaaattgaggatagtaattacaacagaattattatcatgacagatgctgatacggatggtgcacatattcaagtattattgcttacatttttctttaaatatatgaaaccacttgttcaagctgggcgtgtctttattgcgttaccgcctttatacaaattagaaaaaggcaaaggtaagaataaaaaagttgagtacgcttggactgatgaagaattagaaaatttacaaaagcaattaggaaaaggtttcatattacagcgttataaaggtcttggtgaaatgaatccagaacaattatgggaaactaccatgaatccagaaactcggacattaattagagttcaagttgaagatgaagttcgttcatcaaaacgtgtcactactttgatgggggataaggttgccccacgaagagagtggattgaaaaacacgttgaatttggtatgcaagaagatcaaagcattttggataataaagaagtccaaatactagagaatgaaaaatatattgaggaggaaacgaattga

SEQ ID NO: 606 - DNA, 1035 bp, Staphylococcus epidermidis
ttcatatttttttctgttaaagcttttggagaaactgagttttggttatcactgatcaaagtcattactataattgtatttattatttttggaattatgatgattttcggtattcttggtggtcatacatatggctttgagaattatactaaaggtcaagcaccttttgtcggtggaatatcaggcatattaagcgttcttttagttgcaggtttttcagttggtggtactgaagtagtcgcagtaacagctggtgaatcaaataatcccgaaaaatcaatgcctaaagctataaaacaggtattttggagaatattactcttttacgtattgtctatagctgtgatagctgccatcattccatatacggatccacttttacttaatgaaaatgagtctgtatcacaaagtccgtttacaattgttttcgatagaatagggatcgcttttgctgcatcagtcatcaacgctgttatcttaacatcattattatcagcagctaactctggtatttatacaacaagtagaatgctattttctttaagtgctgataaacaagcacctaaattctttggaaaactcaatgataaaactaaattacctatgcgtgcattaattacaacatatattattattgtattagtcattgtttatgctaattttaatgctaatgctgtatttaacttattaaatatcataggatctatggttattgtagtttggggatctagtatttggtcacaaattagattaagacaagcaattaaaaaacagggtaaaaatccagataaactgttgccatataaagcacctttttacccagtcggacctattattgtccttttcacattattattcttattattaggtagttcctttggtagtatcgcatctggtgatattttaggtgtcatacgaaactttacaccattatttattctagctatcatctatattgctcataaattaatcaaacggacacattttgtcaaactggaagaaatagatttaactccgcataattacaagaattaa

SEQ ID NO: 607 - DNA, 1485 bp, Staphylococcus epidermidis
gagtatttagtaatgaattttggatttttgggtactattttaactatattgttagtagttgggtttataactaacgtagtattggcatttgtcatcattttccttgaacgtgatcgacgtactgccagttcaacttgggcgtggttattcgtattattcgttcttcctgtcattggatttattttgtatctatttttaggacgaacggtttccaagaaaaagatggaaaaaaataacggtgatgaattacatgcatttgaagatttagttcaagaccaaatcgacagttttgataaacataattatggttatatcaatgatcaagtcattaaacaccgtgatttaatacgtatgttgttaatgaaacaagatgcctttttaacagaaaataataaaatcgatttatttacagatggtcataagctttatgaaaaagtacttgaggatatttacaatgctcaagactatatacatctagagtactatacctttgaacttgatggattaggtaaaagaatcttagatgcacttgaaactaaacttaaagaaggtttagaagttaaacttttgtatgacgatgttggttctaaaaaggttagattatcaaaatttaaacatttcagagcattaggtggagaagttgaagcatttttcccttcgaaagtacctttaatcaatttcagaatgaataatcgaaatcatagaaagattatcattatagatggacaaattggttacgttggcggttttaatgtcggcgatgattatttaggattaggtaagttaggttactggagagatacacatacacgtgttcaaggtgaatgcatcgatgcactacaattaagatttattttagactggaattcacagtcgcatcgtccacaatttaaatttgatcaaaaatatttccctaaaaaaaatggggacaaaggaaacgcggctattcaaatcgcttctagtggacctgcatttgatttacatcaaatagaatatggttatacaaaaatgataatgagcgctaaaaagtctatctatctacaaagcccttactttattccagaccaatcatacattaatgcattaaaaatggctgctaatagcggcgttgaagtaaaccttatgataccgtgtaaacctgatcatccattcgtttattgggctacattttcaaatgcagctgatttattggatagcggagttaatatttacacttatcaaaatggatttattcattctaaaatattaatgattgatgatgaaatttcttcaattggtagtgcaaacatggactttagaagctttgaactgaatttcgaagtgaatgcatttatatatgatgaagatatagctaaacagttacgtcaagcatttgaaaaagatattgagcaatctaaattacttacaaaagaagtatacgacaagcgtccattatcaattaaatttaaagaaggactagcaaaattaatatctccaattttataa

SEQ ID NO: 608 - DNA, 438 bp, Staphylococcus epidermidis
attgaactagttaaacttagagatgatgttggtgaactaccagcagctaaagaaacgatcattgtttcacctattgctcttgatatacctaatacaattgaagcaacaacgccagaagtcgcagctggtaatacaacttttgtagcgacttcaaatttagttgcgcctaatccaaatgcaccttcacgaattttatcaggtacagatgacattgcatcttcactcatacttgtaatcatagggacaatcattatacccacaacaataccgggactgattgaattaaactctcccaagttaggaattagatttctcaatataggtgtaacaaatgtcaaagcaaagaagccaaatacaattgtaggaatcccagccaaaatttctaatattggtttaatgattctacgtgaacgatcagatgcatattcattaaggtag

SEQ ID NO: 609 - DNA, 348 bp, Staphylococcus epidermidis
tgtttaatagttttaaatttagtattaattaaggtggttattattttggcaatgacaaatcgagaaaagtttaaagtgcttgccgatcaaataaaaatatcaaatcaactagaacaagatattcttgaacaaggtgaactcactcgtatagatgtttcaaataaaaacagaacatggactttccaaatatcactcccacattttttatctcatgaagattatcttctttttacacatgcaattgaagaagaatttaaagaaatagctacagtagcaattgatttttcaattaaagataccaacaatcaagatgagtttcgctttaaaatatttcggacattgtattga

SEQ ID NO: 610 - DNA, 1074 bp, Staphylococcus epidermidis
ctttctgtagtaggaggtctcgttttggataatgaacgtcaaaaagctttagatacagtaattaaaaacatggaaaaatcttttggtaaaggtgccgttatgaagttaggcgataataaaggtcgcagagtatcaagcacttcaagtggttctgtcacagttgataatgcattaggggttggaggttatcctaaaggaagaattatcgaaatatatggacctgaaagttcaggtaagacgacagtagctttacatgctatcgctgaagtacaaaaaaacggtggtgtagcagcatttatcgatgccgaacatgctctcgatccagtatatgcacaagcattaggtgtagatattgataatttatatttatctcaacctgatcatggtgaacaaggtcttgaaatcgccgaagcttttgttcgtagtggtgctgtggacattgttgttgtcgattcagtagcagcattaacacctaaagctgaaattgaaggtgaaatgggagatactcatgttggtttacaagcaagattaatgtctcaagcattaagaaagttatcaggggctatttctaaatctaatactacagctatatttattaaccaaattcgtgaaaaggtcggtgtgatgttcgggaatcctgaaacaacgcccggtggtagagccctaaaattctatagttctgtacgtttagaggtaagaagagcagagcagttaaaacaaggtcaagatattgtaggtaacagaaccaaaataaaagttgtaaaaaataaagttgcacctccatttagagttgcagaagtagatattatgtatggtcaaggtatctctaaggaaggagagctcattgatttaggtgtagagaatgatatcgttgataaatcaggtgcttggtattcttataatggagatagaatgggccaaggtaaagaaaacgtcaaaaattatcttaaggaaaatccacaaatcaaagaagaaattgaccgtaagttacgtgaaaagttaggtattttcgatggtgatgtggatgaaaatgagaatgaagacgattcaccaaaaactttatttgatgaatag

SEQ ID NO: 611 - DNA, 147 bp, Staphylococcus epidermidis
aaaaatggcttttttttccatttatttctttttcatttttcattaaattcaccacgccttaaaaatacatctatttactttttaatttattgtaaaaataagcttaaaaacacaatatttatcttaccacaaataacaatactctaa

SEQ ID NO: 612 - DNA, 1608 bp, Staphylococcus epidermidis
atgttacaagtaactgatgtaagtttacgttttggtgatcgtaaactatttgaagatgtaaatataaaatttacagagggtaattgttatggattaattggtgcaaatggtgctgggaaatctacattcttgaagattttatcaggcgaaattgattcacagactggtcatgtatctctaggtaaagatgagcgtttggctgtgttaaaacaagatcattttgcttatgaagatgaacgtgttttagatgttgtgattaaaggacatgaacgtttgtatcaagtgatgaaagagaaagatgaaatttatatgaaacctgatttcagcgatgaggacggtattcgcgctgcagaacttgaaggagaatttgcagaaatgaacggttggaatgctgaagctgatgctgctaacttattatcaggattaggcatagaacctgacttacatgataaaaatatgtctgaacttgaaaataatcaaaaagttaaggtattgttagctcaaagtttatttggtgatcctgacgttcttttactagatgagcctaccaatggtttagatataccagcaataagttggttagaagactttttaattaattttgaaaatactgtcattgtcgtttcgcatgaccgtcacttcttaaataatgtttgtactcatattgctgatttagactttggcaaaattaaactttatgttggtaactatgatttttggtatcaatcaagtcaattagcacaaaaaatggcacaagaacaaaataagaaaaaagaagaaaaaatgaaagagttacaggatttcatcgcacgcttctcagcaaatgcttctaaatctaaacaggcaacaagtcgtaagaaacaattagaaaaaattgaattagatgatatccagccatcatctcgtagatacccttacgtgaaatttactcctgaacgtgaaattggaaatgatttacttacagtagaaaatctttctaaaacaattgacggcgaaaaagtactagacaatgtttcattcactatgaatcctaatgataaagctattttagttggtgatagcgaaattgctaaaacaacattgttaaaaattttagctggagaaatggaaccagatgaaggtacatttaaatggggtgtaacgacatctttaagttacttccctaaagataactctgagttctttgatggtgtcgatatgaatttagttgaatggttacgtcaatacgctccagaagatgaacaaactgaaacatttttacgtggtttcttaggtcgcatgttatttagtggtgaggaagttaagaaaaaagcaagcgtgctttcaggtggagaaaaagtacgttgcatgttaagtaaaatgatgttatcaagtgctaacgtacttttacttgatgagccaacaaaccatttagatttggaaagtatcactgctgtaaatgacggattaaaatcatttaaaggttctatcatcttcacttcttatgattttgaatttattaatacaatcgcaaatcgagtgattgacttgaatcaagctggtgccctttctaaagaagtaccttatgaggaatacttacaagaaattggtgtattacaaaataattaa

SEQ ID NO: 613 - DNA, 786 bp, Staphylococcus epidermidis
aaaatgaaagtaagaacattaaccgcgattatagccttattaatattcttgcccatcttgctcaaaggtggcttaatattaatgcttttcgcattcttattagctttgatagccttaaaagaactacttaatatgaatatgatcaaatttttatctatacctggtctgattagtgctttagccctaattattatcatgttacctcaagatgcaggtgaatgggttcaagttatccaacttaaaggtttaattgctatgagtttcatagttttaagttatacagtgctatctaaaaacagatttagttttatggatgctgcattttgtttgatgtctgtagcatacgtaggaattggcttcatgtatttttatgagacacgttctgagggcttgagatatattttatttgcatttttaatagtttggctaacagatacgggtgcttatatttttggtcgccttatgggtaaacataagttatggccagtcattagccctaataaaacaattgaaggtttctttggtggtattttatgtagcattttagtaccattagtgatgcaaatgtttgtagatttacatatgaatatttggcttttactattagtcacaattgttttaagtatgtttggtcaattaggtgatttagtagaatctgggtttaaacgtcattttggtgttaaagattcaggacgtatactaccaggacatggtggtatattagatagatttgatagcttcatgtttgtattaccgctattaaatattttactgatacaaacttaa

SEQ ID NO: 614 - DNA, 744 bp, Staphylococcus epidermidis
atcaaaggagttattcaacttatggtacaacatttatcagctcaagaaatcattcaatatattagtgatgctaagaaatcaacaccactcaaagtttatgtaaatggtcattttgaaaatgtcacattcccagaatcttttaaagtttttggctctgaacattcaaaagtaattttctgtgaagcagatgaatggaaacaattttatcaacaaaatcattcattaatcactgaattagaaattgagatggatcgtcgtaattcagctataccgcttaaagatttaacaaacacaaatgctcgtattgagccaggtgcgtttattcgtgagcaagcaatcattgaagatggtgctgtggttatgatgggtgctacgattaatattggagctattgtaggagaaggaacaatgatagacatgaacgcaacacttggtggacgagctacaacaggaaaaaatgttcatgttggtgcaggtgctgttttagctggtgtcattgaacctccaagtgcttccccagttgtcattgaagacaatgttttaattggagcaaatgctgttattcttgaaggtgtacgcgttggtgcaggtgctattgtagcagctggagctattgtaactcaagatgtgccagctggagctgtagttgctggtacgcctgctaaagtaattaaacaaacttcagaagttcaagactcaaaacgtgagattgtgtctgcactgcgtaaattaaataatgaataa

SEQ ID NO: 615 - DNA, 258 bp, Staphylococcus epidermidis
ataaaaggagttctaaccatgattgcaaacgaaaacatccaagaccaagcactagagaactttaaatcggaaaaaactgaagtcacaattttctttttaaatggctttcaaatgaaaggtgtcgttgaaaattatgacaaatatgttgtaagtttaaattctcagggtaagcaacatctgatttacaaacatgcgatcagcactttcactgtagataatgaatcgtctgaagcaactgaagtgaatagtgaagaataa

SEQ ID NO: 616 - DNA, 552 bp, Staphylococcus epidermidis
tgtaggggagttttaattatgaaagagaatattttgccagctattagaaatatgagagatttagaaaagttaattaaaacagactacaaagcatgtgttgtgttagatatgcatataggtcatttgaaaagcattatggagttacttaaaagtcattcgattgaatgttatgtacatatcgatttaatcaaaggactcagtcatgatgaatttgcttgtgagtacattattcaacaatataaacctaaaggtattgtttctacaaaagctaaggtcatcaaaaaagctaaaatgttaaatactttgacgatatttagagtgtttatcatagatagtcaagcattaacaagaagtattgaactcattaaaaaagtagagcctgactatgttgaagttttacctggtgttgcaagtaaagcagtgagtaaaattcaacaagaaacatcagcgtcagtaatagctggtggtcttatcgatgaacaatcggaaattagagaagcaatttccaatggcgctaagtacgtcactacaagttacgagaaactttggtaa

SEQ ID NO: 617 - DNA, 2187 bp, Staphylococcus epidermidis
atgaatatggtaaggagtgattatatgagtaaaaaaagaatttacgaatatgcgaaagaattaaatctaaagagtaaagagattatagatgagttaaaaagtatgaatgttgaagtgtcaaatcatatgcaagctttagaagaagaacaaatcaaagcattagataaaaaatttaaagcctctcaagcgaaagacactaataaacaaaatactcaaaataatcaccaaaaatctaataataaacaaaattctaacgataaagaaaaacaacaaagtaagaataatagtaaaccaacgaagaaaaaagaacaaaacaacaaaggaaaacagcaaaataaaaacaataaaactaataagaatcaaaaaaacaataaaaataaaaagaataataaaaataataaacctcaaaatgaggtagcagaaacaaaagaaatgccctctaaaatcacttatcaagaaggcataactgtcggtgagttagctgaaaagctaaatgtagaatcagctggtattattaaaaaattgttcttactaggtattatggctaatatcaatcaatcattggatgaagaaacattagaattaattgcagatgactatggcgttgaaatagagaaagaagtagtcgttgatgaagaagatttatcaatttattttgatgatgagactgatgattctgatgcaattgaacgtccagcagttgttacaatcatgggccacgtagaccatggtaaaacgactttattagattctattcgtaacactaaagttacagaaggagaagctggcggaatcactcaacatattggtgcttatcaaattgaaaattcaggtaaaaaaattacgttcttagatactcctggacatgctgcatttacgactatgcgtgcacgtggtgctcaagttactgatattacaattttagtcgtggccgctgatgatggtgtgatgcctcaaacaattgaagctataaatcacgctaaagaagcagaagtacctacgattgttgcagtaaacaaaattgataaaccaactgctaaccctgatcgtgttatgcaagaactcactgagtatggattaattccagaagactggggcggtgacacaatctttgtaccactatctgcattgagtggagacggtattgatgatttattagaaatgatcggtttagtagcggaggtacaagaacttaaagctaatcctaataaacaagctgtaggtactgtgattgaggctgaattagataaatcacgaggtccagctgcatctttacttgttcaaaatggtactttaaacgttggagatgcaattgttgtaggtaatacttatggacgtatacgtgcaatggttaatgatttaggaaaaagaattaaatctgccggtccttcaacacctgtagaaattactggtattaacgatgttccacttgcaggtgatcgttttgttgtatttggtgatgaaaaacaagcacgtcgaattggtgaagcacgtcatgaggcaagtgtcatacagcaacgtcaagaaagtaaaaatgtttcattagacaatttatttgagcaaatgaaacaaggtgaaatgaaagatttaaatgtcatcattaaaggtgatgtacaaggttcagttgaagcattggccgcatctctaatgaaaatagatgttgaaggtgtgaatgtacgaattattcatacagctgttggtgctatcaatgaatcagatgttacattagcaaatgcatcaaatggtattattattggttttaatgtacgcccagatgcaggtgcgaaacgtgcggctgaagctgaaaatgtagatatgcgattacacagagttatctataatgttattgaagagatagaatcagctatgaaaggtttacttgacccagaatttgaagagcaagtcattggacaagctgaagtgcgtcaaacatttaaagtttctaaagttggtacaattgctggtagttatgtgactgaaggtaaaatcactcgtaacgctggtgtacgcgtaattagagatggtatcgtgttatttgaaggtgaacttgacacattaaaacgtttcaaagatgatgctaaagaagtagctcaaggctatgaatgtggtattacaattgaaaaatataatgatctcaaagaaggagacattattgaagcgtttgaaatggtagaaattcaaagataa

SEQ ID NO: 618 - DNA, 801 bp, Staphylococcus epidermidis
ctatttcaggtcgtggagataaagatatggaaacaattaaacaatacaaagaaaacggtggtgaacaaaatgagtaaattattcattccgtatattatgggtgatttaaattttattcatcatttaaaaacattaactgagaatggagcagacattgttgaaattggtgtgccattttctgatcctgttgcagatggacctataatcatgaaagcagggcgcaacgctattgacgagggttcaaacattaaattcatttttgatgaattaataaaaaataaaaatactatttcatctaagtatgtattaatgacttattataatattctaagtgcttatggagaagaattatttttggataagtgtgatgaagctggtgtttatggtttaattattccagatttaccttacgaacttacaaaaaagtttaaaaaagatttttatcatcattctgttaaaataatatcgttaattgccatgaccgcaagtgatgctaggattatgcaaattgcaaagaactcagaaggatttatttacacggtaacaatgaatgccacaacaggtaacagtggggagttccatccagatttaaagagaaaaattgaatatataaaaaaagtttcaaaaattcctgtggttgctggatttggtatcaaaaatcctgaacatgttaaagatatagcgtccgttgcagatggtattgtaattggtagtgaaattgtaaaacgtattgaaatagattcaagaaaagaatttatcacttatatcaaatcaataagaaccacgttgaattctttataa

SEQ ID NO: 619 - DNA, 681 bp, Staphylococcus epidermidis
tttgaagaggtgtatatattcatgagtaaaaaagttttatttgttttaacaagtacaagtcaatttacagacggtacagaaactggattatggttagaagaagctggagcaccatataatatattgactgaagaaggtatcaatgttgatgttatttctattaaaggtggaaaagtaaatcttgatcctaattctgtttctaatgaatcactgaatcagtatgctaaattcgtgtcacacttaaacgatacacctagtatcgaaaatgtaaatgcagatgagtatgacgctatttatctaccaggtggacatggtactgtatacgattttgccaataatgagaaattagctgatattttacttcaatttaaaaatagtaataaaataatctcttcagtatgtcatggacctagtgcgtttgtaggtgtaaaagatgcaaataatcactatctagtagatggtgtcaaaataacttcatttactgatagtgaagaaaaagcaatgggatttgaaaataaagtaccatttttaactcaatctaaattagaagagcaaggtgcaaattttgtagtgaaagatgactttacatctcacgtagaaaaagacggtcaatttatcactggacaaaatccccaatcaagtgaagacattggtaaagcacttgcaaatgaattaaaataa

SEQ ID NO: 620 - DNA, 381 bp, Staphylococcus epidermidis
ataaacctatttttctcaattttaactcttttagaattacgcattgatgtttacttggcaaatttattaattattttagtcccatctattacatcagctatcttaattattttcacttcaaaaatgaaattatatttatggttaaatgtaatttcaaacctaattttttacattatttatagtaaatatatcatgcatctagatggttatctatcctatatcgagagggcgcaaatcaataatagtgatatagaaattaaaatatctccaaatatgcttgaattatctcagattatctttttattttttgtttatttaatacctcaaatgattgtagtttttattaaacataaaagaggtgaaatcaatgctagaatttag

SEQ ID NO: 621 - DNA, 156 bp, Staphylococcus epidermidis
attacagtatttatagcattctatattttgggaaacttgtctgacacaaaaaaacttaatataagcgtacttttaattaatttaatcataagattacctatacgtcatacacacttgagatatcaactgataactcaagtgtttttttatgtttaa

SEQ ID NO: 622 - DNA, 246 bp, Staphylococcus epidermidis
ttattggtattcctctatacgctgtacttaaggtattggtttcacacatatttatgttatttaaacgaagatacaatcgctactatggaaatgatgctggtgagtacattatcactgaagaagaaaaaggaattaaacaataatatatataattttagactggaacaacaaaacaacaatgttccagtcttttttatttttaaatcacatacatttgcaatcatgatatgcttagtaatcatatga

SEQ ID NO: 623 - DNA, 1677 bp, Staphylococcus epidermidis
ataatgtcattatctacattgaaaagggatcatattaaaaagaatttaagagacactgaatacgatgttgttatcgtaggtggcggtattacaggtgcaggtattgctttagatgcaagtaatcgtgggatgaaggtagctttagtagagatgcaagactttgcacaaggtacaagttcacgctcaactaaacttgtacacggtggtttaagatatttaaaacaactgcaagtaggggtagttgcagaaacaggtaaagaacgtgctattgtttatgaaaatggtccacatgtgacaacaccagaatggatgcttttacctatgcataaaggtggtacatttggtaaattctcaacttctattggactagctatgtacgatcgtctagctggtgtcaaaaagtccgaacgtaaaaaaatgttatctaagcaagaaacgttaaataaagaacctttagttaaacgtgatggattaaaaggcggtggctactatgtggaataccgcactgatgatgcgcgtttaactattgaagttatgaaaaaagctgctgaaaatggagcagaaatcattaattatacaaaatcagaacacttcacttatgattccaataagaaagtaaatggtattgaagtattggatatgattgatggcgaaacgtatgcgattaaagctaaaaaagttattaatgcttctggtccttgggttgatgaagtgagaagtggcgattatgcacgtaacaataagcaattaagattaactaaaggtgtacacgttgttatagatcaatctaaattcccattaggtcaagcagtttactttgatactgaaaaagacggacgcatgatttttgcgattccacgtgaaggaaaagcttatgtaggaacaactgacacgttttatgataatgaaaaagcaacacctttaacaacacaagaagatagagactacttaattaatgcaattaactatatgttcccaacagttaatgttaaagatgaagatattgaatcaacatgggctggtattcgtccgctaattcttgaaaaaggtaaagatccttctgaaatctcacgtaaagatgaagtttgggaaggtgaatctggattattaactatagcaggcggtaaattaactggttatcgtcatatggcactagaaattgttgatttattagctaaacgtttaaaacaagaatacggattgaaatttgaatcatgtgccacaaaaaatctaaaaatttccggtggtgacgttggcggaagcaaaaactttgaacactttgttgaacaaaaagttgatgcagctaaaggatttggaattgatgaagatgtggcacgtcgcttagcaagtaaatatggttcaaatgttgatcaactatttaatattgctcaaacggcaccatatcatgatagtaaattaccattagaaatttatgttgaattagtttatagtattcaacaagaaatggtttacaaaccaactgacttcttagtacgtcgttctggcaaattatactttaatattcaagatgtgttagattataaaaatgctgtgatagatgttatggcggatatgcttaattatagtgaaactcaaaaagaagcttatactgaagaagtagaagttgcgattgatgaggcacgtacaggtaatgatcaacctgcaactaaagcttaa

SEQ ID NO: 624 - DNA, 867 bp, Staphylococcus epidermidis
ttggctacatttaaagattttagaaataatgtgaagccaaactggtgccctggttgcggtgacttttcagttcaagctgctatacaaaaagcgacagcgaatattggtttagaaccagaagatgtagcaatcattacagggattggttgttctggtagactatcaggttatattaattcttatggcgtacactctattcatggacgtgcattgcctctagcacaaggcgttaaaatggcaaacaaagatttaacagttatcgcttctggtggtgatggagacggctatgcaataggaatgggacatactattcatgctcttagacgtaatatgaatatgacgtatattgtcatggacaatcaaatatatggattaactaaaggacaaacatcaccttcctcagctaaaggatttgtaactaaatcaacacctaaaggaaatatagaaaagaatgtagctccattggaattggcactgtcctctggtgcaacttttgtagcacaaggattctcaagtgatataaaggcattaactaaaatgattgaagatgcgattcatcatgatggtttttcttttgttaatgttttctcaccttgtgttacttacaataaagtgaatacttatgactggtttaaagaacatttaacaagtatcgatgatattgagggctatgacatcacagataaacaacttgctatgaaaactgtgctggatcatgagtcactggttaaaggtatcgtttatcaagatacaacaacaccttcttatgaatcgcaaatttcagaactagaacatgaggcgttagctaaaagagatattcatattacagaagaaactttcaacgatttaactgcacaatttttataa

SEQ ID NO: 625 - DNA, 129 bp, Staphylococcus epidermidis
caaaatacatttatctcactgaatagtcatattaaaataaaaaaactgctcgcaaagcatttagctttgtcggcagctttttacagaacaaatacattaagttcatatatgatacattttaatttttag

SEQ ID NO: 626 - DNA, 123 bp, Staphylococcus epidermidis
ctgttcacattatttatgtatttaataataactctgagtaaaatttcatttgttaaatactttatctatatttttaaaataatttggaataaattatgtcattcttatattatttacttttag

SEQ ID NO: 627 - DNA, 639 bp, Staphylococcus epidermidis
gatgatttttcggaggttaatatggacaaatttaaatctatgacagaattaaaagaattgactaaagaaggaaaagattgggaaatagagtgtgaaaatcgttctagcatagtcactatattagcattacatggcggtggaattgaacctgccacaactgaattagcctatacaattgcacattgtggcgactataactatttttcctttaaaggtatgagaagtaaggggaataatgagttacatgtgacttccacacattatgatgaccaaattgcattagatttagtgagaggtagccaaagaactgtagccatccatggttgtgaaggtaatgaaagtgtggcttatataggaggtagtgatgacagactaattgagttaatcaccgaatctcttgaagatataggaattagcgtgcgagaagcaccacatcatatttctggaactcaagaaaataatattgttaatatgactcaaacccaaggaggagtgcaattagaactgacagctcagttaagaaaggagctatttaaaaatagaaaaagttcacgcaaaaaccgtgaaaataaagataattgggatgatttaatgtacgactttgctgatgcaatgaaaaaagctatagaacgtgcataa

SEQ ID NO: 628 - DNA, 2049 bp, Staphylococcus epidermidis
ttgatgaaattttcgtgggtacgttggattttatatattgttgcattatttttaccaatttttattttttataccgtcgcacgacctgtagatagaaataatcgtaatatgggtgtgtattgtacagttgtatcatgtgttgagtggatggcagcagctactgtattatattttgctgcattgattgtcgatatacatatctcatttatgacttttgtacgtatatttgttattgcagctttatctggtttagttagttttattccaggtggttttggcgcgtttgatttagtcgtgttactaggactgaaatcacttggtatttctgaagaaaagatacttctagcattagttttatatcgatttgcttattattttgtgccagtgatgattgcacttatactatcttcatttgaatttggaaatactgctaaaaaatatctcgacaattcgaagtactttatacctgtaaaagacttcacttcatttttgaggtcttatcagaaagatattttagctaaagtgccttcattttcgttagcgattttaatatttttaactagtattattttctttattaataatttaactattgtctatgatggattgtatgatggaaatcattttgcctattatattgctttagctgtacaaacgagtgcttgtttgttacttattttaaatgtaagaggtatttataaaggcagtcgtcgtgcaataatttatgcctttatttctattattttaattgctagtgcgactatatatacttatgcgtcatttttattattgtcatggctcattatcatatttgtgttactgattttagcttatcaacgtgctcaagtacttaaacgaccattacgctttaaaaagttggcggttatgctacttcttagtatctttattctttatttaaatcatattttaatatcaggaactttatatgcattagatgtttatcatattgagattgatacgtctttattacgatattacttttggatgaccattgttattattatgctactcgttggcgttattgcttggctttttgactataagtataaatgccctcatcatagcattgatttaacactttgcgatgcaattattcaaaaatacggtggtaattatttaagtcaccttgtttatagtggtgacaaagattgtttctttaatgaaaataaagattcatttattatgtatcgatataagtccaatgcccttgtcgttttgggtgatccaattggcaatactaaatcattcgagtcattattagaagcattttatcagtttgcagagtatcaaggttatgagattattttttatcaaataagtgatcaatatatgcctttatatcataattttgggaatcaattcttcaaattaggtgaagaagctattattgatttaacaacgtttacaacatctggtaaaaagcgacgtggtttcagagcgacgctcaataaatttgatgatttaaatatcaattttgaaattattgaaccaccatttactcaagatttctttgatgaacttaaatttgtgagtgataaatggttggatggaagaagtgaaatgcatttttctgtaggtcaatttactcaaacttatttatcgaaagcacctattggagtaatgagagatcactctggcaagatgattgcattttgtagtttgatgcctacttattctaataatgcaatatctgttgatttaattagatggttgcctgaattggatttacctttaatggatggattatatcttcatatgttgttatggagtaaagaaaaggggtataaagcatttaatatgggaatggcgacactctcgaatgtaggtcaattgcattattcttatttaagagagagaatggcaggacgtgtatttgaacatttcaatggtttataccgttttcaaggattaagacgttataaagaaaaatatagccccaattgggaacctagatttttagtttatcaaaagcattattctctgtgggagagtatgcttaaagtgatgagagtcatacgccataaataa

SEQ ID NO: 629 - DNA, 204 bp, Staphylococcus epidermidis
tcatatatttcactttgtcgcttagtgagttctctcataaataggcactccttattgttgtttgagattattatatcattaattacattttctaacacacatttgttcgtaatgttgttgacacagaatttatgttctgataaattacttatacaaacaaatgttctaggagtgatattggatgattttaaaatacaaatataa

SEQ ID NO: 630 - DNA, 627 bp, Staphylococcus epidermidis
  modified_base (502)..(502): a, c, g, t, unknown or other
atggcaatttcagcaaaacttgttaaagaattacgtgaaaaaactggcgcaggaatgatggattgtaaaaaagcgctaactgaaactgatggtgacatcgataaagcgattgactacttacgtgaaaaaggtattgcaaaagcagctaaaaaagctgaccgtatcgcagcagaaggacttgtacacgttgaagtaaaagataatgaagctgcaatcgttgagattaattcagaaacagacttcgtagcacgtaacgaaggtttccaagaattagttaaagaaattgctaaccatattttacatagcaaggtagaaacagtagacgctttgatggaatctaaattatctagcggtaaaactgttgatgaaagaatgaaagaagctatctcaacaattggtgaaaaattaagtatccgtcgtttctctatcagaacaaaaactgataatgatgcatttggtgcatatttacacatgggtggacgtattggtgtgttaactgtantggaaggtactactgatgaagaagctgctaaagacgtagcaatgcacattgcggcaatcaaccctaaatatgtttcttctgaacaagtaagcgaagaagaatcaatcatgaaagagaagtattaa

SEQ ID NO: 631 - DNA, 873 bp, Staphylococcus epidermidis
acaaagatttcatgtgcttcgttgttaacaaggggtgatcaagaaatgacttttgcaaaaaggaaagagtggtacttagaatatgagataactgtaaatcgtgctggcttactcggtgatatttcaagtttgcttggaatgctcggcattagtattgttacaattaatggtgttgatcagggaaaaaggggattgttaattaaaacagatcaactagaaaaggtcgaaaggttcgaacaaattgtaaaagaaattaatgaaatagaaattacaaagttaagagttcctgaattacgagatagactcgctgtacgacacggtagatatattgaacaagatgctgatgataaaaagacttttaaatttgaacgagaagatttaggattacttgttgattttttagctgagttatttaaagaagaaggacataaattaatcggaatacgtggaatgcctagagttggtaaaactgaatctattgtagctggaagtgtttgtgcacataaaagatggttattcataagctcaactttaattaaacaaacagtaaggcgttcactatttaaaggtgaatatgattctaatcacgtatatatcattgatggtgcggtaacagcacgtgaattgaaccctgagcaccaagaattggtgagagaggttatgacgttaccctcaataaaagtagttgaacatccagatttatttgtagagtcgtgcaattataatatggaagattttgactatattattgaattgagagaaaatgaagatcaagagattcgatatgaagaaatgaagaaacatacggttcaaagcaagaataatttagattttggagatccatttggtggagggtttggtttctttgaataa

SEQ ID NO: 632 - DNA, 471 bp, Staphylococcus epidermidis
gaggatgtttcaatgaaaaagtggcaattagtcggtactactgtattaggagcttcggttttacttggcgcttgtggcggaaatgatggaggttcaggagacggcaaagatcttaaaggttctgctaaaggtgaaggttcgtccacagtagctcctatcgttgaaaaattaaacgaaaaatgggctaaagatcataaagacgccaaaatttcttcaggtcaagccggtacaggtgctggtttccaaaaattcattgctggcgaaactgatttctcagacgcttcaagacctattaaagacgaagaaaagaaaaaattagaagataaagggattaaatatcacgaattcaaaatcgcacaagatggtgtaacaattgcggttaataaagataacgactttgttaaagaattaactaaatcacaattaaaagatatttactctggtaaagctaaaacatggaaagaccgttaa

SEQ ID NO: 633 - DNA, 135 bp, Staphylococcus epidermidis
ttactcccttcattcgaatatttaatttttcaaggcagtaaaatcaaaaaattaaattttattttaaaatttttaactttaccaatacactttaatagattaacaaaggtcttcaacattatcaaatttacataa

SEQ ID NO: 634 - DNA, 747 bp, Staphylococcus epidermidis
aggagggaattaccagtgatatcaacttattttaaaatagaattaaagattatatttagaaagaaattgtatttagttatgtccatattcctacctgtcgtgttttatttattatttacttctatattagacatgccagaagaagcaaaacttaagttttataaagagtatatgtacagtatgacagtatttagtttaatgaacttttgtctattgtcatttccattagatttgattgaagagcgaaatcaaggttggtataagcggttaatggtgaccccattatcatcatttcaatattatttagttaaaattagtaagacaatgtgtcagtttttaatagcaattacaattattttttcagtagctcatttttacaaagatgttcacatgactgtttttcaatggatattctctgcattaactttatggattggggttagtttatttttgactttaggattgattatcgctcaactcaacgatattcaaaaagcaagtagttttgccaatttacttaatattacactagctatattaggaggtctatggtttccagtatacacgtttcctgattggcttcagtcgatttctaaacacatgccaacatataatttaaagctacttgctatagatttagcgcaaaataaaggggtgaatatagaagcgtttggctatctcgtggtctattgtataatctttgtgagtattgctttattcatgaataagaaaggagatgtacactaa

SEQ ID NO: 635 - DNA, 132 bp, Staphylococcus epidermidis
ctcaatcgttcattatacgtaattttgatttatactttaattttatatattagcacacaattaataaggggtttcaacaattctgcaatgcattgtagaattatcttgagtggtattacttattatgcttaa

SEQ ID NO: 636 - DNA, 165 bp, Staphylococcus epidermidis
ttaaaaagttctttcaatttctcgataatcgatttcattttaaataaaaatatttcatcagtttatttaagtgctggatggagaggcttgaatttagaaattatgatggaattcattttttatttaaccaccattagtccatttgattttctactaaaaagctga

SEQ ID NO: 637 - DNA, 165 bp, Staphylococcus epidermidis
tatttaatctctaaaaagtctgaaaaaagcaaaagttttctatttgatacatttatgcacaacataatcacgcagttgcataaactactgttactttttcatttgaaatgtaatagcattatcgctatacttttaaatcgtaataattacgtttttcagaaataa

SEQ ID NO: 638 - DNA, 810 bp, Staphylococcus epidermidis
tttttattatctgttgaatgcattgatctatttggttgttctggtgcacctgattgtgctggcgtacctggttccactggtttacctggttccactggtttacctgattccgctggtttacctggttctgctggcgtacctggttccgctggtttacctggttctgctggcgtacctggttccgctggtttacctggttctgctggcgtacctggttccgctggtttacctggttctgctggcgtacctggttctgctggcgtacctggttccgctggtttacctggttccgctggtttacctggttccgctggtttacctggttctgctggcgtacctggttccgctggtttacctggttctgctggcgtacctggttccgctggtttacctggttccgctggtttacctggttccgctggtttacctggttctgcttttgttggaccatactcaacaatttcgtcaacaggttgtttagtgactttttctgttgatttaccttcgccaactttttctcctgtaataggattaactaatattggtgttgtaattgtttttgttcctggttcacctttttgtttaacgcgctcttcacctggttttaaatcaggattaaatacacgtttcttatcaaatggaatctcttccgttgatgtgattggattaccaactttcggaccatattttgtcacatcatccactggtggggtaacaacttcacctgtatcaggatttttaactcctggtttacctggaacttcagttttactatctacaggtgcatttggatcaaattcatctttatga

SEQ ID NO: 639 - DNA, 378 bp, Staphylococcus epidermidis
gtcatgacatctatagtagtagtaagtcatagtcataaaatcgcagaaggtgttaaacaattaatcaatcaaatgactgacggtggtgttgaccttattgccgttggtggcttaagtgacgatgaaatcggtacatcatttgatcaaatcgtctctgtaattaatggacttgaaaatgatgcgctttgtttctatgacattggttcagcaggcatgaatttagacacagctttagaaatgtacgaaggtgaccacaaaattgttaaaatggaagcgccaatcgttgaaggaagctttattgcaagtgtaggaattaaatcaaatatgagtatggatagtgttatctctgaagtaagagctaaatatcctgaagaataa

SEQ ID NO: 640 - DNA, 1617 bp, Staphylococcus epidermidis
aaacttggatcatattccactaatcccacaatcacgtgtatccaatattccacatcatcaatttttggagatgattcaatgaagacctataagccgtaccgacatcaattaaggcgttcgctatttgcctcaacgattttcccagtatttatggtgatgattattggtttaataagcttttatgctatttatatatgggtcgaacatcgcaccattcatcagcatacctatcaaactcaaaccgaattacaacgtatcgacaaacattttcatacgtttgttacgcagcaacaaaaacaatggcgtcatgttgatttatcacatccagctgatatcacaaagatgaaacgccaactattaaaacaagtccatcaacaacctgcgatattgtattacgatttaaaaggttcttcacaatctttcacaaacaattatgaacaattagacacaacaaagatgtatttaatatcaaaatatcgaattgattttaaagacgatacttatatccttaaaatatatatgtcaagcacaccactacttaaaaacattaagaaaaatagtggacaatctgcactcattgttgattcatatgatactgttttatatacaaatgacgaccgattctctatcggtcaaaaatatcaaccaccacagtttgggtttataaacgagtctttaaaactcaattctcatcatgcgcatcttattatatataaagatattcatgaaaccattgaagatggaattgcattactagttgtcatgggtgttgttcttattctgcttgttatttttggatatataagcgctgatagaatggcaaagcgccaatctgaagatattgaagcgattgtccgaaaaattgatgatgctaaaaatcgacatcttggtagttacgaaccgttaaaaaaacatagtgagttagaggaaataaataattatatctatgacttgtttgaatcaaatgagcaattaatacaatctattgaacagaccgaacgtcgtttacgtgatatacaattaaaagaaattgagcgacaatttcaaccccatttcttattcaatacgatgcaaacgatacaatatttaattcctctttcacccaaagtagcacaaacagtcatacaacaactatcacaaatgctacgttattctctacgcacagcatcgcacacagtcaaattagcagaagaattaagctacattgagcagtatgttgccatacaaaatatccgcttcgatgatatgatacagctttacatcgatgctactgagggtgtacaacatcaaacaattggtaagatgatgcttcaaccactcgtagaaaatgccatcaagcatggtcgtgatagtgaacctttaaagataacaattcgtatcagacttacgaagcgcaaattacatattctggttcatgataatggcatcggtatgtctccatcacatttagaacacgtgcgccaatcccttcatcacgatgtttttgatacgacacacctaggtttaaatcatttacataatagagccatgattcaatatggaacatatgcacgtctgcacattttctcaagaagccagcaagggacattaatgtgttaccaaataccacttgtctag

SEQ ID NO: 641 - DNA, 7215 bp, Staphylococcus epidermidis
tgtaagttgtttatgagttattatgggaatgaatatgaaagaaggactctaatgaatattgaagcactatattttcaaaaatatttttattttaaacatttaaatcaatcaagttcagaacacagggtgacatactgggtaaagttaagtcgcgacattgagttacgtagattaatgtatgcattattagatgtcgttcaaagtcaacctgtgttgcgtacacagtttgtgacagatgattttaatcaactcaagataaatttaagagatttttttccatttattgaaattaaagaagttaatgaaatgtcgcaaagcatagatttagaagcattctttacacgtaatttaaattcctaccatttcaatcaattacctctgtttaattttaagatttatcaatttcttgatgaagcctacctacttttagattttcacgctactatttttaatgaaagtcaattaactccatttttacaacaattaaatatcgcttatacccactctttaaaaagtgaatatagtatctcggatttttataattggattaaagaaatgaatcaaaagatggatcaaaatcaagttgtgtgtccatcaaagcacttcaacgtattgaatgcagacggtgataattacgcttacatacctgttaagaatacatgtgaaaagaaaaaaatgtgttctttgcatgcagaactaccatctttagacattgatgtgtggattgtaagtatttacttagcgcatcattttataagtcagtcttctgatgtgacgttaggcatccatttttcgatagataataaaaatactgagaatatgatggttttaaacacagacattgccccacttaatttaagtattagtcaaagtgacgtcgtaaaagatatggtagatgagtgttccgctctacttgaagagcttcaaatgtgtggtgcgtcttttgttgttcaacctaaagcagtacaaatagatgtagaaacgatgattcatattgaaaaagtacaagaacaatttgagcttaatcatatatgtcatcatatacatcgtctatacaatgaagcatcatcattcgcggatttagagttttatcctcatgtgcaggatggttttgatatagtttataatgacaacgtttatgatgatttaactgtacatacgttagtcaaattaattaatgggatttatatgcaaattacacaaaatccatcattattaattaaagatataaaactcagtgatcgctcagatttagctaaatataatgacatcaatcttcaaaacaatgacattaattatagtgaggtcacttataaaaccgtggttgaaagattcgaacgtcaagtgcaccaacatcccgatagtattgcgttgcaatatgaacaacgatcgatgacatatcatcaattaaatcaatgtgcgaatcttttagcatatagattgcgtttaaatcatcagattgaacctaatgatatggtggcattaatagcagaacgcagcttagaaatgattattggaatgttagggatcttgaaagctggtgcaggctacataccaattgatccggattatcctgaagaaagaatgaattatattattgaggacgcaaaacctaaagcggttgtaacatatcgtacatcatttcaatcaggtttacctcaaatggatatagaattgatagttgattcaagagaacatgatattgataacccgagaggcattaattgttcagaagatatcgcttatgtcatctatacatcaggaacgactggtaaacctaaagggacactggtgccacatagaggaattgatcgcttagtacacaatccaaattatgtcgaattgaacgaaaatacaaccgtcttattatcaggaacagtagcttttgatgcagcaacctttgaaatatatggtccattattgaatggtggacggttagtcattacatctaaagatacgttgttaaatcctcaattgttagatcaagctattactgaaaataaagtcaacacgatgtggttaacgtcatctttatttaatcaaattgctagcgaacgtatcgaagcactagaatctttaacttatttgcttattggtggggaagtgttaaatgctaaatgggttcacttattaaattcgcgtgagtgtcatcctcaaataatcaatggttatggaccgacagagaatacaacatttactacaacttttgcgattccacaagagatgccttcacgtatacctattggtttacctattagtggaacgacagtttatgtcatgcaaggtgatcgtatttgtggcgtaggtgttccaggtgaattgtgcattggtggtgcaggtttagcaaaaggttatttaaatcaacctaaacttactgctgaacgttttattcagtcaccttttaataatgaaatgctttatcgaagcggtgatttagttcgccttcaagaagatggctatattgattatattagtcgtatcgataagcaagttaaaatacgtggttttagaatagaattatcagaaattgaaaaagcattagaagctatacgtgatattaataaagctgtagtcatcgttcgagagcaagaccaagataaacaaatagtggcatattatgaagcatcgcaattaaaatcaacaggtcaattaaaagatattttaagtgaaacattacctgaatatatgatacctgtacattttatgaaggtagatcgtatacctatcacgatgaatgggaaattagatgtgcgtgcattacctgaaattaatctaaagaataatagaaattatgtagaaccacgtaacgatattgaacgcactgtttgccgtattttcgaagagattttacatgttgatcaagtaggtgttaaagataatttctttgaactaggtggacactctcttagagcaacattagttgtaaaccgtattgaagaaaggttaaaaaaacgtcttaaagtaggtgatttaatgaaatcgcctactgtagagcaacttggacaacaaattgaagaactgcaaaatgatgtctatgaagtgattcccaaagcaaatgaatcgtatcaatatgatttaagtgcgtctcaaaaaagtatgtatcttttatggaaggtcaatcctaaagacacagtgtataacattccattcttatggagattatcttctgaacttaatgttatgcaattgcaacgtgcattatctaagttgattgaacgtcatgaaatattacgaacacaatatgtaattgatgacaatgaagttaaacaacgtattgcgacacatgtttcgcctgattttgaagaggtaacgacatctctaacgaacgagcaagatattattcaatcatttatggaaccgtttgatttagaacaaccaagtcagatgcgagttaaatatatacatggaccacaacaagattatttatttatggatactcatcatagtattaatgatggtatgagtaacacgattttactatctgatttgaacgctttataccaagataaatcattacctgaacttaagcttcagtataaagattatagtgagtggatggtgcacagagacttatctaaacaacgtcacttttggttacagcaatttgaaaatcaggttccaatattaaatatgcctacggattatcctagaccaagtattaaaacaaccaacggtaatatgttgacgtttcattacaatcgtcaaatcaaacagcaattgaaatcttatgtagaacaacatcaagtgacagactttatgttctttgctagtgcaatcatggtattattgcacaaatatacacgtcaggacgatatcgctattggtagtgtaatcagtgcgcgtactcatcgcgatactgaaaatatgttaggtatgtttgctaatacacttgtatatcgtggtcgaccacatgatcaaaagacatgggatcaattgatggctgagatgaaagagatgtgtctaggggcatatgaacatcaagaatatccttttgaaagcttagtcaatgatcttgttgatgaaagagatgcttcacataatccgttatttgatgtgatgctcgtacttcaaaataatgaaacaaatcatgcgaattttggacatagtcaattgacacatattccacctcagtcaacaacagctaaatttgatttgtcatttattattgaagaagatcaagatgactatgtcgtcaatattgaatataatacagatttatataaacaagagaccattcatcatattgctgaacaacttcaaatgattattaaacatgtaatatctaccgaaaacctaaaaattcaagatattgatgaaaatgatgacttattaatttggttggacaagcatgtgaatgattgttctttagacttgccaaaaaataagtcaatacagcaacttttacatgatgtcatgaaagcgaaagcagatgatgtagcacttaaaatgaatggacaatcgatgacgtatcaagaacttgatgattattctaatagtatggctcaaacattgatacaaaatggcattcaaaaaggggaacgtgtagcccttttaactgaacgaagttttgaaatggttgctagtatgattgctgtattaaaagttggaggttcttatgtacctattgacgtcacttatcccgataaacgcattgaatttattattgaagacgctgaagtcgcagcagtgctcacatatggaaaagcaatatcctcacatataccagtaattaaaattgaagatattgataacactgaaaataataaaaggttaaatatagaatatgcagggaatttggaagatgatatgtatcatatttatacatctggaacaacaggaaagcctaaagcagtatcagtgaaacaacgtaatatattaaatttagtatgtgcttggacaaaaagactcaatttatccgatgatgaagtctatctgcagtacgctaattatgtgttcgatgcttcggcaactgatttctactgtagtttattaaatggatatccgcttgtcattgcaacatcagttgagcggaccaatacagatttattagaaaagttaatttcacaagaaaatatcaccatcgcatctattccactacaggtatataatgtgatgcatcatttctatattcctaaagtgattacaggaggtgcgccaagtactccagcatttgttcaacatatttctaagcattgtgatatgtacgttaatgcctatgggccttctgaaaatacagttatcacatcttgttggatatacgaaaaaggtgacgccataccatcgactattccgattgggaaaccgttagctaatgttgatatttttattatgtcaggcggtaaactatgtggcgttggtattccaggtgaattatgtattgcaggagaaagtttaacttcaggatatttaaacagacccgaactttctgctgaaaaatttataaataatccttttgggccaggacaactttatcgaagtggtgatttagcacgattgatgccagatgggcaaattgaatttcttggtagaatagacaagcaagttaaagtacatggctatcgcattgaactaggtgaaattgaaaatatcattaattcagtagatactgttacagatagcgttgttattttagctaaacagggtgagcgtgaagtgctgcatgcttattatgttggaagtcaagaagatgaaaatcatatttcacaacatttaaatcaatatttgcctaaatacatgattcctaagacattaacagctattagcgaaattccattaacaggaaatgataaggtggatgagtcaagattacctgtacctaatgtacacaaaaataaatttgttgcaccacgtaataatatcgaacgagaaatagcacaaatcgttagcggagtgttggacgtatcgtctatgagtatagatgatgacttctttgaaatgggtggtacatcactagatgctatggtggtagtatcaaaactaaaatcaaatggcatacacattacaatgcaagatgtatatcaatttaaaactgttcgttatatagctaatcacacagaaaaacgccaagcactaccagaagtagtattaccagatcatctaccacaattacaatctttggttgaaagacgataccaactaaaatcacaacacctaacgcaatcatctctaggtcatgtattgctaactggtgcaacagggttcctaggcgcatatttaattgatgaaatgcaagatgatgctgatcaaattacatgtattgtcagaggtcatgatatcaatcaagctaaaactaacttggaaaataatttaaattgttattttgatacggctcatgtggataaattaatgaagcacattgatattattttagcggatttatcagaacttgaccatcttattatcgattcagccattgatacaattattcatgctggagctcgtacagatcactttggcgatgatgaaacatttttcgatgtcaatgtaagaagtacacaagcattaattgatttagctaagaataaaaaagcgaaattaatctatatatcaacgataagtgtgggtacggtatttgaagtacatcaagacgatattacattttctgaaaaagatttatataaaggccagttatttacatcaccatacactaaaagtaagttttatagcgagattaaagtgttagaagcggttaatgaaggtttagcagctcagattataagattaggaaatctgacaagtgcttctactggaccattaaatatgaaaaatttaacaactaatcgttttagtattgtcatgcatgatttattaaaaatgccgtttataggagaaagtatatcgaaagctaaagttgaattttcatttatcgatgtcacagcgcgccatattattaaattggcaagatccaatgcaatacctattatttatcatgtatacgcaccatgttcgataactatgaaacaagtaattgacaatgccaaagggtcagaaatgactgtagtaagtgatagtgagtttgaacagaaattacatgaattaggtatgcatgaattgattggtcttaatagtaatggagataatcaaatttcaggtgtgacagattcaaatatgactcaaacagtaatgaaagaattacaaggtgagtggccacatctttcttaccaatggttgcagcagtggtaccatttattgtttgaaaaatttgatgccaactag

SEQ ID NO: 642 - DNA, 144 bp, Staphylococcus epidermidis
ggttacactcccacacatgtaaaaaatcgatttatttactttgttaaaacgaaagaaatgaaattgtatcaaacttttattgcaattgaatattcacgctttttgattacaatagaagaaacttttacattcatatctttttaa

SEQ ID NO: 643 - DNA, 939 bp, Staphylococcus epidermidis
gcataccatcccttgaaaaatggtgtagaaaataaatttttaataattagtatgtactttaatttaaaaataaaaaggatgaataaaatgaaatttaaaaaatcactcataacagctttagcaaccataactttggtaccatcattgatgattttagatacacagcatgaggcaaaagcagtaggaaattattattacaatggcatggaagatcataatgcgagtgctgcatatcataaagcgaagaaagttgataatagtcaaatagtcataaaacgttataactatgcgcataaaaataaatataaagcagtaggaagagtatcgaacatggatggttggaaaggtccaggcaaagatagtatgggaacaggatttatggtaggcaatcatacgtttgtaaccaatgcacatgttgtagataagaaaaatggtcaaagaacgagtccgagtaaaataaaatttcaattaaacagagacggtaaaaagataccctatcaatttcatgctaaaaagatatataaaatcccttcatacgatatggttgtcgttgaaactaaagaaaatatggctcaaaaagctaacgtgcaaccacttaaacttgcaaccaatcaaaaaattaagagtttaaaatttaacaagaaattatattctttaggatatccagtgatgaacgggaacaatacatatgcatactggaataagttacgttttttacaagaagcatcgaataaatcagaactcatgacaaaagataaatttagagctggtgattcaggatctcctatggtagatagccagtacgttgtttatggggttcgtacgtatggatataatttaagaggtagttctaatcatccttatgcccaacaagaagttgcaggtgcagaatcattatatggtaatccaagagattttattcttaagcataataagtaa

SEQ ID NO: 644 - DNA, 216 bp, Staphylococcus epidermidis
attaaagtaccgccattcatattaaacaacaacatcccatccttacgtatcattgaaaacagaatacctggtgcaagctgtgtaggtacatctagtagccataataaaggtatgaatgcatttgatataaaagtcaaaataggcgtaagagacaatagacttacaataaggcaaattcctataaaaataggtaaggcttgtacaataaacatttga

SEQ ID NO: 645 - DNA, 624 bp, Staphylococcus epidermidis
ttgaaaaagtttttaaaaggatttattttattttttctcattgtgatgctaggatttgcagggggattgggatacagtcattataaagattcaaaagcaaacactgatgtatcttcaaaagagactcagacttcaaataaaaatactcatgaagatacaatttcacaagatgaaatgcaaaatcaagttgatagccaaacaaacgaagtatcaaatgagacatcaactaaaacacttagcgaaaaagcaaagcggttaagagaagcttttaacgttaatgatgaggaagctcaaatattagcagatgaaatcgatagagcagatgtaaataaagatggcacgattactatggatgaaatgacgcctactttagatcgttttgcaaaagaagggaaattccaaccatctgcaggtggcacaactaacgaagcacatcatcctaaatatacagcagaagatgctagaaatatgtcagatgatgaatttctagacgcgtatacagaaggcatgtcagatgatgaagctgcgacaattcacgaaagtgctcaagaatctaacgagtatatgaaatttttaagaggacaagttgaagcacgtgcaaaaggacagggcggtaattattaa

SEQ ID NO: 646 - DNA, 963 bp, Staphylococcus epidermidis
atgaaaaagttaattcaagataaaaacacaattttaaaagatatgcttgatggaattacagtttcaaacaacgatgttgaagttgtatctgacactattgttgttagaaagcataaaaaacaatcaggtgttgcactcgtttctgggggcggcagtggacatgaacctgcacacgcaggatttgtagcagaaggcatgctcgatgcagctgtatgtggagaaatcttcacttcacctacacctgataaaatattagatgccattaaagctgtggacaatggtgacggcgttctacttgttattaaaaactatgcaggagacgttatgaactttgaaatggctcaagaaatggctcaaatggaagatattaaagttgaaagtgttattgtcagagatgatattgctatttctgacccggaaaaacgccgtggtgtagcgggtacagtatttgtgcataaatatgctggatacctagctgaaaaaggtgttgcacttgatgaaatcaaatctaaagttgaggcacttttaccagatattaaaagtattggtatggcattaacgcctccaatggtgcccacaactggtaaaaacggtttcgatattgaagacaatcaaatggaaattggtatcggtattcacggtgaaaaaggtttacatcgtgaagacgtacaacctattaacgtgattgttgaacgtttactcgatcaattatacaaagaaattgagaaaaaacctttaatcgtaatggttaatggtatgggtggtacgccactatcagaattaaatatagttactaaatatctagatgaacaattcaatcagaatgatattgatgttaaacaatggttcgtaggtgactatatgacagcattagacatgcaaggcttctctataactgtactccccttcagtgaagaattgagtgaagctttagctgcacctacagcaagtaaatatttttaa

SEQ ID NO: 647 - DNA, 843 bp, Staphylococcus epidermidis
tgggaaaagttatttcaacggcgcaccgtggctcttcttcttccctggtgtattgttaggaggtttcgccttattatgtcaaattatcaacaaaaaaataacgcagtaaatacggtagtcaacgtcaatcaattatcgattttagatcaagagaaagtattgttaaaggatgttgatttgacagtaactaaaggtgcatttcattgcattataggtgaaagtggcagtgggaaatcactgttaacaagaacaatacttggaatgaaacaatcacaattatgttatcaaggagatattgacatcgatttaactcaaacagatgcagtgtttcaagatgttcaaagtaatatgtttcaaaatataacattagctaagcatttccaatacatttatgaagccaatcgcacacatctcactaaacagcgtattaaggaagatgtcttacagatgatgcaattacttggtttaagacaaggggaacaattgcttgagcgttatcccttcgaacttagtggaggtatggcacaacgtgtcgcctttataatgtcattaattagacgtccgaactacttatttttagatgaaccaacgagtgcacttgatcaagaaaatattaaaaagtttatgcattaccttcttagggcacaggagcgctaccaaatgaccattgtttttatcacacatgatattaacttagtgaaagattgtgccacacatattagtattatgcagcaaggtaaattgatagaaaatggtgaggccgcgtcgatcttaactaagccgacacataattacacgaaaaaattaattacgattgcacatcggagacaaccttatgcttaa

SEQ ID NO: 648 - DNA, 231 bp, Staphylococcus epidermidis
gctcccattacaattccaattacagtattcgtcgcccccaagtcatgtcctcttagaggtatgaaaacattgagtatggcattcgcactaaaaaacatcaatgttaaaatatataatcttaaaaaaggccaagacatggcacctttcatattgtcactccttagattgatagttgtttatcaatcagttctcttgtataaccattttgttgcctatgcaattcacttatag

SEQ ID NO: 649 - DNA, 984 bp, Staphylococcus epidermidis
aagaaggagttaaagattatgacattaaacctagctcaacgtgtgttaaaccgagaaccattaactaaagaagaagcattaacaatttttgaaagttccgaactagatacatttgatttattaaatgaagcctacacagtgagaaaacattactatggtaaaaaagttaagcttaatatgatattaaatgctaaaagtggtatctgtgcagaagattgtgggtactgtgggcaatctgtaaaaatgaaagaaaagcaacgttatgcacttgttgaacaggaccaaattaaagaaggcgctcaagtggcaactgaaaatcaaatcggtacatactgtattgttatgagtggtagaggtcctagtaacagagaagtcgatcatatttgcgaaacagtagaagatattaaaaagatacacccacaactaaagatttgtgcgtgcttaggattaacgaaagaagaacaggctaaaaaattaaaggctgctggtgtcgatcgttataatcataatttaaatacgagtgagcgttatcacgatgaagtagtaactacacatacatatgaggatagagtgaatacggttgaaatgatgaaagataataatatttctccttgttcaggtgtgatatgtggtatgggagagtcgaatgaggacattattgatatggcatttgctttaagagccatcgatgctgatagcattcctattaattttttacatcctattaaaggaactaaatttggtggattagatttattgtcaccaatgaaatgtttaagaattatagcgatgtttaggttaatcaatccaacaaaagaaattcgaattgcaggtggacgggaggtaaatctacgttcattacaaccactcgcattgaaagcggctaattcaatttttgtaggagattacttaattacaggcggtcaaccgaatgaggaagattatcgcatgattgaagatttagggtttgaaatcgacagttaa

SEQ ID NO: 650 - DNA, 429 bp, Staphylococcus epidermidis
atggaaataacaagtgttaatcatatttgtttttcagtgagtgatttaaatacctctatacaattttataaagatattttacatggtgacttattagtatcaggtagaacgacagcatatttaactattggtcatacttggattgcactgaatcaagaaaaaaatataccaaggaatgaaataagtcattcctatacgcacattgctttctccatagatgaagaagattttcaacagtggattcaatggcttaaagagaatcaagtaaatattttaaaagggcgaccaagagacattaaagacaaaaaatcgatatattttacagatccggatgggcataaaattgaattacatactggaacattaaaagatagaatggaatattataaatgtgagaacacgcatatgcaattttacgatgagttttga

SEQ ID NO: 651 - DNA, 138 bp, Staphylococcus epidermidis
aagaaggtaacattacatactagatacataaaatatatgtatcttacatttaaaattaaatacatgggaggtataatatgggcaaacgtagacaaggtcctattaataaaaaagtggattttttacctaacaaattaa

SEQ ID NO: 652 - DNA, 822 bp, Staphylococcus epidermidis
aagcacgtgacactgcttaaagtagcacatttaggaattaaggacacatggtcagatgagacgctcgttgataacgtgaatttcacagttcaatgtggagaaacattaggtattattggagaaagtggaagcggaaaatcgattacttgtaaggcattaataggtttaaacgctcaacgtttatctgtaagcggagatatcttttttgaacatcaaaatttaaatacaataactgaaaagcaactacgcaaaattcgtggtaaagatattgcgatgattatgcaacaaggaacacgggcatttgatccttcaactaaagtgggaaagcaaatgattgaaactttgcgtgcacatacgacattatcaaagcaacaaataaaacaagaacttattcattatatgacgtatatgaagttgaaagatcctcagtcattattaaaagcatatccctacatgttgtcaggtgggatgcttcaacgtatgatgattgcactagcattagcattgaaacctaaattgatcattgctgatgagccgaccacagcattagataccatcacacaatatgaagttatcaatgcttttaaagatataaaacatcattttgattgcgccatgatttttatatctcatgacctcacagtgattaataaaattgcagaccgtgttgtagttatgagagaaggtcgtgtgatagaagaaggtcgaacaaatatggtattacaacaacctcgtcatcactatacagcttatttattatcaactaaaaagacaatttatgattattttcagtttgtgctgaggggtgatttcaatgcttaa

SEQ ID NO: 653 - DNA, 930 bp, Staphylococcus epidermidis
tttcattatttaaaggagagaaacgaaatgaaaagacactttttagcaatcggagcaattacaataacaacattacttgcgggatgcgattttggagatttggtaggacagcatcagtctgataagcaatcagaaaatagtaacactcaaaccgagcaagcttcaaataataaaaattcaaattctgataatgatcattcaaataataacgatgagtctagagatagagtggaagatttaactcaatcgcagaaggtagcattagctatcaatgatccctcagtttctcaatatgtcgttaatgcaagtgaattaaggaatcattcattttatgcaaattataacggcggaggccaacgtaaaagtattcatacgtataagttggaatcattacccaaaaaagtagaaggtgcacctaatgatatgacattctatactgcaaaaccatcaaaagggtcatttgttactcttatcggtattggtaatgaaaaggtattaattgcaggcacacaaagttcaggtacatatcaacaatatgctcattcggaagcagcaagagaattagatttacatgaattattagataaatacggtaaaagttcaaattataaaaatctagcaaatcaaattacgtttacacaaggtcaattatcaaatgcaagtgaatatacatcagatgaagggacgtctaataatgatgcatctaatgatgacaaagttactcgtgataatgtaatagataaagttgaagcgtatgaaggtcatcagctagataccgatacgtatacatttaaagaacccgaacagaacgaagacggagattggggattttctattttagataaggaaggcaatcttgaaggttcttatattgtgacatctgatggtgaagttacaaaatacgatgaaaacggggaagaaatagagtaa

SEQ ID NO: 654 - DNA, 198 bp, Staphylococcus epidermidis
ttattatatttcaagattattatagtttttaaatacatcattttagtaataagtatattaattgttagtgagataaaatttaatagtactactacacaaaaaagagagggcgaattcgttctctcttttcttggatttttaaaagtgaataaaaaagtattaagcaacggaatggagctacttaatattttttcataa

SEQ ID NO: 655 - DNA, 984 bp, Staphylococcus epidermidis
gtgttatatttagaaatgacttactgctcattatctataaagatttatacattgaaaatattgattgttttaacaataggaggtcatgttgttattatgagtcagtttaaggacacattatataaactatttgagccaatgatgaaaatagagttctatcaaaatctattggttaatcttttaattatacttgcttatatcttgatgggtatgattgtaattgcgatatcaagaaagttagttactaaatttttcaacgttaatgaaaagaaaaagaaccgtcataaaattaaaagaagtgaaacactatccacattgattcaaaatttaataagttatgtcgtatggtttattgtccttacgtcaatactttcacgtttcggtattagtgtatcagcaattttagcaggagctggagttgttggtgttgccgttggtttcggagcacaaacaattgtaaaagacattattactggtttctttatcatatttgaaggacagtttgatgtaagtgattatgttcaaattaatgcatctggggtaacaattgctgaaggtacggttaaaacaattggtttaagatcaacacgtatacaatcagatactggagaaatttatacattacctaatggtatgattagtgaaatagtcaattattctgctacagatgtttcacctattgtgatgataccgatttctccaaatgagaattataaagtgatagaagagaaattattaacatttttacctacattaaagaataaatatgacatatttgtatctgcaccagatttacttggtttagacagtgttgatggcaatgaaatggtgattaaacttttagcacatgttaagcccggaatgcattttccaggacaacgtttgcttcgtaaagaggtcatacaatacttcagtgaagaaggcattcatattccaaaaccaacacttgtaaaacttgataaagaattgaataaaaaagaatag

SEQ ID NO: 656 - DNA, 153 bp, Staphylococcus epidermidis
ttggattcagcagcatgtactgagcctccgccaataaataacatcgatgcaacaatgattgaagacgcacctacacttaactttcgaatgctatatgaattctttttatttttcatgtttaaagcacctctatcttttttatatcatttataa

SEQ ID NO: 657 - DNA, 627 bp, Staphylococcus epidermidis
atcatgtatttgtatgtgactaagatgacagaaactttagaggaagtagaattgcttttaaatagaagttctcgtcagttgaaaaagccagaacgaatacactatagatttttaaaggatcgacttatgcaccaattaggtgatgcattgattcagtatgctattgaacaatgtgctggattaactcctaaagaatgggagtatcacatcacaactatgggtaaagtagagatacgaagttcttgtcatatatacgtgagtatttcgtatagttatccttatatcatttgtataatagataatcagcctattggtattgatatcgaagaaatgaaagacttggattataaacatttggcgaagaattttacaaaaaatgaatttaaccaagtgactacacttaaagatttttatgaaatttggactaagaaagaaagttatacaaaactcatcggtgagggattgatgaatggtttagactgctatgatgtgacgcaaaatttgagatttttaaaaaaacatgtccaatttacctcagtagattattttaaaagactcattcaaatatgtcatatgagtaaacatagtttgaactttgaagtggtgccgctcacacaattattataa

SEQ ID NO: 658 - DNA, 879 bp, Staphylococcus epidermidis
caatttaatttgaaaatttacattaaaaaggagtgttttatgcaacgtcaagtggtcgaattttcaaaatataatccatctgggaatatgacaattcttgttcattcaaagcatcaaccgagcgaatatgctgcgattgcacatcagttgatggcgacaacacacatgtgttgtgaacaagtagggtttattgaatcagtaaactatgaaaatggggataactatcacttggtaatgagtggaaatgaattttgtggtaatgcgactatgtcttacattcactatttaaaagaacgtttattgatacagcatcaacaatttcaattaagagtttcggggtgttctcatcctgtagagtgtaaagttcattcgcaacattatgaagtgactatgccaaaagtacatcaagttaaggaaagatttgtgaaattaggggaacagcagtttaaagcatttgaaattagctatgatacatacattcactatgtgatgatgtgtgatgatgtagatttggcaataaaacagtgcgtggaagattttgtcagtgcgcaaacatggcatcgacaatttaaaacaattggtgtcatgctttttcaacaagataaacaattcatatatccactgatacatatacctgcaatagatagcttaatctgggaaaatagctgtggttcaggagcggcttctatcggtgtgttggttaattatctaacagatcatgatattcaagattacctagttaaccaacccggaggcagtattattgtctcatccagaaagtctggacaaaatgaatatcaaacaacgattaagggtcaagtttcaactgtcgcaacaggacaagcatatatagaacaggagacaatgacgcaaatatga

SEQ ID NO: 659 - DNA, 1512 bp, Staphylococcus epidermidis
tatataaatttagaaaggaacatgcacatgagtgaagcaaatcataaaaacatcgttgttgtaggtgcaggaattattggtacgtcagtagctacaatgctttcaaaagtaagtcctaactggcatatcgatatgtttgaaagactagaaggcgctggtattgaaagttcaaatgaaaataataatgctgggacaggccatgcggcattatgtgaattaaactatacagttgaacaagatgatggttcaattgatgcatctaaagcgcaagaaattaatgaacaattcgaattatctagacaattctggggtaatttagttaaaaatggtgatatttctaatcctgaagaatttatccaaccattacctcatatcagtttcgttatgggaccaacaaacgttaactttttaagaaaacgttatgaaacactaagaactcttccaatgttcgatacaatcgaatatacagaagacatggaaacaatgagaaaatggatgccattaatgatggaaaatcgtgaaccaggtcatcaaatggcagcaagtaaaattgatgaaggtacagatgtgaactatggtgcgttaacacgtaagttagcacattacttagaacaaaaatctaatgtttcattaaaatacaatcatgatgttgtagatttaacacaaagagaagatggcaaatgggaagttgtcgttgaaaatagagaaactaaagaaaaagtaactaaaatagcagataaagtgtttattggtgctggcggtcactctattccgttattacaaaaatctggcgttaaacaaagagaacacctaggtggtttcccaatcagtggtcaattcttaagatgtacaaacccagatattattaaacaacatgcggctaaagtttacagtaaagagcctcaaggtaagccaccaatgactgtaccacaccttgatacacgttatatcaatggtaaacaaacattattatttggtccatatgcgaatatcggccctaaattcttgaaattcggttcaaatctagacttattcgaatcaatcaaaccatataacattactacaatgttggcttcagcagttaaaaatgtacctttaattaaatattcaattgatcaaatgatcaaaactaaagaaggttgtatgaactatttaagaacatttattcctgatgctaaagatgaagattgggaactttacactgctggtaaacgcgttcaagttattaaagatagtgaacaacacggtaaaggtttcgtagtatttggtactgaagttgtcaattcagacgacaattctatgattgcattattaggtgaatctccaggggcttcaacatcattatcagttgtattagaagttttagagaaaaacttcgctgatgacaaagaagcatgggaacctgttgttaaagaaatggtaccaacatacggtcgttcattaattaatgacgaaaaattaatgagagaaacacgccgtgaaacttctaaaaacttacatttaaatagataa

SEQ ID NO: 660 - DNA, 126 bp, Staphylococcus epidermidis
ctcacttattatgatgtgcactccagaagttggcctaaaatctatctttatggggtgttttttatgattgaatatgataaattttattttaaaattaaagtttttcaagaatatataaatggttaa

SEQ ID NO: 661 - DNA, 1248 bp, Staphylococcus epidermidis
aataaatgttatattcagtttgaaagagttgcaaaaaactttagtaaaggagtactttttatgaagaaaaaattaagttatatgattaccattatgcttgcttttacgctaagtttagcacttggcctatttttcaatagtgctcacgccgactcgttaccacaaaagaatggtgcaaaccaaaaaacaactaaagtcactgtcagtaataaagacgttccagatgcagttcgcaaacttgctgaagaacaatatttatctcgtgtagctttattagataaagcttccaaccacaaagcaacatcgtatacacttggtgaaccttttaaaatttataaatttaataaggaaagcgacggcaattattattatccagtgctcaataaaaaaggagatgtcatttatgtagtaacaatttctcctaatccttcaaattctaaagcttcaaaacagcaaaacaattattccattaatgtttctccatttctttctaaaatattaaatcaatataaaaatcaaaagataacaattttgactaatacaaaaggatattttgcacttactgaagatggtaaagtgacacttgtgcttaaaacgccacgtaataatgaaaaaacatatgaaaatgccactgaatccactaaacctaaagatttaaatgattttaaacaaactgcatcagtaacaaaaccaactttagaatatcaaagtacacgaaatgaaatgtacgcagaatatgtaaatcaattaaagaatttcagaatacgagaaacacaagggtataatagttggtgtgccggctataccatgtcagcactactcaatgccacatataatacaaatcgatataatgcagaatcagtaatgagatatttacatcctaatttaagaggtcacgacttccaatttacaggactaacatctaacgagatgcttcgttttggtagatcacaaggcagaaatactcaatatcttaatagaatgacttcatataatgaagtagaccaattaacaactaataatcaaggtatagctgtattaggtaagcgtgttgaatcaagcgatggtattcacgctggacatgccatggctgtggctggtaatgctaaagttaacaacggacaaaaagtcattttaatttggaacccatgggacaatggtctcatgactcaagatgcacatagtaatatcattccagtatcaaatggcgatcactatgaatggtatgcatcaatttatggttattaa

SEQ ID NO: 662 - DNA, 897 bp, Staphylococcus epidermidis
gagaaaagatatagaattggatattttaaaaaagtacaaggcattggaaaggaagtggtaccaacagtagtcatagatttagtggatcaattaaaagtaaaatattcaatcaaattgatactagaagtattaaacatacctaaatcaacatattaccgatggaaaaacaaaacctataaaaatgataccgtaacacaaaaagtcattgaattatgtaaagctaaccactatacctacggttatcgtaagattacagcattgattaatcaatgttatacatcaccaattaatcataagagagtacagagaatgatgcagaagcatcatttgaactgccgagttagacctaaaaagacgacaagaataggtaaaccgtattataaaacggacaatttattacaaagacaatttaaagcgagttgtcccatagaagtattaacaaccgatattacttatttaccatttggtcattctatgttgtatttatcttcgataatggatatttataacggagaaattgtggcgtataaaatagatgataaacaagaccaaagtttagttaatgatacattaaatcaaatcgatatacctgaaggttgtatattacatagtgatcaaggcagcgtttatacatcttatgcttattatcaattgtgcgaagaaaaaggcattatcagaagtatgtcccgaaagggaacacctgccgataacgccccgatagaaagtttccatccctcgctaaagtctgaaactttttacatcaataatgagcttaatcgctctaatcatattgtaatagatattgtcgaaaagtacattaaaaactataataataatcgaattcaacaaaaactaggctacttatccccagtaaaatacagagaattaatagcctag

SEQ ID NO: 663 - DNA, 240 bp, Staphylococcus epidermidis
aatactttgtattgtacgagcaaaagaatatatataacaaacaatggaggacatcatgattttaactattttatttatctttttctgtattcgactcatcagcttaaagatatctatgcaacacgcaaaacagctaaaggtagagggcgcggtggaatatggtgtgaaaaattcaaaatatctagccattacgcatgtattaatttacatgagtgcagctatagaaacattcattcataa

SEQ ID NO: 664 - DNA, 786 bp, Staphylococcus epidermidis
gaaaagaggtacgatgtgatgaaaaaatatcaaacgtacatcgcaataggttcactattgagtttgatggttgtattaattacgtatggtttaatgcaagacacgcaacatttgaacccacttgagtcacctaatggacaacattggttgggtaccgatcaattaggcagagacttcttagtaagactgattgtcggtagtcttgtcacattgagtttaacaggcatagtgattctattaagcgtttgtatgggacttatctttggcttaattgcaggcatagaaagacgatggttagatcaaatcatcatgtttgttgccgatatgttgctggctattccgtcatttattatcgcattagtcatcttaagtttagtaagtaactccatgataggtttgatacttgctttaacgattggatggataggacgttatttacgttacttcagaaatttaacgcgagatattcaaaaacgtccatttgttcaatatgcacgattgagtgggaactcaacattcaaaacgacagtaacacatgtgattccacatttattaagtagtatattcgctttggtaacggctgactttggcaaaatgatgctcagcatatctggacttgcttttctaggactaggtattaaaccgccgacgcctgagttaggaacaattctttttgatgggaaaagttatttcaacggcgcaccgtggctcttcttcttccctggtgtattgttaggaggtttcgccttattatgtcaaattatcaacaaaaaaataacgcagtaa

SEQ ID NO: 665 - DNA, 1482 bp, Staphylococcus epidermidis
atgatggatttttggtcttcaaaacgaggcaagatgttagaaatcactgtcctcgtgtttattacaatttttggtgtaggctctcaatttttttcaaatttagcctatagtttaaatcaaggtatccttcaaacatcctttggtattggctctcaatatctgattatcccctctgtattagctaatttcacttttgctttaggtataccgttggggcatacactcacacataaatatggattcaagcgtaattacttatgctttgtgtttatatttctcattggttcaatcttaggacttctatcttttaacttaatcattctgtctattgctaaaatgattcaaagtttcagttcaggtgtattattctttaccttgttacctaaacttttcttgaactttccaaaacaatatagaaatgtatttttattgatggttattgtaggtttatttggttcaaatgcgcttggaggattatctggtagtttatcattagaattagatcgttggcattggatttttgtagtaaatatcatctccgcgatattatgcttaattctaggcaacgtcatattaagaaaaaatgaatatcatcaaacatcagatattcatattagtcgatcaatgatgattactttagtattaagtaccatttctttaatgattcctatgtcacttcttactcaaaaaggctaccattcattatgggtgtggccgatactcttaattgcaatattttttattgtaaattttatcattacaaatcggcaagctacacatcccattgttcactttcatacactattcagtaaaaagcctttcgtcggtgcaacaatggcaatttcatcacatttaactttattaacaggcattgctggtatcaatgtctatatcgtaagaatattaaagttgccttttgatatttcattacatttctatttctttttctttgttggagtcattataacgggtatcttaaaaatgttcttttatagctctgtcggtgcaggttttttaggtacattgggatcgtcagccttactatatgtaagcatccattggattattctgggaaatacgattaacattccattactttatattcaaggtcttctgctcggcttcggtgcaagcatgaccttagttagtggctcgatggctacattattggacggagatttaaaagaagcagcacaacgttctcaaaccatgcatacaataagaaatttctctgctgctatgttgataccgattatagcttatacgattaagaatcatatccaaaaaggaacacagtctatatatgctgaaaacattactgataaaatgatttaccttaaaaagttgcaagatgttgcgattgatgctgatcatcaaatattcttattaatgattattttcaatatggtcatgttcgtttcttcaattatacaaatgattttaggtaaaggtagacgtattacaccacctcgggaatcataa

SEQ ID NO: 666 - DNA, 126 bp, Staphylococcus epidermidis
aacccgcctcacttacgatacgcttctgcgtatcagttaatgatgcggtttctttttctagtttttatttttaatactcaaatgattctgtatacgtcggtgcctactgaaatatattttttctaa

SEQ ID NO: 667 - DNA, 132 bp, Staphylococcus epidermidis
cgtcctatccatccaatcgttaaagcaagtatcaaacctatcatggagttacttactaaacttaagatgactaatgcgataataaatgacggaatagccagcaacatatcggcaacaaacatgatgatttga

SEQ ID NO: 668 - DNA, 1434 bp, Staphylococcus epidermidis
aaggagtaccattctatgtctaacatttcgatgacgacttctaaacgtaatgctatcgttacggtaatgctcattagtgcttttgtgtctatgctcaatcaaactattttaaacactgcactaccagcaatcatcaaaggactgaacatcacagaaacaacagcacaatggttaattaccggatttatgcttgttaacggtataatgattccactcactgcctttttaatggataaatattcgacacgccatttatatattttctcaatggctatttttcttataggatctattgtagcggcattttcacctacgtttacaattttaatgatatctcgtattatccaagcgattggtgccggcatccttttaccattgatgcagtttacagtatttacactgtttcctgctgaacaacgtgggtttgcgatgggattggcaggggtggttgtacaaagtgcgcctgcaattggaccaacgttaactggattattcgtagatttatttagttggagaatgccattttatcttgtttcagcaattgctgcggtagcttttattttaggtttcttcttcgtagaaaataatacaaaaacaaaagacattgttcttgataaaatttctgtagtttattctactttcggctttggtttaattttattcgcatttagtagcgtgagtacgtttggtatcacctctctacctgtcattgtgacatttgtactcggtatagccattatcataatttttacaacgcgtcagcttaaattaaaacatccattgttaaatatgcgtgtgtttaaaaataaagtgttcacactttcagctgtttcttcaatgcttgtatatattacgatggtaagtcctgcgttactcatacctatttacattcaaacaggtttaggtcaatcagcattactatcaggtgtcgtcgtacttccaggcgcggtcattaatggattaacgatggtttatacaggaaaaatttttgataagcatggtattaaagtgcttgtgatacctggttttatcttactcattagtatgacattcttatattcattccttactacaggaacgccatattggtttgttattcttgtttacactataagaatgattgcgttaggattattagttatgcctcttaatacagttggactgaatgcacttgagtcagatgatgtctcacatggtacagcaattatgaattccttacgcatcattgcaggtgctatgggtacagcggttagtgtgacgattctatcaatagtggcaaaacagtatacagcttcacactcgacaatgtcaaaaatgaaactaacacaagaagcaactgtacatggtatagatgttgcatttatttttactacagtattaatcattattggatttatcttagcgttattcataaaagaagaaaaaaatcattaa

SEQ ID NO: 669 - DNA, 144 bp, Staphylococcus epidermidis
gacaaggtacatttcattaactgtactttgactaaacttatgttatgtatacaaaatgttacacatgtactttatattcaacttcactttttttcttatcaaaatacggtacaacaaatattacaaataaagcacatccaatag

SEQ ID NO: 670 - DNA, 153 bp, Staphylococcus epidermidis
attgagaaacatatccatatcatagatattataaatgtgcgtttgggagtcctaacacataaattttatagacatttcaacttagagctcataagccatatggggattatattcaaaataaattctactctatctcattttccacgctcttaa

SEQ ID NO: 671 - DNA, 150 bp, Staphylococcus epidermidis
ggaataagacaacacatttttcttattccctatccaagtattactgaatttaattatttacttattttaatcagtttagttaataattaccgccctgtccttttgcacgtgcttcaacttgtcctcttaaaaatttcatatactcgttag

SEQ ID NO: 672 - DNA, 1395 bp, Staphylococcus epidermidis
tgtgaattgcacatgttaaaggtaacctttaatttacgtgatgggacgtttactgacattccagatgatgcacattactttttaattgaagactatgacaaattaactcccagtcagcaaactttattaaaacgttacattatcaaacatcaattagatatttcattacaacatgctattctttcatctccactccatagtttaaatatgattaaaaagttagagacttttgttaaggagagcaaagcataccatcctcaatttcacaatattatttgtggatggtgctttattgtacttatgtttgctttacccatctacttgtcttatcacgtttcagacggattacaatactacgtgtcacactggttaactaaactatcccaaatatcattatttcaagaaaataagctacaacatattttattcggtcattatggtgtcatttctttaggtacatattcattcgtctgggcgttaccagttgttttcatgattagtttatctacagctcttatagatataactcatttaaagcattatatcgtttggtctatcgaacctacgatgatgagacttggtcttcatggatcagatatcatacccttgttagaaggatttggatgtaatgctgctgctattactcaagctacacatcaatgtcatcgttgtacaaaagtacaatgtatgagcttggtaagtttcggaactgcatgtagttatcaaattggtgcgacattatcgatattcaacgcaagccaccgctcttggttgtttttgccatacataggcatggttttcttaggaggaatcatacataacaaactatggtatagtcatcaaacacctaagacaacaccatcagtttttcaacgacaactcgtacgttggcctaaaccaaacctactcttaaaagcagcgtggaaaagtattcaaatgtttattgtacaagccttacctatttttataggaatttgccttattgtaagtctattgtctcttacgcctattttgacttttatatcaaatgcattcatacctttattatggctactagatgtacctacacagcttgcaccaggtattctgttttcaatgatacgtaaggatgggatgttgttgtttaatatgaatggcggtactttaattcaaagactttccgcattccaattattgttgctagtcttttttagttcaacatttacagcatgttcagtaacaatgactatgctcatgcgtcgactcggttcaattctaggaattaaaatgataatgaaacaaatggtatcgtccacaatttgcgtcaccatactagtcatagcaatgttaagcataactaaaatttcagacttaggagtgatgttatggaaatcattattatcggtggttttttag

SEQ ID NO: 673 - DNA, 663 bp, Staphylococcus epidermidis
ttacgattgcacatcggagacaaccttatgcttaaaatagagagattaaccaaatatatagacacgcaactgatatttaaagagatatcatgtacaattaacgaccagcacttactcataagtggggagagtggttgtggtaaatccacattagccaagattatcgctggcttagatacggattatcagggcgaattatatcttaatgggcgcttacgtgaatcttatacgtctaaagagtggatgaagcacatccaatatgtacctcaatatcaacgtgatactttaaatcagcgtaaaacggtattagctacattattagaaccacttaagaattataaggtaaataaacagcgttatacatcaagcattgaagcagtgcttgatcagtgtaatttaccacacgatatacttaatcataaagtttcgacattaagtggtggccaatttcaacgcgtctggatagctaaagctttaatattagaaccagagattctcatattggatgaagctacaaccaacttagatgtcattaatgaagaagctatacttcaaatgttgatttccttaaagatgacacaattaatcattatttcacatgatacatacgtcttaagccaatttgaaggaattcagttacagctaaataaattgaataattaa

SEQ ID NO: 674 - DNA, 384 bp, Staphylococcus epidermidis
acaatgaagcaccacagatgtcttctacattgcaagcagaagaaggaagcaatgcagaagcacctcaatctgagccaacgaaggcagaagaaggaggcaatgcagaagcacctcaatctgagccaacgaaggcagaagaaggaggcaatgcagaagcacctcaatctgagccaacgaaggcagaagaaggaggcaatgcagaagcacctcaatctgagccaacgaaggcagaagaaggaggcaatgcagaagcacctcaatctgagccaacgaagacagaagaaggaagcaatgcagaagcaccgaatgttccaactatcaaagctaattcagataatgatacacaaacacaattttcagaagcccctacaagaaatgacctag

SEQ ID NO: 675 - DNA, 846 bp, Staphylococcus epidermidis
ttatcatttaagaatgatactggaggaatgaagatgacaaatcgtttaatattattcgactttgatgaaacttactataaacatcgtactaatcaagcagatattccttatttaaaagaaatggaaagtttattacagaatataactgctaaaaacaatgtcattacggcgattttaacaggaagtactatagaaagcgtactgaaaaaaatgagtaaagttaatatgtcatataaacctcaacatattttttcagatttaagttctaaaatgttcacatggaataactgcgaatatattgaatctgatgaatataaaaacgaagtgttgatagaaccgttcttattggaagatatattagatatattaaaacacgtttcttctaaacataaagtagagtttataccgcaaagaatttttcgagaaaatgaaacattgtataatttttatctttattcttcgggtgacacgcatttagataaaacaattttagaagacctcagtcaatattctaagacaagggattatacgatgacatttaatcgttgtaatcctttagcaggtgatcctgaaaatgcttatgatattaattttactccaaagaatgcaggtaaattatatgccacaaaatttttgatgaataaatatggcgttccaaaagaattgattattggctttggtgatagtggtaatgatgaagcgtttttaagttatttagatcacgcaatgattatgtctaacagtcaagatgaggaaatgaagagtaaatttaaaaatacaaaatatccttattacaaaggtatttatacacatgtacgtgaatttatagaatatgaaaatgtttaa

SEQ ID NO: 676 - DNA, 915 bp, Staphylococcus epidermidis
tgcaatattaaatccgcgtttaagggaggcaatgaaatgattgtgttacgtcgtctatttcaagatagaggtgccatatttgctatagctattattacaatctacgtagtgcttggagttttagctcctttaattacattctatgaaccgaatcacattgatacagcaaataaatttgctggtataagttggtctcactggttgggaacagaccatttaggtcgagatgtattaacacggataatatacgccataagacctagtttgttatatgtatttgtcgcattgattatttccgttgtgataggagcgatacttgggtttatttcaggttatttcccaggttatatcgatgcaataattatgcgtatatgcgatgtgatgttagcttttccaagctatgtggtcacattggcattgattacgttgtttggcatgggtgtagaaaatattattattgcatttatattgactcgatgggcgtggttttgtcgcgtgattcgaaccagtgtaatgcaatatattgaagctgatcatgtaaaatttgccaaagtaattggtatgaatgatttaacaatcattcgcaaacatattttgccactaacctttactgacatagcgattattgctagtagttcgatgtgttcaatgatattacaaatgtcaggattctcattccttggattaggtgttaaggcacctacagccgaatgggggatgatgcttaatgaagcacgaaaagtaatgttcacacatcctggaatgatgatgacaacaggtgtggctatcgtcataattgtgatggcgtttaactttttatcagatgctttacaaatggcgattgatcctcgtatgtccgctaaagaaaaacgactggctctgaagaaaggtgtgaaagcacgtgacactgcttaa

SEQ ID NO: 677 - DNA, 1425 bp, Staphylococcus epidermidis
aagcattgtttaattatccatctcaagcaactgacgaaacacaatggcgatgtgaagaactacaaacacgaccgaagcagatttttgatattgcactttatcgtaaagtggcatcaaaagttggtgttgaacatgtctaaaatattaatggttggtagtggaccggtcgctattcaacttgctcgactatgtaacttacatggggaacatatggttgatatggtgagtcgcgttcatgcatcaaccaaatctaagagagtctttgatgcgtatcatcgtgacggctttttttcagtaatgactcaaaatgatgcacatcagtgttttttaggtaagtttacggttagacatttttttaaagatgttaaagacattacacaatattatgacgtggtgattttagcatgtactgctgatgcgtatcgaccgatattacagcaattatctaagtccacattaaaacgtattaaacaaattatcttggtctcgccaacattaggatcacatatgcttgttaagcaaatactatcagatgttcattgtgaaggtgaagtgatttcgttttccacttatctaggcgatactcgaatatttgataaagcacaaccgcattgtgtcctaactacacgagttaaatcaaaattattcgtaggttcgactcattctcagtctattacattgtataagcttaagtctttattcgactatttgaatatagaattaacaacgatggacacaccgctacatgcggagatacataatagttcactttatgtacacccaccattgtttatgaatcaattttcattaaaggcggtatttgaaggaacgaaagtgccagtatacgtatataagctatttccagagggtccaattacaatgaccttaatacatgaaatgcgattaatgtggcaagaaatgatgatgatattaaaaaaattaaaggtaccctcggtcaatctcctgaagtttatggtgaaagaaaattaccctatacgtgatgagaccatgcgcgaagttgatattgaaagctttgaaaatttatcagctattcatcaagagtatctactttatgtgcgatatacagcaattttaatcgatccattttctaatccggacgatcaaggtgcatattttgatttttctgccgtaccatacaaacatgttgatactgatgaacaaggagttatacatataccacgcatgccgagtgaagattattatcgtactttgatgattcaagcaattggaagagcattaaacgttgcaacaccgatgattgacacattgttattacgttatgaaactaccgttaaacaatactgtgatacacatttacatcaacaactatcaaagcaattcgaattacatcattttaaacaggatttagcgttagtgacgaactacttaactttttataaataa

SEQ ID NO: 678 - DNA, 1137 bp, Staphylococcus epidermidis
tataaatataaaagatgttttggaggaatacttatgtctaaatttatttatcaatcaccaggaagatatgtacaagggaaaggtattgttagctctatcgctgaagaaacagaacgtcttggtagtcacgcgttgattattgcagatgaagtggtttggaatatcactgaagaaaaaataaaagaaagtttctcagcaaataacaacgttgattttgaatatgaagtatttaaaggagaatcttctgaagaagaaattcaacgtatagttaaacaatataaagaaaaaaacattgacgttgttattggtttaggcggaggtaaagcgttagatacaggtaaagctgtagcatttgaacttaaagcaagcgtcatcgattttgcgtctacagcatcaatggatgcaccaacagcagcagtatctgttatttataacgaagatggatcatttagtggttatgaattctaccctaaaaaccctgatacagttatcgtagattctgaaattgttgcacaagcacctgtacgtttatttgcatcaggtatgagtgatggtttagcaacattaatcgaagttgaatctacacttcgtagacaagggcaaaacatgttccatggcaaacctacattagcaagtttagcaatcgctcaaaaatgtgaagaggttatttttgaatatggttacagtgcttatacttctgtagaaaaacatatcgtgacaccacaagtagatgctgtgattgaagccaatacattactttcaggtttaggatttgaaaacggcggattagcaggtgcacacgcaattcataatggattcacagctttagaaggagatatccaccacttaactcatggtgaaaaagtggcatacggtattttagtacaattagtacttgaaaatgcgccaactgaaaaattcatgaaatacaaaacattcttcgataatatcaatatgccaacaacattagaaggtcttcacattgaaaacacaagttatgaagaattagttcaagtaggtgaacgtgcattaacaccaaatgatacgtttgctaacttaagtgataaaatcactgctgatgaaatcgcagacgcaattttaactgttaatgatttatctaaaagtcagttcaactaa

SEQ ID NO: 679 - DNA, 168 bp, Staphylococcus epidermidis
gggagggataacttaatggaacacgtttctaaattaggcgaagcgattgtggatacagtaacagcagcacaagcagaagatggtgctgaattagcaaaaagtatcgttaacatcgtagctaatgcaggtggcatcattcaagatattgctcacgcatttggttattaa

SEQ ID NO: 680 - DNA, 1218 bp, Staphylococcus epidermidis
acaactatcaatctaaggagtgacaatatgaaaggtgccatgtcttggccttttttaagattatatattttaacattgatgttttttagtgcgaatgccatactcaatgttttcatacctctaagaggacatgacttgggggcgacgaatactgtaattggaattgtaatgggagcttatatgctaacggcaatgctatttcgcccctgggctggtcaaattattgcacgtattggtccgattaaagtattgcgtattatattattgattaatgctatggcactggtattatatgggtttacaggacttgaaggttatttgattgcacgtatcatgcaaggtgtgtgtacggcattcttctcaatgtctttacaattgggtattatagatgctttacctgagaaatatcgttcagaaggtgtatctctctattcattattttcaacgattcccaatttattaggaccattaattgcagttgggatttggcacgtggaaaatatgtccatatttgctattgttatgatttttattgcagtaacaacaaccttatttggttatagaactacttttgcaaatacacaaaaagaggtatcaccaaaagacgaagtcttgccttttaatgcaatgactgtatatgtccaattttttaaaaataaagcactcttctgcagtggtatgattatgatcttgtcatctatcgtgtttggtgcgatgagtacttttataccattatatacggttagggaaggtttcgcgaatgcaggtattttcctcacaattcaagccattacagtagtgatagctagattttatttacgtaagtatgtaccatctgatggtttatggcatcaccgttttatgatgattgtcttaacgttactgatggttgcttcagtcattgtagcttttggaccacatatagtgagtatatttgtatatataagtgcaatctttatcggaataacacaagcgctcgtttatcctacattgacaacgtatttaagttttgtcttaccaaagataggacgtaatatgttattaggattgtttatagcatgtgcagatttagggatttcactaggaggtgtgctaatggggccaatatcagatacggtaggatttaaatggatgtatattttatgcgctttattggttactattgcaatgacactaagtaaaattagacaaagacaaagtgtttcaaaagcctcatag

SEQ ID NO: 681 - DNA, 1026 bp, Staphylococcus epidermidis
ttcattcacaaggagttgttattgatgaaaaatttacgtaacagaagctttttaactttattagacttttcacgacaagaggtagaatttttattaacactctccgaagatttgaagcgtgccaaatatatcggcactgaaaagcctatgctaaaaaataaaaatatcgcgcttctttttgaaaaagattccactagaacacgttgcgcattcgaagttgccgcacatgatcaaggtgcacacgtcacttatcttggacctacaggttctcaaatgggtaaaaaagaaactgctaaagatacagcacgtgtacttggtggtatgtatgatggtattgagtaccgaggtttttctcaacgtactgtagaaacattagcgcaatattcaggtgttccggtatggaatggattaaccgatgaagatcaccctacacaagtgcttgctgactttttaactgctaaagaagtattgaaaaaagagtatgctgatatcaactttacttatgttggcgatggacgtaacaatgttgctaacgcattaatgcaaggtgctgccattatgggtatgaatttccatcttgtttgtcctaaagaactcaatccgacagaagaattattaaatcgttgcgaacgtattgcgacggaaaatggcggtaacattttaataacagatgatattgataaaggcgtgaaagattctgatgttatttatacagatgtttgggtatcaatgggcgaacctgatgaagtatggcaagaacgccttaaacttttaaaaccatatcaagttaaccaagcactattagaaaaaaccggcaatccaaatgttatttttgaacattgtttaccttctttccacaatgcagaaactaaaattggtcaacaaatttatgaaaaatatggcattagtgaaatggaagtcactgatgatgtcttcgaaagcaaagcttctgtagtattccaagaagctgagaatagaatgcatacaattaaagcggtcatggtagcaactttaggagaattctaa

SEQ ID NO: 682 - DNA, 129 bp, Staphylococcus epidermidis
aatgatagcaaaacattttatactcagaaaaacctactttttcagcaatttcataatgcttgtagtgctggtctaaaagatgtaatgattttaaaatacgataacgatttagataatcaactatcgtaa

SEQ ID NO: 683 - DNA, 768 bp, Staphylococcus epidermidis
ggtgggagcaaaatgcttaaaggacacttacactccgttgaaagtatgggcactgtcgacgggccaggacttagatatatattatttactcaaggttgtttgttaagatgtttatattgtcataatccagacacttggaagattaacgaaccatcaagagaagtgacggttgatgaaatggtaaatgaaatcttgccgtacaaaccttactttgaagcttcaggcggtggggtaacagtcagtggtggcgaaccattactacaaatgcctttcttggagcaattattcaaagaattaaaagcaaatggtgttcacacatgcattgatacttctgcgggctgtgtaaatgatacaccagcatttaatcgtcattttgatgaattgcaaaagcatacagatttaatcttattagatattaaacatattgataatgataagcacatcaaattaacaggcaaacctaacacacatattttaaagtttgcacgtaaattatctgatatgaaacaacctgtttggattagacatgttttagtacctggtatttcggatgataaagaagatttgataaaactaggagaatttattaattctttagataacgttgaaaagtttgaaatcttaccatatcatcaactcggtgtgcataagtggaaaaatttaggcattccttatcaactcgaaaatgttgaaccgcctgacgatgaagcggttaaagaagcttatcgctatgttaattttaatggcaaaatacctgtaacattatag

SEQ ID NO: 684 - DNA, 213 bp, Staphylococcus epidermidis
tttgtattaaaaaagcaatgctattctatagataacttaattaggaggagggaatacaacgtggaacatgtttctaaattagctgaagctatagctaatactgtatcagcagcacaagcagaagatggtgctgagttagcaaaaagtatcgttaatatcgtagcgaatgctggcggtattattcaagacattgcacatgcattcggttactaa

SEQ ID NO: 685 - DNA, 138 bp, Staphylococcus epidermidis
cctgaaataaacccaagtatcgctcctatcacaacggaaataatcaatgcgacaaatacatataacaaactaggtcttatggcgtatattatccgtgttaatacatctcgacctaaatggtctgttcccaaccagtga

SEQ ID NO: 686 - DNA, 129 bp, Staphylococcus epidermidis
cgcgttgtaaaaattatgataatggctataccgagtacaaatgtcacaatgacaggtagagaggtgataccaaacgtactcacgctactaaatgcgaataaaattaaaccaaagccgaaagtagaataa

SEQ ID NO: 687 - DNA, 171 bp, Staphylococcus epidermidis
gtagctcaaaatgatttagagataagttcaagctcagaaccacgaggcaatattaaacttattattataacttatatttttcatataaaatatatagttataaataaaaataatcaaaaaataatttatattggaattgttattcgtttatcatatgtaaatttatattaa

SEQ ID NO: 688 - DNA, 234 bp, Staphylococcus epidermidis
atacataaaaataccgagacatttgatgatgtctcggatatttatcatatatcactagttgatttatctacatgccttttcaagtcccaacttactagcgtcatcatttacacaacactatttaataacaaaacgcttttcgttaaacttaatcctcacgttgttatttatgatgttcaactttatttatatgatataaaacctgaaaatttctcaacgactgttatgccataa

SEQ ID NO: 689 - DNA, 1365 bp, Staphylococcus epidermidis
ttaatgatgaaaaataaactaacattaaaagagaatctatttatcggctcaatgctgtttggtctattttttggtgctggaaatctcatttttccaattcacttaggtcaaactgcggggtcaaatgtatggaccgccaatttaggatttcttatcacggctatcggactacctttcttaggaattatagcgataggtgtatctaaaacaaacggggtctttgaaatttcctcaaggataagtaaaatatatggttatttgttcacaattggcttatatcttgttataggtccgttttttgcgttgccaagacttgcgacgacgtcatttgaaatagcattttcaccatttatttcatctggtacggcccaagcgttgttgcctatttttagtattttattcttcggagtagcgtggttattttcgcgtaaaccttctaaaatattagactatattggaaaattcctaaatccggtctttctcatcttgcttggaattgttgttgtgcttgcatttatccgtcctatgggtggaattagtcatgcgccagtaagtgctgattatagcaatagcgtgttactcaaagggtttatcgatggatataatacattagacgctttggcatcattagcatttggtattatcattgttactacaattaaaaagttggggattactaatccgaatacaatcgctaaagaaactttaaaatcaggtacgattagtattatagctatgggcgttatttatactttattagctttaatgggtacgatgagtttaggtcgttttaaagtaagtgaaaatggtggtattgcgcttgctcagattgcacaacattatttaggggattatggaattattattttgtcactaatcatcattgtggcatgtctgaaaacagcaataggattgatcacagccttttcggaaacatttacagagttattccctaaatctaactatctttggttagctactggggtgagtatattagcttgtatatttgctaatgtaggtttaacaaaaattattatgtattcaacaccagtattgatgttcatttatcctttagcgattactttaattttattagcgttacttagtccattatttaaacattctaagattgtctatcgatttacaacattatttacaatggtggcggcatttgtagatggtgtgaaagcaagtccagagttctttgttaatacaaaatttgcacaaacaatcattggatttggagaaaattatctcccattctttaacattggtatgggatggattgttccagcatttattggtttcattattggtattattgtatactttatgactgctaaaaaatcgtcccacgtacaataa

SEQ ID NO: 690 - DNA, 453 bp, Staphylococcus epidermidis
aataaagtgaaacaatcttattattcgcatacacctcaatctaaaataaaaagtgtagctatcaataaacatgctcatcaatccatttcaattggcattgtatttgttgtcgtcatctttgtaagtgttatccaaatcctattacatcaacgtcttaaacagaacgcacctctcgaaagattatatttggtaccttatagtcaacttaaactatacttgacttatatcagtgtacatgtggtcatactgatgctcatgctattgatgattagccttttaatgcatcaaccattaagcattcttttctacttaaaaacactgattatagttttattttatgaggcaggtattgctttattactttttaaaattaatgttcttagtcaccgtatattcatggctattatttatacggtagcgataggtattatatatttatggattcaattgtaa

SEQ ID NO: 691 - DNA, 225 bp, Staphylococcus epidermidis
gagagaccgaattatgggatgaacctgggacacaaatcgatgttccaggttttttataatgtaaaaacagtgatgaacttctgggcattaacagagtgtatttcaatagacaaagcaatttggctatcgactatcaaagagtggcacaatgaaggcattatgaatatatgtcttatacttcagctttttagtagaaaatcaaatggactaatggtggttaaataa

SEQ ID NO: 692 - DNA, 528 bp, Staphylococcus epidermidis
gaaatgaggaaatgtgtattaatgacggtagcagcaagtgctacgctcttattggcaggttgtggcaatggtcaaaaagaagataaagatgttacggtatcgctacctactgaagcaaaggcggataaacttgacgcgcaaggctatgatgcagcgatgcccgtttatagtgcagtgtatgatgcattagttaaatatgataaagataagggtattaaagcaggtttagcagataaatggagcgttgatgaatcagggaaagtttatgaattccatttgaaaaagaatgttaaattctcagatggttcagcattagatgctaaggacgtgaaattctcgattgatcgtgcgaaagcgatgaacaaagattcgactgtagaaacgttaaaaaaattagataaggtcgttgttaaaaatgagcacgtggtccaaattagattgaaatctccttcaaatcaagtgttaaatgaattaacacaagtgagaccgttgcgtattatgagtccacattcagtagaaggttgttaa

SEQ ID NO: 693 - DNA, 792 bp, Staphylococcus epidermidis
ataaggaggaagatagatatgagtaaaacagcaattataacaggtgcagcaggtggattaggtaaaggtattgcagaacgtcttgctaacgatgggtttaatatagtactacaagatattaatgaagcacttctattagaaactgagaaagaattcaaagaaaaaggttatcaagctgtcgcattcaagagtgatgtatctaaaaagaaagaacaggaagaattagttcagttcgcagttacagaatttggtcaattagatgtcatggtgaataacgcaggtgttgatgcagtgacgccaattttagaaattggggaagaggaattatctaagttatttaatattaacgtatttggtacattgtttggaattcaagcagctgctaaccaatttattaaacaaaaaagtaaaggtaaaattatcaatgcatgtagtattgcaggacatgaatcttatgaagtactcggcacttactcagctacaaaacactctgtacgttccttcactcaaacagctgctaaagaattagcagacaaaggcattaccgtaaacgcttattgcccaggagttgccaaaactgaaatgtgggatcgtattgatgaagaaatggtgaaacttgatgatagtctagaaataggagacgcgtttgaagcattttcttcagaaatcaaacttggaagatatcaagagccatcagatgttgcgaacttagtatcattcttagcttcaaatgattctgattatattacaggccaatccattttaactgatggtggattagtgtacagataa

SEQ ID NO: 694 - DNA, 1338 bp, Staphylococcus epidermidis
tgcaaaattgaattgcgtttaatttatatgaggttaatcactttctttaaagatttaaaaagtattatatgttttaacagagaaagaaggatgaatgtgaagcaattaagtacaactttaaaagtccgattaatatgcgatttttttcaaaatattatagtcacggcatttttaccatttattgcgttgtatttaacagatatggtcaatcaacatttttcagggctttttttatttgggcttgtaatgataaattttccaatttctttgatttcaggtcatattattgaacgtttacctaaaaagacgttaacacttagttatcaatttatattaagtttaatgctcgtaattatggcgatttcaatatcacaacatacttttaagatcattttattttgtatcgcttacacaatatttagtatcacaataggcatgcagcaacctataatggacacgattattatggatgcgattacgcctgaagttgagcaatatatttataagataagttattggctgacgaatattgctgtcgcctttggtgcgctcataggtggattgatgtatggggcacataaatctatgttgtttttcatcgcttttgtcatttacattatggtttttatagcacttatcgtatggttgcctaaagatttaaatattgttactcagtcgcacacacatcatgctaatgagaaacaattctccatgggtcaaatattaaaaagttataaaccagcatttaaagatacaacatatctacttctaattataggatttagtattttaacaatgggtgagttatctgcatcatcgtacatttcagtgcgtttaaaacaagagtttgatccgatgatattgttttcgttacatatcaatggcgttaaaatgtattcacttctattaatgacgaatacaatcattgttataatttttacctattttatttcaaaaattgttatgagaatgaatgttaaaacagcattattggttggaattattttttatgtcattggatattcgaacctcacttatcttaatgattttacgttacttatcatatttatgattatagcgacgataggtgaaatggtatattctccaattcttgaagaaaatcgttttaaaatggttccttctcataaaagagggacatattcagcagtgcatgctttaggatttaacctagctgaattacttgcaagatttggaattatattaggagtgtttttaacttcaatggagatggggatctatatgtttgttttattattactaggtggcatgtcactttacattgcagtgagtcgttttaataatacaaattcacaataa

SEQ ID NO: 695 - DNA, 159 bp, Staphylococcus epidermidis
gttcaatctgatgatttaaacgcaatctatatgctaaaagattcgcacattgatttaattgatgatatgtcatcgatcgttgttcatattgcaacgcaatactatcgggatgttggtgcacttgacgttcgaatctttcaaccacggttttataagtga

SEQ ID NO: 696 - DNA, 243 bp, Staphylococcus epidermidis
aaaaccaccgataataatgatttccataacatcactcctaagtctgaaattttagttatgcttaacattgctatgactagtatggtgacgcaaattgtggacgataccatttgtttcattatcattttaattcctagaattgaaccgagtcgacgcatgagcatagtcattgttactgaacatgctgtaaatgttgaactaaaaaagactagcaacaataattggaatgcggaaagtctttga

SEQ ID NO: 697 - DNA, 528 bp, Staphylococcus epidermidis
ccacagttagacgatacaacaccgtttaaaaaaggtgttggcatagatttagcacgtttatctttggaaaaggcagagacattaaaaggacaacgtccacttacatactatttaacagataaaccgcaagaaacgaagcacgtgtttgatacggcagtaagtacgtctgtcttgtacttaatagaagatattccgcaacatgcaaaagatttaaaagaggtattgaaaccaggcggtgtttattacgcttcattcgcggatttaactaataacccaagtcgtcagtttatggatgacacgattaatcaatatggtgcaacaccttctcagaatcactctctaaaacatatcgttgatagctttgtggatgcaggatttgaagttgcagtaatgaaagagcatgtacctgacgtgattgatttaacacattatagcgatttttatttatcaccgaatgattatttacaaacactatatgaagaatcgtttttaataaaagcaagtgtgaaagaaggtactgagaaatga

SEQ ID NO: 698 - DNA, 165 bp, Staphylococcus epidermidis
ttgagcatagacacaaaagcactaatgagcattaccgtaacgatagcattacgtttagaagtcgtcatcgaaatgttagacatagaatggtactcctttcaaaatgaagttgcagacaccaaacttaagattgtgtggaagactattacagaaacaagttggtga

SEQ ID NO: 699 - DNA, 177 bp, Staphylococcus epidermidis
gtaaaggtagacgtattacaccacctcgggaatcataaaaagatgttaaatcaaaagctaggcacattacaagtgatacattgtaatgtgcctagctctatatataaagatttagtattattcttcaggatatttagctcttacttcagagataacactatccatactcatatttga

SEQ ID NO: 700 - DNA, 147 bp, Staphylococcus epidermidis
cgttttccagataaatgttcttcattgaaagtgaaggcaggtgatgtatctttagctattgcattcatatttggcatgccaaaaccattagttgtaaatgatggtgtgatggtctttgttgatagaggccaatgtttaaatgaatga

SEQ ID NO: 701 - DNA, 2079 bp, Staphylococcus epidermidis
  modified_base (2062)..(2062): a, c, g, t, unknown or other
tataaaaaagatagaggtgctttaaacatgaaaaataaaaagaattcatatagcattcgaaagttaagtgtaggtgcgtcttcaatcattgttgcatcgatgttatttattggcggaggctcagtacatgctgctgaatccaatcaccttgaaaatcaagaacaatcagaagtaagtgcatcacattctattgagatgcaacacaaaaatcaagaaactcaacaaactgagaataaagataataaaactaaccattcagaaacaattgataagactccaactatacataacaatggctactcatatcatgagacacctagtactgacgttaaatctaatgaagacaaacaaattgatagtcaattcaatcaacctcagacatctatgccaaataatgatcaacaaaaccctaaaaaagtagcggaacatacaacgaaaagtataaatgcaaaaaaagaagaaactagaaagaatgaaaatgcaaagagcctagtacaaccccaacaagatgataaaacaacatctgaacaaacaaaaatgaaagaatcacgtgaacaggagattacaaacgagcaaaagcagttacaaagtaaagatgtaaaaaatgctcaacaagaaaatcaaaatatagaccaagaaaaatctcaagaaaaaattaaagtccaacaatcgaacatcgaaaaggctcaaaaatcttcaagaatagatggaaaattagataatcaatacaataaagatgcaacgcaatcggatgaggggactgcatctgagaacgtttcagaacagcatataacagcaaaagatggaggtgttacacgaaataatcgtggagataaacatttaaatcaagaaaagccaacaacatcatcagataaagaacttaaagtggatgacatagacaaagatctttccacaaaagaatctcctgaaaatgaaaaagatgattctagaaaagggattaaagcaatcactaaaaattctcaggcaacaacaagaaatactgcgacaacagaagcatccaaagaattgaaggatcaaacaaataaagtagcatcacaaaaagaatataaaaatcatgaccctattattcttgtacacggctttaatggttatgcatcaggaactggtcccgttacaggaaaaggtaactattggggtggtgaccgtctcaaaattattcaagattatagagctaaaggttataacgtgatggaagcaagtgtaagtgcatttggcagtaattatgatagagctgtagaattgtactattacattaaaggtggacgcgtagactatggtgcggcacatgctgcaaaatatggacacgagcgttacggaaaaacatacgccggtgcttataaggattggaagcctggtcaaaaaattcatctcattggccatagtatgggtggtcaaacaattcgttatcttgaagagttattacgacatggtagtccagaagaggtagaataccaaaaacaacatggtggtgacatttctccgttatataaaggtggacaagataatatgatatcgtctattactactattgccacaccacataatggcacccatgctgcagatttattaggtaatgaagaaattattagacaagtagcatatgactatgcaaggtcaaaaggtaataaattatctcatgttgatgttggtttaagtcaatggggacttaaacaaagagaagacgaaacattagttcaatatattcaacgtgtgaaacaaagtaaattatggacaacaaaagataatggattttatgatttaactactgagggtacagatatcttaaatcaaaaaacatccttaaaccccaatattgtttacaaaacatatcagggtgaatctacaagaccaggtccaaatggtactcaaaaagcagatgtcaatatgaacataggctatacattaactgcaaatacgattggtaaagtaaaagacaaagcgtggagagaaaacgatggactagtgtctgtcatctctgggcaatatccattgaaccaagcgcatacgtttgcgacagataaagttcaaaaaggagtatggncagggacaccagtttaa

SEQ ID NO: 702 - DNA, 984 bp, Staphylococcus epidermidis
atcatgaaagaaaatttttggagtacattgccacgtccgttttttattctggcacctatggaagacgtgacagatattgtctttcggcatgttgtcagtgaagctgcgagaccagatgtattttttactgaatttaccaatactgagagttactgtcaccctgaaggtattcatagtgtgcgcggacgcttaacttttagtgacgacgaacaaccaatggtagcgcacatctggggcgataaaccagaacaattccgagaaatgagtatcggcttagcggatatgggctttaaaggtatagatttaaatatgggttgccctgtcgcaaacgttgcgaaaaaaggtaaaggatccggcttaattctacgacctgaaacggcagccgaaatcattcaagcttctaaagcaggtggtctaccggtcagtgtaaaaacacgtttaggttattacgatatcgatgaatggcgagactggttaaaacacgtcttcgaacaagatatcgcaaatttatccattcatctacgtacccgtaaagagatgagtaaagtagatgcacactgggaattaatcgaagcaatcaagacattacgtgatgaaattgcgccaaatacactattaactatcaatggtgatatccccgatagacaaactggtctagaactcgcaaataaatatggtattgatggcattatgattggtagagggatcttccataacccattcgcatttgaaaaggaaccacgcgaacattcaagcaaagaattattaggtttattacgcttacatctctctttatttgaaaaatatgataaagatgaagcccgacacttcaaaagtttacgcagattcttcaaaatctacgtacgcggcattagaggcgctagcgaactccgccatcaattaatgaacacccaatccattgccgaagcaagagaactactcgatacttttgaagcacgtatggatgcacgttcagaagtataa

SEQ ID NO: 703 - DNA, 513 bp, Staphylococcus epidermidis
caaacaatggaggacatcatgattttaactattttatttatctttttctgtattcgactcatcagcttaaagatatctatgcaacacgcaaaacagctaaaggtagagggcgcggtggaatatggtgtgaaaaattcaaaatatctagccattacgcatgtattaatttacatgagtgcagctatagaaacattcattcataaggatacatttaatctacttaacggcattggcttaatcatattaatcgtcgcttatatcatgttatttatagtcataaagacactagggcgtatttggacattgaaattatttatactgccaaatcaccctattatcaaatcaggattatataaagtaacaaaacatccaaactattttttaaatatcattccagaattaattggtgtattactactaacaaatgctacatacacaacactcttattagttccatatgcttattttttaattgtacgtatccgtcaagaagagaaattaatgaatatataa

SEQ ID NO: 704 - DNA, 978 bp, Staphylococcus epidermidis
tcattgaaggaggataatatgaagaattataaaaaatatctgattgttttagtattatgtctaacagtgttatctggatgtaacttacccggtttaaaaaatagtcattcagatgacgatgttagaatcacaagtttaggaacaagtgaatcacaaattatatcgcacatgctgagattacttattgaacatgatacaaaaggtgaaattaaacctaccttaattaataatttaggttcaagtacgattcaacataatgctgtcacaagtggccaagctaatatgtcaggtacgcgttatacaggcactgacttaacaggggcgttgaaagaagatccgattaaagatcctaaaaaggccatgaaagcgacacaagaaggatttaaaaagaaatacaatcaaacattcttcaattcgtatggtttcgaaaacacgtatgcattgatagtgacaaaagaaacagctaaaaaatatcatttagaaactgtttcagacttggaaaaacatgcgaaagatttaagagtaggtatggatagttcatggatggaccgcaaaggtgacggttatccagcatttaaaaaagaatatggttatagctttggtactgtgagacctatgcaaattggcctggtttacgatgcacttagttctggcaaattagacgtagcagtaggttattctacagatgggcgtatttcagcatacgatttaaaagtgttggaagatgatcgtcgattcttcccaccatacgatgccagtccccttgcatcagatcaattgttaaaagagaagccagagctcaaaccgattgttaaaaaattagaaggtaagatatcaacagaacaaatgcaagaattaaattatcaagctgatggtaaaggaaaagagcctgcaacagttgcagaggacttcttgaaaaaacatcattattttgaagacgatgacaataaaaaagataaacagaaaggtggtcaataa

SEQ ID NO: 705 - DNA, 1578 bp, Staphylococcus epidermidis
ctgtcgaaggagatgaaaccgttggaacaagcgatcaatgataataaaaagaaaaaacgttttaactttagaatgccaggtgcatttatgattctctttatcctaacagttgtcgcagttatagcaacttggataatccccgcgggtgcatactcaaaactttcatatgaaccttcatcccaagaattaaaaattgtcaatcctcatcatcaagtaaaaaaagttcctggaacacaaaaggagcttgatcgattaggagttaaaatcaaaatagaacaatttaaatctggtgcaattaataaacccgtttcaattcctaatacttacgaacgtctaaaacaacatccagctggtcttgatcaaattaccagtagcatggttaaaggaaccatcgaagccgtcgatattatggtctttatacttgttctaggtggattgattggcgttgttcaagcgagtgggtcctttgaatcaggattgttagcacttactcaaaaaacgaaaggccacgaatttatgcttatcgcctttgtctccatacttatgattataggcggaacgctatgtggtattgaagaggaagctgtagcgttctatcctgttctcgttccaatatttattgcgctcggatatgattctattgtctcagtcggtgcaattttcttagcaagctctgtgggcagtacattctcaacaatcaacccattctcagtcgtcattgcttctaacgcagcaggaacaacttttactgatggtctttattggagaataggcgcttgtatcatcggtgctatatttgttattagttatttgttctggtattgtaaaaaaattaaaaaagatcctaaatcctcttattcttatgaagacaaagcagcatttgaaaaacaatggtctgtgctccatgatgacggttcttctgagtttacattacgtaaaaagattattcttacgcttttcgtcttaccgttccctattatggtttggggcgtcatgacacaaggatggtggttcccagtcatggcatctgcattcttaatctttaccattgtcatcatgtttattgctggaacaggacaatatggtttaggtgaaaaaggtactgtagatgcattcgttaatggcgcttcaagtttagtaggtgtatctttaatcattggtttagctcgaggaattaacttagtattgaataaaggaatgatttctgacacaatcttgcacttttcatcatctatcgtgcaacatatgagtgggcctttatttatcattgttctgctctttatctttttctgtttaggatttatcgtgccatcatcatcaggattagcagtactatctatgcctatctttgcgccattagctgatacagtaggtataccaagatttgttattgttacaacatatcaattcggtcagtatgcaatgttgttcttagcgcctactggacttgtaatggcaacacttcaaatgttaaacatgcgttactcacactggttacgtttcgtatggcctgttgtcgcgtttgttttaatatttggtggaggcttactaattacacaagttttaatatactcataa

SEQ ID NO: 706 - DNA, 126 bp, Staphylococcus epidermidis
aatggagaggagtggaataacaggatgcactgtatgaatatgattaaattaatttctacttatacgttaaaacgttactttgtaatgagtgtgccaattttaccttctagtgctgcatctaattga

SEQ ID NO: 707 - DNA, 879 bp, Staphylococcus epidermidis
gggtcaagtttcaactgtcgcaacaggacaagcatatatagaacaggagacaatgacgcaaatatgaatgagcatacaaaaatagagaaccaattacaatattatttagaacaatttacgtacttacatcaactcgttttggaagatagtcggcatattgttgatttagaaaatttgattgatgaatacagtcaatggatacttcaacctttggcagagcatcattatttaacatggaatgatttagaaacaaaaataagctttaccaagaagcttcaagaggtatcagcaaagtgtgtgaaacaggtagaagtcattcgagcacaacgtttgttgaatggtagggcctccacgtcaggttatttcgaaaatatagagcattgtattaatgaagaattcggaagatggcaaattggacaaaatgacaagttgttactgattgggtcgggtgcatatcctatgacattaattcaagttgctaaagaaactggcgctgcggtcattggtatagatatagattcggaagcagttgatttagggcaacgtgtcgtcaatgtactagctccaaatgaagatatcgttattagtaatcaaacagttgatcaattagaagacatccaatctgtgactcatattattttcagttcgacgatacctatcaaatatgacattttgaatgaactttacacattgacgaatgatgaagttgttgtagctatgcgatacggtgatgatatgaaagcattgtttaattatccatctcaagcaactgacgaaacacaatggcgatgtgaagaactacaaacacgaccgaagcagatttttgatattgcactttatcgtaaagtggcatcaaaagttggtgttgaacatgtctaa

SEQ ID NO: 708 - DNA, 126 bp, Staphylococcus epidermidis
acatttcaacttagagctcataagccatatggggattatattcaaaataaattctactctatctcattttccacgctcttaatttacctctttattattaacttctttctttttaaaaagccataa

SEQ ID NO: 709 - DNA, 921 bp, Staphylococcus epidermidis
aaaataaaacttttagaggtgttaatgatgcaaaaagttgttttaacagcagctattactggcgctggagatacaatacaaaaaaatgagaacgtaccagttacaccacaagaacttgcagattcagcaattaaatgtgcacgagcaggagcaactgtcgcacatattcatgtaagagatcctgaaactggaggagtaagtcatgatccagaactgtatgctgaaacagttagattaattagagaagctgatgaagatatcgtcattaatgtgacatctggtggcggtggagacttcattccaagtcttgaacatccagagacaggtggagaaggaacttggatacaaacaccagaagaacgttttaaacctattggtgacttgttaccagaaatgtgtacattagattgtggtagtgtcaacatgggagatgcaatttatttaagtccggcatcatggctacgtaaacaagcacaaatggttaaagatgcaggagtcaaaccagagcttgaatgttttgatacaggccatgtgagttttgccaaacaaatgatagaagaaggattaattgatggagaccctatgttccaattttgtttaggtattccttggggtgcagagaatgatcctgaaacaatagaatatcttaaatcacgtataccagaaaatgcacattggtcagcatttggcattggtaagatgcaactgccaactgtaagaaaagttgcgcaacgtggaggaaatgttcgtgttggattggaagataatatttatttaagaaaaggtgtaaaagcaacgaatgaagcattggtagaagaggcaaaaagaattttagcagaactagatattgagccacttacacctgctgaagcaagagaaaaatttaatcttagaaatcctcatggtaaaggagacaaataa

SEQ ID NO: 710 - DNA, 1959 bp, Staphylococcus epidermidis
gggaaaaaacttatagaggtgatttttttgaaaaataataatgaaacaagaagatttagcattaggaagtacacggtgggagtcgtgtcaatcattactgggattacaatatttgtcagtggtcagcatgctcaagctgctgaaatgacacaatcatcatcagattctaacgaacagtcacaacaaacagaacaagttgaacacaaagaagatacaactcatttatctaacgaattgaatcaagagggtgagacagcgagccaatcaaagactagtcaagagaatcaatctgatggcaatgtacaaaaaaagagtaatcaaatacaacaagattcaacacaaacgtcaccattaaatgaccaaaaacaaacttcaatggaacaacaatcaaaagacaatcatgttaccccaaattcacgtcaggatacatatccaaaaggccaaaatcaagatgataaaggcaaacaacagtttaaagataatcaacactcacaaacaggacatcaacctaatactcaaaaccaaaataatgatcaagattcatcagataaaaagcaacacccatctgatcaaactcaagactcatcttcaaaaggaacacaacctaaacaatcacagtctatagaagatagagataaaacagtaaaacaaccatcttctaaagtacacaaaataggtaacacaaaaactgataaaacagttaaaacaaatcaaaaaaagcaaacatcattaacttcaccacgcgttgtgaaatcaaaacaaactaaacatatcaatcaacttactgcgcaagctcaatataaaaatcaatatccagtcgtgtttgtacatggatttgtaggtttagtcggtgaagatgcattcagcatgtacccaaattattggggtggtactaaatataacgtgaaacaagaacttacaaaattaggttaccgagttcacgaagccaatgtaggggcatttagcagcaattatgaccgtgctgttgaattgtattattatattaaaggtggacgagtagattatggtgctgcacatgctgcaaaatatggtcacaagcgttatggcagaacatatgaaggcatcatgcctgattgggaaccaggtaaaaagatacatcttgttggacatagtatgggtggccaaacgatacgcttgatggaacattttttaagaaatggaaatcaagaagaaatagactaccaacgtcaatatggtggtacggtatctgatttgtttaaaggtggccaagataacatggtgtctacgattactacattaggaacacctcataatggcacgcctgctgcagataaactagggtcgactaaatttatcaaagatacaattaatagaattggaaaaattggtggaactaaagcgctcgatttagaactaggtttttctcaatggggcttcaaacagcaacctaatgaatcatatgctgaatatgcaaaacgtatagcgaatagtaaagtttgggagactgaagatcaggctgtaaatgatttaacaactgctggagcagaaaagttaaaccaaatgacgacattgaaccctaatatcgtctatacatcgtatacaggtgctgcaacacatactggaccattaggcaatgaagtgccgaatattagacaattcccactattcgatttaacaagtcgtgtgataggtggagatgataataaaaatgtcagagtaaatgatggcatagtacctgtgtcttcttcactacatccaagtgatgaagcatttaagaaggtaggtatgatgaacctagcaactgacaagggtatttggcaagtgagacccgtacaatatgattgggatcatctagatttagtcggattagatactactgattataagcgaactggagaagaattaggtcaatgttatatgagtatgataaataatatgttgaaagtcgaagagttagatggtattacacgtaagtag

SEQ ID NO: 711 - DNA, 234 bp, Staphylococcus epidermidis
aaaaaaccttggtttcgagaaacacataaaaaacacccccaaccggttcaaatttttatggaccggaataggggccttgaatttttcttaattaaaaaagggttatccgccatttttcaattaggtccaaattttccaaacatgtggtcccaaaattttctaatttcttctttagagatacgaacttctgatgtatctgaaccacgaaagtcaccatggtcccatttatgttaa

SEQ ID NO: 712 - DNA, 906 bp, Staphylococcus epidermidis
aatttcagacttaggagtgatgttatggaaatcattattatcggtggttttttaggaagtggcaagacctcagcaataaatcatttaatcgctgatgcacttgaaaacaacttaaatcctgctgttattatgaatgaatttggaaaaagaagtgttgatggccaacttatagaacgtcctgaagtacctatgagtgaaatcactgaaggatgcatttgttgtgcgatgaaatcagacgtatcacaacaactacatgaactatacttaaaatatcaaccagatatcatctttattgaatgcagtggtgtagctgaaccactagctgtcgtcgatgcatgcttcacacccgtacttgcaccttttatcactttaaggagtatggtgggaattattgatgcaagcatgtattcacgaattaaatcttatccacaagacattgcagctctattttatgaacaacttcgtcattgttcgactttatttgttaataaaatagataagatagaggtggaagaaaccgcccgcttgctacgtcaactcgagcgtctcaatagcgatgccaatattcaagttggtcaatttggagaattaaatttaaaatcactgctagagccaacacatataaattcaaatgcatgtggcactttgcatagtaatataaatcatcaattcatcgaaaatcctaggctacaaacaaaagaagaaatgattagtgcgttagataacttgcctcaagatgtttaccgtgtcaaagggtttgttcgtttttcagatcagcaacacgtttatttagtacagtatgcacaaggaaatatagaattatctcccattcaacttaaaaacgatgtaccattgtacctcattgttataggcaaacatttaaaacaaatacaacttgatttataa

SEQ ID NO: 713 - DNA, 132 bp, Staphylococcus epidermidis
agggtgctatgtttatttataagtgttatatttagaaatgacttactgctcattatctataaagatttatacattgaaaatattgattgttttaacaataggaggtcatgttgttattatgagtcagtttaa

SEQ ID NO: 714 - DNA, 159 bp, Staphylococcus epidermidis
ctaaatcaatgcgaaaagcacatatatcgaaaattcattaaatatatagaagacattcaattaataaagaagaataaccttatttgtaacctcaacttatacttttgccacctctcctattccaataattccatatttaaacattttcatattctataa

SEQ ID NO: 715 - DNA, 720 bp, Staphylococcus epidermidis
actttaaaatgtaataagtttacattaaagataggtgacatgataaacatgaatatatttgtaactggaacgaatactgacatcggtaaaacgtatgtcactaaatatctctataaagcattaagaacgaggggatatcgggtatgtattttcaaaccttttcaaactgaagaaattggtggaggtagatacccagatttagaaatttataaaaacgaatgcgatttagactatgacgttacgtctctttacacattcaaagatccagtttcaccacatttagcattcaaaattgaaaggcatcagcaattgaaccatcaaacaatgatagacaaactcgaatcactaaaagcacaattcgatatgattctcattgaaggtgcgggcggtattgcagtgcctatctatgaatacagtgaccatttttatatgacaacagatttaattaaagacacatcggatttcattgtgagtgtcttaccttcaaagttaggtgcgattaatgatgccatcgttcaccagaaatatattgatcatcaagaacttcccccgaacgtgttaatcatgaataactatactgatagtgctattgaacaggataatttacataccattgaaaaattaatacacaagtctgtttatacgttaggtcatcaagcgactcaagaaagcttttccgaagcatttatacaacgaattataggaggatccaatggctaa

SEQ ID NO: 716 - DNA, 144 bp, Staphylococcus epidermidis
ccctcaaaatgttttaacacaataacttcaatacttaataatcatataccaaaactgccattaactaataagttaatggcagaaagtttttatatgaaattatttttcattaccttttttacgacgaccaaatatgaacaatga

SEQ ID NO: 717 - DNA, 804 bp, Staphylococcus epidermidis
atagaaagatgtgaaaatatgcaacattcaagcaaaataatagtatttgtaagtttcttaattttaacgatttttattggaggatgtggttttataaataaagaagatagcaaagaaacggaaatcaaacaaaactttaataaaatgttagacgtgtatccaactaaaaatctagaagacttttatgataaagagggctatcgtgatgaagagtttgataaagatgacaaaggaacatggattattaggtctgaaatgacaaaacagccaaaaggtaaaattatgacctcaagaggtatggttctctatatcaatcgcaacactagaacagccaaagggtattttttaatagataagataaaagatgatagtaatggtagaccgatagagaatgaaaagaaataccctgtaaaaatgaaccataataagatctttccaacaaagccaatatctgatgataagttaaaaaaagaaattgaaaacttcaaattttttgtgcaatatggaaattttaaaaacttaaaggattataaaaacggggatattttatacaatcctaatgttcctagttattctgcgaaatatcaattgagtaataatgaatataacgtacaacaattaagaaaaagatatgacatcccaactaaaaaagcacctaaactattgttaaaaagggatggcgacttaaaaggatcatccgtaggtcataaagacctagaatttacctttgtagagaataagaaagaaaacatcttttttacggatagtattaattttaaaccgactgagcgtgatgaatcatga

SEQ ID NO: 718 - DNA, 669 bp, Staphylococcus epidermidis
acagaaaggtggtcaataaacatggaagggaatttaatacaacaactcgttcactactaccaaatgaactttggctacctatgggaattgtttgttaatcatttgttaatgtctgtttacggtgttttactagcatgtttagtgggcatacctcttggtatcatcattgcaagatttggtaaattatcaggtgtgattattactatcgcgaatattattcaaactgttccggttattgctatgttagcgatattaatgcttagtatgggactcggtatgaatacagtcatttttactgtgttcttatatgccttgcttcctattattaaaaatacgtatacaggaattaatgaagttgatccaaatattaaagatgctggaaaaggtatgggaatgacgcgtaaccaagtattaactatgattgagttacctctgtcactttcagttattataggtggtattcggattgcccttgttgtagctattggtgtcgtagctgtaggttcatttattggtgcgccaacattaggtgatattgtgattagaggtacaaatgcaactgatggaacactattcattctagcaggtgcaatacctatcgttatcattgtcatacttatagatgttttattacgtttattagagaaaaagctagatccagctacgtaa

SEQ ID NO: 719 - DNA, 132 bp, Staphylococcus epidermidis
aaatctttgctcaatcaatatgtgtttgaatatttttcaaaccatccaacaagtaaatttaaagtgcttagaaaaataataattaaagaatacaaaggagaattaatgttaagcatacaaaaacaacgctag

SEQ ID NO: 720 - DNA, 150 bp, Staphylococcus epidermidis
gatttaattcgtgaatacatgcttgcatcaataattcccaccatactccttaaagtgataaaaggtgcaagtacgggtgtgaagcatgcatcgacgacagctagtggttcagctacaccactgcattcaataaagatgatatctggttga

SEQ ID NO: 721 - DNA, 963 bp, Staphylococcus epidermidis
atagcaatgctcaaacgtacaattaaattcatactttatttaatcgtaagttcgtttattatcttcattttagttgagaagacatctggtaatccagcgattctgtatctacaacgtcatggttatacgtcgattacgcaagacaatattgaagcggcacaacatcaacttggcttaggacaacatgtgttactaagatatatcgattgggttggacatgcactcacgggcaacttaggatacggctttagtacgaacgaagcagttaccgctatgataatggaagccatcgtgccgacgcttgtgctaatcattgtctctagttgtatcatgttgccatttggctatattgttggttacttcgttgggacgcgtccgcatacacgttacgctaatggaattcgtggattcgcccaagtgatgacctcaatgccagaatactggttagctattttattcatttattatttaggcgtacgttggcaattgttaccatttgtaggtagtgattcatggcaacactttgtgctgccaatcttcacaattgttgttatagaagggtgtcatatcttattgatgacagcacatctgattacacaaacgttagatcaagatgcgtatcaactggcgcagttaagacatttttcgttaaaagcgcgtatcatcgtacaaattaaagagatatttgcaccactaatgacgatttcaattaacagtatcattcatttaattggaaaagccgtaatactagaagtcatcttcagcatgtctggtataggtaaattgttgattaatgctattaaccaacgagattatccactgattcagggcattgtcatctttatcattgtctttattatgctaatgaattatttaggcgatgtgattattttgaagaatgaacctagacttcgacgacgtcatacccagcagtcaggcaatgagaaaagaggtacgatgtga

SEQ ID NO: 722 - DNA, 330 bp, Staphylococcus epidermidis
aaaggtgtgcttatgcataattacaacaacattaacatcgtaagtgatgattcaaaatatcaagaaatttgttggttccatacattagaaggtatttggcaccctgtagaagtagaaacttcaccattaaatattacatttaataaagatataacacctaattacgtttgtacgttaataaatgaagattccagaaaaataattttaagtaatgtagacaatccgaatatcattattgaaatgattcttattaattcaaaaaaattggtttttaatgctataagtaaagaaggcttaggtacctcgcctaaaatcacatttacaaaataa

SEQ ID NO: 723 - DNA, 129 bp, Staphylococcus epidermidis
acaattaagcgcgaaaactcagtaatcatttatttaaaagttgtagtcagctatgtgagttttgtggtaatatcatcatgcgtaaaaattcgagattattattataaagaaggtttaaataaatcatga

SEQ ID NO: 724 - DNA, 1035 bp, Staphylococcus epidermidis
atattaaagcgtaacaatttcgatttaggagatgtacacatgtataaaaaaggtttaattttattttttgtagcagtactaacattggcacttgctgcttgcggtaaagatagtcataatcagtcatctgatcataaaggaaaattagatgtgaacacaacagtctatccacttaaatcatttgcacagcaaattggtggtaaatatgtaaatgttgaatcggtttaccctaaaggcgtagatccacatacatatgatccaagtcaaaaacaaatggtagatattgggaaatcagacttattcttatatactggtgataacttagatcccgtagctaagaaaatcgctaaagctataaatgataaagataaaacactatcactagaatcgactttagataaaaataaagatttattaaaaggcgaagaacatgaacatgagcacggagaaggtcacgaacatggtgaatcacatgaagatgaacacgaacatgaacatcatcaccatggaaaatacgacccacacatttggttggatcctgtagtaagtcaaaaatttgctaaagcgattaaagatgaattgattgagaaagatagcaaacataaatcttattatgaaaagaattacaaccaactagttaaagagttaaaagacttagataaagatatgaaacatgctgtgaaaggtaatgaagataaaactgtttatatttcacacgactctataggttatctagctgaacgctatcattttgaacaagaaggcattgaaaatatgaatgcggaagaaccaagccaaaaagatttaacaaatattgttaagcaaattaaagaagataaagtgaaaaatattttaatagaagaaaatgtatctcataaagtagcagatacggtaagaaaagagacaaatgctaaaacaattaaattttacaatatgggatcacacacaaaacaacaagatgatgacaacaatacttaccaatcatttatgaaagaaaatattaaagctattgaaaaagccctacaaaatgaataa

SEQ ID NO: 725 - DNA, 195 bp, Staphylococcus epidermidis
tctaatattttagaaggtttacgcgaaaataaccacgctactccgaagaataaaatactaaaaataggcaacaacgcttgggccgtaccagatgaaataaatggtgaaaatgctatttcaaatgacgtcgtcgcaagtcttggcaacgcaaaaaacggacctataacaagatataagccaattgtgaacaaataa

SEQ ID NO: 726 - DNA, 144 bp, Staphylococcus epidermidis
aaaacaattaggaaaataaaaattaacaaaatcttaataaatatagttttattaaaattacgagcaatttggtatgaattatacatttctaatttaaaaaattattgtgaatttgtattattaaaacgactcactgcaatgtaa

SEQ ID NO: 727 - DNA, 1401 bp, Staphylococcus epidermidis
cggaagagtaggaggccacttacgatgagcgaacagtttaataaagggaaacaactaattgtagcgattatcttagggattctcacatactggttatttgcacagtcttttttgaatatcgcaccacatgttcaacgtttttatcatgtagatatgagtattgttaatattgcggtcagtctgacatcactcttaacaggtgtatttatagtcgtagcagggggattatctgataaaataggtcgagttaaaatcacaaatgcaggtctaatattaagtatacttggctctattgcattgatcatctcgcatgcaccaattttattattattagggcgtgttttacagggcttatctgccgcatgcttacttccagcaaccatcgcgttaattaattctttcttccaaggtgaagaaagacaaaaggtgcttagttattggtcattcggatcctatggtggaacagggttagcatccctatttgctggaattatagctacatttattggatggcgatggattttcgtgttgtcaatcattttttcaattatcgccttaatattgcttagaggtataccagaatctaaagatgagtctgcatataataaaaaatttgatatcgttggaatcattatttttgttgtcatgatgttaagcattaacgtagtgattacgcaaggagatagaattggatggttaaatcctcttatattgatattaattgctatattcattgtgacattaattgcattttatatatttgaaaaacgtcaagatgaaccttttatagatttaagtttattttcaaataatgtttatattggaacaacattagccaacttgatggtgaacatggatattggttcattagcattatttaatatttatgttcaagacgataagcatttatcagctgcacaagccggtttaattacaattccatatatgctgtgtagtttgttaatgattcgtgttggtgaacgttttatgcaaaaaagaggaccgcaattgccattgatgttaggtccggtatcaattactgttggtattatacttttagcattcacttctttgcctaatatgatttattatattgtggcatgtattggctttatctttataggtctaggattaggattttttgctactcccgcgctatctactgctgtatctaatgttccagctgaaaaagcaggtactgcatcaggaattatcaaaatgacttctacactaggtgcagcatttggaatcgctgttgtgacaacaatatatacggcattatctgtaaatcacccggcatatttagcagctactatcgcatttatcgtgggtgcaggtttagtgtttatcgcatttattgcggcgtattgtttaattcctaaaaagaatgtagatatttaa

SEQ ID NO: 728 - DNA, 144 bp, Staphylococcus epidermidis
atatttaaaaggtatattgttgcagtaaaaagcagtgttagtaatttgaagttgtatttaataatgcataaaaacaacaacttttcgacaaatatattaacaacatttgacatttcccaatcttattactaccaccatgtttaa

SEQ ID NO: 729 - DNA, 153 bp, Staphylococcus epidermidis
aaacggggaagaaatagagtaaaagtacagtcaattgtcgaaattaaaaatttagaaaatggaaatatttcccaggaaattgacaacgttagcatattaaaagctagcgttgtttttgtatgcttaacattaattctcctttgtattctttaa

SEQ ID NO: 730 - DNA, 126 bp, Staphylococcus epidermidis
ataggtatgagtaacgcaggacttaccatcgtaatatatacaagcattgaagaaacagctgaaagtgtgaacactttatttttaaacacacgcatatttaacaatggatgttttaatttaagctga

SEQ ID NO: 731 - DNA, 948 bp, Staphylococcus epidermidis
aaggaagtgagtgaaatggctaaaattgtagtagctttaggtggaaacgctttaggaaaatcaccacaagaacaacttgaattagtaaaaaatacagctaaatccctagtaggattaattactaaaggtcacgaaattgtgattagtcacggtaatggaccacaagtaggaagtattaaccttggtctgaattatgcagctgaacacgatcaaggtcctgcttttccatttgctgaatgtggcgctatgagtcaagcctacatcggctatcaacttcaagaaagtttacaaaatgaacttcattcaatgggcatagataagcaagttgtcacactagttacccaagtagaagttgatgaaggcgatccagcttttaatagtccaagtaaacccatcggtctgttctacactaaagaagaagcaaatcgtattcaacaggaaaaaggttatcaatttgtagaagatgctggtcgaggttaccgtcgcgttgtaccatcaccacaaccaatatctattatcgaactggaaagtattaaaactctagtagaaaatgacacactcgtcatcgctgcaggtggaggtggtataccagtcattcgcgaacagcatgatagctttaaaggtatagatgccgtcatcgataaagacaaaacaagtgcattattaggtgctgatattcactgtgatcaactcattattttaacagcgattgattatgtttatatcaactatcatactgaccaacaacaagcacttaaaacaacaaatatagatacgcttaaaacatatattgaagaaaaacaatttgccaaaggcagcatgctacctaaaatcgaatctgccatctcctttattgaaaataatcctaacggtagcgtgctcatcacatcattaaatcaattagatgcagcactagaaggtaaaattggcacactcattacaaagtaa

SEQ ID NO: 732 - DNA, 336 bp, Staphylococcus epidermidis
atcatacggaggtttttttctatgaaaagagcttcttattcagtagaaacaaagtataaagcagttgaaatgaaagcagcaggattttcaacaaaagaaattatgaaagaattaaatattagaaataggacgcaagtgaaaacttggtggcgatggtatcgaaatggggaaagttatagattttcacaacaagttggtaaacaatatacctacggtaaaggattagaagagctgtcagaagtagaacaattaaaattagaaaataagagaaaagatatagaattggatattttaaaaaagtacaaggcattggaaaggaagtggtaccaacagtag

SEQ ID NO: 733 - DNA, 246 bp, Staphylococcus epidermidis
tataataggaggaacagtaagatgaaagtgtataagttgaattatcaacaccataaagatattgttgatgataatgtattaacgatgttcgtaacagctgacaatcaagatgaagttgaagcgtttgcgaaaaaattacattacaagattgaacatttatctccattaactaaaaaggaatttgaagatgagaaagcgaaagattcacactatagacttgaacacgtggatcactatttaaattaa

SEQ ID NO: 734 - DNA, 2994 bp, Staphylococcus epidermidis
atacatgggaggtataatatgggcaaacgtagacaaggtcctattaataaaaaagtggattttttacctaacaaattaaacaagtattctataagaaaattcactgttggtacggcctcaatattacttggttcgacacttatttttggaagtagtagccatgaagcgaaagctgcagaagaaaaacaagttgatccaattacacaagctaatcaaaatgatagtagtgaaagatcacttgaaaacacaaatcaacctactgtaaacaatgaagcaccacagatgtcttctacattgcaagcagaagaaggaagcaatgcagaagcacctcaatctgagccaacgaaggcagaagaaggaggcaatgcagaagcacctcaatctgagccaacgaaggcagaagaaggaggcaatgcagaagcacctcaatctgagccaacgaaggcagaagaaggaggcaatgcagaagcacctcaatctgagccaacgaaggcagaagaaggaggcaatgcagaagcacctcaatctgagccaacgaagacagaagaaggaagcaatgcagaagcaccgaatgttccaactatcaaagctaattcagataatgatacacaaacacaattttcagaagcccctacaagaaatgacctagctagaaaagaagatatccctgctgtttctaaaaacgaggaattacaatcatcacaaccaaacactgacagtaaaatagaacctacaacttcagaacctgtgaatttaaattatagttctccgtttatgtccttattaagcatgcctgctgatagttcatccaataacactaaaaatacaatagatataccgccaactacggttaaaggtagagataattacgatttttacggtagagtagatatcgaaagtaatcctacagatttaaatgcgacaaatttaacgagatataattatggacagccacctggtacaacaacagctggtgcagttcaatttaaaaatcaagttagttttgataaagatttcgactttaacattagagtagcaaacaatcgtcaaagtaatacaactggtgcagatggttggggctttatgttcagcaagaaagatggggatgatttcctaaaaaacggtggtatcttacgtgaaaaaggtacacctagtgcagctggtttcagaattgatacaggatattataataacgatccattagataaaatacagaaacaagctggtcaaggctatagagggtatgggacatttgttaaaaatgactcccaaggtaatacttctaaagtaggatcaggtactccatcaacagattttcttaactacgcagataatactactaatgatttagatggtaaattccatggtcaaaaattaaataatgttaatttgaaatataatgcttcaaatcaaacttttacagctacttatgctggtaaaacttggacggctacgttatctgaattaggattgagtccaactgatagttacaattttttagttacatcaagtcaatatggaaatggtaatagtggtacatacgcaagtggcgttatgagagctgatttagatggtgcaacattgacatacactcctaaagcagtcgatggagatccaattatatcaactaaggaaataccatttaataagaaacgtgaatttgatccaaacttagccccaggtacagaaaaagtagtccaaaaaggtgaaccaggaattgaaacaacaacaacaccaacttatgtcaatcctaatacaggagaaaaagttggcgaaggtgaaccaacagaaaaaataacaaaacaaccagtggatgaaatcgttcattatggtggcgaagaaatcaagccaggccataaggatgaatttgatccaaatgcaccgaaaggtagtcaaacaacgcaaccaggtaagccgggggttaaaaatcctgatacaggcgaagtagttactccacctgtggatgatgtgacaaaatatggtccagttgatggagatccgatcacgtcaacggaagaaattccattcgacaagaaacgtgaattcaatcctgatttaaaaccaggtgaagagcgtgttaaacaaaaaggtgaaccaggaacaaaaacaattacaacaccaacaactaagaacccattaacaggggaaaaagttggcgaaggtgaaccaacagaaaaagtaacaaaacaaccagtagatgaaatcacagaatatggtggcgaagaaatcaagccaggccataaggatgaatttgatccaaatgcaccgaaaggtagccaagaggacgttccaggtaaaccaggagttaaaaaccctgatacaggcgaagtagttactccaccagtggatgatgtgacaaaatatggtccagttgatggagatccgattacgtcaacggaagaaattccgtttgataaaaaacgcgaatttgatccaaacttagcgccaggtacagagaaagtcgttcaaaaaggtgaaccaggaacaaaaacaattacaacaccaacaactaagaacccattaacaggggaaaaagttggcgaaggtgaaccaacagaaaaagtaacaaaacaaccagtggatgaaatcgttcattatggtggcgaagaaatcaagccaggccataaggatgaatttgatccaaatgcaccgaaaggtagccaagaggacgttccaggtaaaccaggagttaaaaaccctgatacaggcgaagtagttactccaccagtggatgatgtgacaaaatatggtccagttgatggagatccgattacgtcaacggaagaaattccgtttgataaaaaacgcgaatttgatccaaacttagcgccaggtacagagaaagtcgttcaaaaaggtgaaccaggaacaaaaacaattacaacaccaacaactaagaacccattaacaggggaaaaagttggcgaaggtgaaccaacagaaaaaataacaaaacaaccagtagatgaaatcacagaatatggtggcgaataa

SEQ ID NO: 735 - DNA, 195 bp, Staphylococcus epidermidis
cgtatttatggttattggtcattgattccaaagtttagttattatatttttaatgaaataccatgccattttcatatctttaacagtataaataattacattatctttttaaaaataaaatatattaagattttctttttcatttttaatatcatcatatcagtttatttacccaccttaccattagcgttataa

SEQ ID NO: 736 - DNA, 318 bp, Staphylococcus epidermidis
tcctcccatggaaccatttgctttaagccttctcttataatcctttcatcatcacaaataactactttaaacatctttattcctcctagacaagtggtatttggtaacacattaatgtcccttgctggcttcttgagaaaatgtgcagacgtgcatatgttccatattgaatcatggctctattatgtaaatgatttaaacctaggtgtgtcgtatcaaaaacatcgtgatgaagggattggcgcacgtgttctaaatgtgatggagacataccgatgccattatcatgaaccagaatatgtaatttgcgcttcgtaa

SEQ ID NO: 737 - DNA, 3246 bp, Staphylococcus epidermidis
atcaagccaggccataaggatgaatttgatccaaatgcaccgaaaggtagccaagaggacgttccaggtaaaccaggagttaaaaaccctgatacaggcgaagtagtcacaccaccagtggatgatgtgacaaaatatggtccagttgatggagatccgatcacgtcaacggaagaaattccattcgacaagaaacgtgaattcaatcctgatttaaaaccaggtgaagagcgcgttaaacagaaaggtgaaccaggaacaaaaacaattacaacaccaacaactaagaacccattaacaggggaaaaagttggcgaaggtgaaccaacagaaaaagtaacaaaacaaccagtagatgaaatcacagaatatggtggcgaagaaatcaagccaggccataaggatgaatttgatccaaatgcaccgaaaggtagccaagaggacgttccaggtaaaccaggagttaaaaaccctgatacaggcgaagtagttactccaccagtggatgatgtgacaaaatatggtccagttgatggagatccgattacgtcaacggaagaaattccgtttgataaaaaacgcgaatttgatccaaacttagcgccaggtacagagaaagtcgttcaaaaaggtgaaccaggaacaaaaacaattactacaccaactactaagaacccattaacaggggaaaaagttggcgaaggtgaaccaacagaaaaagtaacaaaacaaccagtggatgaaatcgttcattatggtggcgaagaaatcaagccaggccataaggatgaatttgatccaaatgcaccgaaaggtagccaagaggacgttccaggtaaaccaggagttaaaaaccctgatacaggcgaagtagttactccaccagtggatgatgtgacaaaatatggtccagttgatggagatccgatcacgtcaacggaagaaattccgtttgataaaaaacgcgaatttgatccaaacttagcgccaggtacagagaaagtcgttcaaaaaggtgaaccaggaacaaaaacaattacaacgccaacaactaagaacccattaacaggggaaaaagttggtgaaggtgaaccaacagaaaaaataacaaaacaaccagtggatgagatcgttcattatggtggcgaagaaatcaagccaggccataaagatgaatttgatccaaatgcaccgaaaggtagtcaaacaacgcaaccaggtaagccaggagttaaaaatcctgatacaggcgaagtagtcacaccaccagtggatgatgtgacaaaatatggtccagttgatggagatccgattacgtcaacggaagaaattccattcgacaagaaacgtgaattcaatcctgatttaaaaccaggtgaagagcgtgttaaacaaaaaggtgaaccaggaacaaaaacaattacaacaccaacaactaagaacccattaacaggggaaaaagttggcgaaggtgaaccaacagaaaaaataacaaaacaaccagtagatgaaatcacagaatatggtggcgaagaaatcaagccaggccataaggatgaatttgatccgaacgcaccgaaaggtagtcaaacaacgcaaccaggtaagccaggagttaaaaatcctgatacaggcgaagtagtcacaccaccagtggatgatgtgacaaaatatggtccagttgatggagatccgattacgtcaacggaagaaattccgtttgataaaaaacgcgaatttgatccaaacttagcgccaggtacagagaaagtcgttcaaaaaggtgaaccaggaacaaaaacaattacaacgccaacaactaagaacccattaacaggggaaaaagttggtgaaggtgaaccaacagaaaaaataacaaaacaaccagtggatgagatcgttcattatggtggcgaagaaatcaagccaggccataaggatgaatttgatccaaacgcaccgaaaggtagccaagaggacgttccaggtaaaccaggagttaaaaatcctgatacaggcgaagtagtcacaccaccagtggatgatgtgacaaaatatggtccagttgatggagattcgattacgtcaacggaagaaattccgtttgataaaaaacgcgaatttgatccaaacttagcgccaggtacagagaaagtcgttcaaaaaggtgaaccaggaacaaaaacaattacaacgccaacaactaagaacccattaacaggagaaaaagttggcgaaggtgaaccaacagaaaaaataacaaaacaaccagtggatgagattgttcattatggtggtgaacaaataccacaaggtcataaagatgaatttgatccaaatgcacctgtagatagtaaaactgaagttccaggtaaaccaggagttaaaaatcctgatacaggtgaagttgttaccccaccagtggatgatgtgacaaaatatggtccgaaagttggtaatccaatcacatcaacggaagagattccatttgataagaaacgtgtatttaatcctgatttaaaaccaggtgaagagcgcgttaaacaaaaaggtgaaccaggaacaaaaacaattacaacaccaatattagttaatcctattacaggagaaaaagttggcgaaggtaaatcaacagaaaaagtcactaaacaacctgttgacgaaattgttgagtatggtccaacaaaagcagaaccaggtaaaccagcggaaccaggtaaaccagcggaaccaggtaaaccagcggaaccaggtacgccagcagaaccaggtaaaccagcggaaccaggtacgccagcagaaccaggtaaaccagcggaaccaggtaaaccagcggaaccaggtaaaccagcggaaccaggtacgccagcagaaccaggtacgccagcagaaccaggtaaaccagcggaaccaggtacgccagcagaaccaggtaaaccagcggaaccaggtacgccagcagaaccaggtaaaccagcggaaccaggtacgccagcagaaccaggtaaaccagcggaatcaggtaaaccagtggaaccaggtaaaccagtggaaccaggtacgccagcacaatcaggtgcaccagaacaaccaaatagatcaatgcattcaacagataataaaaatcaattacctgatacaggtgaaaatcgtcaagctaatgagggaactttagtcggatctctattagcaattgtcggatcattgttcatatttggtcgtcgtaaaaaaggtaatgaaaaataa

SEQ ID NO: 738 - DNA, 1128 bp, Staphylococcus epidermidis
attcagaaaggatgtactatcatgtctcatcatcgcatcatcatcatcggcgcaggagccgctggtgtgggtatggcaatcactttacaagaattcaatattaaagatgttctaattgttgaaaagggaaccatcggtcattcatttaaacattggcctctatcaacaaagaccatcacaccatcatttacaactaatggttttggcatgccaaatatgaatgcaatagctaaagatacatcacctgccttcactttcaatgaagaacatttatctggaaaacgttatgctgaatacctctcactagtagctacgcattacaatctaaatgtcaaaacaaataccaatgtttcacgtgtaacatacatagatggtatatatcatgtatcaacggactatggcgtgtatacagcagattatatatttatagcaactggagactattcattcccatatcatcctttttcatatggacttcattacagtgaaattcaaacattcactcaattaaaaggtgatgcttttacaatcattggtggtaatgagagtgcttttgatgcagccataaaccttagtcaaacaggtgcaaaaatatcaatatatacatctaaaactggacttaaaaaggaagatgcagacccaagtataagattatcaccgcatactcaacagcgattacagaatgctatacaagagggtgcattaatcgaaatgcatgttggctaccaggcacgcaaaataacatatcaaaatcattcctataagatacactttgataatggacatattgttcactctcatactgaaccgattattgcaactggatttgatgttacccaaaaccctttaatagaacaactatttcaagtacgacaatcagaagttcaattaacagaattagacgaatctacaaagtttcctaatgtatttttaattggggcgactgtacgtcatcaaaatgccattctttgttatatatataaattcagagcacgttttgcagtattagcacgcatagtaagcctacgcgaaggcttacctgaagatacgtctttaattcagtcatatcgtcaaaaaaatatgtttctagacgattatagttgttgtgatgtgaattgcacatgttaa

SEQ ID NO: 739 - DNA, 939 bp, Staphylococcus epidermidis
gtggaaagggggagtcaaaaggtgaaaacgctaatgattaaagcaatggggacggtgatacgtttatcgattgaacatcaacatccggatacattacttcaagaagctgaaataaaaattcgtgcttgggaatcacaatttagtgctaatgatccgaaatcagatttgatgaatgtgaatcaacatgcaggtatcgcaccagtcaaggttagttctgaaatctttaacatgatacgttatggttatgaaactacattatcttctaattttaagatgaacattttgatagggccactagtcaaattatggaaaattggttttaaagatgcattgaaacctaaagaagtggatatacaacgtgctttattgtgtatgaatcctgaaaatcttgttctaaattcaaaaacacatgaagtatttcttacacaatcaggaatggagattgatttaggagccatagttaaaggttattttgctgatcaattacagcaatactttttagctcatggtgtatcttctggcattatcgatttaggtggtaatgttttaacaattggtagacaacccgaaacattagaaaaatggcatgtaggtgtacgtaatccatttcataaggatacactaccactcgttacattaagcgtagagcatcaatcagttgtcacatcaggtatctacgaacgctacttcatacaggaaaatcaattatttcatcatatattggattcaacaacaggttatcctgtagataatgatatcgctagcgtgacaatcatatctgatcatgggattgatggcgaggtatggagtacaatttgtagttttggtcagtcacaaaaaaatattgaattattaaatctcattgacggtattgaaggcattattgtgacaagagatggaagcgttttaatgacttcgaaaatgcaaaagtatttataa

SEQ ID NO: 740 - DNA, 984 bp, Staphylococcus epidermidis
tgggatattatgaaagttaaactttatacgttgttattattactcatttttctgatagcatgcgctccaacatcgacttcacaatcacctcatcctttacgtacgttgattgtttattctccttatccatcacatttaattcgtccgattttaaatgattttgaaaagcgagaacatgtgaaagttgaaatcaaacatggctcaactcaagtattactatctaatattcacaaagaagcactttctaaacgtggggatgtctttgtgggtggcgtgttatcagagatgatagatcatcaagaagattttgttccttaccataatcgttctacactgaaacaaatagaggattatcgctctaacaacccattagtcacgagctttctattgatgccaacagtaattgtagtgaatacagatttacaaggtgatatgactattcatggatataaagacttacttcagtcttcactaaaggggcgtgtcgtttattctaatcctcattctacgacgacaggataccaacatatgcgtgcgatgtatcatatgcgtcaccaagtaagcgatgttcatcaatttcaacaccatgctgtacagttatctaaaagttctcaagtgattgaaaaggtggctaaaggtgcttattacgctggattgagttatgaacaagatgctagaacgtggaaacaaaaaggataccctatctcaatcatttaccctactgaggggacgatgttaaatgtagatggtattgctttagttaacaatgcacaacctcatcccaaacgtaaaaagttagtacaatatttaacaagccgttctgtacaacaacgtttggcagaagaatttgatgctaaatcaatacgtaaagacgtgactgaaacaaatcactcatctattgaaaacttggatcatattccactaatcccacaatcacgtgtatccaatattccacatcatcaatttttggagatgattcaatga

SEQ ID NO: 741 - DNA, 777 bp, Staphylococcus epidermidis
gccaagattatggctcatattacattaaattatttatctaaaactttaggaatgcatcaaacgattaatgtcattcttccagaagataaaagttactttgatacaaatgaaaatgcgaaaccattaaaaactatgttattgctacatggtttatcaagtgatacttcctcttatatgagatatacgagtatagaacgctacgcgaatacccaccaactagcagtggtgatgcctaatgccgatcatagtttctattcaaatatggcttatggacatagttattatgactatatactagaagtttatgattatgttcatcaaatattgccattgtctaaaaagagagaagataattttatagcaggtcactctatgggaggttatggtgcaatcaaatttgcattaacgcaaagttatcgtttctcaaaagccgccatgctttcagcgccatatgatgtttctatgattggtcaatatcaatggtatgattttacgccagaagcgattgtaggtaatacgcaacatgtcgcggggacatcttttgatccatactatttagttgaacaagcaatagacaatggacaagcgttaccacaactatatattacttgtggaactgaagatgaactgtatcaaggtaatattgattttgtgaactatttagatgaaaaaggtattccatatcaatttaaaaaagcgccaggtaatcacgattatgcattttgggataaagcaatagaagatgtcattgaccgttttacatcatcacatatttaa

SEQ ID NO: 742 - DNA, 393 bp, Staphylococcus epidermidis
ttagtttatattataaatatattaatatttaagattttaggagatgcacaaatgcttaaaattaatttttttaataaggaatatggagttttaaaatcacaaaattacgaaagaatttcactagaattattgaacaaacattaccatataactgaaaatgattttaaaaacaaagattattgtttggataaatttaatagtaaagatacatttattggcgatatagcacatacagagaaagagttaatttctttaattgaagataatattaaaaatcctaaaaatatggagcatcaaaatctatcaagcatattcgattatacagatcatcataataaccaacgtgtctatcacagtattttagatcttatacaagacaatacgtcttcttaa

SEQ ID NO: 743 - DNA, 774 bp, Staphylococcus epidermidis
tcaccgtatattcatggctattatttatacggtagcgataggtattatatatttatggattcaattgtaaaggagtcatattcaatgatagatattcaaaatgtttccaaaagctataaaaagaagcatattttcgattccctagatatgcaatttcaaaatcataaaattactattttattaggtgaaaatggtgctggaaaatctacattattgcgtttaattgcaggtattgagaatgcagacgaaggacgtattcaatacttcaatcaatatttgtcaagacgtcgaatacgtcatattgtaggctatgtccctcaagacatcgcactattcgagcatatgactgtcatggagaacattgagtttttcaagtcactttgtgaaaatcctatttcagatgaaacacttcattcttatttatcacaattaaactttactgatacaaaagtgaaagtatctaacctttctgggggaaataaacgtaaagtcaatattatgataggtctacttagtcggcctaaaatacttattctagatgagccaacagaagacattgatttagaatcaagatatgatattcacaacttattacaacaaatgaccgatcaatgtttaatcatcatgacgacacatcatttagacgaagttgaagcactagcagatgatattaaagttataggtcaaaatcctttttatcatgatattttagaaaataaaggttggtcttttaaaaaatatgcaaatgccttagctgataatacgaaatcttaa

SEQ ID NO: 744 - DNA, 243 bp, Staphylococcus epidermidis
acttatcatataatatatgttcctctgtcaacgtcggttaattatgaaaaaatattaagtagctccattccgttgcttaatacttttttattcacttttaaaaatccaagaaaagagagaacgaattcgccctctcttttttgtgtagtagtactattaaattttatctcactaacaattaatatacttattactaaaatgatgtatttaaaaactataataatcttgaaatataataattaa

SEQ ID NO: 745 - DNA, 219 bp, Staphylococcus epidermidis
ataattaatattgaagctacccaatatgagggtagagctgttagtagaaaagctattgaacgtatagcacgatctggaaatctaccactagtcaaagcactcactatgcctagtacaacagacgttatcatcaccacaacactggaaatcaaagtgagttttaatgtattcataaacgctggccccatacgctcagatactggatcccctgtgatataa

SEQ ID NO: 746 - DNA, 129 bp, Staphylococcus epidermidis
tataacaatataaatgaagttcaaaagggtggaggacggttaattgaaaaagtttttaaaaggatttattttattttttctcattgtgatgctaggatttgcagggggattgggatacagtcattataa

SEQ ID NO: 747 - DNA, 396 bp, Staphylococcus epidermidis
gaagcaaatatttcattaaaaataaggtgcatatcaatgaaaagattgatttttatagttgttattctctttatccaagcctgtagttatgttgttattaactttttcttcttcgacatgtgggtgattcactctagtgaacaacaattaaatcaatccatacaacatcatgacacaaagcaacttcataagattgctaaagataagcagacatatcagtttttaaaaactataaaaaaagccgatttcgaaaatgcgacagataaccaaggtggtgggcctattggttattatcgtttagatattaataaaaaacccgtcggacttacaatcaatattaaatataacttccttccagaaaagacaactattaaatcaataaagttatatcaataa

SEQ ID NO: 748 - DNA, 3054 bp, Staphylococcus epidermidis
tgtgaaaatattcacaaaaaactaggaggatttgctatgagtaaggaaatattcgatacttttaaatttaaatgtggtgccgaattaaaaaatagagtattaatggcacccatgactatccaagctgggtattttgatggaagtgttacatcagaaatgattgattattatcaatttagagctggtgatgcttcagcaatcattgttgaaagttgttttgttgaaaatcacggacgaggatttccgggagctataggtattgataatgatgacaaaatacctggactcaaacgtttagcagaagcgattcaagctaagggatcaaaagcgattttgcaactttatcatgccggaagaatggcaaatcctaaatttaatgaaggagagcagccgatatctgcgagccccattgcagcattaagacctgatgctgtaccacctagagaaatgacacatgctcaaatcaatcagatgattgatgactttggagaggctacacgtcgcgctatagaagcggggtttgatggtgtcgaaattcatggcgccaacacatacttattacaacaatttttctctccacattctaatcggagacaagattcatggggaggcagtcgtgaaaaacgtacacgatttccaatcgaagttttaacaaaggttcaacacgtcgttgctgaaaaagaggcttctcattttattataggatatcgattctcacctgaagaaattgaagaaccaggcatacgttttgaagataccatgtttttactaaatacattagcagaatatgaacctgattacttccatatatcagcaaacagttatcaacgtacatctattgtgaatcaagaagatacagaacctttaattaataagtacatcaaaatgcaaagtgcacagttggcaaaaattccattaattggtgtaggtagtattgcccaacgacaagatgcagaacatgcccttgaactaggatatgatcttttaagtgttgggaaagcctatttagtggaaccacaatggacagataaaatttcacaaaacgaagaagtagaacaatttgtcgatatacatgatcagaaagtacttcacataccatcccctttatggaaagtaatggactttatgattttagataaagaagaagagcatcgtaaatatgaaaaattaaaagcacttcaaaataaaaaagttaaatttaacaaaggtacgtatcatgtctatgcaaaaggtcataatggcaacttacctatgaaagtccaattatcagaagataagattgtaagtatcgaggtagatgatagcggagagtctgaaggcatagcgaacccagtgtttgaacgtttacctcaagatattatcaatgggcaaacactgaatgtagatgtcatttcaggtgcgacagtaacaagtgaaggcatcgtgcaaggtattgcagatgcaattgaacaagcaggagaagacccagatattttacgggcgcgtcctaaaccagtcgttcagtggtctgatgaggtcgttgaagagacgactgacgtcgttgtgatcggtacaggaggtgccggactcagtgcagctgctacggtattagatgaaggaaaagaagtcatcatgcttgagaaatttgcggctataggtggcaatactatccgtacaggtggtcaagtcaacgctgctgagcctaaatggcaaaatgcattcccggcacttgctggtgaaaaagagacactcatacagttattaaatcatgatgaaaatgatatagatgaagcttacattgaagatttcaatactttaaaacgtcaaattaaagactaccttgaaaatagcagtaatgaagatgaatatctttttgattctgtcgaattacatcgtattcaaacatatttaggtggtaaacgtaaagatcgtaataatgtcgaaatatcaggtgattatgatttagttaaaacactcacagataacgttttggaatcagtatattggttgaaagacaaaggtgtacattttgatcgttcgtttgtagatatgcctgtaggtgctttatggcgtcgtggtcataaaccaatgaaagcacaaggtttagagtacattgaaaatttaggagactacgttaaacataatcatggtcgtatttttacagaaactactgcagaaaagttaatcaaagaaggtaatcaagttgttggtattgaagcacgtaaagcaaatggtgctaaagtgaagattcatacacgtcatggtgtagtgttggctactggtggctttggagcgaatacaaaaatgctacaacaatataatacgtattgggataatattcctgatgacattaagacaacgaattctcctgcaattacaggtgatggtatacgtttaggtgtgcaggcaggcgctgacatcgtaggtatgggattctctcaaatgatgccgatttctgatccgaagacaggtgcattgtttactggattaattgtaacaccttcaaactttgtcttcgttaataaggaaggacagcgttttgttaacgaatttgaaagtagagatgtattatctaaggcagcattagaacaaaaagacggtatcttctatattattgcagatgcaaatattaaagcactagctatgaatacaactgaggataaaattaatcaagaattagaagacggcactttagtaaaagcagataccttagaagcattagcccaaaaattaaacattgatacaactacttttgtgaacacgattgaaagatataataccttcgtagaacaaggacaagatgaggatttcaataaaaatgcatttgatttaaaaattgaaaaagcaccattctacgcgacaccacgtaaacctgcaatacatcatactatgggtggtttaaaaataaacacgcatgcacaagttatagatgttgaaggtcatatcattgaaggtttatatgcggctggtgaagttgccggtggtattcatgctggtaaccgtttaggcggaaatgcactggcagatatttttacttttggtcgcattgcaggtcaaagtgctgtaacgaaataa

SEQ ID NO: 749 - DNA, 1221 bp, Staphylococcus epidermidis
gtatgtctaataaagaaattaaaaaaatggttaaaattttcaacaaagccttacatcaaacattgggtaagaagtaagaggggatttatggacattaaagcacagttaaaacagattcaagataaaggtttatatagagagcttcagccgattcagtccgtagaaaaacaatatatttatatcaatgaccaatcttatattaattttacttcgaacgattatctcggtataggacaacttgaatatcaacctcaaaatttcttagattttataaagacatatagtatccatctatcaagttctagattagtgagtggcaactcagtcgtttatcagcaattagaacaggcaattagcgagcattttaattttgaagacgccttaatttttaatagtggttacgatgcgaatttggcggtatttaatatttttaaaaataataatgtagttatcttttcggatcaacagaatcacgccagtataatagacggtattaaattaagtggtttatcaaaagtgatttatcaacatttaaactatgatgacctggaaagtcatttagcacggcacaccaatccagatgttcaaaaagtaattgtctctgatagtgtgttttctactaatggcactaaagcagatattaataggctagtacatctcaagcaacgttacaatgcgattttaattattgacgcatctcatagtttaggattaaatctctttgagtatcatgcagacattgacatagttacttcaagtttatctaaagcgtggggagcccatggtggcttaatactaagttcaaaagatataaaagatttaattattaataaaggtcgttcgcttatctactcgagtagtttacctagctatcatttgtattttattcaagtgagcttacaacatgtgattgaagatacatacagacgagagaagttgaatgcacttagtgaatattttaaccaccaatttatggaattatttcccaatcaaccattatctaatacacctatcaaaaatatcgtttgtgatagtttggcttcagcacaagcacaatacgacatgttatttgaacatggtatatttgtcagttatttaaggtatccaacagtgtcacagccaacattaagaatttcattatcctattttcatgacacagatgatattaatcgacttttcaatgtaatgaaacaatacgatgaaggtgatagctatgtatag

SEQ ID NO: 750 - DNA, 141 bp, Staphylococcus epidermidis
cctatcataataaaaataaagcatccttcactttacgatgagggatgctttatgaattttcatataaaaattaaatctgcagactattcttttttattcaattctttatcaagttttacaagtgttggttttggaatatga

SEQ ID NO: 751 - DNA, 321 bp, Staphylococcus epidermidis
tgtgactttttcaaaaaaatgtgtcgtaaaattcttgtatataagcatactatcacagtaattaagggtttctttctccacacttcacacaatttttttaatacccctttactatcaatagttatcgagtttaactacataccttttgatattggtaagcttaataaaacttttcaaacatacaaacaattgaatataccattattattcaaaagaatcctttctaacgaactatatactataattaaagttttacaaaaatttgaaagtctaaattttacatattttatatatatagcgcacttcattattatgctataa

SEQ ID NO: 752 - DNA, 885 bp, Staphylococcus epidermidis
ggtgaatcaatgaataaattatcaaagtacattgcaatagctacattagcatcgacagttacaatttcagcaccaattcatacatatgcatgtgaatctcatactaaagataaccataatcaaacgacacaacatcaaaatgaccccaaccttggtgaacaaaatgtaatggctgtctcatggtatcaaaattctgccgaagcgaaggcactttatctacagggatacaatactgcaaaatatcagttagatgaacatattaaaaagaataaaggtaagaaaaaacttgctatagctttagacttagatgaaacagttcttgataattcaccatatcaaggatatgcttctatgcacgatacgtcttttccagaaggatggcatgaatgggttgctgcagcgaaggcaaaacctgtttatggcgccaaatcattcttaaaatatgctgacaaaaaaggtatcgatatttactatatttctgaccgtgataaagaaaaagattttaaagctacaaaggaaaatttaaaaaatattggactaccgcaagcgaaagataatcatattttactaaaagggaaaaacgataaaagtaaagcatcacgacgtcaacaagtcgaaaaaaatcataagttagtgatgttatttggtgacaatttgttagattttacagatcctaaaaaatctactgctaaagaacgtgagaaactcgtgaagaaacatgcaaaagattttggcaaaaagtatattattttcccaaatccaatgtatggaagttgggaatcgacactttatcataatcaatacgaaataagtaagaatgagaaggatgaactacgaaaggcatcaattaaacaatttaatcctaaaacgggtgaagtaaaataa

SEQ ID NO: 753 - DNA, 1365 bp, Staphylococcus epidermidis
gaggatccaatggctaatacacgagagttaaatcataaagatgcacagtatgtatggcacccattcacacagatgggagtctatgctaaaaatgacaatattattattgaaaaaggtcgcggaagttatttatacgatactgaaggtaataaatatttagatggttatgcgtcattatgggtcaatgtgcatggacatcagcataaaaagttaaataaagctattcataaacaacttgataagattgcccattctacgctattaggttcgtctaatattccatcgattgagctagccgaacagttagtcaaattaacaccagatagattacaaaaagtgttttactccgatacagggagtgcgtcggtagagattgctattaagatggcttatcaatattggaagaatatcgatgctaaacgatatgcgaagaagaataaatttcttacattacatcatggatatcatggagatacaataggttctgttagcgttggtggtatcgatagtttccacaaaatttttaaagaccttatttttgaaaatatacagatagaaacaccgtgtttatataaaagtaagtaccgcaatgaagcggaaatgcttaattcaatactgaatcaaattgaaaatatattatctgagagaaatgatgaaatagtaggatttattctagagccacttatacaaggtgcaacaggtttattcgttcatccgcatggttttttgaaagctgtagaacagttatgtagaaaatatgatgtattactaatttgtgatgaagtagctgttggtttcggacgtacgggagaaatgtttgcttgtaaccatgaagatgtacaaccagatattatgtgtctgggtaaggcgattacaggtggttatttaccgttagcggcaactttaacatctcaaaagatatatgatgcttttttaagtcagagtcacggtaagaatacgtttttccacggtcatacatatacaggtaatcagttagtttgttccgtagcacttgagaatattaatctttttaaaaagaagcatctgattgggcacattcaaaagacatctcaaacattaaagcaacgcttagaggcacttcaacctcataaaaatattggagatattaaagggcggggattaatgtatggtgtggaattagttgaaaacaaatcaacgcagacaccactcgatattccaactgtagaactgattatacgtcgatgtaaagagaatggattgatgattcgtaatttggaaaatgtcatcactttcgtacctattttaagtatgtctaataaagaaattaaaaaaatggttaaaattttcaacaaagccttacatcaaacattgggtaagaagtaa

SEQ ID NO: 754 - DNA, 588 bp, Staphylococcus epidermidis
ataattacaattatatattatttagaattcgataaagaaggtgacgaaatgcctagaatttccaaaagacaattaatattagaatcggccgcagctattattaatgaaaaaggtgctgattatctcacgttggatgctgtagctcaaagggctggaataagtaaaggtggtttattttatcattttaaaagtaaagatgaactcatcaaagagctggttaactatgccaataatttgtacagagagaacgtgaaccaacatatcggtaatgaaaagaacaaaaaagggcaatggctcaacgcatttatagaagcgacaagagcacatcgtacggataatgcgcctattacttctggaatgttagcggcgcaagggactaatagaagtttattatcaccattaaagacctcatatcaagaatggcaatatcaaattacccacgacgggttagatgaggtagatgcaaccattattcgtttagctgtcgatggtttatggttgtcggaaatattcggaattagtgctatagatgaagaaatgagagagaaagttattgaacgtttaaagatgcaaatagaaaaaaagtaa

SEQ ID NO: 755 - DNA, 816 bp, Staphylococcus epidermidis
atgtatacaataatagagagatgtgaaaagatgaaatattatgggaagtgcatttcttacataagcattttaatattaacgttttttattggcggatgtggatttatgaataaagaaaataataaagaagcagagattaaagaaaattttaataaaacattaagtatgtatccaattaaaaatttagaagatttatacgataaagaaggctatcgtgatgaagaatttgaaaaagaggacaaagggacatggattattaattcagaaatgaatattcagaaaaaaggtcaagcgatgaaatctagaggtatggttttgtatatgaatagaaatactagaaagacgactggtcatttttatacaaatataattacagaagataaaaaagggagagtgcacagtaaagataaagaatatccggttcgccttaaaaacaataaaattgaaccgactaaatctatcgccgatgaaaaattaaaaaatgaaattaaaaactttcagtttttctctcaatatgggaattttaaaaatttaaaagactacaagaatggaaatgtgtcttataacccaaacgtaccaagctattcggcagagtaccaattaagtaatgaagatgacaatgtgaagcaactcagaaagaggtatgatattccgattaagagagctcctaaactaatattaaaaggggacggtgaccttaaaggttcatctataggttataaagatatcgagttttcttttgtcgacaataaagaagaaagcgtctactttgtggatagtttggaatttaatccaagtgatgtaaataatgagtag

SEQ ID NO: 756 - DNA, 156 bp, Staphylococcus epidermidis
atgttcacaattatatcaaatattaatcaaagaataaattttactcttttaaattatgcttctttgaatctttttaataaaaaaagagtggaacagaatccatacagaattctttattccactctcacaaaactaactagagttgacagcctttaa

SEQ ID NO: 757 - DNA, 195 bp, Staphylococcus epidermidis
gttattcaaatgaatcattttggtaagcttcatcgtatatcattaatattaaatattatgtttttaatactcatgcctaaaatctatagttttgataatatttatttatcaataatttggactttgttaggaatagcaaatgctgtctacttattgattaagcaaaaacaagaaaacaccattaaacgtaaataa

SEQ ID NO: 758 - DNA, 978 bp, Staphylococcus epidermidis
aggagacaaataatgaaattcgcagttgttggaacaggtgtaattggtagtggatggattactagaatgcttgcgcatggtcatgaagtgattgctactgatccaagtgaaggtgcatatgaacgcatgttgacacaagttaaacaaaattggccttacgcagagcaaatgggccttgctgaaaatgcatcaattcaaaacctaacatttacaccacatttagaagaagcggtcaaagatgcggatcatattcaagaaaatgtaccagaagtagaagaaattaaagatgctgtattaaaagagattgatttttatgcgaaacctgaagcaacaattggttcaagtacatcaggaattatgccttcagaattacaagctaacttatcacatcctgaacgattagttgttgcccatccatttcacccggtatatattttgccattagtcgaaattgtgccaggtaagcaaacatctgaagaaacaacagttaaagccgaacagatttatgaaagtattggtatggatgttttacatgtgcgtcatgaaatagaaggacatattgcagatcgtcttatggaagcattatggcgtgaatcattgcacatagttaatgatggtattgcaacaacagaggaagttgataaggcgtttacccatgcagcaggtttacgttatgcacaatatggtccatttatgacgttccacttggcaggtggtgaaggtggtatgcgtcatatgttaaaacaatttgggccagctttaaaaaaaccttggacaaaactcatcgcgcctgaactgacagatgacctatatcataaagtagtaagtggtagtgaagcatcttctcaaggatatacaatgtctgaacttgatcaaaaaagaaacgaatttctaattaaagtgaaagaattagcagaacaatattggccaagtgatagtaaagcgatgaaaaagtctaacggagcggaattacaatga

SEQ ID NO: 759 - DNA, 1257 bp, Staphylococcus epidermidis
aaagtgaaaatcattactaaaaatgaggaggactgtgaaatgactgtattgagtgagcaagacaaaataagattattagctgatatcgtcaagattcaaactgagaatgatcatgaaattgaagtatgtgagtacttaaaagacctgttaagtcaatatgatattgattctaagattgttaaagttaatgattcacgcgctaatttagttgctgaaattggtagtggcgctccagtcttagcaatcagtggacacatggatgttgtagatgctggtgaccatgatgattggacttttcctccatttgaactcacagataaggatggcaagttattcggcagaggtaccactgacatgaaaggtggtcttatggcgatggtcatcgcgatgattgaattgaaacaatcaaacgcattaaagcaaggtacgatacgtttattagctactacaggagaagagacggaacaatatggtgcacaattacttgctgatgaaggttacttagatgatgtgagtggtttaattattggcgaaccaactagtaatatcgcttactatgctcataaaggttctatgagctgtgtagtcacagcgaaaggtaaggctgcacacagttctatgccacacctaggtacaaatgctgttgatattttagttgattttgtaaatgaaatgaaacaagaatataaaaatattaaagagcatgataaagtacatgagctagacgctgttccaatgattgagaagcatctccatagaaaaattggtgaagaagaatcacatatctactctggatttgtaatgttaaactctgttttcaatggtggtaaacaagttaattctgttcctcataaagcgacagctaaatataatgtaagaactgttccagagtatgacagtactttcgtgaaggatttatttgaaaaagtcattcgtcatgtgggtgaagattatttaactgtagatatacctagcagtcatgatccagtggcaagtgatcgtgataatcctcttattcaaaatattacacgtattgcaccgaattatgtacatgaagacattgttgtgagtgcattgattggtacaactgatgcatctagtttcctaggaacaaatgaaaataacgtagattttgctgtctttggacctggtgaatctattatggcgcatcaagttgatgaatttattagaaaagatatgtatttaagttacattgatgtttataaagatgtatttaaagcatatctagaaaaataa

SEQ ID NO: 760 - DNA, 2271 bp, Staphylococcus epidermidis
caatacgaaatggaggcggagagtatgttagaaacaaataatcatactaatgcttggcaaggatttaaaacaggtcgttggaataaaaatatagacgtgagagaattcatacaattgaactattcattatatgaaggtgacgatgaatttttagaaggtcctacaaaagcaactgaaactttatgggatcaagtaatgcaattatcaaaagaagaacgtgagcgcggtggcatgtgggatatggatactaaagtggcatcgacaatcacttctcatgacgctggttacttagacaaagatttagaaaaagttgttggtgttcaaactgaaaaaccattcaaacgttctatgcaaccattcggtggtattcgtatggcaaaagcagcatgtgaagcgtatggttacgaattagacccagaaacagaaaaaatcttcactgaatatcgtaaaacacataaccaaggtgtattcgatgcatattcaagagaaatgttaaattgtcgtaaagctggtattattactggtttaccagatgcttacggacgtggacgtattatcggagactatcgtcgtgttgctttatacggtgtagacttcttaatggaacaaaaacttaaagactttaacacaatgtccactgaaatgtctgaagatgtgattcgtttacgtgaagaattatcagaacaatatcgctcacttcaagatttaaaagaattaggacaaaaatatggatttgatattagccgtcctgctactaacttcaaagaagctgtgcaatggttatacttagcatatttagctgctatcaaagaacaaaatggtgcagcaatgagtttaggacgtacttcaacattcttagatatttatgctgaacgtgatttacaaaatggtgacatcactgaacaagaagttcaagaaatcattgaccacttcattatgaaattacgtatcgttaaattcgcacgtacgcctgaatataatgaattattctctggagatccaacttgggtaactgaatctatcggtggtgtaggtattgacggccgtccgatggtaactaaaaactcattccgtttcttacactcattagataatttaggtccagcaccagaaccaaacttaacagtattatggtctacacgcttacctgaaaacttcaaaatctattgtgctaaaatgagtattaaaacgagctcaatccaatatgaaaatgatgatttaatgcgtgaaagctatggcgatgattatggtatcgcttgctgtgtatctgccatgaagattggtaaacaaatgcaattcttcggtgcacgtgctaacttagctaaagcattactttacgctatcaatggtggtaaagatgaaaaatctggcaaacaagttggaccaagttatgaaggtattaaatcagacgtactagattatgatgaagtcttcgaaagatatgaaaaaatgatggactggttagctggcgtatacatcaactcattaaatatcattcactatatgcatgataaatacagctatgaacgtcttgaaatggctttacatgatacagaaattattcgcacaatggcaactggtatcgctggattgtctgtggcagctgactctttatcagcgattaaatatgcacaagttaaacctatccgtaatgaagaaggtcttgtaactgactttgaaatcgaaggcgacttccctaaatatggtaataatgacagtcgtgttgatgaaattgcagtagatttagttgaacgtttcatgactaaattacgtagccataaaacataccgtaattctgaacacacaatgagtgtattaacaattacttcaaacgttgtttatggtaagaaaactggtaacacaccagatggacgtaaagctggcgaaccatttgcgcctggtgcaaacccaatgcatggtcgtgaccaaaaaggtgcattatcttcactaagttctgtagctaaaataccttatgattgctgtaaagatggtatctcaaatacatttagtatcgtaccgaaatcactaggtaaagaagaagcagatcaaaataaaaacttaactagtatgttagatggttatgcaatgcaacatggtcatcacctcaatattaacgtgtttaatagagaaacattaattgatgcaatggaacacccagaagagtatccacaattaacgattcgtgtatctggatacgctgtaaacttcattaaattaacacgtgaacaacaattagatgttatttcacgtacattccacgaatctatgtaa

SEQ ID NO: 761 - DNA, 504 bp, Staphylococcus epidermidis
cggagcggaattacaatgatgaatcaacagtatgtgtttcacacaaaagtacatcgtgattgggtagatcataacgggcacctaaatgatgcaatgtataaccgaattttcagtgatacaacagatgattggttaggtcatttaggcttaactattaatgccattcaatcttatcaatataccgtattcaccttagaaaatcatgtcatgtttcttaatgaaatgaaagaaaatgaagatgtcattgttaaagtacatcttcacgattatgatagcaaacgattacatgtcctaatggaaatgtttaatgcagatgatgatttatgtgcaacatatgaagtgatgctgatgggcattgatacgacttcaggaagaccttcagcctttccgaacgacattttgaataacattgaacactattataatattgagaatgtggagatgacatctcaatatataggtcatcgtattggcatcaagaaaaagccaaaaagcaaagagtaa

SEQ ID NO: 762 - DNA, 291 bp, Staphylococcus epidermidis
ctaagcaccttttgtctttcttcaccttggaagaaagaattaattaacgcgatggttgctggaagtaagcatgcggcagataagccctgtaaaacacgccctaataataataaaattggtgcatgcgagatgatcaatgcaatagagccaagtatacttaatattagacctgcatttgtgattttaactcgacctattttatcagataatccccctgctacgactataaatacacctgttaagagtgatgtcagactgaccgcaatattaacaatactcatatctacatga

SEQ ID NO: 763 - DNA, 255 bp, Staphylococcus epidermidis
tacgttatgatggattttttacattacatactgccagtcattatatacgctgttttgcttgctattcattactttttatcgcgtacgggaaataaaatattaggccttattgtgcctgttggtgtgattgcaagtcttgtatatatgtatcaagccgatattatacatatgaaaatgattggcgttattattataggtattgtggctctattattcttggcagaggagtggcagagagcacaaaaggataaataa

SEQ ID NO: 764 - DNA, 642 bp, Staphylococcus epidermidis
gacaccatgataaagtttatttcggaacatagtggtatgttatttgcaaagactttcgaacatttgtacatatcgatagtggcattggttattgcaatgatcgtagcggttcctttaggcattttattatctaaaaaagaaaagctttcgaaagtgtcattgacgatagctggcgttttacaaacgatacctacattagcggtattagctttaatgattccattatttggcgtaggaaaaacacctgcaattatagcgttatttttatatgtattattaccaattttaaataatacgattataggcattcaaaatatagattccaaccttagagaagcaggacgtagtatgggaatgactaactttcaattgatgaaagatgttgagttgccactcgcattaccattaatacttagtggaattagactgtcttcggtctatgtcattagttgggcaacattggcaagttatgttggtgctggtggtttaggtgattttatctttaacggattagcgctatttgaaccgagtatgattattactgcaactattcttgtcactgctattgcacttattgtagattatgttttatcactgattgaaaaatgggttgtacctaaaggattaaaagtttccagataa

SEQ ID NO: 765 - DNA, 192 bp, Staphylococcus epidermidis
ttaaactcgataactattgatagtaaaggggtattaaaaaaattgtgtgaagtgtggagaaagaaacccttaattactgtgatagtatgcttatatacaagaattttacgacacatttttttgaaaaagtcacactatcaaaaattaaaaaatattattataataaatgttgtgaaaaacgtattagattaa

SEQ ID NO: 766 - DNA, 711 bp, Staphylococcus epidermidis
aacaatacgatgaaggtgatagctatgtatagtataaaaatgcgtgcaagccacgaagatgttcatattagtggtgctgaaacaatgtgtgaatttgaggatttagaaaattatttaaaaaaatattttaataaagcctttaatcatgaaaatggaaatatagatttcttaaatttgaaaattgaaaaggttaaggcaccgattcaaacgttagtagcattaccagtggttgaaaatctaaacgatactttaacacaattagcaaaacaaacaggtgtttctgaatatgcgctaaacaaagggttagaatttataaaaaatgatattacttatactggagccattattctatctgcacaaaccggacaacgacttgatagcactgaacaacgaggtatcagggtaacacaattagcatttaaaacatgcaaatgtaatggagaaatatcagaaagagtaaaagatgcacgtgcacttgcaacttgtatcaatgcatttgaaggtgtaaaagcagaactatgtgtatcagacgatttgcattacacgactggatattttgcgtcgcctaagttaggatatcgtagaatctttaatattaaagaaaaaggtacgcgtcacggaggaagaattatcttcgtagacgaaggaataaatttaaatgaatatgtttcctttttagaaacagtacctaaagaaattatagaaaaataa

SEQ ID NO: 767 - DNA, 171 bp, Staphylococcus epidermidis
tcttattttgtcttgctcactcaatacagtcatttcacagtcctcctcatttttagtaatgattttcactttttaataaaaaataaaaatccttgtacacttaatattatcaaaaacttttatttattaaaaattatatgccaaaataaatggatttttaataaaaaataa

SEQ ID NO: 768 - DNA, 579 bp, Staphylococcus epidermidis
agaatgaatgtagcagatatcaaagcacgcttattagatttagaaaatacttttaaagaaaaagaaagtgaactgactgatttagacagagctatcggtgatggagatcatggtgtaaatatggtcagaggtttcgaacacttaaaagaaaaaatagatgatcaaagtatgcaagcgctatttaaatcaacaggtatgacattaatgtctaacgtaggtggtgcttctggaccattatacggatttggttttatcaaaatggcgagtgcagtgaatgatgaaattgatcatgataatcttaaagaggtacttaaagcgtttgctgatggcattcaacaacgtggtaaagtcgaattaaatgaaaaaacgatgtatgatgttatcgaacgtgcgagagaagctgttgaaaaaaatgaaacagtagatctagataaactacaatcatttgctaatgaaaccaaagatatggtagctactaaaggccgtgcatcatattttaacgaagcttcaaaaggttatattgatcctggtgcacaaagtagtgtttatattcttaatgcaattataggaggagagtaa

SEQ ID NO: 769 - DNA, 228 bp, Staphylococcus epidermidis
aatatttgcttcttatatttaatttatcataatattgttcagtttaacttaaaattcacgatgttcaatatatattcatcattctatattttgtataaaaagcatggactatatttaacagtttgctcatttacttttcggcccactatatgtttaagtaatcagtctaaaacttatttttatgtcacttttgtaaattgctcgagatttactactactaaatattaa

SEQ ID NO: 770 - DNA, 948 bp, Staphylococcus epidermidis
aggagcgtcgtcatggttaaatttattatgaaacgtcttacgctcatgattccattattgattgtagtgacttttatgactttcatgatgacctatctcacgaacgaagatccagccgtaacaattttacatgcccaaggaacgcctaatataacgcaagatttaatagctgaaactaaagaaaaatatggattaaatcaaccgatattcacgcaatataaaaattggcttgttgatgccttgcagtttaaatttggaacgagttatatcacaggggatccagtatctgagcgtatggggccagcgtttatgaatacattaaaactcactttgatttccagtgttgtggtgatgataacgtctgttgtactaggcatagtgagtgctttgactagtggtagatttccagatcgtgctatacgttcaatagcttttctactaacagctctaccctcatattgggtagcttcaatattaattatttatgtatctgtaaaactcaatttattaccaacctcaggactcactggtccagaaagttatattcttccagtctttgttattacgattacctatgcaggaatttattttagaaatgtccgacgatctatgcttgaacaattaaatgaagattatgttttgtatttaaaagctagtggtgtacctcgtctgacaatgttgctgcatgtattacgtaatgcattacaggtagccatatctattttttgtatgtcgataccaatgattatgggaggtctagtcgttattgaaaatgtatttgcgtggccgggtttaggaccattaagtattaaagcgattactgaacatgattttccagtaattcaagcatacgtgctcattgtcgcggtgttgtttattctttttaatacacttgcagacatcattaatgcaatattaaatccgcgtttaagggaggcaatgaaatga

SEQ ID NO: 771 - DNA, 165 bp, Staphylococcus epidermidis
agaccatcagtaaaagttgttcctgctgcgttagaagcaatgacgactgagaatgggttgattgttgagaatgtactgcccacagagcttgctaagaaaattgcaccgactgagacaatagaatcatatccgagcgcaataaatattggaacgagaacaggatag

SEQ ID NO: 772 - DNA, 774 bp, Staphylococcus epidermidis
ttgacgatggtaaacattatggaaaaatttaaattaactggtaaggtggcaatggtcattggaggtgcaactggcattggtaaagctatggcagaggcattagcacaagcaggggcaaatatcgttatcgctgatttgcaatccaatattggtcaagaaacagccacaactatatctacacaatcaggtgttaaaaccacatcattaaaattagatataactcatctagatgaagtaaatcaaattgttgattatgtagtaagggaatatggaaaaatagatattcttgtcaataacgctagtatctcaattcaagatgatactgaaaatatttcgtatgaagaatggttaaaagaaatcaatttaagcttaaatggagcattctctgtagcgcaaacagtaggacgtcaaatgattgagaagggcagtggttcgatgattaatgtctcttcagtattaggattgattgctaataaaacgcaagaccagagctcttatgaaacgtctaaagccggtgtgacgatgctgactaaaagcttagctagagaatggtctagatatggaattaaagtaaatgcaattgcccctggttacatgagaacaatcgaaacggaaaagatactaaatgataatactgaaacaaatacaacgcctatggaacgagtaggtgagcctgaagaattagctggaataacagtttatcttgcttctgatgcatcatcgtttactcaaggtagtgtatttaatattgatggcggttattcagcattataa

SEQ ID NO: 773 - DNA, 585 bp, Staphylococcus epidermidis
ttaatcctattacaggagaaaaagttggcgaaggtaaatcaacagaaaaagtcactaaacaacctgttgacgaaattgttgagtatggtccaacaaaagcagaaccaggtaaaccagcggaaccaggtaaaccagcggaaccaggtaaaccagcggaaccaggtacgccagcagaaccaggtaaaccagcggaaccaggtacgccagcagaaccaggtaaaccagcggaaccaggtaaaccagcggaaccaggtaaaccagcggaaccaggtacgccagcagaaccaggtacgccagcagaaccaggtaaaccagcggaaccaggtacgccagcagaaccaggtaaaccagcggaaccaggtacgccagcagaaccaggtaaaccagcggaaccaggtacgccagcagaaccaggtaaaccagcggaatcaggtaaaccagtggaaccaggtaaaccagtggaaccaggtacgccagcacaatcaggtgcaccagaacaaccaaatagatcaatgcattcaacagataataaaaatcaattacctgatacaggtgaaaatcgtcaagctaatgagggaactttag

SEQ ID NO: 774 - DNA, 1422 bp, Staphylococcus epidermidis
tgtgatatattttttttaacgaagatgataggggtgttagggatgaacttttttgatattcataaaatgccaaacaaagggataccattatctgtacaacgcaaattatggctcagaaactttatgcaagcgttttttgtcgtattctttgtttacatggcgatgtatttaattcgaaacaattttaaagcggcacaaccgttattaaaagaagaaatcggattaacaacattagaactaggttatataggattagcgtttagtattacttacggtttaggaaaaacaatactcggttatttcgttgatgggcgtaatacgaaacgtattatttccttcttattaatattatctgcgattacagtacttattatgggatttgtattaagttatttcggttctgtgatggggctattaattgtattgtgggggcttaacggtatatttcaatctgtgggtgggcctgcaagttactcaacgatttcaaggtgggcgcctcgaacaaagcgcggtcgttatttaggcttttggaatacatcacataacattggtggtgctattgctggtggtgtcgcactttggggcgcgaatacatttttccacggtaatgtggttggaatgtttatttttccttccgtcatagctttaatcattgggattgtgacattatttattggtaaagatgatccagaggaattaggttggaatcgtgccgaagaaatttgggaagagcctatcgaccaagaaaacattgattctcaaggtatgactaaatgggatatctttaaaaaatatatccttggaaatcctgtgatttggattttgtgtatctctaatgtttttgtatatatcgtgcgtattggtattgataactgggcaccgctatacgtatcagagcatttacattttaataaaggtgatgcggtgaatactattttttactttgaaataggtgcattagtagctagtttattgtggggctatatctcagatttattaaaaggtcgtcgtgcgattgtagcgattggatgtatgtttatgatcacctttgttgtactcttttataccaatgcaacaagcgtgacaatggtcaatatttctctatttgcattaggcgctttaatcttcggtccacagttactcattggtgtatctctgactggctttgttcctaaaaatgcaattagtgtcgctaacggtatgacaggttcatttgcatatctattcggggattcaatggctaaagtgggtctggctgcaatcgctgatccaacacgtaatggtttaaatatttttgggtatacgttgagtggttggacagatgtctttattgtattctatgtagctttattcttaggaatgatattattagccattgttgcttattacgaagaaaagaaaattagaaaattaaaaatttaa

SEQ ID NO: 775 - DNA, 135 bp, Staphylococcus epidermidis
ttcatctctttcattctcatttttaagatgaaatcacattgttcacattttgtctttatgcctcactatcgcacatacttccttattcaattaaatcgcacctccttcctatttcctataaaaaacaccccgtaa

SEQ ID NO: 776 - DNA, 1632 bp, Staphylococcus epidermidis
gtttacatattttcgaaaagaaagaggaaaacaatgaataaactcacaaaactaagtacagtcatttttgtatctgggattattttagccggttgtggaagtaacaaagaactaacagagaaaaaagagaataaagtattatcatatacaactgtcaaagatattggagatatgaatccccatgtttatggaggttcaatgtccgcagagagtatgatttatgagccgttagttcgcaataccaaggatggtattaagccattattagcgaaaaaatgggacatttcacctgatggtaaaacatatacgttttatttaagggacgatgtatcttttcatgatggtacgaaatttgatgcagacgcagtgaagaaaaacatcgatgcagtacaacaaaataagaaactacattcatggttaaaactttcaacactgattgatgatgtcaaagttaaggataagtatacggtacaactacatttgaaggaagcttatcaacctgcgttagcagaactagctatgccacgaccatacgtttttgtatcgcctaaagattttaaacacggtacaaccaaagatggtgtgaaatcatttgacggtacaggaccatttaaaatgggtgaacacaaaaaagatatatctgcagaatttaataaaaataatcaatattggggagaaaaggcaaagttaaataaagtagaagcaaaagttaaacctgctggagaaacagcatttttatcaatgaaaaaaggagaaaccaactttgcttatacagatgatagaggtacagacagcttagataaagatagtttaaaacaattaaaagaaaccggaagctatcaagtaaaacgtagccaagccatgaatacaaaaatgcttgttgttaattctggtaagaaagatagtgcagtcagtgataaagcagtcagacaagcattaggtcacatggtaaatagagataaaatagctcaagatattttaaacaagcaagaaaagccagccacacaactatttgctaaaaatgtgacagatataaactttaatttaccaacaagaacatatgataagaaaaaagcacaagcgttattagataaggccggatgggtgctttcaaaagatcgacaagttcgtcaaaaagagggcaaagatttgaatcttaagttgtattatgacaaaggctcttccagtcaaaaagaacaagctgaattcttagaggcagaatttaagaagttaggtgtacaactagatataaacggagaaacgtcagataaagtagctgaacgtcgtagttctggtgattacgatctaatgtttaatcaaacatgggggctattatatgatcctcagagtacattagcagcatttaagacgaaaacgggatatgaaagtgcaacattaggtattaagaataagtcacaactgtacaaagatattgatgaggcgttcaaaattcaagatgcaaaggcacgttcaaaagcgtatcagcaaattttgaaacaagttgacgatgaaggtgtctttattccaattactcacgggagaatgactgttgttgcacctaaagatttacaaaaattatcctttacacaatcacaatatgagcttccatttaatgaaatgcaatataaataa

SEQ ID NO: 777 - DNA, 516 bp, Staphylococcus epidermidis
ttcatgatattatgcttcttctgcaagtattccatatgtcaaatctttattatgtatgaatcctacactcattcatcacaaataagaggtagctactctatgtcaaaaaagaaaatcttgatctttattagtgtcatattaatcatttttggaggtgtctacctcaaaatgaaatatgacgaaaaagcaaaacaaaaagaaatctactacaaagagcaacaagaacgtatcacgctttatcttaaatacaacacaaaaaaacctaatactatcaaatctgtccatttcacaagtttaaaacagggaccaatgggtgatgctattattgaaggctatatcaataacaataaagaaaatgaatttgttgcatttgcatcatctgaagataattttcaattccaaggtgatatgatagaaagcaaaaaagtatcaaatctaataaaatatcaaacaaaaacacctgatgaaatcaaaaaagatttagacaaaaagaaaaacgctaaagatttttactga

SEQ ID NO: 778 - DNA, 210 bp, Staphylococcus epidermidis
tgtcctccattgtttgttatatatattcttttgctcgtacaatacaaagtattttatatagaaaatgtttcaaatgccattaactatttattaactttagcaccaactcataactcttctaacacctcacatattaagttcagtttttcggataatttaatacttttaaggatattaagcgcttacattgatgtgatatattttttttaa

SEQ ID NO: 779 - DNA, 1026 bp, Staphylococcus epidermidis
accgttaaatttgaaaaagcgattggaacaggtgcatttgttgttgataaaactgttaaggaaaaaacgacattgaagcccaataaatattttgaccacggtcacccaatcaattatcatcttgcattccaaacgattgaagatggggactccagaaattctccagtacaaagtggttttgtagatatttctggtggtgctttaggtatgctctcagacgaacaaatcaaacaagataagaaaaataagaacttaacgattgaagatagacctagcacagtaagtcactttatggcatttaaccctaaaaatgatgtattaaatcaacgcacaattcgtgaagcgataagtaagagcatcgatgcgaaagacattgcgggcaaatctgtaaatggtctgttccagaagaacgtacaatttgtgactaaaaataatcaacagccacacgattatgatatgaaagcggctgaaaggttacttaaatcagaaggatatcataaaaacgatgacggcatctttgaaaagaatggcaaacctttatcatttaacttagtcattcaaactgcagagttcccaaattggaaagataaagctgaaaaagtgcaacgtcagcttaaacaagccggtattaagttaaatgtgaaaacgttagattcacaatcatactatgatacattatggacgaaaaaagactatgatttgattttctatagaacgtattcagatgcattaatgccttacaactttataagttcagtgtttaaaaataatgatggtcaaccaggggtgttagctgatgatgaaacattaacgaaacagctagacgatttcccatcaaccgtatcaaaagaagaccaacagtgttcatttgatgacatatttaaacactttaatcaacaatactatggtgtgccaattgcttatccaaatgagacgtttgtagtgagtgataaagtaaaacaattcaaattctctggacttacggatgcaccaattgattataaagcgttgaaagttaatgaatag

SEQ ID NO: 780 - DNA, 762 bp, Staphylococcus epidermidis
ggggtgatttcaatgcttaaggttcaaaatgttattaaattttatggaaaaaaatcaatgtttcgtgataaacgtattcctgtagttaaaggcgtgtcatttgattgtcccactggtgcatcagtagcaattattggtgaaagtggaagtggaaagtctacgttgagtcgtatgattttaggactagaaaaaccagatcaaggacaagtgactttggacggtcagcctgttcatttaaaaaaagtgagacgtcatcgaattgctgcggtttttcaagactatacttcttctttgcatccttttcatactgtcaaagatattttgtttgaagtaatgaatcaatgtcgatgtacatcgaaggagaatatggaagagtatgtaacagtgttactacgtgaagtagggttaaaatctgattgtttgtattgttatccacatatgctttcaggtggagaagcacagcgtgtagctattgcacgtgcgatatgtatgcaaccagattatatattatttgatgaggcgattagttcattagatatgtctatgcaaacacaaatattagatttattgaaaaggttacgtcactcacaccagctgagttatatctttattactcatgatatacaagctgcgacatatatatgtgatgacttgcttatttttaaaaatggttgtatcgaagctaggacatctataagtgaattgcataggcaacaaaatggttatacaagagaactgattgataaacaactatcaatctaa

SEQ ID NO: 781 - DNA, 1221 bp, Staphylococcus epidermidis
caaattgaattacctatagaaaggaatggacatatgttaagtattaaaaacttatcaaaggtctatgcaggtggtaaaaaagctgtagataatatgaccatagacattgaatcaggagactttattgcatttattgggacaagtggtagcggtaaaacaactgcccttagaatgattaatcgtatgattgaatctacagagggagaaattaccattgacggtaaaaatatcaaagagcttaatccggttgagcttcgtcgcagtatcggttatgtcatacaacaaatcggcttaatgccacatatgacagtgaaagagaatattgttctcgtaccaaagttattaaaatggtcacaagagaaaaaggatgagaaagcgaaagaacttatacgcttagtagatttaccagaagaatatttagatcgatatccttcagaattatcaggtggtcaacaacaacgtattggtgttgtaagagcactcgcagctgaacaagatattattttaatggatgaaccgtttggtgcactcgatccaataacaagagatacattacaagacttagtcaaaaaattacaacaacaattaggaaagacattcatttttgttacacatgatatggatgaagcaatcaaacttgcagataaaatatgtattatgacaaatggacaggtggttcaatatgacacgccagataatattttacgtagtccagcgaatgatttcgttagagactttattggtcagaatcgcttaattcaagatagacctaatatccgtacagttaaagatgcgatgattaaacccgtgacagtacatgttgaccgttctcttaatgatgcggtgaatattatgagagagaaaagagtcgatacgatatttgttgtcggcaatgatgagcatttattgggttatttagatattgaagatattaacgaaggattaagacatcataaagaacttatagatacgatgcaacgagatatttatagagtacgtattgatagtaagttacaagattctgttcgtacaattcttaaacgtaatgtacgtaatgtacccgttgttgacagtgataataaaacattattaggccttgtcactcgagctaaccttgtagacattgtttatgacagtatttggggagagttagaatcggataacaatgataatcattctgggattgttgaacccgaatccacaggagttgagacaccatga

SEQ ID NO: 782 - DNA, 861 bp, Staphylococcus epidermidis
agccatgattcaatatggaacatatgcacgtctgcacattttctcaagaagccagcaagggacattaatgtgttaccaaataccacttgtctaggaggaataaagatgtttaaagtagttatttgtgatgatgaaaggattataagagaaggcttaaagcaaatggttccatgggaggactatcatttcaccactgtttatactgccaaagacggcgtggaagcattgtctttaattcgccaacatcaacctgaactcgtcattactgatatacgaatgcctcgaaaaaatggtgttgacctactagatgacatcaaagaccttgattgccagattatcattttatcgagttatgacgacttcgaatatatgaaagccggtatacaacatcatgttcttgattatttactaaagccagtagaccacactcagttagagcatattctagacatattagttcaaaggttattagaacgcccacattctaccaatgatgacgcggcatatcatactgcctttcaaccattattaaaaattgattacgatgactattatgtcaatcaaattttgtctcaaatcaagcaacattatcacaagaaagtgactgttcttgacttaattaatcctattgatgtaagtgagtcatacgccatgaggacgtttaaagaacatgtaggcattacgatagttgattatctaaatcgttatcgtattttaaaatcattacatcttttagaccagcactacaagcattatgaaattgctgaaaaagtaggtttttctgagtataaaatgttttgctatcattttaaaaaatatttacatatgtcaccaagtgattataataagcaatcaaaatag

SEQ ID NO: 783 - DNA, 261 bp, Staphylococcus epidermidis
tgtgacgattctatcaatagtggcaaaacagtatacagcttcacactcgacaatgtcaaaaatgaaactaacacaagaagcaactgtacatggtatagatgttgcatttatttttactacagtattaatcattattggatttatcttagcgttattcataaaagaagaaaaaaatcattaattattcaaaaaaactgtataagagagaccgaattatgggatgaacctgggacacaaatcgatgttccaggttttttataa

SEQ ID NO: 784 - DNA, 168 bp, Staphylococcus epidermidis
gcactttgttctgagctacctgaagcatatgatacgtttaccgtacttaaaacggatgctgctacgattgatgaagcaagcgtcgtcttacccattttgttcataaatttcataaataaattgcctcccaatatgtatgataaatcaagtatagaagacaaactttga

SEQ ID NO: 785 - DNA, 144 bp, Staphylococcus epidermidis
attatcagttccacaatgacaacgtttttttatttctacattttttatattcctcatctaattatttcattagatatgcctaaaaaaatactttccttcacttcattatttatttatttaaaaataagccttgtacatatatga

SEQ ID NO: 786 - DNA, 126 bp, Staphylococcus epidermidis
attaaaatctctttttatttaattatactttatcattttattgttgaaaattataagaatttttatgtcgtttgtgacaaagtacgtaaacatacattcaaatttaaaattaatctatttatttaa

SEQ ID NO: 787 - DNA, 156 bp, Staphylococcus epidermidis
cttgttgtctcaggttttttagtgtgtaacattactgtgatagatttgtacgatgattgtttaaatataaaaattaagatatgtatctctaaaacgttgtgtaacaatatttataaattaaagtttataataatcttgaggagaggattaagatga

SEQ ID NO: 788 - DNA, 126 bp, Staphylococcus epidermidis
gcaccatcctcggttaatatgcaaccatggagaattgctgttgatgaaagtgatgaaatgatagaaaaagttatgcactcatttggattcaattccagacagttaacaacatcctcagctatgtaa

SEQ ID NO: 789 - DNA, 366 bp, Staphylococcus epidermidis
aatgcccactcaataacaccccaatataaaatatctgaaccaataccggcacagaataacatggctgcccatgtgaaattattaaattcaggtttgtcagtcgcttttcctaacgtgacattcccatacttaccaaatgctatgtataaaacaaaacaaaatatagccagtcccataaagagatataccgatccaattgaattagaaatggcactattgatatcggtaatgattatttcacttgctttcggaaaaaccatcataggtataacagcaaaaagtaacacaatgactacgcctatgaaggtcgtccagtccataactttttcctttttcaaatgtgatccccctaatattaatttatga

SEQ ID NO: 790 - DNA, 2217 bp, Staphylococcus epidermidis
tattttagattggtgcataataaagataaattaatgaggtgtatgtatagtatgcaaactcgattgggagaaaaagatattaatttaccgcagtattacaacaatagggagttaagttggctagattttaactatagggtattacaagaatcatatgataaaaataatccgttgcttgaaaaacttaattttatttctatcttcagttcaaatttagatgaattctttatggttcgagtggctgggttaaaagaccaagtcaaaatgggatatgacaaacctgaaaataaagcacaaatgacgcctcaagaacaacttgatgctattaaaattaaaaatacagactatgtgaacactcaatatcaacgttataacgaattaattaaagaattagccaattacgatattgagatggtaaaacctgaagacttatcagatgcattgatagaaaaattagaacaagagttcaagttaagtgtcttgccgacactcactccgttaggtattgatgcgtatcatccatttccaaagttaaataataaaagtttaaatatttttgttgatatcgatacggaagatgccattaattcagctatcgttcaaattccttcattaattccacgctttttaactttaaatgagggtacaaaacaatacgttgtcatggtagaagatgtgattacgtatttcatcaattatttatttacaggatacgaagtactaaatacttttactttccgaatcacacgtaatgcagatttaaccattcatgaagatggcgctgaggacttgcttatagaaattgaacgtttcttaaaagaacgtaagagtggttcggctgtacgtttagaattagattgtcgcacttctgaaaaagagaatgtagaatggttaatcaatcaattagaaattgaagataatgatatttattatttagatggtccacttgatttaacattcttatttggattggttgatcatctatctcataagctcaaatatttaacgtatgagaaatatactcctcaaccacctagatcattaggcaacaagaatatctatcaattatcattagaaagagatatattcttccaccatccgtatgaatcatttgaaccaatagttgactttattcgacaagcagcagatgacccaaatacaatcgctatcaaacaaaccttgtatcgagtgagtaaggattcgccgattattaacagcttaaaagaagctgctgaaaacggcaagcaagtaacggtgctcgtagaattaaaagcacgctttgatgaagaaaataacgtacattgggcacgtatgctagaagatgctggctgtcacgttatttatggtatgacacatctaaaaacgcatagtaaaattgcgctagtcgttaaacgcatcaacaatgaacttacgtcatttgttcatttaggcacaggtaactataatgataaaactgctaaattatacacagatatgggtatcattacgacaaataaagatatcgctgaggatgcaattaacttctttaattacttgagtggttactcaacaaaaccagaatacaataaattgattgtagcaccatacgatattcgagacgtcttcattgatcgtatcgataaagagatacgtagtcatttacaacatggtaatggtaaaattatgatgaaaatgaactctttaaccgataaaacgattatcgaaaagctcttcgaagcatcccaagcaggcgttaaaatacaactcatcattcgtggtatatgttgtcttaaaccaggcattccaggtattagcgaaaatatagaggttgttagtatagtgggtcgtttgcttgaacattcacgtatttactacttccataataatagtgaggcgcatatttatttatcttcagctgacgttatgacacgtaatatgattaaacgtgtcgaaatattgttccctgttgaagataaatcaataggacaacgattagttaactatatgaatttacaattatctgacaaccaaaaaggtcgttaccaagatgcacaaggcctttatcattatgtcgaaaacaattcatctcctttaaactctcaatcttacttgatgcaagaagcaattaagtatggagaagaactaaaaaaacaatcggtacaaccttctggacaacctgttcattctagacgtggcggtagttggatgcgaaaattaaaaaacacatttaaaagataa

SEQ ID NO: 791 - DNA, 591 bp, Staphylococcus epidermidis
acagcaatatctttcaaaaggggcaagctaattatgaatatatataataaagtgacattatctgtcattttagttataacaattatcatttcgttcctcttttatttttatacaacagagaaaaaagtggacaaagataaattgtatgaaaacaaaattacaaatcataaacaagcaggtaaacctaaaaattatggtgtcgcatctaataataaaatagctacgaaagtcggaaataagattattgaagatggtggaaatgcggttgatgcggcaataggtgtttcttatgcactagcagtgacagaacctcattcatcaggactaggaggtggcggtgcgacacttacatataatggtaaagagaatgaaacgcctaaagcttatgaatataaaacaatgtcctcatatgaatataaagaaggcgacaaaattggagttcctggcttcgtgagaggattacatgatatgcacgcgaaagaaggaaaaatggatgagaaaaagattttagattacgttattccgcttgctaaagatggttttgaggtagattcagaactagtaaagaagtttgaaattatatggtcgtga

SEQ ID NO: 792 - DNA, 192 bp, Staphylococcus epidermidis
  modified_base (182)..(182): a, c, g, t, unknown or other
tatttagtatcaacttatttaataaagcctctagaaactgaatttaaacagtctctagaggctttattattaattatcgatatatatgcatttttttcctggggcattataactattttccaaagtgtgctttttaattttaatgaattgtttagagttaggaataatagatgggaaaatancaaattttga

SEQ ID NO: 793 - DNA, 231 bp, Staphylococcus epidermidis
tttgaagtatcattttgtttatttttgcgattgtgttctatttttttatcattcttattagaattcgtatggtggttaatagctgcatataatgaaaagcccaatgcgcatataagaatgattactactattgtagctgaaaattttttcaaagcgtatatcctccatcctttttatcaactatattttattataatccttttttttattgtaagtagaattattctataa

SEQ ID NO: 794 - DNA, 747 bp, Staphylococcus epidermidis
aagagggtatcgctcatgattgaattgtctcatatccataagtcttttaatgaaactgaagtgattaaaggtattgatttgaaaattaatcaaggtgaagttgtgacactaattggacgttcaggttcaggtaaaacaactttacttagaatgattaatgctttagagatacctactgaaggtacagtgtatgttaatggcatgacatataacactaaagataagaaatctcaaattaaagtaagacaacaatcaggaatggtttttcaaaattataatttatttccacataaatctgcattagaaaacgttatggaaggtcttataacagttaaaaagatgaataaagcaacggctaatgaagaagcaatgaatttattggctaaggttggattggtacatgttaaagatcaacggccgcatgctttatcaggagggcaacaacaacgtgtcgcaattgctcgtgcattagccatgaatcctaaagtgatgttatttgatgagccaacatctgcacttgatcctgaattggtcaatgatgtattaaaagtcattaaagaattggctgacgaaggtatgacaatggtcattgtgactcacgagatgcgttttgccaaagaagtttccaatcaaattgcttttattcatgagggcgtcattgcagaacaaggtacgcctgaagatatatttaatcaccccaaaacagaagagcttcagcgatttttaaatgtgattaatgaaaaatag

SEQ ID NO: 795 - DNA, 390 bp, Staphylococcus epidermidis
atagctggatttgtactccactgcattaaattccacataaataagccaactaataataatcctgttcctggtaataataagttaagaattatcatcattattataaatattgaaatcgaaattattaaccaacgcttactagtaaacttatcagataaaacaccgcctaatgaagtaccaatcacacctgctacaccattaacaagtagtgctaaagacacaaaagacatttcatgtccattggataaaattaatggattaataaacacgaatgttacagaattagcaaccagcactaaaaatgtaatcatcagatatttaaaaacctcacgaggtcttatgacgcttgagccagtttgtgattcaatactagatgaacgaggtgtttga

SEQ ID NO: 796 - DNA, 150 bp, Staphylococcus epidermidis
ttaaatggatttatttttctaatgttgattagtataatatttgtattaaggcgtaattcatttttgttgatacttgtcaactatataaaccataagataaattatatcaaattctcatttgttatgacaataactaaaaataatttttaa

SEQ ID NO: 797 - DNA, 1401 bp, Staphylococcus epidermidis
atgaatacatcacaaaagtttaggggagataatcgcttattattagggattattttaggggttattacattttggttatttgcacaatcacttgtaaatctagtcgtgccattacaatcatcatacaatagtgatattggtactattaatatagcagttagcttatcggcactattttctggtctgtttattgtaggtgcaggagatattgcagataaaattggtagagtaaaagtgacatacataggcttagcacttaatattgttgggtcggttttaatcattattacgccattaccaagtctattgattattggacgtgctattcaaggattgtcagcggcatgtataatgccagcgacactcgcaatcattaatgaatattatatcgggacagcacgacaacgtgcattaagctactggtccatcggttcatggggaggtagtggtgtttgtactttgtttggtggtttaatggcaactaaccttggatggcgctcaatctttattgtttcaattattctgacaatattatccatgtttctcattaaacatacacccgaaacaaaagcagagcctataggagatcaaccgacagagacaaagaaatttgatgttgttggtttaatcatcttagtggttagtatgttaagtattaatgtgataataactcaaacctctcaatttggtttgttctcaccatttattttgggacttattgcaatttttgttatatcgttaattatattcgtgatttacgaaaataaaatcaaacaaccacttgtcgattttgatatctttaaaaacaaaggttatacaggtgcaacgatttcaaactttatgttgaatggtgtagctggtggtacattgattgtagtaaatactttttatcagcaaaaattagattttaactctcaggaaacaggatatatttcacttacatacctaattgcagtattaattatgatacgtgtgggtgaaatgatattacaatcgttaggacctaaaagacctttgttactcggaagtgccttgaccgtcataggattaatattattatctttgacgtttttacctaatgcttggtatatagcgtcaagtgtcattggttatttattatttggtaccggtttaggtgtttatgcaacaccatccacggatacagctgttgcacaagcaccagatgataaagtaggcgtcgcatccggtgtatataagatggcatcatccttaggaaatgcatttggtgtggccatctcaagtacagtttacagcgtacttgcagcccaacttaatctgactttaggtggttttactggagtaatgtttaatgcgcttatagcattattagcattcctttctattttgttcttaataccgaaaaaacagtctaatgtataa

SEQ ID NO: 798 - DNA, 129 bp, Staphylococcus epidermidis
attcagacatcatcgtggcttaatataagaaaagtaacagctcaacgagctgaaaataatcaaaaaaattataaaaaagacaatttctatattatttcaatagaaattgtctttttttacttatcttga

SEQ ID NO: 799 - DNA, 174 bp, Staphylococcus epidermidis
gttcagacatcctcgtggcttaatataagaaaagtaacagctcaacgagctgaaaatcatcaaaaaaattataaaaaagacaatttctatattatttcaatagaaattgtctttatttacttatcttggacctttttgtcccagcctctttcttacagtatgctcagtcaatga

SEQ ID NO: 800 - DNA, 165 bp, Staphylococcus epidermidis
aattttcaatcaatcttatgtttaaaaacctcactaaagcccgttgatatctttagtgaggtcgatgttctttattctaaaatgattttcatagagcgttgtacactatcagcatacatacctccaaatttaagtaaatgtatcataagtaaatataatctataa

SEQ ID NO: 801 - DNA, 132 bp, Staphylococcus epidermidis
aaatgtaaatcaaatttaaatataacgcttatggaaagcctaagacctcacagagtgtcttgggctttttctatgattagtggtcagggtagattgagtatagtattattccaagtcgctttaactttatag

SEQ ID NO: 802 - DNA, 825 bp, Staphylococcus epidermidis
atagggggattaacgatgattaaagccattgcggtagatatggatggaacatttcttgacacaaataaacagtttgatcgaaatcgttttgaaactatttttaaagaattaatagataaaaatattaagtttatagctgcgagtgggaatcaatttgcaaagctaaaatcaatttttggagatagggaaatgttctttatatctgaaaatggagcagtcatctataaaggtaatcaactttacaattatcgaagttttgatcagtatatttttcaaaaagttgtaaattatttaaatttgaatcaaaagataaacaatttgattatttgtggtgtaaaaagtgcatatattttaaaagaaacaagcgaagcatttaagcaagatgcacgtacatattatcaccaactaatagaggttgactccttacaaacattacctgatgatgattatgtgaaaattgctttcaatataaatcgtcagactcatccagacttagatgagaaattagctcttaagtttaaagacgatattaaactagtatcaagtgggagagatagtatagatgttattatgccaaatatgactaagggtcaagctttgtctagattattaaaagaatggcaaatgcctgcttcacatttaatggcatttggagatgcaaataacgataaagatatgttggagcttgccgaacatagttatgttatggctaatagtgaagatcaatcattatttgatatagcgagtcatgtggcaccttccaatgatgaacaaggcgtactatcaacaatcgaaaatgttgttctcggttattccaataaataa

SEQ ID NO: 803 - DNA, 1566 bp, Staphylococcus epidermidis
ttatcagaatcagccaattcattttatctacatgtagatgattttttaatacgtattgttaaggaatgtttgctgactcatgttaatagtaagttgatgttatggaggtttgttatgggaagtttttttaatcggatgactcgaaaagagaatcctactatttatcaaagtaaagatgggcatcttaaacgcacattacgtgtacgcgactttcttgcactaggtgttggtacaattgtttctacatctatcttcactttaccaggtgttgtcgcggctgagcatgccggacctgctgtttcattgtcattcttattagctgctattgtggcaggtcttgtagcctttacttatgcagaaatggcatctacaatgccttttgctggttcagcttattcatggattaatgttctttttggtgaattattcggatgggttgccggttgggcgcttttagcagaatactttattgctgttgctttcgttgcttcaggcttttctgctaacttaagaggtcttattgcaccattgggcatttctttacctaaatcattatctaatccatttggaagtaacggtggtgtcattgatatcattgctgctgtagtgattattttaactgcattactattatcacgcggaatgaacgaagccgctcgtatggaaaatgtattggttatattaaaggtgttggccatcattttatttgtgattgttgggctaactgcgattaatttcagtaactatataccttttattccagaacataaagttactgaaactggcgactttggaggttggcaaggtatttatgctggagtttcaatgatttttttagcttatattggttttgactctattgctgctaattcagctgaagcgattaatccacagaagacaatgcctagaggaatcttagggtcactcatagtagcaattgtattgtttgtggccgtagcacttgttcttgttggcatgttccattactctcaatacgctgataatgcagagccagtaggttgggcattacgagaaagtggtcatggtattattgctgcaattgttcaagcaatttctgtcatcggtatgttcactgcattaatcggtatgatgcttgcaggttcacgtctattatattcatttggacgagatggtttactcccttcttggttaagtcaattgaatcacaaacatttacctaatcgagcacttgccatacttacaatcattggcgtagttatcggatcaatgttcccgtttgctttcttagcacaattgatttccgcaggtacccttgttgcattcatgtttgtgtcactagcaatgtatcgattaagaaaacgtgaagggaaagatttacctaagccagagtttaaattacctttatatcctatattgcctgcaattacatttatattagtattgctagtattttggggattaagttttgaagctaagttgtatacactgatatggtttattgtaggtataattatttatttaatttatggaattagacattccaaaaagaatgatgaagaagcgtatcaagtacctagaaaataa

SEQ ID NO: 804 - DNA, 144 bp, Staphylococcus epidermidis
gtccatttgtcatactcatttcctccttttcttcgctacattataagtataaaactgatcaataacttagttcgtgatgattatcacatgctaaatgtaaaaagtttcgcaacatttggttattcaatacataattgtgtttga

SEQ ID NO: 805 - DNA, 201 bp, Staphylococcus epidermidis
attgctctgtcttctgctttctctttagcaaatatgattgttaaaattactgttatggtagccaatataccaccaatgagaattgcagatccacgtaaaagtgcttcttctggggctatcggtaagtttatagataagcaaaacgttactaaaaagaatgtcgatgatggaccagcgatttttagtgcattaaacgtataa

SEQ ID NO: 806 - DNA, 312 bp, Staphylococcus epidermidis
tataacatgtcatttaatatttggatgtggattttacttgtattatttattgtggggacaatagctgtaattctcattttaacagttggctcagtgttagaagagcgctcatatgaccgtcgatcagaagatgaaaagcgcaaaaatttagaaaaaaatcttgagatgtcaaagggacatacagatgtatcgcaagagtcgagcaatggggaagaacaagtaacacaagagcattctcaacatgtcgttcaagatcatcaacaaacacatcaaaatataaatcaatcaacacaagataatagaaataattag

SEQ ID NO: 807 - DNA, 225 bp, Staphylococcus epidermidis
ctatatgcgtctggcgttaaggtagcaatacctgttttaggatcatacgtcgcagatccagacagattcatatgttcattaaagttatctttgttcaccacaacagaattagatgtcagacttgaagttgttgtcgtggacgttgttgtcggtgctgccatcgtattcaaaacagtaaatctactaaatgttcttaaatttgcaaaggaagtaggactcgattga

SEQ ID NO: 808 - DNA, 126 bp, Staphylococcus epidermidis
tatccaaagtcaacgttgtattcgccatctaaatgcctccatttcacatctaatgtaccccctataggtatacaagtcaactacttagcttatatattatgggatagtattatgtgttacctttaa

SEQ ID NO: 809 - DNA, 1458 bp, Staphylococcus epidermidis
catctaactttaacatatatagagggtgaaacgatgtcagggaaactagaagaattacaattaaaagtagctcgattaagtcgacgtactcatgaattaggtattccaattatggtattatttgaggggattcctgcttcggggaagacacgtttatcaaatgaattactattgcacctagatgccaaatattcgcgatttatagctactaaatcgccagagtcaaacgatttacgttaccaatttttacaaaaatattggaatactttaccacaaaagggcaatataaatatttattttagaagttggtattcacactttttagattataaagaaaataaaattaagcatgatcaatataaaaattatgatgttttagtcaatcaaatttatcattttgaatcgatgttaaagaatgataactatgaaattataaaatttttcatagaaataaatgaagaaaaacgcaatgaacatattcaacagacaaaagataatccattaactagatggaaagttcaagaatatgaaaatgttatacctcaagaaagttatctaaatcaaatgcatcaattcatcaacaaagataaagattggaaagtgatcgattacacagagcgcgagcatgcttttgaaaaaatgtacttacatttaatagatagacttgagcaagctataaaaaaagttgaacaacaaacaactaaagtcaacggtaagttcacatcaagctttacgacttctttatttaataataatcttgagaaagtagacaaaaaaacgtataaaaatctcattgttgaattgcaacagagaatgagagaaatccaatttgctttatatgaaagaaagattccccttgttttggttttcgaaggtatggatgctgctggtaaaggtggcaatattaaacgtattagagaaaaattagatccaacaggatatgaagtgaatggtattagtgcacctacggatgtcgaacttaagcatcattatttgtggagatttgctaaaaagatgccaaaatcaggtcatataaaaatatttgatcggagttggtatggtcgtgtactagttgaacgtgtagaaggttttgcaagccagaatgaatggcaacgagcatctgatgaaatcaatcaatttgaaaagatgtggacagatgaaggtacaatcatattaaaattcttcttatgtttagataaagatgagcagcttaagcgttttaaagaccgtgaaaataatcctgataaacaatggaagattactgaagaagattggcgtaatagagaaaaatgggatgaatatttagaagcaagtcatgatatgattgaatctacaaacacttcatatgccccttggtatattgttccggcagatcataaaaaaacgagtcggattgaagtacttaaaacaattattagaaaatgtgaagaagtactatggggagttaagacgtattaa

SEQ ID NO: 810 - DNA, 1311 bp, Staphylococcus epidermidis
ttcaaaacttttcacaatttttgtaaagcgcttacatatttattatatattcctggtcatgtctgttatatttcattgtataaaacgaattttctttggtatgatactagtgctacttcaaaaaatgaaaggatgtcacaccttatgaatataggtatagataaaataagtttctatgtacccaaatattatgtagacatggctaaacttgcagaagcgcgccaagtcgatcctaataaatttttaattggaattggtcaaactgaaatggctgtgagcccagtgaatcaagatatcgtatctatgggagccaatgctgctaaagatattataacagaagaagataaaaagaatattggtatggttatagtagcaactgagtctgcgattgataatgccaaagcagcagccgttcaaattcaccatcttttaggtattcaaccctttgcaagatgctttgaaatgaaagaggcttgttatgcagcaacacctgcaattcaacttgccaaagattatcttgctcaacgccctaacgaaaaggttcttgtcattgctagtgacacagctcgttatggtattcattctggtggtgagcctactcaaggtgccggtgcagttgcaatgatgatttcacataacccaagtattttaaaacttaatgatgatgccgtagcatatactgaagacgtttatgatttctggcgtccaacgggtcatcaatatcccttagttgctggtgcattgtcgaaagatgcctatatcaagtcattccaagaaagttggaatgaatatgcacgtcgccataataaaacactcgctgatttcgcttcactatgtttccatgtaccattcaccaaaatgggacaaaaagctttagattctattattaatcatgccgatgaaactacacaagaccgtcttaactctagttaccaagatgcagttgattataatcgttatgtcggtaatatttacacagggtccttatatttaagtctcatctctttattagaaacacgtgatttaaaaggcggacaaacgattggtctctttagttatggttctggttctgtaggcgagttctttagtggaacattagtagatggattcaaggagcaattagatgttgagcgccacaaatctttattaaataatagtatagaggtttctgttgatgaatatgaacattttttcaaacgctttgaccaattagaattgaatcatgaacttgaaaaatcaaatgcagatcgtgacattttctatttaaaatctattgataacaatattcgtgaatatcatatagcagaataa

SEQ ID NO: 811 - DNA, 2091 bp, Staphylococcus epidermidis
tcttatttgttcatgctttttttgtggcacgtaaataagaagatagagaggaatgaattgattatgtttaaaaagctatttggtcaaatgcaacgtatcggtaaagctttaatgttaccagttgcgattttaccggctgcagggttgctattagcaattgggactgcgtttcaaggcgaagcgttacaacattatcttccatttataaaaaatgatattgttcaacaaatcgctaatatgcttacaggtgctggtggtattatatttgataatctacctattatctttgctttaggtgtagcaattggtcttgcaggtggagatggtgtagctgctattgctgcatttgttggttttatcattttaaataaaacaatgggggcattcttgcatgtaactccagataaattatctgatccaactaatggatatgcaaatgtattagggattcctacacttcaaacaggtgtgttcggaggtattattattggtgcactagcagcctggtgttataacaaattctataatattaccttaccatcatatttaggattctttgcaggtaaacgttttgtaccaattatgatggcaacaacatctttcattttagcctttccaatggcaattatttggccaacgattcaaaacggtttaaatgcatttagtgagggattattagattcaaatacaggtttagctgtatttttatttggatttattaagcgattattaataccatttggtttacatcacattttccatgcaccattctggtttgaatttggttcttggaaaaatgctgctggagagataattagaggcgaccaacgtatttttattgaacaaatccgtgaaggtgctcatttaacttctggtaaattcatgcaaggggaattcccagtcatgatgtttggattaccagctgcagcattggctatttatcaaacagcaaaacctgagaataagaaagtagttgcaggtttaatgatttctgctgcattaacatcatttttaactggtattactgaaccattagaattctcattcttatttgtagcaccattcttattcgtaattcacgcagtattagatggtttatcattcttgacactatacttgttaaatgtacatttaggatatactttctctggaggatttatagattatgtcttattaggtattctacctaataaaacagcatggtggcttgtcatcccagtaggtattatttatgcagtgatttactactttgtatttagattccttattgttaaatttaactataaaacaccaggtcgtgaagataaaaaatcatctgtaacaactacatcggctagtcaactgccattcgatgttttgaaagcaatgggtggtaaagaaaatattaaacatctacatgcttgtattactagactaagaatacaagtaaatgaaaaatcaaaagttgatgttgccggccttaaatcattaggtgcttcaggagtacttgaagtcggtaacaatatgcaagccattttcggtcctaaatctgatcaaatcaaacatgatatggctaagataataagtggagaaattacaaaaccaagtgaaacaacaattgatgaagaagtgtcagatgagtctgtacatgtggaagatattgtagaaacagaaatttacgcacctggacatggtgagataataccgttatctgaagtacctgataaagttttctctgaaaagatgatgggtgatggtatcggatttgtaccagattcaagaaaaattgtagcaccatttgatggtacagttaaaacaattttccctacaaaacatgcgataggattggaatctgatagtggcgttgaagtgttaattcacattggtatcgatacagttaaattaaatggtgaaggttttgaaagcttggtaaatactgatgaaccagtaacacaaggtcaaccattaatgaagattgatttagaatacttaaaggaacatgctccaagtattattacaccagtaatcataacaaaccaagaagacaaaacattaacaattgaagatgtaaaacaagtcgatcctggtaaagcgattatgacaattaaataa

SEQ ID NO: 812 - DNA, 231 bp, Staphylococcus epidermidis
ggcataattccatatatatatgagagtacaacaatacctactaataacactgctaaaattgtacccatagtgactaaagttttgactgcattcttaggtgctggatttttaaaatttgttactgcattggatattgcctctacacctgtaagtgatgatgctccagatgaaaatgcttttaaaagtaaaaataacgtaacaccgggcacagtactacctacagtggaatga

SEQ ID NO: 813 - DNA, 1590 bp, Staphylococcus epidermidis
ggggtattgtttatgtcagttttaactgtcatgcaattcatagtcaatattatcatcatgattgtgttattaacgattatgattcttgggggtatttggttatttaaagataaaggtcaaaatcaacacagtgtactaagaaattttcctgttttgggtcgaatccgttatatttctgaaaaaatcggtcccgaattaagacaatatttcttcgctaacgataatgaaggaaaacctttttcacgaagtgattataaaaacatcgttttagctggaaaatataaatcacgaatgaccagttttggtacagggaaagattacttagagggattttatattcaaaatacgatgttcccacttcaagcaactgaattacatatcgatcatactgaattcatttctacattcttatatcatattgagaatgagcgcctatttagtagagaagaatacagaaaaagcgctcaggttgatccgtttttcttaactgatgaacatgcagtagtattgggctctaaccttaagcatccctttaaaattaaacgcttagttggtcaatctgggatgagttatggcgctttaggtaaaaatgcaattactgcactgtcaatggggttagctaaagctggtacatggatgaatacaggtgaaggtggattatctgaatatcatttgaaaggtaatggtgacatcatctatcaaattggtccaggactctttggagtaagagatcatgatggcaattttaatagagacatgtttatcaatcttgccgaacacaataatgtacgcgcatttgaaattaagttagctcaaggtgctaaaacacgtggtgggcatatggaggggaacaaagtcacagaagagattgcacgcattagaaatgtgaaaccatatgaaactattaattcacctaatcgttttgattttattaaaaatccaacagatttactgaatttcgttaatcatttacaatcgataggtcaaaaacctgtcggcttcaaaattgttgtcagtaaagttgaagaaatagaggcgttagttaaaacaatgatagagatagacacctatccaagctttattactgttgatggtggtgaaggtggtacaggcgctaccttccaagagcttgaagatggtgttggtttaccgttatttacagcacttcctatcgtttcaagtatgttagaaaagtatggcataagaaacaaggttaaaatttttgcgtccggtaaattagtgactccagataaaatcgctattgcattaggattaggtgcggatctcgtcaatattgctagaggtatgatgataagtgtaggatgcatcatgagccaacaatgtcatttaaatacatgtccagttggagtagcaacaaccgatcctaaaaaggaaaagggacttattgttgatgaaaaacaataccgtgttacaaattatgttacaagtttgcatgaaggtttatttaacatcgctgcagctgtaggcgttcatagtccaacggagattacttccgaccatattatctatagacaattagatggcactacaacgtccattcaggattataaacttaaattaatttcttaa

SEQ ID NO: 814 - DNA, 1164 bp, Staphylococcus epidermidis
agcagattgttactcattatagcgtgtgttgcgcttattctctggctaggaattaaagagaagaagcgtcatgcaaatcgacttgaaaaaattccattacgtattaacataaatggaattcgtgggaaatctacgattactcggatggcttacagtgttctacgtgaggaccagtatagagttgttggtaagacaacaggaacagatgcacgaatgctctattggtttactgaaaaggaatatccagtaatcagaaaaccacaaggcgccaacattggagaacaacgagatattattcgtaaggtggttaaacaaaaagcaaatgccctagttaatgagtgtatggctgtaaatccagattatcaaattacctttcaaaatgatttagtaaaagcaaatatcggtgtaattgttaatgtgatggaagaccatatggatgtcttaggaccgacacttaaagatgtagcgcaagcttttactgcaacaattccatataacgggaaattagttgtaatgaaagataactatactagtttctttgtaaaggaagctaaaaagcgtaattcagaactcattgttgtagataaagacgtcataccagaatcatatttacggaagttcgattatttagtatttcctgataatgtagctattgtgttaggaatagcgcaagcagttggtgtagatgaagaaactgcattacaaggtatgttaaatgcaccagccgatccaggtgctgttagaattaaatatttccatgcaaatcgcacaaaaaatgtatttgttaatgcattcgctgctaatgaaccgcagtctacaaaagcgattttaaataaagtggaatcatataattatccatacgataagaaaataatcattctcaattgtcgttcagatagggttgatagaacacaactctttgttgataactttttaggtgaagtcgattacgatgttctcatttgtacaggaaaaagtacacaaatggtgacacagtttatggaaactatgccagaaaaaacatatatcaattatgaaggacgagactttgtagagattgaaaaaggtattctacatgaagctgagaatgcacttgtattttgtgtaggaaacatccacggcccgggtggtagaatagcggaattcatagaagggatagaataa

SEQ ID NO: 815 - DNA, 747 bp, Staphylococcus epidermidis
gagggggctccgctaatgtctatagaaagaattatttatgacaattttcaaaacgatccatttataaatgaattagatattaatgatgagacaaaaggcgcttatgagattttaaaatgggcatatcaaacttatgaaaatgatattgtttattcttgcagttttggtgctgagagtatggttttgattgacttgatttctcaaattaaacccgacgcacaaattgtatttttagacactgatttacattttcaagaaacatatgacttaatagatagggtgaaagataaatatccgcaattacgcattaaaatgaaaaaaccggaacttacgttagaggaacaaggtgagaaatataatcctgctttatggaagaatgatcctaaccaatgttgctacatacgcaagattaaaccactagaagacgtattatctggtgctgtagcttggatatcaggtcttagacgagcacaatcaccaacacgagcacatacaaatttcattaacaaagatgaaagatttaagtcaattaaagtgtgtcccttaatctattggacagaagaagaagtatggtcttatatacgtgataaggacttaccttataatgaattacatgatcaaaattatccaagtattggttgcattccatgtacatcacccgtatttgattctaatgattcacgtgctggtcgttggtccaattctagtaagactgaatgcggattacatgtagctgataaaccataa

SEQ ID NO: 816 - DNA, 132 bp, Staphylococcus epidermidis
tctgtatatcccggatcaggtaaaagtacaatttcaccaggattaacaacacaagtaggtaatgcaacaagaccatttttagtcccatataaaatacaaacttcatcttctttgtctaattcaacatcgtaa

SEQ ID NO: 817 - DNA, 654 bp, Staphylococcus epidermidis
aggaggtatcctcgtgagatgaataaacttatagacttttctaaaggattagtaccagtaattttgcaacatgcacaaacggatagcgtattaatgttgggatatatgaatgaagaagcttatcaaaaaactctgaaagaaaagaaagtaaccttcttctctagatctaaacaacgtttgtggactaaaggtgaaacttctggtcatttccaacacgttgagagtattcatctagattgtgatcaagatgcgatcttaatcaaagtgatgccacaaggtcctacatgtcacactggaagtctgagttgttttaatagtgaaattgaatcacgttttaaaattcaagctttagcacaaacgattcatcaaagtgctaaagccaatcaatctaactcttacactcaatatttgttaaaggaaggcatcgagaaaatatccaagaaatttggtgaagaggcatttgaagttgtgataggtgcgataaaacataatcgtgaagaagttattaatgaaacagcagatgtcatgtatcacctttttgtgttactacatagtttagatattccattttcagaagtagaacaggtactagcgcatcgccatcaaaaaagaaataattttaaaggcgagcgcaaagaggttcgagaatggtaa

SEQ ID NO: 818 - DNA, 144 bp, Staphylococcus epidermidis
attcgttgtcccactcccgtttatctatgttttaaaataatattctcgttttttaatttgctatatataatcatttatgacaatgtagcacttgtgacatacccatctttaacgtggaaaacgatgtttccttttccgacttga

SEQ ID NO: 819 - DNA, 1389 bp, Staphylococcus epidermidis
gctacgactttatatgtaaaggtgtgttcaaacatggttcaagtcaagataggtaactgtaccatcaatggcatacacaaaaagaatattgatgtattcttaggtatcccgtatgccaaatcgttcaataagatatctcgattccaacattcaaagcttatggaactaagcaaaccaatgattgatgcaactcatattcaatccatcccaccacaaccctacaattcacttgaagactttttttcgatgacagattcatcgtttaattcttttaaacaaaatgattattgcctgtttttaaatatttggaaaccatcatccaatcaaaatcatttacctgtagtgatttacttttatggtggtagttttcttcaaggacatggcacagctgaactatattgtcctgaacacatagtagaacaagaaaatataatagtagttacttttaattatcgcttaggtgcactcggctacctagattggtcttattttaatcaacatttgaactataataatgggatttctgatcaaattaacgttttaagatgggtacatcaatatatcgaacattttggcggtgatccaaataacgtgacactaatgggtcaatctgcaggtagtatgagtatcatgacattaatgcaaatgcccgaacttgatgattattatcataaagtgatgttactaagtggaacgttaactactgatacaccactcaatgcacatactaaagtacaacatttttcacaactcatgaggcattattttcctaataaaacacttaagacacttaacagtgatgacattttatatctaatggagtctcaaaaaatagagcgtggaagatctcgtggacttgatttgatttatcaacctattaaagatcatcatatgtcacgatccattaaaaaatttcccaaaccgacattcatgagttatacacacgatgaaggtgatatttatattgaagacgcaacacgcaccttaccttctgaacgttttattcacttgatgtctcaatatggtacacacgtcgaaaaaaatgatgccctcacaatgaaacaacaaagaaatgtaataacagagtattgttttgttcgtccgatttatctatttttaaatcaaatgaatagttgcgacacttggctagcacgttttgattggcaccaaccccatacctcctactttaaaagtgcatatcatatattggatttagtattttggtttggtcatctctctattttgactaaaaatcattattctgtaacccaacatgatatgaatttaagtcgtaacatgatatctgacttagcttattttgcccgaaaaggtaagatgccatggaaatgttatgaacctcaacatcaagcgttacatatctatagataa

SEQ ID NO: 820 - DNA, 621 bp, Staphylococcus epidermidis
aacgccatgttacgagttgcattagcaaagggtcgtttattaaagagttttatcgaatatttacaacaagttaatcagatagatattgcaactgtacttttaaatagacagcgacagttattgcttacagtcgacaacattgaaatgattttagttaaaggaagcgatgtgcctacttatgtagaacaaggtattgctgatgtaggaatagtgggaagtgatattctgaatggtcaaaaatataatattaataaattactcgatttgccatttggtaaatgtcattttgcgttggcggcaaagccagaaacatctcgctataaaaaagtagcaacaagctatgtacatacagctactcaattctttaataaagaaggtatggatgtagaagtgattcaccttaacggttcagttgaattgtcatgtgtagtggatatggttgatgctattgtagatattgtacaaactggttctacgcttacagctaacgggctcgttgagaaaaagcatatcagtgaaattaacgctaagttaattacaaataaagaatcatattttaagcaatcatctgaaatagagagactaatcaagcagttaggagtgtctattaactatgcttag

SEQ ID NO: 821 - DNA, 828 bp, Staphylococcus epidermidis
gaagacatgttcaagaacaacaaaagtattgaagatacttatgcaacaaaacctattattcagaatatcgttggtcaggcacaaatcaaacaagtgatggcgaaacaaacacccatgagatatacgttgaaagctatcatggctggttttctattatcaatagttacagtttttatgttagcaattaaaacacaattcgcttcaacgcataatgacgggttaatcaatttgatgggagctattgcgtttagtttaggtctcgtattagttgtgttaaccaattctgaattattaactagtaattttatgtatctgactgttggttggtattataaagcaattagtgtaagtaaaatgatatggatttttattttctgttttataggtaatatcttaggtggatttattttatttttcctcatgaaatatgcacatgttatgacgccagaaatgacagatagtttaacagcattagtacataaaaaaacagtagaatcgacttggttaaatattttgattaaaggtatattttgtaatttctttattaatatcggtatttttatttcaatgcagtttaaagagggactagccaaagcattctttatagcttgtggagtgattgtctttgtatttatgggttacgaacacgttgtttttaacgctggattatatgcaggtatgatgttctttaatatggatggattatcttggttgggtgtgctaaaaaatattgtttttgcattccttggaaactatatcggtggaggtatctttattggattagtgtatgcatatttgaacggtaaacgtgacagcctccaaccatag

SEQ ID NO: 822 - DNA, 408 bp, Staphylococcus epidermidis
aaaggggtgttgttgatggaaaaagcaaaatttgtcattaagttaatacttcaacttgcccttatcatgcttattacttttataggcacagaagttcaaaaattacttcatatacctctagcaggtagtatcgtagggcttatgctttttttcctattgttacaatttaaaattgtacctgaatcatggattaatgtaggagcagactttttacttaaaacaatggttttcttctttatcccatcagtggtaggaattatggatgttgcatctaatatcacgatgaattatatattattctttattgttattataattggtacatgccttgtagcactatcatcaggttatatcgctgaaaaaatgctagaaaaaagcaatacacgtaaaggaactgatcactcatga

SEQ ID NO: 823 - DNA, 285 bp, Staphylococcus epidermidis
tcaataccaccagtggcttgtaacgtaccacctgctataccaatagataatatgattaacactgccgtcactggtgctgaacctggaggtaactggaatccaaatatcatgataagctgcgctactatagcaaagatgccacatcccagtgcaccagcagttcttaatcctaataatatcgctagaatcatgattatgatttctatgataaacaataacatggaagaatctcctaacttatgccgaacaattttcacttcaatattttatcactttaatatgtaa

SEQ ID NO: 824 - DNA, 231 bp, Staphylococcus epidermidis
ccgttcaaaccaactaggggagaaatgaggcctcctaaaataaattggaataggccaagtaaacttgaagcattgccacttccacctgtgcgttcagccattgccatagaaaaacaaagtggtgctatagaagtgactggacatatattaataaaaaagccaataagtaaaacatacaatggaagatgtaatgttaaagtaaatattaaaattacaacacctaacatttga

SEQ ID NO: 825 - DNA, 873 bp, Staphylococcus epidermidis
catatgaaacctttcaaattaatctttattagcgcattgatgatattaataatgacgaatgcaacaccaatatcacacctgaatgctcaagctaatgaagaaaacaagaagttaaagtacgaaaaaaatagcgcactcgcgttaaactatcacagagtaagaaaaaaggatcctttgaatgactttatatcattactatctgggagtaaggaaattaaaaattatagtgtcactgatcaagaatttaaatcacaaattcaatggcttaaagcacacgacgcaaagtttttaactttgaaagaatttattaaatataaagaaaaaggtaaatttcctaaaagaagtgtttggattaactttgatgatatggatcaaacgatttatgacaatgcctttcctgttttgaaaaaatatcatattccagcaacaggttttcttattacgaaccacattggttctaccaattttcataatttaaatttactttcaaaaaagcaattagatgaaatgtatgaaacaggcttatgggactttgaatctcatactcatgatttacacgctcttaagaaaggcaataaatcgaagtttttagattcgtctcaatctgttgctagtaaagatattaaaaaaagcgaacactatttaaataaaaactacccaaaaaatgaacgcgcacttgcttacccatacggattaattaatgacgacaaaataaaagctatgaaaaaaaatggaattcaatatgggtttacacttcaggaaaaagctgtcacaccagatgccgataactatagaattccacgtattttagtaagtaatgatgcatttgaaacgctaataaaggaatgggacggattcgatgaagaaaaataa

SEQ ID NO: 826 - DNA, 150 bp, Staphylococcus epidermidis
tacaagaaaccccaacatagagagtttcattcagaaattctctatgtcggggttcgttaccgagataagacaatatattcaatacatattttatcttatcctcatctatttagtatacaaatcattgtagtctataatgtttggagttaa

SEQ ID NO: 827 - DNA, 162 bp, Staphylococcus epidermidis
attcgtgctttttgtgcagttttcgctatgataggttcaagtgaaagagctatatttgcagtaccaattccaaaaacaaagacaaagacaatcattggcgctataaatataattgattttggaaagcgttcaatcacacgtgatgcaatgtatactaaatag

SEQ ID NO: 828 - DNA, 1293 bp, Staphylococcus epidermidis
attgttacgtttgaattcaaccactttacacaaaggatgggatatcaattggataaacgtcaatttgaaattttagatatgctagtgagatttaatactgaaagtccacctggacgtaatacagatccattgcaagatgaaatcgaaacgttacttaaacaactggatttttcaatacagagagaacagttatatgacaatgatagtgtgatagtagccaccttaaaagggcacaatcctaaagcgccaaaactgatattgaatggacatgttgatgtagcttctgtagatgacgatcaatattggcagtatccaccttttaaacttaccaacaaagatgaatggttatacggtcgtggcgttagcgatatgaaaggtggtatgtcttcattattctacgtcttggagcaattacatcaagcggggcaacgtccagaaggtgatattattgttcaatcagtagtcggtgaagaagtaggtgaagcaggaactaaacgtgcatgtgaaataggacctaaaggtgacttagcccttgtcttagatacgagtgagaatcaagcacttgggcaaggtggcgtgattaccggatggattacagttaaaagtaaaaatacaatacatgatggtgcgcgtagtcaaacgatacatgctggtgggggcttgtttggtgcaagtgccattgaaaaaatgacaaaggtgattcaatcgcttaatgaacttgaaaggcattggggtgtcatgaagaagagtcctggaatgcctccaggtgcgaatacaattaacccagctgtcatagaaggtggacgtcaccctgcatttattgcagatgaatgtcgattatggattactgttcattacttaccgaacgaaagttatgaatctgtagttaatgaaatagagcgatatttaaataaggttgcagaagcagatgtatggctcagagagaatccacttgaatttgaatggggtggtacatccatgattgaggataaaggagaaattttcccaagtttcactgttccgacacatcatccaggttttaagcaattagaagaagcacatgaacatattcataataaaaagcttgaacatggtatgagtacaactgtaactgatggaggttggacagcacattttggcattcccacgatattatatgggccaggtagtttagaagaggcacatagtgtagatgagaaaataaaagcaaaggaattagctcaatatagtgatgttttatatacatttttaaaagaatggtatgaacacccacaatcctataaatcatcatag

SEQ ID NO: 829 - DNA, 1416 bp, Staphylococcus epidermidis
gtaaacgctttcatattcgtatccctaaggaggaagttgatggcaaaacaactacaaagagagttgaataataggcatattcaattaattgctataggtggcgttataggtactggtttatttttaggttcaggacaaacaatttctctaaccggaccttcattactctttacttacatgttgataggtatagtgttatttgcttttatgagagctcttggtgaattattattaagtaactctaaatttaattcattcgtagatattgcaaatgaataccttggtccatttggtggatttgtaattgggtggacctattgggtttgttggattgtctctagcatgtcggacctcactgcgatgggacaatattttgcttattggtatccacaagtcccacactggttgacagtactatttattgtactcctacttatatcatttaatttgcttggcgccagattatttggagaacttgaattttggttttctataattaaagtcgttacaattattacgatggttattgtaggtttagttctgatttttttatcatttaaaacagaatatggacatgcttcttttggtaatttgatacatcatggcgggatgtttccacatggtgcagctggatttttaatgtccttccaaattgctgtatattcatttatcggtatagaacttataggagtcacagctggcgaaacaaaaaatccagaaaaaacaattcctaaagcaataaataacgttcctatacgaattttattattttatataggtggtttacttgtaatcatgtctgtcattccatggtttaaagttgatcctgatagtagtccgtttgttaaattattcacactaattggtgttccctttgctgctggcatagttaattttgttgttttaacagcagcagcatctgcaacaaatagcggaatatattctaatagtagaattttatttggtttagcgaaacaaggtttaggtcctaaagtattgacaaaaactaattctaatggtgtaccttatctctcaatgttagtatcttcaataacattgttaatcgcagctttattaaattttattttcccagatgctattaaattatttatttatgtaacgacactatctaccgtcctattccttgtagtgtggggaatgattatcgtttcttacatcgcatacgtaaagaagaatcctgaacaacatcaatcaagtgcatttaaattatggggcggaaaaattattgcctatattgtgttatcttttttcatatttatctttattttgctattctttagcaaagatactagagtagctatttttatttcaccattatggtttatcttcttgttcttttattataagaaatacaagaataatgctgaatctttagccgatagacagcgacattaa

SEQ ID NO: 830 - DNA, 1986 bp, Staphylococcus epidermidis
atgtatgcgtttacaattattgttaggaaaaggagcgtgcatactatgaaaatacttgcaattacatcatgtccaaatggaattgctcatacatatatggctcaagaaaaattagaacaagcagcaaaagatatgggcgttgatattaaggttgaaactcaaggaggcgtcggagcagaaaatgtgctcacttctaaagaaatcaaagaagctgatggaatcatcattgctgccgatagacaggtagatttatcaaggtttaatggtaaacctctcatcaatgaaagtgtacgtgaaggtattcatagacccaaggaattaatacaacgtgtgattgaccaagatgcacaaatttaccatgatcaaaatatttcttcaaatatatctagagaccaggaagaacctcataaaagtaatattcaaatggtatatcagcatttaatgaatggtgtttccttcatggttccatttatcgtcgttggcggtttactcatagctattgccttaactcttggaggacacaccactccaaaaggattagttatcaccgaagattcattttggaaatctattgaaaatattggtagtttatcgtttaaattcatggttcccatccttgctggttatatcgcggtgagtattgctgataagcctggtcttgttccaggtatgattggtggtgccattgctgctgatggtagtttatatggaagtgaagcaggagccggtttcgttggtggtatcgtcgcaggtttcttagcgggctatattgcaaaatggattaaacagattaaagttcctaaagctatggctcctattatgcctattattattatacctattctatcttctttaatagttggtctcatttttatatttgtaataggcacaccaatttcaaatatatttggtgcattaacatcatggttaaaaggaatgcaaggtgctaacatcattattcttgctcttattattggcgcgatgattgcttttgatatgggaggtccagtaaacaaagtagcattcttattcggttctgcattaattactgaaggcaactacactgtgatgggaatggttgctgtagcagtatgtacaccaccgattggtttaggtttagctacatttgttcgtaaacaccaattcaataaagcagaacaagaaatgggtaaggcatcatttacgatgggattatttggtattactgaaggggcaatcccttttgctgcacaagatcctctaagaatcattccagccaatatgattggcgcgatgattgcttcagtaatagcggcggttggaggtgtcggtgataaagttgctcatggaggtcctattgtcgctgtactaggtggaataagtaatattttatggttctttatagctgttgtcgttggaagcttagtaaccatgttcacagtcttgttatttaagcgtcacacccctgctatagcaaaaagcaataatggaaatgatacttctgttggaactgaaaatgtattttctgatgaccaatctattaatcacagcaaacaactctcacatcatatggtgttcgataaatcactcattgaaattaccaaggaaccaatgacaagagatcaagctattgatagattacttactaagttatgccatcgtcattacattacgaatatagaagaggtaagaaccgcaatccttaaacgagaggctgagtcaacaactgctatcggaatgaacgttgcaataccacatgctaaatctcatgcagttaaacgtcctatcgtcgctgtattaaatcataaagcaggtgtagagtgggaaagtctagatgaatcaaatcctcagctcatttttcttattgcagttcccaatgataataacgatacacatttaaaactgctacaacggttatcacgaacgctcatgaaagataatacgcgtgatgagttaattcatgctcaaagtcgtgatgaaatatttaatattttaaaagagatataa

SEQ ID NO: 831 - DNA, 126 bp, Staphylococcus epidermidis
ataaagaagccagtaaatgaatttataaaaactcatttactggctattttgttaggaattatgtcccagcttcccgtatcaattattattcttttttacttaatttataatcaattaaatagatag

SEQ ID NO: 832 - DNA, 915 bp, Staphylococcus epidermidis
ctattacagtttattttcgcaatcagttcttacacaggtttgaaaaaaggtattcaaaaattaagtgatgttaacgtttggttatcatttttattattagcatttgtattcatcgtaggtccaactgtgtttattatggaaactacagttacagggttcggtaatatgataaaagatttcttccatatggcgacatggatggaaccatttggtggcataaaaggtcgtaaagaaacgaatttccctcaagattggacaatattctactggtcatggtggctcgtttatgcaccgtttattggattgtttatcgcgcgtatctcaaaaggacgtacacttaaagaagttgtattaggaacaatatgctatggaacattaggttgtgtgttatttttcggtatttttggtaactatgctgtatatctacaaattactgagcaatttaatgtaataagctatttaaacaattatggtacagaggcaacaatcatagaaataatgcatcaactaccattctcgacaattactattatcttattcttaatatcagctttcttattcttagcaacaacattcgattctggttcatatattttagcagcagcgtcacagaaaaaagtgataggagaaccgttacgtgctaatcgtttgttctgggcgtttgcgttatgtttactaccgttctctttaatgctagttggaggagaacgtgcattagaagtattgaaaacagcatcattacttgctagtgtacctttaattgttatatttacgctaatgatgatttcgttcttaattatactcggacgagatcgtatcaagttagaaagacgtgcagataagcataaagaaattgaaagacgttctctaagaatagttcaggtcaaagacaaacctgaagacgataacttataa

SEQ ID NO: 833 - DNA, 906 bp, Staphylococcus epidermidis
aaagaacagttaactgaagacaatgtccaatctattgaaggatttgatggactatcattgtctcaaacattaccattatcagaaacaatttataataaattaaatcaacttggaattcggcagatcgctcaacgaagtgctggatttgatggttataatttagagttagcatctaaatatggtcttattatatctaatgtgccttcctattcacctcgaagcattgctgagtttaccgtgactcaagccatcaatattgtacgtcactttaatcatattcaaagaaaaatgagattgcacgattttaggtgggaagcatcaattttatctcaatcaatcaaagatttaaaggtagcggttattggcacgggacatattggtggcattgttgcacaaatattctcagaaggatatctatgtgacgttgtagcgtatgatccttttccaagtgaacatgtgaaaccttacgttacctataaacaaagtataaatgaggcaattaaagaggcagatattgtcacaatacatatgccgtcaacacaatataacaattacctgtttaatgaaaacatgtttcaaatgtttaaaaagggtgctgtgtttgtaaattgtgctagaggatccttagtagataccaaggctttgttatctgcaatagagcaaggtcaaattaaaggtgcagcacttgatacttatgaatatgaaattggagtatatacgacagatagaagtgaagaaggtttgaatgacccacttttagaggaattaattactagagaagatattattgttacaccgcatatagcattttatactgaagaggcaatcaaacatcttatttttgatgctttagatgcaacaatggaagtattaaatactggcacgacggagttaagagtaaattaa

SEQ ID NO: 834 - DNA, 471 bp, Staphylococcus epidermidis
tatattaagttaagtgtaattcaaaaacaaggagtttttataatggcaaattctatttactcaactacaatgatttcaaatggtggacgtgatggtcgcgtttttagtccagataatacatttgttcaaaaccttgcaacacctaaggaaatgggtggtcaaggaggcaacgatactaatcctgaacaattatttgctgctggatatagtgcatgctttaatagcgcgctatcattaatcttatctcaaaataaaataagtgatgccaacccagaagttgaaatcactattgaattacttaaagatgatactgacaatggttttaaactcggcgcagatattaaagtcacacttgaaaatatgtcccaacaagatgctgagaaatttgtggagcaagcacatcaattctgtccatactcaaaagcgacacgtggtaacattgacgttcagttagatgttacagcgcaataa

SEQ ID NO: 835 - DNA, 213 bp, Staphylococcus epidermidis
aatgtaaagttgctcatcaccgaaggaggactatttatgtttaccatatcaatcatcgctatgattattggtgttgtgcttattgttttaagtcaaattatctatcattcaaaaccgatagatgctaaggaaaaaatgtttatacccggtgtatgcctttttttagtaggactcttaagtttaatcggtcactttgttaatggctacgtataa

SEQ ID NO: 836 - DNA, 165 bp, Staphylococcus epidermidis
ttactatttacaaataacttaatttctttcataatagtgttatacaaggaggaagataaaatgaaacagaatttacaaacagcaagacgcaacctcaatagtcctaacatcaaaacacgaaaacgtgctttaaaaataataaaacagcatcaacgttcgaaataa

SEQ ID NO: 837 - DNA, 285 bp, Staphylococcus epidermidis
gagagaattacgctacctgcacctattgcaagaacgaccaaagctacattaacatctgaatgctctaaaagtggtaacacaatgcctgttgttgatacagcagcaactgtagctgatcctaatgaaatccttaagactgcagctacaatccatgctaataaaatgggcgacatgcttgttccttcaaacatcttagcgattgtatcacctacgccaccatcgatgagcacttgtttaaatgtaccaccaccaccgatgatgagtaacatcatgccgattggataa

SEQ ID NO: 838 - DNA, 849 bp, Staphylococcus epidermidis
ctatgtgagttcgaaagtgagggaaaaattagcatgaatacgttggatagtaaatatgaattaaaatcaaaaaaacatcgtcagcgaataattaaaaattgggttatagtcactgtagttgcagctgtaattatatgggcgtttgcaggaattccaggtcttgaacttaaaagtaagtctattgaaatattaaagtctatcttttacggactatttcatccagatttaagttacatatatatacctgatggtgaagacttacttagaggtttgctggaaacttttgctattgcagtgattggcacgttcattgcttcaattatatgtattccttttgcatttttaggagctaaaaatatgatgaaattacgaccggttacgggcataagtaaattcatattaagcattatacgtgtgtttcctgaaattgtaatggcgttaatatttattaaagctgttggaccaggttcgttttcaggtgtacttgcactggggattcattcagtcggcatgttagggaagctttttgttgaagatattgaaagtttagattttagcgctgtagaatctttaaaggcgagtggagcaaataaaatgaagacgttaatgtttgctgtaataccacaaattttaccatcgtttatttcacttattttgtatcgatttgaattgaatttacgttcggcctccattttaggattaatcggcgcaggtggcataggtacaccattaatttttgctttacaaacacgatcttgggaccgagttggcatgattctaattggtttgattgcgatggtcgctttagttgatttaatatctggcgcggttcgtaaacgtatcgtttag

SEQ ID NO: 839 - DNA, 180 bp, Staphylococcus epidermidis
ctttttgctacattcatttatcttatattatttgaacaagtcaaatatacttttacgtgtgtacaattcattaaaagcatccacaaaattttattcttaataaattcaatggcatattatacttttttatattttatcattcatatattcaacacaaatttagttattaagactttctaa

SEQ ID NO: 840 - DNA, 1449 bp, Staphylococcus epidermidis
aaggcatatacgttttcaatccctccttctaaaggagaaatgaatatgaatgacacaggagataaaagattaagtcgaacatcattaatcggtcttgttataggttcgatgattggtggcggtgctttcaatattcaatctgatatgggaggccacgctggaggattagcaattataattggatggttgattactgctataggaatgatttcattagcacttgtctttcaaaacctaactaatgaacgatctgatttagatggtggtatttatagttatgctcaagcaggttttggtgattttatagggtttgcaagtgcttggggatattggttctcagcttttttaggtaatgtcgcatatgcaacgttattaatgtcttctatagggaacttctttccaatatttaaagggggcaacacatttcctagtatcatagtggcatcaatattattgtggagtgtgcactttttaatattaaaaggagttgagacggctgctttaatcaatagtattgtcactattacaaaattaattcctatcttattagtgattatatgtatgattgtagcctttaattttaatacattcaggataggtttctttggaatggatggatatggatcattatcatttcatttcgctaatacgatgtcacaagttaaaagtacgatgttagtgacagtttgggtatttattggtattgaaggtgctgttgtattctccggaagagctaaaaataaaaaagatgttggaactgccactgttatcggacttatttcagtattgctcatttacttcttgctgactgtattagcacaaggtattgtgattcaaaatcatatttctaaacttgaggcaccatcaatggcacaaattttagcttatatagttggtgattggggagcaacatttgtcaatattggtcttattatttcagtattaggtgcatggctaggttggacattactcgccggagagttgccttttattgtagctaaagatggtttgtttcctaagtggtttgcaaaagaaaataaaaatggggcacctatgaacgccttattcattactaatgtattagttcaaatattccttattagtatgctgtttaccaaaagtgcttatcattttgcattttctctcgcggcaagtgctatactttatccatacatgttcagtgcgttttatcaggtgaaatatacaatagaatacaagttaactgcaacgcctaaacaatggattataggaattctagcatctatttatgcaatttggctggtttacgcgtcaggtatagattatttgttacttaccatgttgctctatatcccggggattatcgtctatgttgttgttcaaaaaaataatcaaaagcgacttacacaatttgactatattttcttcggtcttatcgttattttagcattgatagggttattacgatga

SEQ ID NO: 841 - DNA, 216 bp, Staphylococcus epidermidis
taccttcatacttttctaaagaaaccaggttcagcgaatggtattgtatccatgatgggaggaataggcggtttcttcccaccactggtgattacttttgtaacgagtatcactggttcaagtcatctcgctttcttcttcttggctatatttggtgtaattgctcttattacaatgattcatttaaataaaaaagagaaagctattcgtatataa

SEQ ID NO: 842 - DNA, 138 bp, Staphylococcus epidermidis
gcaccaaatactatgaatgcagaaggaacaagcaagattaacacaataatcgttcttgaaaatcttgttaaatttttcggtatcaccgtgaatgctttaaatccattttttctaataggtgtttcgataaatttataa

SEQ ID NO: 843 - DNA, 2385 bp, Staphylococcus epidermidis
atggcgaatacaacgttgactttggatattattggtatgacatgtgctgcgtgctcaaatcgtattgaaaagaaattgaatcgtatgaatcatgttcaagctaaagtgaatctgactactgaaaaagcaactatcgactatgagtctgacgattatcatctcgaagattttgtagagcaaattcaaagtctcggctatgatgttgcagttgagcaagtagaattaaatataaatggtatgacatgtgctgcatgttctaatcgtatagaaaaggttctaaatcaaacgcaaggtgtacaacaggcaacagtaaacttaactaccgaacaagcactcatcaaatattaccctagtgctacgaacacggaagcattaattaagcgtattcaaaatattggatacgatgctgaaactaaaacttcatcaaaagcgcaatcaaatcgtaaaaaacaagagttaaaacataaacgcaataaattaatcatttcagctattttatcgttgccactattattagtaatggtggtgcatatctcaccaatttccattccatccattttggtcaatccttgggtacaattaattctttcaacacctgtccaatttattattgggtggcaattttacgttggcgcgtataaaaatttgcgaaatggttcagctaacatggatgtattggttgctgttggtaccagtgccgcatatttttatagcatttatgaaatgatgatgtggctcacacatcaaacacatcacccgcatttatattttgaaacaagtgctattttaattacgttaattcttcttggtaaatatttagaagcacgtgccaaatcacagactaccaatgcattaagcgaattgttaaatttacaagcgaaagaagcacgagtaattaaagaaaataaagaaattatgcttccacttgataaagttaaagtcggagatactttactaataaaacccggcgaaaagatacctgtagatggcaaagtcactaaaggtgatacttctattgacgaatccatgctaactggtgagtctatacctgttgaaaaaagtagtggcgattcagtgattggttctaccatgaataaaaatggttcaatcatgattgaagcaactcaagtaggtggtgatactgcattatcacatataattaaagtggttgaggatgctcaaagttctaaagcaccgattcaacgcttagctgatattatttctggatattttgttccgattgtagttagcattgcggttattacttttatcatatggattatattcgttcaccccgggcaatttgaacctgcacttgtttcagcaatatctgttttagttattgcttgtccctgtgcacttggtttagcaacgcctacatctattatggtaggtacaggacgtgctgcagaaaatggcatattattcaaaggaggccaatttgtagaacgtgcacattatgttgatacaatcgtgctagataaaacaggcacaattactaatggtcaacctgtagtaactgattatgttggtgacaatgatacattacaacttttagcaagtgctgaaaatgcttcagaacatcctcttgctgatgctattgttacttatgctaaagataaaggtcttaatttacttgataatgacacttttaaatcaattccgggacatggtattaaagctacgattcatcaacaacaaatccttgtgggcaatcgaaaattaatgaacgattacaatatatctattagtaataaattaaatgaccaattaaatcactatgaacatttaagtcaaacggcaatgatgattgccgtggataatcaaattaatggaatcattgctgttgctgatacagtaaaaaatgatgctaaacaagcgataaaagaactaagaaatatgaatatcgacgtggttatgctgactggtgataacaatcgaacagctcaaaccatcgccaaacaagttggcattgaacatgtaattgcagaagtgttgcccgaagaaaaggcacatcaaatctctttattacaagacaaaggtaaacaggttgccatggtcggtgatggaattaatgatgcgcctgcacttgtaaaagccgatattggaatggctataggcactggagctgaggtagcgattgaagctgcagatattacgattcttggtggtgacttgctattagttccaaaagctatcaaagcaagtaaagctacgattaaaaatattcgacaaaatttattttgggcatttggatataacgtagctggcatcccaatagctgcttgtggtttattagcaccttggattgccggtgctgctatggcattaagttctgttagcgtagttatgaatgcattaagactgaaaaaaatgaaactatag

SEQ ID NO: 844 - DNA, 165 bp, Staphylococcus epidermidis
gacagtggtacactccaaacatgtactaaacgagtaaatggccaacacgcaaacactgtaaaccctaataatatgtgcagtttaaacgaccaaggcacgtttaacattaagtcagcatttggagaaaacatgaataaatgtctaaaccatatcgcaatggtttga

SEQ ID NO: 845 - DNA, 126 bp, Staphylococcus epidermidis
ccatacgtcacgttctatccacctcaattcaatgcacttctacttgtatacaagtatgttaatatacaaaaatttgttttgcaagcgctttcttttaggtgttttgacattttaaacacaatttaa

SEQ ID NO: 846 - DNA, 138 bp, Staphylococcus epidermidis
agagcctacacatatgatatggcagactctttaataatttcttttacattcgtttatagtggcttcattcaaaatattacaaatgaaacaagattattttattctttaatccaagaagtagacaggcatttattttaa

SEQ ID NO: 847 - DNA, 339 bp, Staphylococcus epidermidis
tgtatcaggttccatattatcaacttgattactctgttcattctgtcttactatatcatcaataatttgatacccttcacaatattaataataaataatacaagcgaagcgataagtagaatacctccaataattactcctatcactagtacagcgactccatttgtcgaatcaatcaaggatagtccagcagcaaatgatataagtcctaataccaaacacacccaactcaaaatatggttaaataatgcatttcttgaatacgtagatgctggtggttgtccaacaatccatacgattaatggaaacaatacaggtgcgaaaaatacacttagataa

SEQ ID NO: 848 - DNA, 144 bp, Staphylococcus epidermidis
ggttatttaactatctttaaaatttacaatttaatattaaaaagatttataagtatcatgatttacatacataagaaaagagaggtaaagcagattgttactcattatagcgtgtgttgcgcttattctctggctaggaattaa

SEQ ID NO: 849 - DNA, 177 bp, Staphylococcus epidermidis
actaaattaacgaggtgtcttatgtataaaaattataaaatgactaaacatactctactaatggaaacttcagttcttatccccacaaatgatatttcacgacatgtaaatgttattgcagaaacaattcccgagactgaattcgataaattcagacattatcgttgcttaatataa

SEQ ID NO: 850 - DNA, 177 bp, Staphylococcus epidermidis
actaaattaacgaggtgccttatgtataaagaatataacttgactcaacatactctaccaatggaaacttcagttcttatccccacaaatgatatttcacgacatgtaaatgatattgtagaaacaattcccgatactgaattcgatgaattcagacatcatcgtggcttaatataa

SEQ ID NO: 851 - DNA, 210 bp, Staphylococcus epidermidis
actaaattaacgaggtgccttatgtataaagattataatgtgactcaacttacgctaccaatgaaaacttcattttttatccccgcaaatgatatttcacgacatgcaaatgatattgtagaaacaattcccgagactgaattcgatgaattaagacatcatcggggtgcaacatcataccattcaaaaatgattttaaaagaactatga

SEQ ID NO: 852 - DNA, 177 bp, Staphylococcus epidermidis
actaaattaacgaggtgccttatgtataaagactataacatgactcaacatactctactaatggaaacttcagttcttatccctacgaatgatatttcacgacatgtaaatgatattgcagaaacaattcccgatactgaattcgatgaattcagacattatcgtggcttaatataa

SEQ ID NO: 853 - DNA, 177 bp, Staphylococcus epidermidis
acaaaattaacgaggtgccttatgtataaagattataacatgattcaacatactctactaatgggaacttcagttcttatccccacaaataatatttcacgacatgtaaatgatattgtagaaacaattcccgatactgaattcgatgaattcagacatcctcgtggcttaatataa

SEQ ID NO: 854 - DNA, 177 bp, Staphylococcus epidermidis
acaaaattaacgaggtgccttatgtataaagactataacatgactcaacatactctactaatggaaacttcagttcttatctccacaaatgatatttcacgacatgtaaatgatattgcagaaacaattcactatactgaattcgatgagttcagacatcctcgtggcttaatataa

SEQ ID NO: 855 - DNA, 177 bp, Staphylococcus epidermidis
acaaaattaacgaggtgccttatgtataaagactataacatgactcaacatactctactaatggaaacttcagttcttatctccacaaatgatatttcacgacatgtaaatgatattgcagaaacaattcccgatactgaattcgatgaattcagacattatcgtggcttaatataa

SEQ ID NO: 856 - DNA, 1308 bp, Staphylococcus epidermidis
aaaaggctaacgcataggaggtgtatcacaatgagtgaaaatattattatgccaaagcttggaatgacaatgaaagagggaactgttgaagagtggtttaaatcagagggtgacaccgtaaaacaaggagagagtattgttacaataagctctgaaaaattaaccaacgatgttgaagcgccggcgagtgggacattgttagaaattaaagtgcaagccggagaagatgcagaggttaaagcggtattaggtataattggagaagaaggggaagctattgataaagatgaagatgatttagcatcagaaaaagtaaaagaagacaacgagcatgagaaggaaacgcaagaagttaaagatacatcacaaccgtcttccgataataaagataattcgcctaaaagcgcagcacgagaaagaatctttatctcacccctcgcacgtaatatggctgaggataaaggattagacattaacaagataaaaggcacaggcggtaatcatcgtattacaaaactagatattcaacgtgttgaagcaaatgggtacgactatgctagtgatacgacatctaatgaagatacaagtcatgttccaacacagactgtggatacaagtgcgattggtgaaggattgaatcctatgcgtcaacgtattgctcaaaacatgagacaaagtcttaatagtactgctcaattaacattacatcgtaaggttgatgcggatcgcttgctagatttcaaagacagattagctacggaacttaaacaagcagatcaagatgttaaattaactgttactacattattagctaaagcagtagtgcttgcacttaaagaatatggggcaatgaatgctcgctatgaacaaggcgagttaactgagtatgaagatgttcatttaggaatcgcaacgtctctagatgaaggccttatggtgccagtgattaatcatgcagatacaaaaagtatcggcactttagcccatgaaattaaatcatcggctgaggctgttcgggaaggaaacacaggagcagtacaattagagggagcaacatttacaattactaatatgggtgctagtggtatagaatactttacaccaattttaaatttaggtgaaacaggtattctaggcgttggtgctttaactaaagaagtcgtgctagaagcggataacattaaacaagtttcaaaaattcctttaagcttgacatttgatcatcaaattttagatggtgcaggtgcggccgattttcttaaagtactagctaaatatatcgaaaacccttatttattaatgttatag

SEQ ID NO: 857 - DNA, 177 bp, Staphylococcus epidermidis
cctctaataacactatgcaaactcctttctacccttctactacatcataaaataaaaagaatgccaataacattcatgaaatcttacaaatatcattggcaaacttacaattttgaaagtttattatttttctttagtaaaatgtataaaaaatactgtcccatgattcaactctga

SEQ ID NO: 858 - DNA, 141 bp, Staphylococcus epidermidis
tttaaaataactaatcacacgattccgtcacaatttattttttataaacaccgtttctatataaaaaacaaacttgcctctctttatataaaaacaaactcaaatatcatctcattatacatttttaaaaacgtagtttaa

SEQ ID NO: 859 - DNA, 297 bp, Staphylococcus epidermidis
aagtggataacacccatactatttatagatattgttatttttacaccaatcattgaagaacttttatttcgtcatttaatcattcatgaactaggtaaaaaattaacttatggtttgatgtatattgtgtcaatagtgggatttacatattttcattgtactgatgcagtttcaccatttgaagcaggaccttactttattgcagcagtcgtatttgttataggttaccattttagccaccgtaatttagcagtacccattgctttgcatatgattacaaatttaatagcattttaa

SEQ ID NO: 860 - DNA, 225 bp, Staphylococcus epidermidis
aatttctcaactccatttacatatatctatgtgtatgttagaaataattatgtaagcgtatcacaaacaacaacaagggaggattatattatgtcaggtatcgttgaatcattacataacgctgtaaacgctggtttacacgtaaaacaagattgggtagacatgggattcggtattgcagatacagttgcaaaaatcgttgaccaagttttaaaatttgtttaa

SEQ ID NO: 861 - DNA, 192 bp, Staphylococcus epidermidis
tggagcccaactggcatttttaataagatgcctaagatgactattaaggtaatgattgttaaaaatataaaaatcattttccaacttgcaatagataaagcgaggccacctaacagtggagcaatgatggtgattataccgtttatgaccataagagaagttaaaaattttgctaatttgtttccgtcatag

SEQ ID NO: 862 - DNA, 141 bp, Staphylococcus epidermidis
tatattacaacatttatgttaaattgtgcatttaatttttattttagggaaaagagatgtctagaaggaattcatatttacagatatataggaggaatctttaatggttttacgttatgctacaaatttaaaactagctaa

SEQ ID NO: 863 - DNA, 132 bp, Staphylococcus epidermidis
aatttcacaacatttttctggaagatatatttactgttgattgccaaatatcatcattctcttatgtatacttcatttctttttaacgaatatagtaatatagacacactaaaaaagtttaaaaagccgtaa

SEQ ID NO: 864 - DNA, 2421 bp, Staphylococcus epidermidis
acacatcaaactatcacaggagtgatacgaatggctaaaggtgttaaccaaattattaataatattaggttaagaaaattgcgcaaaatattaaatcaaattaatgcgcttagtgaggagttctcaaattttagtgatgaagcacttcaagcgaagacaaaagaatttaaagtttatttaaatgataataaagcttcactcaatcacattctgccacaagcttatgcaacagttagagaggcttctaagcgcgttttaggtatgtatccaaaagatgtgcagattttaggagcaatcgctatgcatcaggggaatattgcagaaatgcaaacaggagaaggtaagacgcttacagctaccatgcttctgtacttaaatgcacttacaggtaagggtgcttatctaatcacaacaaatgattacttagcaaaacgcgattttttagaaatgaaaccactatatgaatggctaggcttgtctgtatcattaggatttgtggacattccagaatatgaatacgctgaaaatgaaaaatatgaactgtaccaccatgacattgtttacacgactaatgggcgactagggtttgattatttaattgataatttagctgatgatattcgtgccaaatttttaccgaaattaaactttgctattattgatgaagtcgattctattatattagacgctgcccaaacgcctttagttatttctggtgcaccacgtgtacaatctaatttatttcacatcgttaaaacgtttgttgaaacacttgagaaagataaagacttcatagttaattttaataaaaaagaagtgtggctcactgatgagggctcggaaaaagcaagccattatttcaaagtgaatagtatataccaacagcaatattttgatttagttaggatgattcatttatcgcttagagctaagtatttattcaaatataatttagactattttatttttgatggtgagattgtgcttatagatagaataactggtcgtatgctacctggaacaaagcttcagtctggtttacatcaagctatagaggctctggaaaatgttgaaatttctcaagatatgagtgtgatggcaaccataacattccaaaacttatttaagcaatttgatgaattttcaggtatgactggaacaggtaaattaggggaaaaagaattctttgatttatattcaaaagttgttatagagattccgactcacagtccgattgaacgagatgatagacctgatagagtatttgctaatggtgacaaaaagaacgatgcaattttaaagacagtgattggtatacatgaaactcaacaacctgtgttactaattacacgtactgcagaagcggcagaatatttttcagctgagttatttaaacgtgatatacccaacaatttattaatcgctcaaaatgtagctaaagaggcacaaatgattgctgaggcgggacaattatctgcagttactgttgctacaagtatggcagggcgtggaactgatataaagttatcaaaagaggttcatgatatcggtggcttagcagtgattattaatgaacatatggataatagccgtgttgatcgtcaattaagaggacgctcaggtcgccaaggagatcctggatattcacagatttttgtatcacttgatgatgatttagtaaaacgttggagtaactctaacttggcagaaaataaaaacctccaaacgatggatgcatctaaactagaaagtagtgcactctttaaaaaacgtgtaaagtcaattgttaataaagcgcaacgtgtatctgaagagactgctatgaaaaatagagaaatggcaaatgaattcgaaaaaagtattagtgttcaacgagataaaatttatgctgaacgtaatcacatacttgaagcaagcgattttgatgattttaattttgaacagcttgcacgagatgtgtttacaaaagacgttaaaaatcttgacttaagtagtgaacgtgcacttgtgaattatatatacgaaaacttaagttttgtcttcgatgaagatgtatcaaatattaatatgcaaaatgatgaagaaatcatacaattcttaatacaacaatttactcaacaatttaacaatcgtttagaagttgctgctgattcatatttaaaacttcgtttcattcaaaaatcaattttgaaagcgatagatagcgaatggattgaacaagtagataacttacaacaacttaaagccagtgtaaacaatcgacaaaatggacagcgtaatgtcatttttgaatatcataaagtggctcttgaaacgtatgaatatatgtctgaagatataaaaaggaagatggttagaaatttatgtttaagtattctagcctttgataaggacggagatatggtcattcatttcccataa

SEQ ID NO: 865 - DNA, 1575 bp, Staphylococcus epidermidis
aacatcaaaacacattctaggggggagtgcatgtctaaaattttactaactggtgcatcaggttatattggtaaccatctcaagaataaattaaaaaaagatcatgaagtgatagctatatccagaaatactcataataaaacggatgaagaaaatgtcacgtggaagtcagcagacttatttgatttggacgaagttacaaaagtaatgaaagatgtagatacagcgatatatttagtacactctatgatgccatcagcaaaattaacgcaggctagctttgaagatatggatgcattgttagcagataattttgcgcgtgcggctcaaaagcagggtgttaagcatattgtctacatgagtggtttaataccagaaaatgatgagctatctgcacatttaagaagtcgacttgaatgtgaaaaaattcttggtgattacggtataccagttagcacattacgtgcaggtttaattattggtgcaaaaggtagttcttatccaattcttaaacgactagttgagagattgccagcaatggttttgcctagttgggcttacaataaaattgcacctgttgccattgacgatgtgatagatggtttagcagcattggtgaatcgaacacccaaagataacgaagcaattgatatcacaggtcctgaagtgatgaattataaaacgctgatacagcgcacagctaacgtacttgataagcgactgcctatgcttgatttacctattatacccattatcgtaagtcgatattgggtacaactgatttcaaatgtaccgaaagaaatggtatatccattaatgaatagtttaactcacgatatggtaccacatcgaaaacgcgttgtgtctaacttgtccgtaggaaatatcacctttgaagatagtgtgaaaagagcactaagagaagaacaaaagacttctaagaaaaagtcagattcgaaaaattctcaatcatttgggcttatgcatcaagaaattaaagatgtacgagccattacacggtttaaaattccggaaggttattcgattaaagatgtgactaaagaatatgcaaaattcatcaataatatcacactacatatcgttaaaggtacgataaatgaacgagaatttaatatgaatttgcccttcattaataaatttattttaaaaatggaacgtgatgaagctgactctacagaagatatggtggtatataatattgtgggtggcgatttagcacattcaaatgatggtggaaatgcacgctttgaattccgaagaataagaaacaccaatgagggtattattgctttacaagaatatgaacctacattaccttgggtagtatataaactaactcaagctaaagcacacaagactgttatgaatatttttaaaaacaaaatggcacgtttagcgcaacaaaaaaatgtaaaagatgaaacatatatgtctaatcgtgtaactattggagtaacagtagcatcagcgttcgttattggaagcgcagtagggttccaactttttaaaaagcatcaaatcaaaaagaacacaatgtcgaatgcagaattataa

SEQ ID NO: 866 - DNA, 1170 bp, Staphylococcus epidermidis
aaaatgaaaacagtatctaaatattttgtatatatgatgatattagttacgtttttcatagttgttagtgggtgttcgattaatcaatcttttagcgataaacaaaatacaaataaaacaatacgtgtggttgctgtaggtgataatttaattcacccagttgtatataaagatgcacaaattacggggaatagttttgattttaaacctatgtatcaaccagtaaaaaaagacattcaaaacgcagatatttcttttgttaatcaagaatcaccattaggtggggatgataggccttattcaggatttaaaaactttaatacaccgagtagtattgctcaggatttagtagatactggctttaattttgtaaacggtgcaaacaatcatgccttagatcaaggagagcaaggtgtaagaaatcatattcatacttggaacaaatttaaatatcaagttttgttcacgggtgtatatgaatcagaacaagcacaccgtcaaattcctattaaaacaattaaaggtgtgaaagttgctttattaagttacacatttggtacaaacgatcatcaaccaactcatgattatacggtagatacgtttgatgaaaataaaattaagcaagatgttaagaaagccaaacaacaaagtgatgtagtacttgtttcagcacattggggtaatgaaggtaagcatcagcctaacgccactcaaaaaaaatatgcacaaattttcgctgatgcaggtgttgatgtagttttaggtacacatcctcatgtgattcaaccagtaaaatgggttgacggtagagaagggaatcgtacactcgtagcatattcattagggaatttcttgaacggtcagtcaacagggaatgaaagtaatgatttattaggacggatagattttaaaattagtaagaaagataaacagtttcaagttcaagatgtgaagtggagaagtatggtgaattattacgaattaactcaacaccaaaaccagttccttaagtcgaactttaaagtgatgatgctagatgactataatgacaaagatgccactcatcatggtcgcaatcaaatggatagttcttcgatgagccctgcacacttacgagatatcacacgttcagttattgataaacaatatttagacaatcggagtttatag

SEQ ID NO: 867 - DNA, 537 bp, Staphylococcus epidermidis
atgttagaaacacatagattaaagctagtgaagcctaatttgagttatacagatgaactttatcaattgcatacaaataaggtagctacaaagtatacacctaaaggtattcatcagaataaagtagcaacccaagattttattaaaggatggatgaggcattgggatgaatatcaatttggttacttcattttaattatgagagataatcacgaagtagtggggatagcgggatttgagtatcgtacaattcatcaacaacagtttcttaatgcgtattatagaatctttccatcgtatactggtgttggtttagcttttgagtcaatggaggagattgcccgtcatttaaaaaagcatgataccataacaccaaaattaattcgaacaaatcaatataatacaaattctattaaattagcacaaaaactcggatataattatgatgctaactgggacgatgtaattaataaaggagatcgttgttttttaacctacaagcgttggataataactaaaagcatgatgaattcgtag

SEQ ID NO: 868 - DNA, 726 bp, Staphylococcus epidermidis
gttgatagaacgattaacgataggagtggatataaaatgaattattcaccaaaacaaggtgttaaaagtcatggattgccacatgatccgttcaaaagtagcacagtacctagacctataggttggatttctacagtatctaaagaaggtaaagataacttggcgccgtacagtcaatatcaaaatcttacatgggatcccccaatggtaatgtttgcggctaatcagtcagtgcttggcgatcatgaaagaaaagatacagttaaaaatgcggaagaaactggttggtttgtatggaatatggcaacatatgatttgcgtgaagcagtgaatttatcatccaaagcattacctccagaagatgatgaatttgactttgctggtgtgacgaaagaatcgtgtatcgaagctcctggaagtagggtaaaggaatcacctgttcattttgaatgtgaatatgttcaaacagtaagaattcccactggagaccctgtttcaactgtggatgtagtcatcggtcgtgtagcacaagtgcatattgacgataaagtaattatggacaacggaaaattagacattaagtcaatcagacctatagcacgtctcggttattatgattacacggttgtcgatgaaatatttgaaatgaaagcacctgcagcttcgaaagaagaattggctggacttgaaggtcgaaattttgacaacactaataatgaatcatga

SEQ ID NO: 869 - DNA, 183 bp, Staphylococcus epidermidis
aatacaagaacacatattataaatgcctgggacacattaaatgtctcaggcatatttatttatggcaatcgttgcattaatagaaaatacaatgagttgtatcaaattttcaaattaagctatacgagtgaggaacataaagttttattcaacctttgttctacttcttttatttatacataa

SEQ ID NO: 870 - DNA, 2031 bp, Staphylococcus epidermidis
atgaagagaacagataaaattggtgtctacctcaagctgtcatgttctgcgttgttacttagtggttcgctggttggttatggcttcacaaaagatgcttttgcagattcagaaagtacatcatcaaatgttgaaaatacttctaatagtaactccatcgctgacaaaatccaacaagctaaagatgatattaaagatttgaaagaactttctgacgcagatatcaaaagttttgaagaacgtttagataaagtcgataatcaatcaagtattgaccgtattataaatgatgcaaaagataaaaataatcatttaaaatcgacagactctagtgccacatcatcaaaaactgaagatgacgatacatctgaaaaagataatgatgatatgactaaagacttagataaaatactgtcggatttagattcaattgctaaaaatgttgataaccgtcaacaaggtgaaaatagtgcttctaaacctagtgactcaacaaccgatgaaaaagatgattcaaataataaagtacacgatacaaatgctagtacacgcaatgcaactactgatgattctgaagagtcggttattgataaattagataaaatccaacaagattttaagtctgactctaataataagctttctgaacaaagcgatcagcaagcatcaccatctaataaaaacgaaaataacaaagaagaatctagtacgacaacaaatcaatccgatagtgatagtaaagacgataaaagtaatgatggtcgtcgctcaacattagaacgtatagcatcagatactgatcaaattagggattcaaaagatcaacatgtcacagatgaaaaacaagatatacaagcaattacacgttcactacaaggtagtgataagattgaaaaagcacttgctaaggtacaatctgacaatcaaccactagattctaattatataaataataaattaatgaatttaagatcactagatacaaaagtagaggataataacactttatctgatgataagaaacaagcgcttaaacaagaaattgataaaactaagcaaagtattgaccgacaaagaaatattattatagatcaactcaatggtgctagtaataaaaaacaagcaaccgaagatatcttaaatagtgttttcagcaaaaatgaagtagaagacataatgaaacgtattaaaacaaatggccgaagtaatgaagatatcgctaatcaaattgccaagcaaattgatggtcttgcattaacttctagtgatgatattttaaaatcaatgttagatcaatctaaagataaagaaagtttaattaaacaattgttgacgacacgacttggtaatgatgaagcagatcgtattgctaaaaaattgttaagccaaaacttgtcgaattctcaaatcgtagaacaattaaaacgtcatttcaatagtcaaggaacagctacagctgatgatatattgaatggtgtgattaatgatgctaaagacaaaagacaagcgattgaaacaatattacaaacccgtatcaataaagacaaagctaaaattatcgccgatgttattgcgcgtgtacaaaaggacaaatcagatatcatggatctcattcactctgcgattgaaggcaaggcaaatgatttattagatatagaaaaacgagcaaaacaagctaagaaagatttagaatatattttagatcctataaagaatagaccatccttgttagatcgtattaacaaaggtgtcggtgattctaattcaatatttgatagaccaagtttacttgataaacttcactcaagaggatctattcttgataaattagatcattcggcaccggagaatggattatctttagataataaaggtggccttttaagtgatttatttgacgacgatggtaatatctcattaccagcgacaggtgaagtcatcaaacaacattggataccagtggctgttgtactcatgtcattaggtggagcgctcatctttatggcgcgtagaaaaaaacaccaaaattaa

SEQ ID NO: 871 - DNA, 606 bp, Staphylococcus epidermidis
aatggaggaacaagaatgatacaacgtaaaggtgaattaatactttcatggattggcaatggattacatctgttgtatgtatttttagtaggcatatttttcataatgacacaaacaagtgaatttaaaaatgggatgattcaaggatttatagaagaaaatccgggggaatatgatttagcataccaaacttataatttgatgttaggtttaggtgttgttttcattattatacttctcattttattaattgtatcaatagttgccgctattttaattggcaaaaatgcaaaagtatcaggaatattacttgttattacaggaatcattggtctctttttaagttttattgctggtgccttatggttaatagcaggtatcatgcttttagtacgtaaaccacaaacacaaaatgaccaaatcaattctcaatatagtaatgacatacattcacatgttgtgccagaagaaaagaaacgtgaacaacaacaatataatatgaatgaaccacatattggtcaatcatcaacatctcatcatgatcacgcattgaatgatcaaaataaacgagaaaatcataatcatgataatcaaccatacaaatag

SEQ ID NO: 872 - DNA, 1203 bp, Staphylococcus epidermidis
aaaggaggaacaacgacgatgctaacagtcggaattataccttcgccaggtatagcgcatcaacatgtaaaaaaaataattccaaatgttaaacagttattgtcaaagcggactaaacatagtcaatggaatttcgacatcaaagtcgatctcatgataggatctgcagaagatgtacatgaaagtgttgaaaaagcagcacaaattaaagaggaacatcagtgggattacgttgtttgcctgacagatttgcctagtatttcagataataaagtggttgtcagcgactttaatagtgacaaacatgttgcaatgctatcattaccgtcactaggttttattgatttgaaacgcaagctagttaaaacgatgacttcattgattgaacaattatattataatcaaccgaaagacaaaaatgcgccacatccttttgtacgcgtgaaggctgtagaacctgacgaagacgccacatcaaagcaacgatatattaatattttatttatcataagttggattcagttaattggtggactgacacgagcaaatcagccttggaaaaacatctttaattttaagaaaatcatttcagttgcctttgcaacaggaacttatgtctccatattttcaatgccatgggaattaagcgtgatttattcgccgcttcgacttatcatattgatggtgattgctatacttgggatggccggatggctattctatgcgcatcaattgattgaaaagaaaactgctaaatctcagcgagtatatcgatatatttataattcaaccacacttgttacattaagtttgattaccctcataaattatgtcattttatatttattgttaatcatcagtattacactctttgtccctgtggaattatttaatagttggacgagtgcccaatcacaatttacattctcaaattatatgagattgatttggtttgtatcatcattagggcttttagctggagctatgggatcaacagttgaaaatgaagagaaaatacgtcgtattacttattcttatagacaatatcatcgttataaagaagctgagcaagaacaaaaagaacaagaaacttctcgtgatgtatcacaacaaaatgtcgaacaacaaacttcaagtaaagatgaaaataatgaacaatatgaaggtaaaaaacaaggacatagagaggaggatgacgcatga

SEQ ID NO: 873 - DNA, 141 bp, Staphylococcus epidermidis
aattttttgactatctcttatggtttatcagctacatgtaatccgcattcagtcttactagaattggaccaacgaccagcacgtgaatcattagaatcaaatacgggtgatgtacatggaatgcaaccaatacttggataa

SEQ ID NO: 874 - DNA, 993 bp, Staphylococcus epidermidis
ctaaaattgactaaagaggagcacagatttatggattatagagtactactttattataaatatgtaactatagatgaccctgaaacttttgcagccgaacatttgaaattttgtaaggaacatcatttaaaaggaagaatactagtttcaacggaaggcattaatggaacattatctggaacaaaagaagatactgataaatatatagagcatatgcatgcagatagtcgttttgctgatttaacttttaaaattgatgaagctgaaagtcatgcgtttaaaaagatgcacgtgcgtccaagacgtgaaattgttgcacttgacttagaagaagatattaatccacgtgaaattaccggtaaatactattctcctaaagaatttaaagccgcactagaagatgaaaatactgttatattagatgctcgaaatgattatgaatacgatttaggacatttccgtggagctattcgtcctgatataacacgattccgtgacttacctgaatgggtgcgtaataataaagaacaactcgacggaaaaaatattgtcacatattgtacaggtggcattcgttgtgaaaaattttctggttggttagtaaaagaaggatttgaaaacgtaggtcagttgcatggtggtattgctacatacggtaaagaccctgaaactaaagggctatattgggatggtaagatgtatgtatttgatgaacgttttagtgtcgatgtgaatcaaattgataaaacagtcatcggcaaagagcattttgatggtacaccttgtgaacgttatattaattgtgcaaaccctgaatgtaataaacaaattcttgtttctgaagaaaatgaagaaaaatatttaggtgcatgttcgtatgattgtgcaaaacatgagcgcaatcgctacgttgcccgtcatcatattagcaatgaagaatggcaacgtcgtttaaataatttcaaagatgtgcctgaacacacacatgcataa

SEQ ID NO: 875 - DNA, 966 bp, Staphylococcus epidermidis
gaggaattgacaatgaaaatggaaaaagaacaagcacattggatttataaaacgatgaacgaaattcgattttttgaagaaaaggtacacaaaatttttagtgatggtagaattccaggattcgtacacttatatgtaggtgaagaagctgttgcaacaggtgttatgtctcaattaaatgatgatgactatattacaagtacacaccgtggtcatggtcatgcgattgcaaaaggatgcgatttaaatggtatgatggcagaaattatgggtaaacgtgacggattaggtcacggtaaaggtggctcaatgcatgttgcagaaattgacaaaggaatgctcggtgcgaatggtattgtcagtggtggttttgggttagcaattggtgcaagtatttctatcattaatcaaggtaaagataatgttgccgtatgtttctttggtgatggtgctgcaaatgaatgtaatttccatgaaggtcttaattttgcttcaattttagatttacctgttctttttatatgtgaaaataaccaatttgctgaaggaacaacacatgactacgcaagtgcttctgaaacaattgcagagcgtgctgcggcttataatatgccgggtgtacgtgttgatggcatggatgttatggaagtatataaagcaacacaagaggctgtagaacgcgctaaaaaaggtgaaggaccaacgttaattgaatgtgatacgtatcgtaaatatggacattttgaaggtgatgagcaaaaagtaaaatcaccagatgatcgtaacgcagataaaaatgcgacagtagaatttagaaaaagagcaattgaagaaaattggctcactgaaaaagaagcagatgaaatagaaaaagcagctgaacaagctgtagaagatgctgtgaaatttgctgaagaaagcgaattaccagatgaggattcattatacaaggatgtttttgcttaa

SEQ ID NO: 876 - DNA, 867 bp, Staphylococcus epidermidis
agcaacatgactaaagttattacaacaatcaatgaaatgcaatctattgttaaacaacatcaacgtgaaggtaaaacaataggattcgttccgactatgggagctttacatgatggtcatttaaccatgatgaagcaatctgtaagcgaaaatgatctcacggttattagtatatttgtgaatcccttgcagtttggacctaatgaggattttgatgcttatccacgtcaactcgatgatgatgtggctgcagtaaaaaagttacaagtggattatgttttccatccgagtgtagatgaaatgtatccagaagaattaggtattcatctgaaagttggacacttggcacaagtattagagggagcacaaagacctggacacttcgaaggtgttgtgaccgtggtcaacaaactatttaatattgtgcaaccagattatgcctattttgggaaaaaggatgcacaacaattagctattgttgaaaagatggttaaagactttaatcttcctgtacatgttatcggtattgatatcgtaagagaaaaagatggtttagccaaaagctctagaaatatttacttgacctctgaagaacgaaaagaggcaaaacatttatatcaaagtctacgcttagcaaagaatttgtatgaagcgggtgaacgagatagcaatgagattataggtcaaatcgctgcgtatttaaacaaaaatattagtggacatattgatgatttgggtatttatagttatccaaatcttatacaacaatcaaagattcatggacgaatattcatatcattggcagttaaattttctaaagcaagattgatagataatataattattggagatgactatattgattag

SEQ ID NO: 877 - DNA, 1971 bp, Staphylococcus epidermidis
ctatgcatgacccatattacagaaagtgaaatgaaacaaaaatatctagatttactctcacaaaaatttgacagtgcagaaaaacttgctactgaaattattaacttagagtcaatcttagaattacctaaagggactgaacattttgttagtgaccttcatggtgaatacgaatctttccaacatgttttaagaaacggatctggaaatgtgcgtgctaaaattaatgatatcttcaaagataaattatcccagcaagaaatcaacgacttagcagcattagtatactatccggaagaaaaactaaaattagttaaaaataatttcgattcaatcggaacattaaatatttggtatattacaaccattcaacgattaattgatttaattacatattgctcatcaaaatatacacgttcaaaattacgcaaagcattacctgaacaatacgtttatattattgaagagctactttacaagagcaatgaatttcataataaaaagccttattatgaaacattagttaaccaaattattgaattagaacaatcagatgatttgatcattggcctttcctatactgtacaacgtctagtcgtagaccatcttcatgtcgtgggcgatatctatgaccgtggtcctaaacctgataaaattatggatacattaataaattatcattctgtagatatccaatggggaaatcatgatgtattatggattggcgcctatgctggttcaaaagtatgtcttgctaacctactacgaatctgtgcacgttatgataatttagatattatcgaagatgcatatggcatcaatctacgtcctttacttacgcttgctgaaaagtattacgatgctgaaaacccagcgtttaaacctaagaaacgaccagataaagacgtcagtcttacaaaacgcgaagaaagtcaaatcacaaaaattcatcaagcaattgcgatgattcaatttaaacttgaaatgcctattattaagcgccgtccttcttttgagatggaagaacgtttagttttagaaaaaatagattatgataataatgaaatcactatatataataaaacatatccgcttaaagatacttgtttccaaactgtaaaccctaacaatcccgctgagttactagcagaggaaaaagaagttatggataagctattactttcattccaacaatctgaaaaattaagacgtcatatgtctttccttatgcgaaaaggaaaattatatcttccatataatggcaaccttttaattcacggttgtattcccgtcgatgaaaatggagaaatggaatcatttgaaattgaaggtgaacgtttaagtggtcgtgaactactcgatgtttttgaatatcatgtaagaagagcttttgaccataaagaatctaccgaagacatttctacagatttagtatggtatctttggacaggtaaatattcatctttatttggtaaacgtgccatgacaacgtttgaacgttattttatagaagataaagcatctcataaagaggagaaaaatccttattattacttacgtgaagatgttgatatgatacgtaaaatgttaaaggattttggtcttaatccagatgaaggacgtatcataaatggtcatacgcctgttaaagaaattgatggtgaagatccaattaaagctaatggtaaaatgttagtcatagatggaggattttcaaaagcttatcaatcaacaactggtattgccggatacacacttttatataattcatttggtatgcaattggttgcacataaagagttcaatagaaaagaaaaagtgttatcaatgggggcagatgaattgtcagtgaaacgcgttgtagatgaagaattgcaacgtaaaaaaattagagataccaatatcggtaagcaactgcaagaccaaattgatatcctcaaaattttaatgcacgaccgatatttaacataa

SEQ ID NO: 878 - DNA, 999 bp, Staphylococcus epidermidis
tttttaatgacaaaaattatgtttttcggcacaagagcatatgagaaggacatggcattacgttggggaaagaaaaataatatcgatgtcactacatcaacagaacttttaagtgtagatactgtcgatcaattaaaagattatgacggtgttacaacaatgcagttcggtaaattagaacctgaagtttaccctaaattagagtcctatggtattaaacaaattgcacaacgtacggctggatttgatatgtatgacttagaacttgcaaaaaaacatgaaattattatctcgaatatacctagttattcacctgaaacaattgctgaatattcggtatctatcgctctgcaactcgtacgaaaattcccaacaattgaaaaacgtgtgcaagcacataatttcacatgggcgtcccctattatgtctcgtccagtaaaaaatatgactgtagcaatcatcggtacagggcgtattggtgctgcaactggtaaaatctatgctggttttggtgcgagagtagttggttatgatgcatatcctaatcattctttatctttcttagaatataaagaaacagtagaggatgcaattaaagatgctgatattatctcattacatgtacccgctaataaagatagtttccatttatttgataacaatatgtttaaaaatgttaaaaaaggtgccgttttagtcaatgccgcaagaggagctgtgataaacacgcctgatttaattgaagcagtaaataatggtacattatcaggtgctgccattgacacatatgaaaatgaagctaattatttcacatttgattgttcaaatcaaacgattgacgacccaatattattagacctaattagaaatgaaaatattttagttacacctcatattgcctttttctccgatgaagcagtacaaaatttagtagagggtggtttgaatgcagcattatcagtaattaatactggcacatgtgatacgcgattaaactaa

SEQ ID NO: 879 - DNA, 213 bp, Staphylococcus epidermidis
gcctcaatgacatatatttctttatcacaaaagattcggaacgcaaatattctaaattatcagaaaatatttacaaatttgaaaattattagtatattgattactatcctattaatattgatttattttaaaacgatagcagttgatagttttatagcttcatatgtagatagctatattaaaaagagtcactattgggagggaactcaatga

SEQ ID NO: 880 - DNA, 888 bp, Staphylococcus epidermidis
gtgaaggtgactcaaaatgaaaatttgaagttagcgcaacgaggtgcatttcttagtttagtcatctatattatactttctattgcgaaatatatgactggatatgtttatgattcggcggcagttagagcggatgctttaaataacatgacagacattttagtttcagtagcagttatcgtcggacttaaaatctctattaaacctgctgatcaaaaccacccatatgggcacttaaaatctgaaaatatttccacattgctagtatcattcattatcatgtttgtgggaatacaagttattatagaaaactttccgagattatttacacatgattcacatattcctaactttattactattattataagtatgatcagtggacttgtgatgttatgtgtctttgctattaattatcgattatctaaaagaacgaaaagtagctcattaaaatcagcagctaaagataatttatctgatagtttagtcagtattggcactgccattggtctaatgttcacacaaattggatttccaattatcgatattatattggcaaatattttaggtttattaatcgtgtatacaggttttggaatttttaaagagtcgattttcaccctaagtgatggtttcaatgaacaagatttagaagaatacagactagacatattagaagttgaagatgtaattgatgttaataatattaaaggtagatatcatggaagtagtatctttattgatgtgaccattgtagtagatccttatctttcactttatgaagcacatcagatttgtgataaagttgaaattcatttgcataataaaggaatttcgtctgtatatgtacatccagaaccctatactacaaaagacgaagtaaaataa

SEQ ID NO: 881 - DNA, 1062 bp, Staphylococcus epidermidis
cttatgtcgacgataaaaaatatcgatggaccaaaggattttgtttttagagtgttatcaggggtagcaattggaatagtagccggactcgttccaaatgcaattttgggagaaatttttaaatactttatgcaatatcatcctattttcaaaactttattaggggtcgttcaagccatccaatttacagtgccagcgcttattggagcattgatagctatgaagttcaatatgacacctttagcaatagctgtagtagcaagtgcctcatatgttggtagtggtgcagctcaatttaaacaaggtacatgggtaattgcgggaattggggatttaattaatacgatgttaactgcatccatcgccgtgttacttattttattaataaaaaaacgtgttggtagtatggctttaattgtttttccgacagttgttggtggtttagcagctacaatcggcgtatttactttaccatatgtaaggttaattacaacgggaattggtaacatggttaatagctttactgaattacaaccagtgtttatgagtatgttaatctctatggtgtttagttttataatcatatcaccattgtcaactgtagccatagctattgctattggattatcaggtattgctgcgggatctgcttcaataggtatagcagcgacagaagctgtattattgattggtaccagcaaagttaatcatgtaggtattcctttatcaatatttttcggtggggtgaaaatgatgatgccaaatatggttaaataccctgtcattatgattccgattttcttgacagcggcaatatctggtattgcttcagggattattggtatttcaggaacaaaagaatcagcaggatttggttttatcggaatggttgggcctattaatgcctttaaatttatgcatgttgattctgcatggttaagtttattacttattgtcatcgccttttttgttgtgccgtttctagttgcatggattttagatttaatacttagaagattaattcatttgtatgagaatgatatttttaaatttatgggataa

SEQ ID NO: 882 - DNA, 483 bp, Staphylococcus epidermidis
gagaaggcgactactatgaaaaaagtcatatcgcttttagtagtattagttataagtgctgtatctctttcggcatgtgggaaagaacgcacaaaaacttatgaaggcgaagtcaacggaaagcaagtgattacatctttgacatacaaagatgatgaagttctcaaacaatctactatagcaacaattaaatatgatgatttaggcatcgataaagatgaagctaaacaaatgtttaaaaatgatgaacaagcattcaaagggatagacggggttacatataaagctgattttaaagatcgaaaagccatcgaacatatcgatattgattataaagatgcggatatagatcagcttaagaaaaatttaggtttcatatcatcagatgccaaaaaaggtgaccatgtgagtgtggatagggttgttaaacaactcaaacgtaatggtttaaaagataaaagtaaaatgaatgaagataattaa

SEQ ID NO: 883 - DNA, 123 bp, Staphylococcus epidermidis
aaaagcgagaccgattcttttcagattcgtcgtctcgctcccttacaactgactatgattcgaaacagtcagcaacaagcatttttcaattcatttatttataataaaagtttaaaacattaa

SEQ ID NO: 884 - DNA, 141 bp, Staphylococcus epidermidis
gaaagcgagacaacaatacgaggtattataaataaaaagccagtaaatgaatttataaaaaacccatttactggctattttgctaggaattatgtcccagcctctccttttaatttcaatatttgtaaaataaatatctaa

SEQ ID NO: 885 - DNA, 1086 bp, Staphylococcus epidermidis
aggaatgggacggattcgatgaagaaaaataaacttgaattagtgtatttacgtgcgtttatttgtgtcataatcatcgtgacacacttactaacgcaaatcactttagaaaatgaacagatgtctgatagttcactcatattgcaatattatatacgcaatatttttattttcggcacccctagttttataatattgtctcaattattaacaacattaaattacgaatcagtaactataaattatcttttttcaagatttaagtatatttttattccatatcttttaatcggcttgttctatagttatagtgaatcacttatcaccgcttcttcttttaaaaagcagtttatcgaaaatgttgttttaggacaatggtatggctatttcattatcataattatgcagttctttgttctatcttatatcatttacaaaattaattttagattgttcaatagtaaaattttgctgcttttagcatttatagtccaacaatcttatctacattattttttgaataatgacacttttcatcaattcatgactcattattatccattaagcgaaaatacaatgatattaggatggatattctactttttcttaggtggttacattggctataattatgaaaaaatattatctttcttagaaaaatatttaattatagttattatgttaactttaggcgcatatgttttatttatcgctgtttccggtagtgattattggaatgtcacaagctttacttatacgttaacattatataatagtgtcatgttcttcttattactaggagtctgtatgcactttaaaactatgttattaaatactattaaagctattagtgcattttcctttttcatttatttgttgcacccaattatcttagattctctttttgcttacaccaacatatttgaagataatacaattgttttcttggcgatttcacttttaatgattctaggaatttgtataggcgtcggaatgatgttaagagagttttatatattcagatttgtaattggaaaacaaccgtacaagttacaatttgaccaataccagcctaactggaattaa

SEQ ID NO: 886 - DNA, 153 bp, Staphylococcus epidermidis
aacaattttttaaaaaatggaggagtactaaaattgacacgtataaatgattttaacgaagtgcttaacagtagaaaatcactaaaggtatttgatgagaattataaaattcctcgagaagaaatggatgaaatcattactaaagcaacttaa

SEQ ID NO: 887 - DNA, 138 bp, Staphylococcus epidermidis
aatctttatttaatcatgaaaaatcgattcacgtacgccgataaagataggttattacgatatctgttaataaaaatgaaagcgtatgttcgttactctattgctacagaagaacaacttcttctactggaaaaatag

SEQ ID NO: 888 - DNA, 138 bp, Staphylococcus epidermidis
ttatttgttgcgtttattaagccaatgagtaaaaaacgcaatggcacagccactgatgactggcgctatgatgtgaacgaaaataagcatcactttatacacctcctctctgcgtcgaaattgacgcctgagagatag

SEQ ID NO: 889 - DNA, 147 bp, Staphylococcus epidermidis
gggccttatttttcaaagtattttaatgtaaaattacatatgaatataaagtattttggcgagactcttgagggaacaggacaagctgaagactacaggctgaagctgtcccctaagaaagcgagccaacaatacgtagtattgtaa

SEQ ID NO: 890 - DNA, 201 bp, Staphylococcus epidermidis
acgcgatctgcgtcatataataaaacacctaaatatctcatacgtcctgtacaagtttcggaacaaacagttggcataccagcttcgattcgtgggaaacaaaatgtacatttttcagctttattcgttttccagttaaaatatacttttttatacggacatccagtcatacagtatctccaacctcgacaggcttcttga

SEQ ID NO: 891 - DNA, 156 bp, Staphylococcus epidermidis
gattattattttcgtaaaattcctttgtatatcacaggaatcaataagataaaaccaaaaagtcccatgatagggaacactttaccaatgagagaaatgaatcccacaaaagtacaagcaaatgttattatcgccatcataactataagaatataa

SEQ ID NO: 892 - DNA, 162 bp, Staphylococcus epidermidis
aaaagtgctgctatagcatcatgttttatactaataattaattcgggtttaaatagtaatgtatatattaaaacaaccgtgacaacaaacatcattgctggtattaatcgtttaaatcttctaagccaaaaattaactaaattaatagaattatttctataa

SEQ ID NO: 893 - DNA, 1584 bp, Staphylococcus epidermidis
acaaattatttatgcttatccaaaaggtggggagcgtatattgtttctaaaacaaatcttggtgagaaatggggattgctagctggagggtctttattagtcgactatatattaacggtggcagtgagtatttcttcaggagcagatgcttttgttgctgcatttccccacttatatcattttaaagtgcttattgcatgtttattagtactctttattttaatgatgaatttaagaggtttgactgaatcagcaactgtattatcatatccagtctacttatttattataggtttaattgttttgatagtcgttgggacatttcgcgtagctactggacaaatcgcaccacatattcattccactgtaggtagtactgtgcccggtgttacgttatttttacttttaaaagcattttcatctggagcatcatcacttacaggtgtagaggcaatatccaatgcagtaacaaattttaaaaatccagcacctaagaatgcagtcaaaactttagtcactatgggtacaattttagcagtgttattagtaggtattgttgtactctcatatatatatggaattatgcctcaaactgaaacgaccgtgctttcacaacttgcgtcccaaatatttggtgaaaatgtagcgttttattttatacaagctactacagttatgattttggtattggctgctaatactggttttacagcatttcctatgctagctgcatcaatgtctaaagacaaatatatgccacgtatgtttactgttcgtggtgatcgtctcggttattcaaactcgattattatattaggtgtattagccatcattttaattatcctatttgaaggaatgacagagaacctcattccattatatgcagtaggtgtttttattccatttacgcttgctcagtttggtatggttttaaaatggcttcgggaacgtcctgaacgatggggaataaagcttactatcaatttaattggtggtacgattacgtttatcgtattcatgattttactcattactaaacttaatcaagtatggccaattcttttatttttaccttttattgtatttatttttattagaattcatgtacattatgagaatatagcatgtgaattacgatctgaaattgatatacacgatattcctgttgtagatcgcaatttagctattgtacctattcaaagtattacaactgtagttgataaatctatttattatgccaaattattagctaatgatgatgttattgcagtgcatgtgacatttggtgatgaagatgagcaggcttttatgactaaatggaaaaaacattttcctgatgtaagacttgtgattttacattcagagtatagaagtattattcatccgatttcacgatttatagataaaattcgtaaaaaagcgaatgataaaaattatttaattacagtagtcgttccagaatttatccctaaaaaggcttggcagcacttattgcacaatcaaacgagtttacgtttaaaattgcatttaatttatcaaaaaaacgttactctgtgtactattccattcaaattaataaaataa

SEQ ID NO: 894 - DNA, 153 bp, Staphylococcus epidermidis
cttaataatgcattactatttgtaaaaataattaaaccaccgacacaaattgcaagaatgttaatgggtaacactttaactaaatacgctgaaataggtgctgctaccattccaccgagacttaaagcaattacagcaaaccaattaatttga

SEQ ID NO: 895 - DNA, 993 bp, Staphylococcus epidermidis
cacagttatttgtgtaactttattatgaaggagttcgttaaaatgaaaaaatttgggaaaaaagttgttttagtaggagacggttccgtaggttcaagttatgcatttgctatggtgactcaaggaattgcagatgaatttgtaattattgatattgcaaaagataaagtggaagcagacgttaaagatttaaaccatggtgcactttacagttcttcaccagtgactgtaaaagctggagaatatgaagattgtaaagatgcagatttagttgttattacagcaggtgcacctcaaaaaccgggtgaaactcgtttacaacttgttgagaaaaatactaaaatcatgaaaagtatcgtaactagtgtcatggatagtggctttgatggtttcttcctaattgctgcaaacccagttgatatcttaacacgttatgttaaagaagttacaggtttaccagctgaacgtgttattggttctggtacagtgcttgatagtgcaagattcagatatttaataagtaaagaattaggtgttacatcaagtagtgttcacgctagcattataggtgaacatggtgactctgaacttgcagtttggtctcaagcaaacgttggaggtatttcagtgtatgatacattgaaagaagaaactggtagcgatgctaaagcgaatgaaatttatattaatacaagagatgctgcttacgatatcattcaagctaaaggatctacgtattatggtatagctctagcactattacgtatttctaaagctttactaaataatgaaaatagtattttgacagtttctagtcaacttaatggtcaatatggatttaacgatgtttatcttggcttaccaacacttatcaatcaaaatggtgcagttaaaatttatgaaacaccattaaatgataacgaactacaattactagaaaaatcagtgaaaactttagaagacacttatgattctataaaacatttagtttaa

SEQ ID NO: 896 - DNA, 267 bp, Staphylococcus epidermidis
atccccagtgcaagtacacctgaaaacgaacctggtccaacagctttaataaatattaacgccattacaatttcaggaaacacacgtataatgcttaatatgaatttacttatgcccgtaaccggtcgtaatttcatcatatttttagctcctaaaaatgcaaaaggaatacatataattgaagcaatgaacgtgccaatcactgcaatagcaaaagtttccagcaaacctctaagtaagtcttcaccatcaggtatatatatgtaa

SEQ ID NO: 897 - DNA, 579 bp, Staphylococcus epidermidis
aatggaggtgcaatgatggattataataacaatgacagtcaatatatcgaagaagctaaagatttagttatcaactcaatcggtgaaaccatggatttgtatggtatcaaccgtagtgtaggtaacttgtatggcattatggtttttgaaggaagtatgacacttgatgaaatgcgacaacaactgcaaatgagtaaacctagtatgagtacaggtgtaaaaaaactacaagaatacgatatcgtcaaacaacaattcacgcgtggtagccgaaagcaacattttattgcagagaaagatttcttcactttcttccgcaacttttttactaaaaaatgggaacgtgaaattgacactaatatggaagcaattgaagatgcagaaaatatcattcacccacttcttgaaaagaatgatatagatgaggaagttaaaaaacaagcaataaatgtaaaagcgcagttagaccactctaaaatatattacaagtggctcgctcaattaagtgaagctctagagtcaggagaaatttttaactatttcccaattccagatgaacaacatcatcatgatcaataa

SEQ ID NO: 898 - DNA, 261 bp, Staphylococcus epidermidis
gtgtgtatcgcatgtcttaaatgtggctttttaatgcttaggtgttattttaatgttttttctttttatcagaacggtaagttatacttattaaagataaccaaaccagtaacatggttatggctagatagacacttacaactaaatatttcgaatgtaaaggtaaccatgataaaacaaacccccaagttgcatctcctaatattatcaagggaagtagataaaaaagaatattcattgctacaaatcccaacaaaatga

SEQ ID NO: 899 - DNA, 951 bp, Staphylococcus epidermidis
tggagatatttacttatgtctataacttatcctggcacagtttatctaatcggtgcaggaccaggcaatccaaacttattaactaaaaaagctgaacggttaattagatcagctgacgtgattttatttgatcgtctcgtaaatcctttcatcttacagtatgcttcttctcaaacaaaagtgatcaatgtgggaaagaaaccttattgtaaacacattcaacaagaggagattaatcaaaaaattgttgaagcagccaatcaatatcaatgtgtggtgagactgaagggtggagatcctgcgatttttggtagaattacagaagaagtacaaacattagaagatcatcatattcattacgagattgtccctggtgtgacatcagcaagtgctgccgtagcaactatgaatatgggattaacaatgcgttctatcgcaccgagtgtgactttctcaactggtcattttaaagattcggttaatcacgatatggatattaggaacttgattaatggaggcactttagctatttatatgggtgtgaaaagattaggtcaaattattaaacaaattgaatcgtatacgaatgaagactaccccattgcaatagtgtttaatgcttcctgctacaatgaaaagattgttataggtcatttaagtacgattgaagaacaattggtttctcaacaactagaaggtcatccaggcatatgcattttaggtaatatacttgatgacattaatcgtacgttattgaataataataagaatgacaaggggaatctatatttaattaagggagataaagaacgtgcaattgcaaaggctgaaactttatatgatgaaggaatccaatgtctgattgattttgaccatagctaccacatttctcaacaaaacgtgtataacgaaatgattaaacataagagtattaaaacaatatatgtataa

SEQ ID NO: 900 - DNA, 132 bp, Staphylococcus epidermidis
aaattaaaagcgcccgtacatacactcatgtacaggcgcttaatttatgtgctgaagtatactttgttttattttgaattaattaatggtcacgtcattgattatcttttcataaaacaaattaatctttga

SEQ ID NO: 901 - DNA, 597 bp, Staphylococcus epidermidis
agaaatggagcgtatgttatgaactatcaaatcaaaagaaacactgaagaaactcagcttaatatttcactggctaataacggaacacaatctcatattaatactggtgtaggatttttagatcatatgttaacgctatttacttttcatagtggattaactttatctattgaggccactggagatacgtatgttgatgatcatcatataactgaagatataggtatagttattggacaattacttcttgaattaataaagactcaacaaagttttacaagatatggttgctcatatgtacccatggatgaggcgcttgctcgaacagtagtggacattagtggtcgtccatatttctcatttaatagcaagttgagcgctcaaaaggtaggaacttttgacactgaactagttgaagaattttttagagcattgataattaatgcgcgattaaccgttcacattgacttattaagaggtggaaatacacatcatgagattgaggcaatatttaaatcttttgcaagagcattaaagatttctcttgcacaaaatgaagatggacgtattccatcgtctaaaggagtaattgaatga

SEQ ID NO: 902 - DNA, 441 bp, Staphylococcus epidermidis
ttttatttggctggagctatttcagacaagattttgaatacaggtcaatcacgttttgttgcacgtggcgtaattgcgattgcgggatttgtggtattctcaatttcaattttcttagcagtacatacagacaacttatatgtaaccattttctggttatcactttgtttaggtggcgtacgtatttctatgggaatgagttgggctgcagccactgacttaggtcgtaatttctctggaactgtgtcaggttggatgaacttatggggaaatgttggcgcacttattagtcctttacttgcaggaattgttgtagatcatttaggatggtcaatgacattacaactcttaatcgttccggctattatagcagcaattctatggttcttcgttaaaccagacaaacctcttattgttagtgaagaacacgttaataaataa

SEQ ID NO: 903 - DNA, 138 bp, Staphylococcus epidermidis
aaaggcttggcagcacttattgcacaatcaaacgagtttacgtttaaaattgcatttaatttatcaaaaaaacgttactctgtgtactattccattcaaattaataaaataacaaaaggaccaaatacacttgattaa

SEQ ID NO: 904 - DNA, 147 bp, Staphylococcus epidermidis
attttaatggcagttctttgggcaattattgctaaagacttagcagaacaacataaaatggtaaacgatgccgagaaaagattattaatcaaaatcgtgatattgtcgcaactgagaaatctttaccaccgtggaaacgttttttaa

SEQ ID NO: 905 - DNA, 288 bp, Staphylococcus epidermidis
acgtcgatggctgcagaaattaaacaaggcgatcataaattctatgtaggtaatgacgaaaataacccaaaagctgttattacatttaaagaggttgataacaatgaaatagacattgatcatactggagtttctgatgaactcggtggacaaggtctaggtaaaaaattagttaatcgtgttgttgaacatgcacgagaaaacaatctaaaaattatcgcttcttgtccattcgcaaaaaacgtattagaaaaagatgatcatgcacaagatgtttatctaggatag

SEQ ID NO: 906 - DNA, 864 bp, Staphylococcus epidermidis
atgaaggaggccaaaatgaagaagcaacagaataaagtccatatgattaatatatctttatgccttatagggacattacttattgcaatcgcagtaaatagttttgttataccgggcaatttaggtgagggtggttctataggcctttcattaattctgaattatactctaggtatttcacccgcactcagttccttcatcattaacgcaatattaattattgtaggttggaaatttctcagtagaacgacagcgatttacactgctataacaatcaccgcaagttcaatttttcttgatttaactcacacattcggattaggtattcatgataattttattaattcaatttttgcaggtttaatgttgggaatcggttctgggttagtaattactgctcatagtacattgggtggtacatctgtcattgcacgtatcatttcaaaatatagtgagatgaagacgtcacaagcactacttatattagatgcaatcatcgtgttatcatttatcgttgttttacctataacgaatgtattatatactattgtgatgctatttattgttgaaaaatcaatgtcttttgttgttgaaggatttaatcctaaaaaagctgtgacagttatttcaaaatataataaagaaatcagtgctgatatatatgaaatgactggaagaggggcaaccttattaagtggtaaaggtgcttaccaaaaaagtgatacagaagttctatatgccgtggtatcccaaaatcaagttggagcaataaaaaagattgttaatcaatatgatgaaaatgcctttttagtgattcatgatgtgcgtgatgtcttaggtaatggatttattaatattaaataa

SEQ ID NO: 907 - DNA, 546 bp, Staphylococcus epidermidis
tatacacatttaaggagttggagaaatatgtatcaatcaatgtatgactcgcccgttggcttattgcaattaattacaaacgatggcatctcgttgtcacatgtcttataccctaatcaacatttgaaaggaattaaaacaaatgatacgttagatgtttttaaagatactaaagcgtggttaagagagtattttaaagggaattatcctgagataaaagtaccgttagcaccaaaaggcactgattttcaacagaaggtatggaatgaacttcagacaattcgttatagagaacttaaaacatatggagagattgctaaaacagtaggacgagcaatgaataagccagcaatgtctgctcaggctgtaggaggtgctgttgggagtaatcctatttctatacttataccatgtcatcgagtggttggtaaagatggaaatttaacaggatacggaggtactttagacaacaaaataaaattattaaaattggaagaaatagatatgacacatttatacagacctaaaaaaacaacgaaaccttga

SEQ ID NO: 908 - DNA, 132 bp, Staphylococcus epidermidis
tattcgcatttatattttgtatggtacaatcattttaaatatgaaaatgttgtgagagattttatgaatctagaaaaaagttatattgaacaacaagtaacaaatcgtggaaaatctactgctgtatcttaa

SEQ ID NO: 909 - DNA, 165 bp, Staphylococcus epidermidis
gttataaatttgatcgatggctcgatttatcattttatcaatatgatttatctgattcataaaaaaagtgtagagttattattaaataagttaatcgaaaaagatactctttattttttatttcttcagtcttcttttttattttcaataacaaaacgaatgtaa

SEQ ID NO: 910 - DNA, 1365 bp, Staphylococcus epidermidis
caacttttttatagagataacttgaaagtagggattaaattgatttgttctaattgtggggcacatttagagaaggatgataaattttgtgttaattgtgggcagagtgtgttcgataatccaaagacaaaaactgaacataattttaatagtcaagatagacaatgtccaaagtgtcacaaagtagtaaatgtcgatgataagttttgtatcaattgtggtcattctcttcagcaaacattatcaaattcaaatgacaacatagcatcacatacatattcaaatacaaaacctgaaattgaaaatgaaactgcagatcatattcgattgacagaagaagccaagcatctatttaataacacaacgaaatcaataggtaggctagcaggaaatgatgaaagtttaaaactaaatttgcgtgacatgttttctgaggtgtttaaatctcacaccaaagatgaagcggatgatgtatttattgctggaacaaagcgtacgacgccacatattaatgaagtttcggaggagtggggaagaccttgggtgttctcgcgtgtatttttagctttaggtatcactttcctagcgttatggatattaacaaatatatttgataatgccaatgccataccaggtatgatatttattggcgcactattagttcctatttcaggattaatcttcttcttcgaatctaatgcatttaaaaatattagtatctttgatgtaatgaggatgttctttattggtggtgtattgtcactcattagtacaatgattttatatcaatttgttacatttagtactgaatcgcaatactatggaattatgactataacagatgcattcatagtaggatttgttgaagagcttggaaaagcaactgttgttattttatttattaattatttaaaaacaaataaaatactcaatggattacttatcggtgctgctgttggtgcagggttcgcggtgtttgaatcagccggttatatctttaggtttggatttaatttatttgatggagctaataatattactgaaatcactatacaaagaggttggacagctttaggcagtcacctcgtttgggcagctattgttggtgctgcggcagtaatagtgaaagaaacaaagcatttcgaatgggcgaatatcatcgataaacgttttatatttttcttttttgtagcagtgacattacacggaatatgggatacggaaataacacttttaagtagtggttatttaaaatatatcttattaattatgattgcatggctatttatatttatacttatgaaagcagggctaactcaggtgaatcagttgcgtgatgaatacaatcgtttagaggaaaggtga

SEQ ID NO: 911 - DNA, 213 bp, Staphylococcus epidermidis
tcaattatttatataaaggatgaattcgtcatgtttattttagtcaatacaatattgttcatagcgatttttggttatacagcaatgacattagtaaaattctttaaacgttcaaaagaaggtgattgtggtgggtgtaaatctaattgcaaatgcgatacgaatacttcatctcataaaaataaattaaatattccacatattaagtcatag

SEQ ID NO: 912 - DNA, 477 bp, Staphylococcus epidermidis
atgagtatttatgatattgaggtagagaattatgatggctctacctatttactaaaaagatataaagggaaagtgctcattatcgtaaatactgcaacgaattgtactttgaatgatcaatttaataaattagaaatgctttataaaaaatatcataagtatggtcttgagattttgagcttcccttgcaatgattttaataatcaggagccaggattaatcaaagatatttatcgagtatataaatataagtttggtattactttccccatccatgctaagattaatgttaatggagagcatgaacaccctttgtacacattattaaaatgtaaacaaccaggattatttggttcgcaaattaaatggaatttcactaaatttgtagtagatcaacagggaaatattgttaaacgatttttaccttgtgataatcctaaccaaatggaaaaattaataaggcaattattaaaataa

SEQ ID NO: 913 - DNA, 1212 bp, Staphylococcus epidermidis
attaaagtttataataatcttgaggagaggattaagatgaatcaaactttagttcaacatctacgtgaaaaagagcaaagaatgaaagaaataagacgttacttacatgaaaatcctgaattatcattcgaagaaaatgaaacatctaaatatattgcaaacttttataaagataaggattgtttagttgagacgaatgtgggtcctaatggaattaaagttaccatcgcaggtaaacatccaggaaaaactatcgctattcgtgctgactttgatgcgctaccgataaaagaagaaacagaattaccttatgcttctaaaaatgagggagtcatgcatgcttgtggtcatgatgcacatactgcgtacatgctaatacttggagaaacattaattgaaatgaaagatcaattgagaggtaatgtcgtgattatacatcaacctgcagaagaaatgccaccgggcggtgcgaaaggtatgatagatgacggcgtattagaaggggtggaccatgttttaggtgcacatgtgatgagtatgatggaaacaggtaaaatatactatcgtgaaggttttgttcaaacgggacgcgcttattttagacttgttgtgaaaggtcagggtggtcacggctcatccccacatacatcgaatgacgctattgtagcaggtgcgcattttgtaacgaccgcacagaccattgtttcaagacgcttaaatccgtttgaaacgggtgtagtcacaataggttccttcgacgggaaaggacaattcaatgtgattaaagatacaataacaatcgaaggtgatgtacgtgcactgactgatgatacaagagacaatattcagaatgaaatgacacgactagtcagaggattagaagagatgttcggagtgatttgtgattttgaatttaaaaaggattatccagctctttacaatgatcctgaatttacttcttatgtagcaacaactttaaaaaatgctaagctggatgacataaaagcaatagatatttgtgagccgcagccaccctcagaagatttcgcgttttatgcgttagaaagaccttcaacatttatttattcgggtgcagcaccagaagatggacctatgtaccctcaccatcatcctaagtttaatatcaatgaaacatctatgcttgtagttgcagaggcagtgggtacaattgtattagattatttgaaataa

SEQ ID NO: 914 - DNA, 147 bp, Staphylococcus epidermidis
ttaatatattacatcgatgttcacaatttgtcaacaattacatgcaatttaattatttatcatactaatattaaatctaaagaaatgatggtaatctatatatactataaaataaaaaatatcgatttatataaaaacaaaggatga

SEQ ID NO: 915 - DNA, 183 bp, Staphylococcus epidermidis
tggctgaatttaaaatgtgccgaagtaaatctttatattataaattctttaaaaaggtatacgacggtagatattttaatcaattactatttttttgatgttttgacgttatatttattgataaatatttggaattcactgtatttaattgttagtttatacatagaggtgggtatggcctag

SEQ ID NO: 916 - DNA, 147 bp, Staphylococcus epidermidis
aatatacattatactatatttttagtttacgtttattttcgaaaagataaaaagttcttaacttattttaaaacaacttataaaatacttcttaaatcacattataaaatttctggcttcaaaatgcatcaatatttttataattaa

SEQ ID NO: 917 - DNA, 1296 bp, Staphylococcus epidermidis
agttgtaattacattgataaagttaaagttttacaatttatgaaaggcggtatcatgatgagcgtattatctaatgaagaaagagttgaaattttatccgatatagtctcaataaaaactgtaaatagtaatgaattagaggttgcacagtattttgaaagactatttagtcagtatggaattcgttcatatatagatattgttgcagacgggcgagcgaatttaatagcaacggttggttccagtcatccagttattgggatatctggacatatggatgttgtatctgaaggaaatcatgatgattggacgtatgatccttttacactaacagaggaccaaggctatttatacggtaggggagctgcggatatgaagtctggattagcagctttagccattgctcttattgaaattaaagaaagtggtaagttaacacagggaactattaaattcatggcaacagtgggtgaagaaatggaacaatcaggttcgcaacagttgtttgaaaaaggatatgctgatgatttagatgccttactcatagcagaaccatcatttcctagtttggtgtatgcacataaaggttcaatggactttagaataaaatctaaaggacgtgcttcacatagttcaataccatttttaggacaaaatgctattaaaccattattagagtttattcaaaatataaatcaagaatatgaaaaaataatgcaaacagtaaaaggtgagtccttagatttttcaaatatgattaataaattagagaatcaattacctaaccatataacaaaagaaaaagcacaagagcttatacaggggcttgttatgacaaatagtatcgttcaaggtggtacacaagtaaattcagtaccagattttgctacagctgaatttaatgtacgcacaataccagaatataataataacaaagtaaaagcgttatttaataaatatgtagagcaagcaaatcacaatggtgctagtttgactcaagaactttatcttgatttagaacctgtagtaacaacaggtcaaaatcgcttggtagagctaggatttgatattgcaaaaagccatttttctaacgaaagagatttaatcattactcctactgtagcagttactgatgcttcaaacttattaaaaggaaaagatgaaaattttccatttttaatgtttggcccaggaaatggacctcatcaaattaatgaatgcgttgaaaaagtaaattatttagaatttgttgaatattatatagagtttatcacttcatatttaaatgaaaagtaa

SEQ ID NO: 918 - DNA, 873 bp, Staphylococcus epidermidis
aaagtgaatttattaaaatttcacaacaaaatcaaaggatatactcaaaatagacaaccaggtattgaagcggatatggaacctaaacccattgcagaattagaagaatataaagcagcaggaaagttagagaataaagttgctctaataacaggaggagattcaggtattggacgtgcgatagcaatactatatgctaaagaaggggcaaatgttgctattggttattatgacgaacatcaagatgccgaagacacagttaatcgacttcaagaaatgggtgtaaaagctaaagcttatgctcatgacttaaaagatgaaaagcaatctcaaaagttaatcaaagatgtcataaatgacttcggtagtttaaatatattagtaaataatgggggcgtgcaatttccacgcgatcattttgaagatatcactccacaacaagtgaaagaaacttttatgacgaatatttttggtatgatgtttttatcccaggcagcagtaccttacctatctgaaggagatacaattataaacactacaagtgtcacagcatataaaggatcggggcatctcattgattattcagctacaaaaggtgccatagtatcgtttacccgttctcttgctactactttaatggaaaagggaattcgcgttaacgccgttgcgcccggcccaatctattcacctttaattcctgcgacatttgatgaagaaaaagtagaacatcaaggtgacgaaacgccgatgggtcgtcgtggacaaccagcagaacttgcaccatcttatgtcttcttagcaacacatgcagatagttcctatattactggtcaagttattcatgtcaatggtggcgattttatcacatcttaa

SEQ ID NO: 919 - DNA, 123 bp, Staphylococcus epidermidis
tcatttcgttatacacgttttgttgagaaatgtggtagctatggtcaaaatcaatcagacattggattccttcatcatataaagtttcagcctttgcaattgcacgttctttatctcccttaa

SEQ ID NO: 920 - DNA, 156 bp, Staphylococcus epidermidis
gacatacgttattttacttcagtattaaatgaaatatttttagtttataattcaataatcctcactatgagcaacctcaaatcaacaatcacatgttcttttttatatttatgtgaaatttcacaacatttttctggaagatatatttactgttga

SEQ ID NO: 921 - DNA, 198 bp, Staphylococcus epidermidis
cagcaattctatggttcttcgttaaaccagacaaacctcttattgttagtgaagaacacgttaataaataatatttttcaaacacatgcaatgacattcatatcattgcgtgtgtttattcttttattatgtggtatagaacatggaagcgataagcgaattgttttttttatcagttataaactgctaaacttataa

SEQ ID NO: 922 - DNA, 123 bp, Staphylococcus epidermidis
gacatctactataaatggcttaatcttttgctagtagtagactatcacttcgatattgattcagttttaaaaactttaaatcaatgttatgttaacgtaaatttatgtaaattcataccataa

SEQ ID NO: 923 - DNA, 156 bp, Staphylococcus epidermidis
caaaagtgctatggcaataaagatattgcagaaaagttgtttgtatcggtgaaaacggtagaggcacataaaacgcatattatgacgaaactaaatttaaagagtaaacctgaattagttgaatatgccttaaagaaaaaattattagaattttaa

SEQ ID NO: 924 - DNA, 2088 bp, Staphylococcus epidermidis
agaaacctttttaatcatgcatatctagttaaaaaattaaatagcaagattaagattgttggtgaaatacatggtccattggaatatattaatgagaatatagatttagcattagactgtattgattgtgttcgagtgagtacagctagaattaaaaatgaatttatagctaaatatgactatcatcgggtttttaatcaatacgtaaatgcacaacatatcgatttaaaatcagagccgataaatactaaacgaaattttttaattaaagcacgttttgaggatgaagttaaagatatttcatatattattaaattgtttaattacatcattaaaaaccaaattgttgatgatgctcaactttatttaataggatatggtccttcagaaatgctttacaaaaatttgataaattactatcatcttaatgagtatatccatattaatgaaaaagaaccacagagttatatttatgtatctagttcgccatatgaaacgctcggctattctatattagaaacgattgcacagggtaataaagctctagtttactatggtgatgataacgtgttaaaggatatctatgcaccatatgaagcgatacgttttttaaccaaagatatgattaaagatagtaaaataattaaagactttctaaattataaatatagtcactttgatcgacaaaaatattatcgacagttggaaagtacgtttaaatgcattaattatggacaggaatttttaaataatgttgaaactttctcttcatctcaacatgtaaaagtgaagaaaattcatcgacatctcggtagtgaaaaacaaatagatatagcaagtcgtttaaaagagagtcgttggatgaatttaattagaaaaaataaatatttatttaataaatgtaaaacgtactatgaaaaaagaacgcatatgagctatatcaaaaatttaaatcaaatacctgtagacgacgattcaatatttatagagtctttccatggcaagaattttagtggagatcctaaatatattgctcttgctattaagagacagtatgatcataaaaaaatatatgtgagttcaaccaattcacttgttgatatggaaatcaaacgttacggttttacacctgttcgatttggaagcgagaaatatattaaaacgtttagaaagtgtaagtatgtttttatcaatggtaactcgtgggataaagtgtacaagtcttcagatcagatatttgttcaaacatggcacggttttccattaaagaaaatggttaatgatttaaatgaacaacatgaaagacaacaacaactagaggcattcataccacgcatgaaaaaatgggattacattttgacatcatcagatattaatacgacgttgttggaatctgcttttatgctaaataaaaatccaaatcttaaagttctagaatacggcgcacctaagaatgaatatttaataaataataataatttacaagagcgccagcagttacagcttaaatatatgtataagatagatgatgataaaaaatatatattatattgtcccacttggaggggaaatcaaagaaaagaagtcactcagattaatttaaaagatttacttaaatatttaccagagaattatgagattattgtgaaacttcatcctaatgaaagtcatttaagaaccagatataatcaaatagataatcgaattcactgttatttcaatgaacttgttgatattcaagaactgtatattctgagtgaatgtatgattacagattactcgtcgaccatttttgactatatacatttaaacaagccagtctttattcttcaagaagacgagcaacaatataaacaaagtgttggtttttattttgatttgtttgaagtgggtgattttcttaaagcctctttaaatgaacacatgttagctaaacaaatttgtagcactgattatataaattattcaaaagtggttcatcgtttgatgaaacaagatagttcgaaaagcagtgaaaagttaatggccgaaattcttggggaaccagaatatccaagttcatcaaactgcaaacaacagatttcttaa

SEQ ID NO: 925 - DNA, 141 bp, Staphylococcus epidermidis
gtcaagttatattctttatacataaggcacctcgttaatttagtttattggtatttattaaattatacgaaagggcttatttttttaagtattttggcgagactcttgagggaacaggacaagctgaagactacaggctga

SEQ ID NO: 926 - DNA, 1881 bp, Staphylococcus epidermidis
tatacactatatatagcgaagggtgacgaaatgactactctagaaacatcattaactcgattaatcacaaaagatccaactatattaaatgaaaatgcaaataaagatagtaatacattctcaacaatgcgagatttaacagctggaacggtatcaaagtcttatgcactcgatcatttacttccaaagcatgttgctcatgcacatcaatcgggagatattcattttcacgacttagattaccatccatttcaaccattaaccaattgttgtctcatagatgcaaaagatatgttagagaatggctttgagataggcaatgctaatgttacaacacttcaatcaatacaaaccgcttcagcacaacttgtacaaatcattgcaaacgtttcaagcagtcaatatggaggttgtactgtcgatcgtgttgacgaattactaagtaaatatgcacaaatgaacgcacaacatcacagggaagtagcgaatgatttcgttcaacctgacaaaattgagaattatgtggatacacaagtaactaaggatattggtgatgcaattgaaagtttagagtatgagattaacacactctatacttccaatggacaaacgccattcgttactttgggatttggtttaggaacagatcaattaagtcgaaaaattcaacaagcaattttacatacccgtattaaaggtctcggtaaagatagggtcactgcaattttccctaaacttgtattttcaataaaaaaggggattaactttggtccagaagatcctaactatgatattaaacaacttgcattggaatgttcaacaaagcgcatgtatcccgatattttaaattacgataaacttgtggaactgcttggtgattttaaagcaccgatgggatgtcgttcatttttaccaagttggaagaatgatgaaggtcaattggaaaataatggacgatgtaacttaggtgtagtgacgttgaacgtaccgagaattgcaatcgaagcagatggcaacatgcagcagttttgggatatctttgaaaaacgcatgcaattattacatgatgcacttgtgtatcggattgaaagactacaagatgctattccagataacgcgcctattttatataaaagtggtgcatttaaaaataaactcacttcagaagatactgtcgattcattatttacaaaacaacgcgcaacgatttcaatggggtatatcggtttatacgaagcggcaacattattttatggaccgaattgggaacacaatcctgaagctaaaacattcacactagacatattaagagaaatgaaacgttatcaagtagagtggacgaaacaatatgatatttggttcagtatatacagtacacctagtgaatcactaacagatagattttgccgattggacaaagaaaaatttggatctattccagatgttactgataaaggatattaccaaaattcattccactatgatgtgcgtaaagatgtaacgccgtttgaaaaattagattttgaaaaagactatccttactatgcaagtggtggattcattcattattgtgaatatccaaagttaaatcataatctgaaagctttagaagcagtatgggattatgcttatgataaggtaggttatttaggtacgaatattcctattgatcactgttatcgttgtggctatgatggagattttgaaactactgctaacggatatagatgcccacattgtggtaacactgatcctaaaacggttgacgttgtaaaaagaacatgtggttatttaggaaatccagttcaaagacctgttattgaaggtcgacaaaaagagatatgtgcaagagtgaaacacatgaaggcacttcgttcatga

SEQ ID NO: 927 - DNA, 1683 bp, Staphylococcus epidermidis
tataatgtatattttaattttaataaagaggaatttgtaaatatgaaaaataattggatagatgtattagatgaaagtttagtcaaagatttttataataatcaaacttccgaagagcaacaagaaggacttaatactacactgtcttttggcacggctggtattagagggaaattcggtttaggtgaaggacgattaaataagttcacagtatctaaagtagcgttaggctttgcccattatttaacatcaagtatcgcgcatcctgttgtcgtcatacattatgacacaagacacttatcacctgaatttgctcaaattatcgctaatattctagcaagtcttgatattaaagtttatcttgctgatacatacagaacaacacctgatttgtcatttgcagtcagatacttacaggctgatgcgggtgttatgattacagctagtcataatcctaaagattacaatggaattaaagtttatggagaagatggtgctcaattatcaaccgacgattccgcacgactaagcacatatatcgataagttaggtcatccgcttcatattaatttacctagtttaactactgaacaacaatcattaattcattcagtcccgagcgaagtcagagaagattatttcaaaaacgtacaagacttagttggaacgattccacagtctgatttaaaagttgtctttacaagcttgcatggtacgagtgtgccagttgtacctgacatcttatcttctcttaactttaatcaatttgagttagtcgcatcacaatgtgaacctgattcagatttcagctctgtagccagtgcaaatccagaggatcataaagcctttgatcaatcgatagaactcgctaatcacattgatgctgatttacttattggcacagatcccgatgcagaccgtttaggaatagttgaacgtgatgctgaaggtaacatccactattacaacggaaatcagattggtgcacttttgttaaattatcgtatcaaacaaacagaaggattatctaacagaattatgttccaatcaattgtaagtggtggcttagctaaatctcttgctcaatatcataatgtcaatttcaaagaagttttgacaggttttaaatatatcgcagctgaaataagacatctgtctcctgaacaaaactttatttttggctacgaggaaagttatggcttcttagcccgtcctttcgtgagagataaagatgcgattcaaattgtgccattaatgattaagtatgcagctgaattaaaaaacaaaggacgcatgcttaaagatgaattagaagacattactcgaaatgtcggtaactttaatgacaagcttttctcacatacatttgaaggtactcaaggcaaggcaaaaatcgaaaatattatgactcaattcagaagtgaaacaccttcggaaatgtgtggtcttaaagtcattgcaatcgaagattttgaaacaggtaaaaagactgacttacaaaatgatgaagtcagcgatataactttacctaaagcgaatgtaataaagatatactttaatgaaggatttattgctttgcgtccttctggtacagagcctaaaattaaactttatgtatcactttcttgtgaccattttgacgtagttgcacaaaaaatgaacgatgctatatttaactcttaa

SEQ ID NO: 928 - DNA, 126 bp, Staphylococcus epidermidis
acaaccccatatttgaaatgcatttactttataaattctaatcaccataaacatataacaaagcctagaacacaaattcatgtcctaggctttgttaaccatatagataatttatacttgaattga

SEQ ID NO: 929 - DNA, 1152 bp, Staphylococcus epidermidis
atgtcaccatataaagttatcattgcacctgattcttttaaagaaagtatgtcggcaaaggaagctgctttagctattaaagatggattccaagaggtgttcgattccagtactatatatgacattattcctatggctgatggtggcgagggaacaaccgaagtattgaaagaagccttaaatgctacctcttattgcgtagaagtaaaagatccacttaatagaaatatcatggctagttatgcgagaagcgacgaacaccaaacagctatcattgaaatggcagctgcttcaggactagcattattgagtaaagatgaaagagatccatctattacaacttcgtacggtaccggccaactcattaatgatgcacttaatcacgatgttaataaaattattttaggaataggtggaagtgccacgaatgatggtggtgtaggaatgttaaaggctttaggtgtctcttttaaagataaaaacaatcaagagattcgcgatggaggtttagccctatctcaaatagaatacattgatattactcgtataaacccacgattgaaagatgtgaatattaaagtagcctgtgatgtaactaatccattattaggagacaatggagcaacaatagtttatggtccacaaaaaggcgctcaacaaaagatgataccaaagttggattccgcattacgtcactatcatgataaaattgaaagagaattaaatatgaatgtaaaagatatcccgggcgctggtgctgcaggaggcatgggaacagcgttaattgcgtttctaaacgctgaattacgtcctggaattgatgtagttcttgaagagactcaatttaaacaaagaataaaagatgcgaatttagttgttactggcgaaggtaaaatggataaacaaacaatctatggcaaaacacccattggcgtagctaaagttgcaaaatcatatgatatacccgtcattgctatttgtggtagtttaggaaaagattacgaagtaatttatcaccacggtatcgatagcgtgtttagtatcatggaacgtccatgccaccttgacgaagctttgaaagaaggcgcacttcatgttaaacatacaacaacaaatttcgcacgacttttacaattaaaaattgaaaactga

SEQ ID NO: 930 - DNA, 801 bp, Staphylococcus epidermidis
tattggacatatcattttaaagagaaaggaaagatggtaatcatggatgacttgaaacaaaatcaatcttctaacgaaaaacctaaaggtaataaaataattaatattttgatattcatcggaatgattttattaattcaaatacctattggcgtgtcactaatagctttacctttttcagtgaaattcagtaagttaacatccatcgcattaagtatgctaataactggtacagcactattaatcatatggttagttaggaattattatttgagtcatacatatgaaagacaatatcaatcaatgaggggaaaagatatctttattaatattggttttctggtattatcaatggtttttagtattctaagtagtgtattaatggtcatatttactggcaacgatactacagcgaatgagaaagaaatcaatgaaagtttagatttacttttacaaaaagaccatttaccacatatttcaattgttgcaactgttgttttaatgatatgtattataggtccgtatttagaggaattactcttccgaggaatttttaaagaaacattatttatgaaatatcgattttggctaccattcattatatcttctattatttttagttcacaacatttatcaacaaatatattttcatatgcaatttattttctaatgggttgtgtattataccttgcctataacagaagacgtaatatcaaagatagtatgatggttcacatgttgaataattctgtttcaacattaccggtatttgttggttatttatggatatattttagatag

SEQ ID NO: 931 - DNA, 129 bp, Staphylococcus epidermidis
cattttcaatatttaaacaatataactgaaaactttatgacatttcatcaaagtgtaatgatttactcaaattttttcacgtttctttggttaggtatacgatcgaggtttatatcacttttgatttag

SEQ ID NO: 932 - DNA, 1011 bp, Staphylococcus epidermidis
tttcaaaaatatacatattacaccaatattgatatgaaggggacagtaagtagaatgaaaaatcttaagtttttagtggtgcttgttttatcggtggttatttttgcagcagcctgtgggaattcaagttctttggataataataaaagttcggatagtggatcagattcaaaatcgggtagttatacacctaaagaattaacagtacaatttgtaccttctcaaaacgctgatacactcgaagctaaggcaaaaccgttagaaaaattgttgtcagataaattagggattccggttaaagtatcagtttcaacaaactacaacacgatagttgaagcgatgaaatctaagaaagtggatgttggtttcttgccaccaactgcatatacattagcacacgatcaaaaggcagcggatttattattaaaggcagaacgttacgacgttaatgaagatgggtctccaagtaaaaagttagttgatgattataaatcagaaatccttgttaaaaaggactctggtattaataatctcaaagatttaaaaggtaaaaaaattgcattacaagatgtaacttctacagcaggatatacattccctctagtaacattaaaaaaagaagctggtattgatgcaacaaaagatatgaaaatagtcaatgttaaaggacacgatcaagcagttatttcattgttaaatggagatgtggatgcagcagctgtatttaatgatgcacgtacagttgtaaaaaaagatcaaccaaatgtatttaaagatactaaaatattaaaactcactaaacctattcctaatgatacgatttcagtacgtcctgatatggataaaaaattccaagataaattgaaaaaagcttttaaagaaatttctaaaactaaaaaaggtcataaaatcattagcgaggtatattctcatgaaggttatgttgatactaaagattcagactttgatatcgttagacaatatgaaaaagctgttcatgatatgaaataa

SEQ ID NO: 933 - DNA, 1335 bp, Staphylococcus epidermidis
aatatgaaatattgcagtaattgtggtcaacctcttcgagaaggtgtaaaggtgtgtacaaattgtggtacgcctgtgagaaatgatggacctaattataaacattcagaacaacgttattctcatcaacaaccacgttccaataagagtaataaaaaaacttggttgattgttactatagtgttagccattatcattgctttggtagtaatctttactatagctaaaaatcaaatgtctccagaaaaacaagcgactcacattgcacatgctatcaaaaaagacgatgctaaatcattatctaagcaattaacatcaaacgatcatcgtttaaatgaagaagaagcacgtgcgtacttaaagtatattaaagcagaaagtgatttaaagcatgttgctgacaaagttgaagaaaacaccaaagatattaaaaataatcactataacaatttatctgtagatgcaaatgataataatattttaaatatatctaaagacgggaaaaaatatgttttttttgataactatcaatttaatgttcctcaaaaaacaattacgatcgtttcaagtgatagtggtgaaattacttatgaatttaacggggataaacatcatatttctgtagaagaagatgacgataaagaattaggaacatttcctatcggtgattataatttaaaagcatcaaaagacatggaaggtaaaaattttaaaggcgctattacaattgatatgagtgaaagtgatagtattgcatatgaatcgtttaaacaaaaacgttttaatgttgatactgaaggcggatatatattagataatgtaaaaatatatgctaatggtaaagaaataggcgatggtttttcatcagaaacatatggtccttatgatccagatgaagaagttatcgttcacgctgaaggttcatacgaaggaaaaacttttaaatcaaattcggtcaatgtagcaagtgcaagcgaaaaagatggtggtgtgacagatgtcacagtcaaattcgatgaagaagctattgatcagtatgtcgataaaaaattagatgaaaaatacgatgattcagatgacgagtcagataacgattcaagtagtggcgaagtaacgcgtgaaaatgtaattgataaagtagagtcatatgaaggacatacactagatactgatacgtatacgtataaagaacctgaaaaaaccggtgatggtaaatggggtttttcattcttagataaagatggagatttagctggatcgtacacggtagacattgacgacggttatgttacagaatatgacgaagatggtgaagaagttggatctggttattaa

SEQ ID NO: 934 - DNA, 1545 bp, Staphylococcus epidermidis
aatatgaaatatatgattggtgtagatatggggacaacgagtacgaaggctgtgctatatgatgaaaatggcaagtttataatgaaacataatattggctatgacttacatacaccaaacgtagatgtgtctgaagaaaatccggatgaaatatttgatgctgtgcttatgacggttaaatatattgtaagagaatctggcatcgcaaaagaagatattaagtttatttccttgagtgcacaaatgcatagtttgattgctatgaacgaggataatcaacgtttaactgaaaatatcacttgggctgacaatcgtgcgaatgattatgctgatttaatagaaaaatcatatggcggttttgaattgtatcaacgaactggtacaccgattcatcctatgtcaccattatctaaaatcttttggatgagacatgaggaaccgaaaatatttaaacaaacagctatgtttgcagatttaaaaacatacgtactgtttcaattatatgaaaggttcgtcattgattattctttaggatcagctacaggtatgatgaacttagaacaattagattgggataataaggctttagaattgttaggtattgaaagaaatcagttaccacaacttgttccaactacacatgttttaactggaatgaaaaaacgctacgcaacgttgatggggattgatgagcaaacgcctgtgattgtcggagcgagcgatggcgtattatctaacttaggtgtaaatagctatcaaaaaggtgaagttgctgtaactattggcacatcgggtgcaattcgcacggtaattaatcagccaaaaacagacgagaaagggcgtattttctgttatattctcgacaaagatcaatatgtgattggcggtccagtcaataatggtggtgtcgtcttgagatggttgcgagatgaaattttagcgagtgaagttgaaacggctaaaaggttgggggtcgatccttatgatgtgttaactcagattgcaagcagagtaaaaccaggtgcagaaggattgatttttcatccctatttagctggagagcgcgcaccattgtggaatgctgacgcaagggggtcattcttcggattgacattatctcacaagaaagagcatatgattcgtgcggccttggaaggtgtactgtataacttatatacggtttatcttgctttaattgaagtgatgaatgaaacaccaacaacgattaaagcaacgggtggttttgctaaaagtgaaatttggcgacaaatgatggcagatatttttgatacagacttaatcgtacctgaaagctacgaaagttcatgtctaggtgcatgtgtacttggaatgaaagctctgggagaaatagatgatttttcagtcattaaagatatggttggtactacacatgcccatgaacctaaccaagaaacagttgccatctaccaacaacttgttaccatttttattaacattagtcgttctatgactgagaactacagtgatattgcgaatttccaacgagaacatttaagtgattaa

SEQ ID NO: 935 - DNA, 141 bp, Staphylococcus epidermidis
ggttttgaatatatagttatctatacatatttttatttattaattttaaaaaatgaattttcattaattatctatcaattaaagaaaagatatgaaatatactttgtattgaatttttcgctgccttatcaaaggatatga

SEQ ID NO: 936 - DNA, 639 bp, Staphylococcus epidermidis
agaagagaatatgtattaatcgttttaggaaaaggagaaacgatgaaaaaattaatcggattattgatgattttatgtatggttttgctatacagttgctcaggtccaatggactctccaaagcattctaataatagcaaacctgtagtggtaatatacggtgattataagtgtccttattgtaaaaaaacagaagatcgcgtgatgccaaagcttaagaagaagtatattgatacaaacaaaattaaatatcaatatgtgaatttggcattcttaggaaaagattcaattgtaggttcaagagcgcagcatgcggtaaatcattatgctcccaagaagtcacttgaatttcagaaattaatgtttaatcaacaaaaagatgaacataagcaatggattacaacacgtcttgttgataagcaaattgataaattaagtatcagtgatgacaaaaagaaaaaaataaagactgattataaaactaaaggttccatctcgtggaaaaaagccaaggaagatcaacaaattgcgaagaaaaatcacatcaagcaaacacctacagcgtttgttaatgataacaaggttgaagatccatatgacttttctagctacgagatgttgctagaaaacgaaaagtga

SEQ ID NO: 937 - DNA, 1557 bp, Staphylococcus epidermidis
ggacggagatatggtcattcatttcccataaacaaagaggtgttagacatgacgatttataatatcaattttggaatcggttgggccagtagtggtgttgaatatgcacaagtgtatcgagcaaaactattaaggcaattaccttatccaacaaaatttatatttttagattttattcaatcagaaaatattcaaacactcacaagcaacatagggtttaaagatgatgaagttatttggctatatcaatacttcacagacgtaaaaatcgctcctacaacgtacacagttgatgatttaatttcagagttaggtaatgaggttactcgaaaagaacaaaacggtaaagtattacgactctatttaaataatcagcaaacattcgtaacctgctatttaaaaaatgctaacgaacattacgttgatcgtgcagagtttgtggtgaatggaatgttaattaggaaagatttttatagctatgtaagaacattctcggagtattatgctccttttgacaataaagctaaaatatatatgcgtcaattttataatgaaaatggatcaattgcatatcgcgaatatatagatgaagatgaacatgtttttgtgtttgatgatgcacgtttatacagtaaacaagcactcgtcgcatactttatacgtcaattgcgattgaattcagaggatatcattattattgatcgagcaactgatgtgggacaagccatattagaaaacaagggatccagtaaagttggcgtagtcgttcacgctgaacatttcagtgaaggtgcgactgatgggactcacattttatggaataattattatgagtatcaattcgaaaatgcacagcatattgatttctttatcacagcgacagatttgcaaaggcagacactaagtgaacaatttaaacaatataagaatgattgtccacgtatacgtacaattccagtaggtagtatagaatcgttacaatatcctgaaaaagaaagaaaaccatattccatcatgaccgcatcacgtcttgctaacgaaaaacatgttgattggatagtggaagctgtgattaaagctaaacatcagttacctcaattgagttttgatatctacggacaaggagaagaacaagaaaaaattaaaaatattattaccaaacatcgtgctgaggattacatacaaattaaaggacatagaaatcttcgtacaatatatcagcaatatgaattattcatagcggcctcacaaagtgaagggttcggactgacattaatggaagcggttggctctggtttaggtatgattggatttgatgtgaattatggcagtccgacatttattcgacatcatcaaaatggctatttgataccgatagattttgaacaagcgtctactgatgatatcacaacgcaaatcgctcatatgattattcgatattttgaagatggtcccataagggcacatgaggtatcgtatgacattgcagaatcatttaaaacatcgcatattgttgatctatggagacaactcattgaagaggtgctatatgattaa

SEQ ID NO: 938 - DNA, 1539 bp, Staphylococcus epidermidis
aaactaactctcagtcaaagtttgtcttctatacttgatttatcatacatattgggaggcaatttatttatgaaatttatgaacaaaatgggtaagacgacgcttgcttcatcaatcgtagcagcatccgttttaagtacggtaaacgtatcatatgcttcaggtagctcagaacaaagtgctcaaactaagcaaacacaaaacgatgccattgctttcggcaacacaaaaaatccaaaaaatgtcatctttatggttggcgatggtatgggaccttcttttaacactgcatatcgctattataaaaataagcctggtgctaagaaaatgactccaactgcatttgataaatatctaaaaggaacaaatcgtacttattctaatgatcctaaagaaaatgttacagactctgctgctggaggaacagcttttagtaccggtcacaaaacatataacggtgcgattagtgttgatacaaataaaaaaccaattaaatctgtgctagaacaagctaaagaacaaggaaaatcaactggtttagtaactactgctgaacttactgatgcaacacctgctgtatatgctgctcatatagattcacgcgacaaaaaagatgaaattgcacagcaattttataatgataaaataaatggcaaacataaagtcgatgtgatgttaggtggcggtgcaaaatacttcggtaaagaaaataaaaatttagcgaaaaaattcaaaaaagatggttatgatatcgtttctaataaagatgaattaaatcaatcacaaagcaagcaagttttaggtactttctcagaaaaagatatgccattacaaatagatgcacctcaatctaatccgttgctagtagacatgcaaaacagtgcactaaataaattaagtaaaaataataaaggattctttttaatggttgagggtgcttcaattgataaagctgcacaccctaatgatatcactggtgtgatgtctgaaatgtctggtttcgaaacagcttttgataatgctattaattatgcaaagacacataaagatacacttgttgtagcaactgcagaccactcaactggtggtctatcaaccgcaaaaggtaaagattataaatggaatccagaggctattcacaagatgaaacattctggaatgtatatgacaaaacaaatcgctgatggaaaagatcctgaaaaagtaattaaagatggatacggcattgatttcccaaataaacaactcgataaagtcaaaaaagcagcagacgagcttcacaaattacaaaaagaaggtaaagatgacaaagacgaaaaagttgtagaacaaacaacaaaattacaaaatgcaattcaaaaaccaattaacgatgcttcacacacaggttggacaaccaatggccatacaggtgtagatgttaacacatatgcatatgggccaggttctaacaaattcaaagggaatatggaaaatacccaaagcgctaaaaacttatttgactttttcggagacaatgtaacatcaaatcaaaattag

SEQ ID NO: 939 - DNA, 684 bp, Staphylococcus epidermidis
aacgtgacgtatggttatccgaaaaagtggaaggaaaacatgacttcaggacaagtaatagctgctgagttacgtttaggaatagtgagtggtgaaattgaatcccatatacaactaagtgaaaatcaagttgcacaacaatttaatgtgagtcgttcaccagtcagagatgcatttaagttacttcaaacagatcaactgattcaattagaacgtatgggcgcacaggtacttccttttggtgatcaagagaaaaaggaaatgtatgatttgcgtttgatgctcgaatcattcgccttttcaaaattaagtggaacagatacacaacatattgttaaggaaatgaaaaagcaattagaaatgatgaaggttgcagtccaattcgaggatgctgaagcatttacacaacatgattttgagtttcatgaggtgatgattcaagcaacaaaccatcagtatcttaaagtgttttggaatcaccttaagcctgttatggaatcactcatactcatttcaatgagacaaagaatgacaaatgaccccaaagatttcgagagaattcatagtaatcatcaagtttttatagatgctgttgagaacgatgatgcctccatattgagaaaagcattccatttaaattttgatgatgtaggagaaaatattgaagcattctggttacgttaa

SEQ ID NO: 940 - DNA, 156 bp, Staphylococcus epidermidis
ttggataagtacatgacaactaaatccaactttagattatccttagcctctttagatatgattcaagtgattaattatttaataattagggtgaaaaaatgtttaagaaattcgaatataaaatcttatataaaagaatattttttacatgcttaa

SEQ ID NO: 941 - DNA, 222 bp, Staphylococcus epidermidis
tataaagatttacttcggcacattttaaattcagccattaacttccaatatacaaaacacctgagacaaatatcgatgtctcaggctcagttatttaagtataaacacctacttgaaaagcacacttcaatttatgtactagtcattttaatatttaaattgtggagtgagaactattggtgtaccttaatgaaatttacgtgcatatgtacaatacattaa

SEQ ID NO: 942 - DNA, 126 bp, Staphylococcus epidermidis
ttttttcatcttaataacactcctttcaaagatgcggttcttgaacaaacaaaatgttcaatagttagttactattatacacgttttatagttgtttttaaaaacttgaatttcaaattatcgtaa

SEQ ID NO: 943 - DNA, 1197 bp, Staphylococcus epidermidis
aaggggcatctagttgttatgactgtcgcacgcacaacaacatttatattaagtgttttcatcgtaggtatggttgagatgatggttgcaggtattatgaatttaatgagtcaagatcttcatgtttctgaagcggtggttgggcaactggtaacgttgtacgcgcttacctttgcgatatgtggtccgttattagtgaagttgactcatcggttttcttcgcgatcagtattattatggacgttaattgtctttatcttcgggaatggtatgattgccattgcgccacattttggaataatagttgtaggacgtattttatcttctgccgcagcttcactcattattgtgaaagttttagcactcacagcgatgctcacatcagcaaaaaacagaggtaaaatgattggtattgtttatacaggttttagtggagcgaatgtctttggtgttcccatcggtacagtgattggcgactgggtaggatggcgatttacatttttattcattattattgtaagtgtatttgttggtgttttaatgttaatatatctaccaaaagaagatgaattgtcacatccaaatcaaacacctcgttcatctagtattgaatcacaaactggctcaagcgtcataagacctcgtgaggtttttaaatatctgatgattacatttttagtgctggttgctaattctgtaacattcgtgtttattaatccattaattttatccaatggacatgaaatgtcttttgtgtctttagcactacttgttaatggtgtagcaggtgtgattggtacttcattaggcggtgttttatctgataagtttactagtaagcgttggttaataatttcgatttcaatatttataataatgatgataattcttaacttattattaccaggaacaggattattattagttggcttatttatgtggaatttaatgcagtggagtacaaatccagctattcaaagcggtattattgaacacgtcgaaggagatacaagccaagtgatgagttggaatatgtcgagtctcaatgccggtattggcgttggcggaatcgtaggtggactcgttatgacacatttatcagtggaatatgttacttatactagtgcattgataggtttaattagtcttatcattgtattcactttaaaaaatagacattatgctaaaaatttatga

SEQ ID NO: 944 - DNA, 129 bp, Staphylococcus epidermidis
ctcaaggatttttacatatgggtagtcgatagtggattgaaatacgattttatcaagtttgtttcaatatttatgttattggtaagaggggataatgtgttcaaaatgttttacgaaactgtagtttag

SEQ ID NO: 945 - DNA, 123 bp, Staphylococcus epidermidis
gtaaaaaatctcttaatggtttttatcggtgctctatcaatctttattttgaaattgaatgagagcgaagctgggacaaaaaggttcaagataagtaaaaaaagacaatttctattgaaataa

SEQ ID NO: 946 - DNA, 129 bp, Staphylococcus epidermidis
atgttgtttcacgggaaacgtcattttttaagtttcaacttctataaagatatatttaacacccgtataactagagaattatacgggtgtttgaattgcttatattatagaattttaaaaagatattaa

SEQ ID NO: 947 - DNA, 198 bp, Staphylococcus epidermidis
acgtttattcatatcgttaatattgatgaaaatattaacgatatgaataaacgttcttctatcaattgcaataattatttcctttccaaactaaaaagtcgttgtaaagtggctataagtcatctccctcattcacgcacattacaacgacatgttatatataaattaaaacatttcagaaacaactttttgttctaa

SEQ ID NO: 948 - DNA, 411 bp, Staphylococcus epidermidis
aatcatattcattatcaagaagccccaaatcttacaaaggttgaatatggtgaccattatgaacgcagatttatgaagcctaagaaattgaaggccaacatcgaatatacaacaccgcatggacacgtgtatcgaacggatcacaaaggccgtattaaagaagtatatgcggatgacctatcacttctagatggcggacgtaattcatatgcgcaacgaacagtaggaagagaataccgattaccagatgatgacggcggtcatttaattgcgcgcggattcggaggttctaaagatatagataatctcgtcccccaaagtaaatacatcaaccgctcatttaaagagaacggagaatggtataacatgaagaaagaatggcaaaaagcaattaaaaagggagagaagtaa

SEQ ID NO: 949 - DNA, 171 bp, Staphylococcus epidermidis
attaaaattcataatcattatatagctgttggatttggtattgaagcaatatcaaatatagtgaaaacatattcatatattgaaattgttttcaacataaaaaataattacctttgtcattcacactatcgcttaatatataagataaatctcttattttcatttatataa

SEQ ID NO: 950 - DNA, 237 bp, Staphylococcus epidermidis
ctttattctcattttataaaaatttatattaaatgtcattatagctacacgactacacttttattcatatatgaaaaccaccacatcttatatcggtcaaatgacggatttataggctatcttattgaaagcaattctcattttgatacaatattaaaatgtctaatttttaaacttcaatcactatcatttttttatataaattcaaatacttttaaattaactaaaattgactaa

SEQ ID NO: 951 - DNA, 123 bp, Staphylococcus epidermidis
caacatcctcagctatgtaaaattatttttggagatttacaaaactccgaaaaacctgaacatgatcatggccatgctgccgaacatcatttgatgacggaagagctcactgcacacctgtga

SEQ ID NO: 952 - DNA, 2028 bp, Staphylococcus epidermidis
tgcacgactcataacattagaggagtagttataatgactcaaagctactgtattcttggaaaccctaatgtaggcaaaacatcattatttaatgcgttaaccggttcttacgaatatataggtaactggagtggcgtaaccgttgaaaagaaagtaggaaaattgaaagataatgtaggtgatttagttgatttaccgggcatttatgatttatcacctatttctaaagatgagacggttgtcacagattatttaatgtcaacgtcattcacaggaatgattaacattattgacgcatgtcagcttaaaagaaatcttaatcttacaatacagttgatggaactcaacaaacctatgattattggtttaaatatgatagatgttgcaacacaaagaggtattaaaattaactatcaagctttgatgagaaaattaaaagtaccggtatttccaattgttgctagaaaggcaaaggggacacatagtcttttaggagagcttaattatttagaaccacatcaacgtcgtgcatttaagattaattatggaactgaaattgaaactgcaattcaacaaatttgttcaattatcaaacaggataatatgtatccaacagaacgtttacgttttatagccatacagtatttaatagacaatgttcaaatttatcaagaactcgatgccatgattttagaacagttagaacccattaagcgaaagttaagtaacgcgacagaacaatcaacacgccaaagaattgaagctgtgcgaaatgattacattaatcagctattggaagatatcgtagaatatcccgaagaggataaacaattctttacttcaaaagtggatcgattattattaaatagatatctaggtatacctatatttttaggtattatgtggcttatttttcaaacaacctttacatggataggaacaccattatctgatcaattagacgcttttataagtggtcctttatcagaatggattaaatctgttatgaatacattacatattacgtcgtttcttcaagatcttattacagatggtattatcgctggtgtgggttctgtattggtatttgtaccacaaattgttgtgttattcttttttatttctttattagaagattcaggttatatggcaagaatagctgtattaatggataaaacaatggaatctataggtttaagtggaaaatcatttattcctatgattattggatttggatgcaatgtaccaagtattatggcagcaagaagtatagagaatgagaaagaacgtttgattacaatattggttgcacccttcatgtcatgttcagcacgcttaccggtttatgcactttttgtaggagcgttcttttcagcacatcaatcactagttgtattaagcttatatattttaggtatagttgtcgctttactagtaagtacgttattgaataaattgatattaaaagataatcagtctgtttttattgtggagttaccgacataccgtgttccatcatttaaaacactttggcgcagtacttgggaaaaagcaaaaggttttgtcaaaaaagcaggtacctttatttttggtggttcagtcgttatttggacactcacatacatcggtccgcacggtgttaatgtcccgattaatcaaagttttatgcatatgattggtcaagggttcgcgaatttaattgcacctttaggatttggctcttggcaggcaggagcaactttaatacctggctttcttgctaaagaagtgattatcagttctatggctattttatactcttctagcgaaagtggtttaacacaagtcattcaacagcaattcactccactttcagcttatgcattcatgatttttattttactttacgttccttgtatttcaacagtcgctacgattcgtaaagagacaagttcttggaaatggacattactagcggttgtttatccaatagcaacagcatatatattaacgttcgtattctatcaagttagtcaattatttatataa

SEQ ID NO: 953 - DNA, 1083 bp, Staphylococcus epidermidis
cttgaacatcacgaaatacattcacttatgctattaaatttgatagcgacttataaaatgaaaggggcgcatcccatgaaaaacatcaagaaaccctttgatttaaaaggtaagtcattgctaaaagagtatgatcttacaggtgaagaatttgaaggtctaatcgattttgctatgacattaaaaaaatataaacaacaaggcacaccacatcgatatttagagggtaagaacattgctttactcttcgaaaagacatctactcggacgcgtgccgcatttacagtcgcatctattgatctaggtgcacaccctgaatttttagggaaaaatgatattcaattaggaaaaaaagaatctgttgaggatactgctaaagttttaggcagaatgtttgatggaattgaatttagaggtttttcacaaaaaactgttgaacaattggccgaattctctggagtaccagtatggaatgggttaactgatgattggcatcctacacaaatgttagctgattatatgacaattaaagaaaattttggatatttaaaaggcatcaacctaacttatgtaggaaacggacgtaataatgttgcacattcgcttatggtggcgggtgcgatgcttggcgtaaatgtacgtatttgtacaccctcatcattaacaccgagagatgtatattttaatattgctaaagatcaagcgtctaattatggaggttcagttaagatgactgataacattcatactgctgtcaaagatgcagatgttatttatactgatgtttgggtatcaatgggtgaagaaagtgaattcgaaacacgtattcatttattgaaagactatcaagttaatagaaaaatgcttaatttaaccggtaaagtagatacgatatttttacattgtttaccagcttttcatgatacacaaacagaatatgggcagaatatttttgagaaatatggcttaactgaaatggaagtgacagacgaaatctttagaagtgagcattctagagtgtttgatcaagctgaaaatcgaatgcatacgattaaagccgtgatggcagcaactttaggctag

SEQ ID NO: 954 - DNA, 135 bp, Staphylococcus epidermidis
aaaagtaatcagattacacaaataaaaaaagaagagtattatcaaataggcattgatagttttgtcaacgtaatgttggtcaatgaaaaaatggtaaatatgtatatatgtcattcaatcaccgactgtctatga

SEQ ID NO: 955 - DNA, 123 bp, Staphylococcus epidermidis
aggttaaatcaacctaggacaacaatagataattactttttcctatatcagattaagagatttagaataacatcttatcgctaccaaatgtatctcccaatgcttgttgggctaacacattaa

SEQ ID NO: 956 - DNA, 477 bp, Staphylococcus epidermidis
gaggttgatcattcaatgaaaaagagtaaacgacaagatttagtaactatgattgttaagcaaaatcacatttataaaaaagcagatattattgattacattgatgatcactttggtgtacgttatagcatgactactattgcgagagatttaagagaacttcatatttatcgcctgcctgtgaaggcaaatcaatatgaatacaaattacttacgcaacaatctcaattagactcaagagtaagactaaatgattatatagaaacagaaattattaacactatgattaaagaatcgtatatactaataaagacgacaccaggatttgcacaaagcataaattattatattgatcagttacaactgaaagagattataggaacgataagtggtaatgatacaattatgattcttacacattcccagtctatagctgaatatgtctattacaaaatatttaatcataattattcataa

SEQ ID NO: 957 - DNA, 297 bp, Staphylococcus epidermidis
gggatgagtcaatatccattctatagacgcatgtttatcatcataaaaaaatgtacactcatatataattcaataaaggagttgtatcctatgagaaaaatacttaagggtattatattatcattaataatcatcggcttaatcaaaacgttcaatgaatatgatattatacattgtgcaaatcattatttcgaacaaatcaaaagtggaaaaataattgaagatatcaaaatcgatcatttcaataattatcataatattaattttgaagatctaaatccttctgactttttttaa

SEQ ID NO: 958 - DNA, 732 bp, Staphylococcus epidermidis
aagagaggtcatattgtgattgaagcgaatcaaattttagctaaaatgaaaaatcaaaaaatcaactatgataaagtattaagaaagataatttctcaatgggaacgtgatggagaacgccctaaaatcttacttcatagttgttgtgcaccttgtagtacatatacgttagagtttttaacacaatatgcggatatagcgatttattttgcgaatcctaatatacatcccaaaagtgaatatttaagacgtgctaaagttcaagaacaatttgtaaatgattttaataataaaacaggtgcaaatgtaaagtatattgaagccgaatatgaaccgcataaatttatgaaaatggcaaaagataaaggtttaactgaagagccggaaggtggactaagatgtacggcttgtttcgagatgcgattagaaattgttgcaaaagctgctttagaacatggttacgattattttggtagtgcaatcacactctctccaaagaaaaatgcgcaattaatcaatgaactaggtatggatgtacaaaatatatataatgtaaaatatttaccaagtgattttaaaaagaataaagggtatgaacgttctatcgaaatgtgtaatgattataatatttttagacaatgttattgtggttgtgtatttgcagcgatgaagcaaggtatagattttaaacaaataaataaagatgctcaagcatttttacaacaattttaa

SEQ ID NO: 959 - DNA, 135 bp, Staphylococcus epidermidis
atattgttacacaacgttttagagatacatatcttaatttttatatttaaacaatcatcgtacaaatctatcacagtaatgttacacactaaaaaacctgagacaacaagttatctcaggcttctatatgagtaa

SEQ ID NO: 960 - DNA, 168 bp, Staphylococcus epidermidis
atatttatacattttgtcacccatctcgttaatatcatacttttatcatatacaacagacttctctaaatcaaaatctctttattataaaatcattttaaatccaaaaagtatttttgaaaatatttctaattatctgtatactttaaacaaatactttgcaagttaa

SEQ ID NO: 961 - DNA, 138 bp, Staphylococcus epidermidis
gtgcaaatacacaatctagtaacacaaatgtacaagctgtttcagctccaacttcttcagaaagtcgtagctacagcacatcaactacttcatactcagcaccaagccataactacagctctcacagtagttcagtaa

SEQ ID NO: 962 - DNA, 189 bp, Staphylococcus epidermidis
tgtaattcacatttaaaattaaaatcggggatttccctaatggcatggatatggttttctaggatgaaattgaggccaaaattaaaatatattattaactattttataatatatgttgcaattgaaattacactttacgctgtcattttaaaccacaaactattttataatgagctgcattcattatag

SEQ ID NO: 963 - DNA, 1983 bp, Staphylococcus epidermidis
gggagcacacataagatgaagaaaaataaatttttagtatatttactatcgacggcgcttatcacgccaaccttcgctacacaaacagcttttgctgaagattcatctaataaaaatacaaattcagataaaatggaacaacatcaatcacaaaaagaaacatcaaaacaatctgaaaaagatgaatttaacaacgatgattctaaacacgattctgatgataaaaaaagcacttctgacagcaaggacaaagactctaataaaccattatcagctgactcaacacatcgtaactataaaatgaaagatgataatttagttgatcaactttatgataattttaagtctcagtcagtagatttttctaaatactgggaaccgaataaatacgaagacagttttagtttaacgtcactcatccaaaatttatttgattttgattctgatataacagattacgaacagccacaaaagacaagccattcttctaatgacgaaaaagatcaagtagaccaagcagatcaggcaaaacaaccatcacaacatcaagaaccatcacagtcgtctgctaaacaagatcaagaatcatcaaacgatgaaaaagaaaagacaactaaccatcaagccgattctgacgtcagtgatttacttggagaaatggataaagaagatcaagaaggcgaagacgtagatacaaacaaaaatcaatcttcttctgagcaacaacaaactcaagcgaatgatgatagctcagaacataacaagaaatattctagtattacagattcagcattagactctatattagatgaatatagtcaggacgctaagaaaacagaaaaagattacaataagagcaagaatacaagtcacactaaaacatctcaaagtgataatgccgacaaaaatccacaattaccaacagatgatgaattaaaacatcaatcaaaacctgcacaatcatttgaggatgacattaaacgctcaaatacacgttcaacaagtcttttccaacaactacctgaattagacaatggtgacttatcttctgattcatttaatgttgttgacagtcaagacacacgtgatttcattcaatcaattgctaaagatgcgcatcagattggaaaagaccaagatatatatgcatcagttatgattgctcaagctattttagaatctgactctggaaaaagttcacttgcacaatcaccaaatcataacttgtttggaatcaaaggtgactacaaaggacaatctgtaacttttaatactttagaagctgatagcagtaatcatatgttcagtatccaagcaggtttccgtaaatacccaagtactaaacaatctcttgaagattatgcagatttaatcaaacatggtatcgatggtaatccgtcaatttataaaccaacttggaagagtgaagctctatcatataaagatgctacttcacatctgtcacgctcatacgccacagatcctaattattctaaaaaattaaatagtattattaaacattatcatttaacatcttttgacaaagaaaaaatgcctaacatgaagaaatacaacaaatcaataggtacggatgtctctggtaatgacttcaaaccatttactgaaacttccggtacatcaccttacccacatggccaatgtacttggtatgtgtaccaccgtatgaatcaatttgatgcatccatttctggtgacttaggtgatgctcataattggaataatcgtgctgaaagtgaaggctatacggtaacgcacacacctaaaaatcatactgcagttgtgtttgaagctggacaattaggtgctgatacacagtatggtcatgttgctttcgttgaaaaagttaatgacgacggttcaattgttatttctgaatcaaatgttaaaggattaggtgtcatttcattcagaactattgatgcagaagatgctcaagatttagattacattaaaggtaaatag

SEQ ID NO: 964 - DNA, 684 bp, Staphylococcus epidermidis
cataaaggtcttagaagaagaaaaagacaatttctatatttattcaatagaaattgtcttttttataattgtataaagaaaaccatgcgctatgcgtatggttcagaaaaggttttaccgttatctaaaaaaacatctcatcatgctagaatatatattggtcagccaaccaaaatattcaacacgaggagatgcttttttatgtcatctgacacaaacagtttagcacatacaaaatggaattgtaagtatcacatagtctttgcaccaaaatatagaagacaagtgatatacggaaaaatcaaaagagatattggagttattttacgtcaactatgtgaaagaaaaggcgtagaaataatagaagcagaagcatctaaaaatcatattcatatgttagttagtattccacctaaattaggagtatcctcatttgttggatatttaaaaggtaaaagcagtttaatgatttttgatagacatgctaatttaaaatatagatatggaaatagaaagttttggtgtaaaggattttatgtagatacagtaggtagaaataaaaaggtaattgaaaattacattcgtaatcaattacaagaagagatcgttgcagatcaaatttcaatggaagaatacctagatccctttacaggagaagaaattaaaaaaagacgaaaaaaatag

SEQ ID NO: 965 - DNA, 159 bp, Staphylococcus epidermidis
caatttaaacacatccttatatcgacattactaaactctattccctattttgactattttaatattattaaatttaagtttgtacctgttaaattattgtactcaatcactcacttatattatagatgtatacatacttataaatgcaaccacacttaa

SEQ ID NO: 966 - DNA, 756 bp, Staphylococcus epidermidis
ataacaaaacaaacaaattttaaattatatctggaggatttatatatcatgaaaaaaacagttatcgcttctacattagcagtatctttaggaattgcaggttacggtttatcaggacatgaagcacacgcttcagaaactacaaacgttgataaagcacacttagtagatttagcacaacataatcctgaagaattaaatgctaaaccagttcaagctggtgcttacgatattcatttcgtagacaatggataccaatacaacttcacttcaaatggttctgaatggtcatggagctacgctgtagctggttcagatgctgattacacagaatcatcatcaaaccaagaagtaagtgcaaatacacaatctagtaacacaaatgtacaagctgtttcagctccaacttcttcagaaagtcgtagctacagcacatcaactacttcatactcagcaccaagccataactacagctctcacagtagttcagtaagattatcaaatggtaatactgctggttctgtaggttcatatgctgctgctcaaatggctgcacgtactggtgtatctgcttcaacatgggaacacatcattgctagagaatcaaatggtcaattacatgcacgtaatgcttcaggtgctgctggattattccaaactatgccaggttggggttcaactggttcagtaaatgatcaaatcaatgccgcttataaagcatataaagcacaaggtttatctgcttggggtatgtaa

SEQ ID NO: 967 - DNA, 1542 bp, Staphylococcus epidermidis
ttatttttgcacgaattcttaaaccaaagaaaggtgagcaaaaaaatggctaataaagagtcaaaaaatgttgttattattggcgctggtgtcttaagtacgacatttggttctatgattaaagaattagaacctgattggaacatcaaactctatgaacgcttagatcgtccaggtattgaaagttctaacgaaagaaacaatgccggtacaggacatgcggcgttatgtgaattgaactatacagtacaacaacctgatggttcaattgatatagaaaaagccaaagaaatcaacgaacaattcgagatttcaaaacaattctggggtcacttagtaaaaagtggtaacatcagtaaccctagagatttcattaatccacttcctcacattagtttcgtaagaggtaaaaataacgttaaattcttaaaaaaccgttacgaagcaatgcgtaacttccctatgttcgataacatcgaatatacagaagatatcgaagaaatgagaaaatggatgccattaatgatgacaggtcgtactggtaacgaaatcatggcggctagtaaaatcgacgaaggtacagatgttaactacggtgaattaactcgtaaaatggcaaaaagtattgaaaaacatccaaatgctgatgttcaatacaaccacgaagtaattaatttcaatcgtcgtaaagacggtatttgggaagttaaagttaaaaaccgtaattctggagacgttgaaactgttctagctgattatgtatttatcggtgcaggcggtggcgctattccactattacaaaaaactggtatcccagaaagtaaacatcttggtggattccctatcagtggtcagttcttaatttgtacaaaccctgatgtaattaatgaacatgacgtcaaagtatatggtaaagaaccaccaggcacacctccaatgactgtaccacatttagatacacgttatatcgatggtgaaagaacattattatttggaccatttgcaaatattggccctaaattcttaagaaacggttctaacttagacttattcaaatcagttaaaccttataacatcacaacattactagcatctgcagttaaaaacttacctttaatcaaatactctatcgaccaagtattaatgactaaagaaggttgtatgaaccatctacgcacgttctaccctgaagctcgtgacgaagattggcaattatacactgcaggtaaacgtgttcaagttatcaaagatactaaagaacacggtaaaggattcattcaatttggtacagaagttgttaactctaaagaccactctgttatcgcactattgggtgaatcacctggagcatcaacttcagtatcagtagccctagaagttttagagaaaaactttgctgagtatgaaaaagattggactccaaaattacaaaaaatgatcccatcatatggtaaatctcttatcgatgatgttaagttaatgagagcaactcgtaaacaaacatctaaagatttagaattaaattattacgaatctaaataa

SEQ ID NO: 968 - DNA, 141 bp, Staphylococcus epidermidis
attaattcgcaaaatcgttttaatagtcttcctaaaacatttatatacacgaattttatattttacgatagtttcaaattactttttttagttaattggttttatttatctactttaaatactgtaaaagtaaaaagttaa

SEQ ID NO: 969 - DNA, 228 bp, Staphylococcus epidermidis
ctttattttaaatatatcggtgacagacatccactgaaaaacactagttatatttttaaaatgagagcttcaggaatttttctctatacaaataaaccgataaataaaataaatataatacctgatactgaaataattgtctctaataacgaccatgttaaaaatgtttctttaactgtcagcccgaaatattctttaaacatccagaatcctgcatcattgacgtga

SEQ ID NO: 970 - DNA, 150 bp, Staphylococcus epidermidis
acattttgtttgttcaagaaccgcatctttgaaaggagtgttattaagatgaaaaaattagcagttattttagcattagctggtgcagcgttctatggtttcaaaaaataccaaaatcatgtaaaccaagctccaaacattgaatattaa

SEQ ID NO: 971 - DNA, 195 bp, Staphylococcus epidermidis
aatgaatttaaagataattattgtcgagttattaaaaaatcatttaattatgatcaaacagggaaaagaagacgtattataagagagttcgtcaaaaaattgacattatttcatgaatattcaattttatttatcaaaattaaatcaattcaatcagacatatttaaacatatgctttatatcaagtcatcataa

SEQ ID NO: 972 - DNA, 1101 bp, Staphylococcus epidermidis
agacttattaatggaggaatgactatgccagaatctaaagcgttacttaaatctttaacagatgttaatggtatttctggacatgaaatgcaagttaaatctttaatgaaagattatttaacacctgtgagcgatgatatcgttgaagaccaattaggtggtatttttggtaaaaagaatgctactcatggaactaaatctttaatgatttctggccatttagatgaaattggctttatcgttacacaaattgatgaacaaggatacatttatttcacgccaattggtggatggtggaatcaagtcatgttatctcaaaaagtgacgattactactgaaagtggcaaagagatacgtggaattattggttctaaacctccacacgccctctcgtcggaagaacgcaaaaaaccagttgatattaaaaatatgtacatcgatattggtgtgcgtaataaagaagaagcgaaagaagcgggaatcgaattaggtaatatgattacaccttatagcgaatttgaatcattagcgaatgataaatacttaactgctaaagcttttgataatcgctatggatgtgcactcgctgttgaagtacttcaacaactaaaagatgaaaacatagacatcaatttatatgccggtgcaactgtacaagaagaagtaggtttacgtggtgctaaagttgcagcaaatttgattaaacctgatttagcaattgcggtggacgtcggggttgcatacgatgttccaggtatgacgagtgaaaaaaatgaaggtaagttgggcgatggtccattagcaatattgatggatgccactagtatcgctcacgatggtttgcgcaaacatattaaagacgttgctgagcatcataatattccagtacagtgggcaacaacacctggtggtggtacagatgcaggtagcattcatgtagccaatgaaggtatcccaacgattacaatcggcgtgccattaagatatatgcactctaatgtatctgtgctcaacattgatgattatacaaattcagtgcgcttaattactgagattgttcgatcattaaatgatgacagttatcaagcacttatgtggtaa

SEQ ID NO: 973 - DNA, 141 bp, Staphylococcus epidermidis
cttataattaaaaaaataaaatttttgacaactatgttagcatatttatttaagatgctacattatacattagtacacaaatgtgatttaattattcgtaataatgataatacaaaagggtgggataattatgataggtaa

SEQ ID NO: 974 - DNA, 159 bp, Staphylococcus epidermidis
ttgataattaaattttgtttttacgatacaagcttcttttggaaattgaaaagatacgataaatatagtggtgagtctaacaacacttcttgtgggttatttatagttgttaagggaagcttaaaagatacttttggtaacgtcaaaataaaaatttaa

SEQ ID NO: 975 - DNA, 189 bp, Staphylococcus epidermidis
gttaaaattaaagtaactaatcttatattgaggtgtatcatgagaaaactgatatctaccattatcgtttcaacattattaattggaggatgttccacggtgcataaagaagcaaaacatacatcacaatcaattcctgaagaagttcccgcaagtcaatacaaaggtcaaggtttccacaaccagtag

SEQ ID NO: 976 - DNA, 882 bp, Staphylococcus epidermidis
atggaaattaaacaaattaaatatttcgtagaagttgtacgacaaggtggtatgacgcaagcatctgaacacttatacattgcacagtcaacgattagcaaagcgattaaaaatattgaaaatgaatacgatattacattgtttgaccggtcacaaaaacaaataaaactaacagatataggtcaaacattttatgataatagtttagaatttttagctttattcgagaaattatctttagaaatgaatgacattgtgaacgttcaaaaaggtcatattaaaataggcttatcaccaatgatgaatgttcaaatgtttacaaatgcattgaatcagtttcacagactctatcctaatgtgacatatgaagtgattgagggtggtggtaaaattgttgagaacttaacatctaatgatgatgtggatattggtattactacattacctgtagatcacactgaatttcattcaacttctttatataatgaagaattattattagtagtaagtaatgaccatcatttagcacatttaaataaagtagacatggcagatttgaaagatgaagagtttgttttatttcatgatgattattatttaaaagatcaaattatagagaactgtaaaaggctaggctattaccctaaaactgttgctaatatttctcaaattagttttatcgctaatatgattcaacaaggaataggaattagtatcgttccagaaagtttagttaatttaatggggaataacgtaacgtccattcaattagagaatgttgaattatcatggcatcttggcgtgatatggagaaaagatgcttatctcaatcatgtaactcgcaaatggattgaatttatttctgagatgaaaccaacatag

SEQ ID NO: 977 - DNA, 273 bp, Staphylococcus epidermidis
atgaagattaacatatttggatataatatcttcgccaagggcggaacatcaagaagtaatattaacttagtgaaaagcttattagaaattggacatgaggtacactactttaattatcaggactataataaaagtgatatcacaaaactaattatttacgaaggtttgagcacaaagcatcttcatattcatcaatttaatagtggaaaagaacttgctcatggagacctacttataattactagagaaacctttttaatcatgcatatctag

SEQ ID NO: 978 - DNA, 912 bp, Staphylococcus epidermidis
agggggattaacatgtttgattcaattagagagacaatagattattcagttgaaaataacatcagttttgctgatatgatgattaatgatgaaatggaaagagaaggtaaatctcgcgaagaagtgcgtgatttaatgagacaaaacttaaatgttatgcgtgaggcagttgaaaaaggtacgactggcgacggtgtggaaagtgtaacaggttatacaggtcatgacgctgctaaacttcgagattacaacgagaataatcatgcattatcaggtcatgaaatgattgatgcagtcaaaggtgcagttgcaacgaacgaagtcaatgcagcaatgggtattatttgtgctactccgacagctggttcctcgggaacgattcccggcgtaatatttaaattagaaaaaactcataatatcactgaagatcaaatgatagattttctattcacatcagctttattcgggcgagtagttgcaaacaacgcaagcgttgccggtgcaactggtggttgtcaagccgaagtgggttcggcatctgcaatggctgcagctgctgcagtatcaatttttaacgggtcaccagaacaatcaggacatgccatggcattggcaattagtaacttattaggcttagtttgcgatccagttgctggtttagttgaaattccatgtgtaatgcgtaatgctattggttcaggaaatgcattaatatctgcagaccttgcactagctggagttgaaagtcaaattccagttgatgaagtcataggtgctatggatagagtaggtcgtaatttacctgcatcattaagagaaacaggtttaggcggtttagcaggtacacctactggcgaagaaattaaacgtaaaatattcggcgaagcagacaacatggttaaaaataaataa

SEQ ID NO: 979 - DNA, 138 bp, Staphylococcus epidermidis
tcgccttgtttaatttctgcagccatcgacgttcactcctttaaaattgtatatatttatatttatcacgctttgacgttttcaaacataattagtttacagtttacatttatattgataactattgcttttttataa

SEQ ID NO: 980 - DNA, 126 bp, Staphylococcus epidermidis
ttcctaactaaccatatgattaatagtgctgtaccagttattagcatacttaatgcgatggatgttaacttactgaatttcactgaaaaaggtaaagctattagtgacacgccaataggtatttga

SEQ ID NO: 981 - DNA, 303 bp, Staphylococcus epidermidis
gagttgactaaaatgattataattaatgctaaattaaaaatcgatgctaataaacgcgaggattatctaaaacttatgaaagaattagtcataaattctagaaaagaagacggtaatttattctatcatcattacgaagatgtaactgagaaaaatgtctttgtcgtagttgaaaactataaagacgaacaagcggttcaagcacacaatcaatcagatcactttaaagtttttagtgataatattagtcaatatttaattgaagaacctcaaattgatgtaagtcaacctattcaattataa

SEQ ID NO: 982 - DNA, 942 bp, Staphylococcus epidermidis
ttattttataaagtggtttattttgttgagttaaatatattagaatgtgagggagtatttgaattgaagaaattagcagtgatatgtgcgtttacaatattaatattagctggttgtggtcttggtgatagtgataataatggaagctcaacgataaatgatgatcaacaatcaggatataaaagtaacagagattcaaaatcaagtataagtagaaatcaaacagaagataatcagcaggacacacaacaagatacccattcgaatagatactatgctcaagtttggttaactgctttagatagttatagaggtgaaagtgaccttccttttgacgatttagaaattgtacatcaaaatatttctaataaagttttagatccctatcacccagacgaatcagccaaactacctgaaggaacagaattgttaacagcaagtgttactgcagcaggttcagtttattataaaagtaatggagatggcacaattacaatatatagtgtaccatcacatttccaagggagttggcgtgacgctgattactctaaaagagaatctcaacgcattatagatgatgctcgtacagttaagttatacaacgctagtgaaagtgaaatcaataagataagtcagatgatgaggactgaattttcagttggtgataatttaacagatgaagatgatacttctgaatctgaagatcaatcaagtagttctgatgaagtaacggtgacacgaagtaatgttatcgatatagttgaagactacgaagggcatcaattagatacagacacatatatttacaaagaaccagaaaaagatagcgatggtagttgggggttctcatttacagataaagaaggccatttagaaggatcttatattatcgataaagatggagaagtaacgaagtatgatgaagatggagagccagaataa

SEQ ID NO: 983 - DNA, 123 bp, Staphylococcus epidermidis
aataattataaactaactatttttaaaaatgtacaacaatttaacaaattcttaaagattcgctatttacgaagcaatacttgccgtctgttttactgctatatcattagcaatggtttatga

SEQ ID NO: 984 - DNA, 132 bp, Staphylococcus epidermidis
aaaaattataaaaaagacaatttctatattatttcaatagaaattgtctttatttacttatcttggacctttttgtcccagcctctccatttctataatattactattctatttttcattaatcacatttaa

SEQ ID NO: 985 - DNA, 1242 bp, Staphylococcus epidermidis
aacgtatataatagatgctataacttttctaggagaataatgatgatgactacaagttccaaacacttatctaaaatattaatcgttatacttggcgttatgactgcatttggtcctttgactattgatatgtacggaccatctttacctaaagttcagcatgcgtttggttcatcaatttcagaaatacaacttacattatcctttgctatgataggtttagctattggtcaatttgtattcgggccactatcagatgtattaggtcgtaaaaaaatggcactcattttattgattggatatttaatagcctcattactatcagtgtttacagttcatttaacaatatttttaattatccgtttaattcaaggtttagcaggagggggtgcaatcgtcatagccaaagcttctattggagataactatgacggaaacaaattagcaaaatttttaacttctcttatggtcataaacggtataatcaccatcattgctccactgttaggtggcctcgctttatctattgcaagttggaaaatgatttttatatttttaacaatcattaccttaatagtcatcttaggcatcttattaaaaatgccagttgggctccatcaaaaacaatctcagttaaattttaaagcaatatttaaagattttggtttgttattaacaaaacccaccttcgttattccgatgttattgcaaggattaacttatgtcatgttattcagttatttgtcagccgcaccttttatttctcaaaagatgtatcatatgacaccacttcaatatagtgcaatgtttgctattaatggagtgggtttgatagtcgtcagtcagataaccgctattatagtagaaaagataagccgatatgcgatgctcatatatttaacaatcattcaaatgttaggtgttgtaattttaatatttactttaacattacatcttccattgtatgttttacttattggcttttttattaatatatgtccagtcacttctatagcaccactttgtttttctatggcaatggctgaacgcacaggtggaagtggcaatgcttcaagtttacttggcctattccaatttattttaggaggcctcatttctcccctagttggtttgaacggtcagcatgatatgtccccgtatctaattattattagtgctacagctgttttacttattgcactacaaattatttatttcaaattatttatgaaaaacacatag

SEQ ID NO: 986 - DNA, 240 bp, Staphylococcus epidermidis
attccatataaaggagtatatattttccgccactttttcaactcatatattctcaaattgatttatagtaatagtatgtatttctcttcattattatttagacatttacttcaaaacaatataattgaaataaaaaagagtctggacatccatctaccttgtgtccagactcttaatcatgctcatagtattttattgattcaatcatcatcttatttatatcttttcaaacctttttga

SEQ ID NO: 987 - DNA, 687 bp, Staphylococcus epidermidis
tgtcgatataaggatgtgtttaaattgctacttaaggttgaacatcttacatacaaggttgataatcgtacgattttagatgatattaatttgaatattaataaaggagacacgattgctattgtaggtccttctggaagcggtaagagtactttactcaaacaattgaatcatttaattagtcccacgagtggagatttatatttgaatgatcaatcttactttaattataagccggaagagataagaacacgtgtgagttatttaatgcaacaaagtgagttaatcggttatacaattgaagataatatgaaatttcctgctgaggctagaagtgaagcttttgaccgtgataaagcgaaacaactcatctctcaagtaggattaggtaattatcagttagatgctcaaattgagcacatgtctgggggagagcaacaacgtattaccatcgctagacaactcatgtatgaacctgaagttttattattggacgaagctactagcgctttagatacacataataaaaagaaaattgaagaaattatatttaaactagcagataaagggattgccattttgtggattacgcatagtgatgaccaaagtatgcgtcattttaagcgtagaatcacaattactgacggtaagatatcgagtgatgaggagttgaatggtaatgagtaa

SEQ ID NO: 988 - DNA, 318 bp, Staphylococcus epidermidis
ataacgtataaaagtttaagaatgctattattcattggaggtcctatcatggataaaataaacaaagaagataccgatactaaaaaagatagtaataacaactataaacatcaaaatgaccatatagatagacaaggtttaaatggttatcaaaaaactgatttagatcttgagatagaacgagaactacaggaaatgatggaaaatggagaatctaataaagaaacaaaaagtaagcatttcaaaatcttatctttcgtttcaatgattgtcattgtagtgatagccatcatacgattcatccaaaaaacgatataa

SEQ ID NO: 989 - DNA, 138 bp, Staphylococcus epidermidis
attaagcataacgtcaatcctcatttaatttttaatatcataaaaagaaatatattttttattaaaaataaaagcacttacattggcttgtttcatatatttatagtttatattaaaacacgattaaatcaattatag

SEQ ID NO: 990 - DNA, 138 bp, Staphylococcus epidermidis
tcttttaataaaggcattgaattgatgtctttattgacgaaaaagaccgcgattaactcatattcgtttatttcatatatgaataaacaaagtattacatttttctataggaaacctattccttttatgaatggttaa

SEQ ID NO: 991 - DNA, 297 bp, Staphylococcus epidermidis
caattaaataaagcctataagaataacttaatggctaaaacaaacaagtctgggacaaggatattttatgtcccagaccttctttatgtatatacagattcttatgagatgagtccaacacagagaatttccgaagaaattccacggacaaagcaagttggggttggggccccaacagagagaatttccgaagaaattccacggacaaagcaagttggggttggggagaagacaggggacaatgaattctatcctagtttagcgttcattttaataaggggaattttacaaagttga

SEQ ID NO: 992 - DNA, 144 bp, Staphylococcus epidermidis
ctaaagaataaaagtcaaactttaggagaaacagtaatgtcgttttatgaacgagtattaaaactaggtgaaaataatcatcgtactgcttttgaatttcgttttgaagagttattttcaaatgaagaatggtgcgcattatag

SEQ ID NO: 993 - DNA, 813 bp, Staphylococcus epidermidis
gggtggaataaagtgacgacaccaacaacgcataaatataatcgctatttaaataaaaggatgtctcttaaaactagcttttcaattattttaatcacgggtttgattatctggagttttatttatactggatttagcattggagatttaatgataggtctgccacaaattggcgtattcttcaaacaaatgatacctccagattggggttatctagatcatattacacaaccaatgctagacacgattcgtatggcaattgtcggtacttttctaggaagtattgtctccattcctatagcgttactgtgtgcgagtaatattgttcaaacaaagtggattgcgattccatcacgttttgtccttaatattgtacgcacaatacctgatttattattagctgccgtatttgtagccatatttggtattggacaaattccgggtgtattagcactttttgttctaacaatatgtatcattggtaaattattatatgaatcattagaaacaattgatccaggacctatggaagctatgacagctgtaggggctaataaagtgaaatggattgcatttggcgttgttcctcaagcaatttcatcatttatgtcatatgtgttatttgcctttgaaattaacattcgggcatcagcagttttaggtcttgttggcgcaggtggtattgggttgttctacgatcaaacgttaggattgtttcaatataaaaagacagcaatgattatcctgttcactctaatcattgtagttattattgactatgtgagttcgaaagtgagggaaaaattagcatga

SEQ ID NO: 994 - DNA, 231 bp, Staphylococcus epidermidis
agaggtgataaggtgagtttttatcattttatacaaaatttcgttggtgatgaaacacctctaggtaaactagccacatgtattaaccaagatgaagatttacctatggaagaaacaacagcacataatatattaaactattttaatcagttaaattattttgatgacgattgtattgaagctgtaaaacgctcactatcactatatgaacaaagtaaagtagccctataa

SEQ ID NO: 995 - DNA, 2637 bp, Staphylococcus epidermidis
aaaggagataacagtatgtctaaaagctacgctaaattttacaaatgtgctttgcaagttaacccatatagttacattaaatatagaggcctagaacatgaaatgacagaggaacaatataatgagtctatataccaatattgtaagaccaataatatatcaattattggtctagcagatcatggtaacgttgataactcgagtaaactcagacaatatttagtatctaaaggtatccttgtatttccaggttttgaaatttccacatcagaaaaagttcacattgtatgtttattttcagaaaataccgaagaacgagaattagagagatacttaggagaactaggattatcaaatcttgaagaaggtaattctccaagtactctaagttttcatgaaatcacacaaaaagtattagatagaggaggattttggtacgcagcacatgttaccagtgataatggcatcttgaaaggaaaacataacaatctctggcaatcagataaattaatagcagcacaaataccttcaaaaaaaaacgaagtagaccctaagtatactagtatacttaaaaataaagatcctaattatcaaaaacaaactccttttgctcttattaatgctaaagatattagtaaaccggaagatctagcgttagatacttcaagttgtttaattaaaatgtcaaagcttaattttgaaagctttaaattagcttttagagatcctgatgctagagttaaattaaactctgacattaataacaaatttccacattcttctattgataaaattaaaatttctatgggatacttggataacctctcgttagatttatcttcaaatcttaatactattattggtggtagaggaactggaaaatcaacacttatcgaattaattcgttatgcattagatatagctcctacgagtcaaaatacaaacacatcttttgaaaacatctgtaagtctaatttaggaatcggtggaaaagtagaattaattgtcacatcacatgcacaatatggtaaacaatttaagataataaaaagatataatgaagatcctataattaaagatatagacaacaatgtgtcaaattacacagttaaagatattctccctaatatagaggtctatagccaaaatgaaattatcgatttaactacaaatgaaaacgcaaaactaaacattttgaatcgatttttagataaagatgatagaagtaatgataaaaaagaagaaataaaaactaatttacattcaaattcaaaatctttaattaaagctaaagaagatcttgaaaatttacaagaaaagatcaatcaattacctaaattaaaagaaaagttaaaacatttcaatgaactaggtattggaaagaaattagaagtacagggtaaaatatctagagaagaacaatacatacagaatactaaacaaattattgaagacaatgatatttctataacaaatatcattttaccttttaacgaaaattataatcaacaaattaaacatgttgagatttttgatagtattaaaaatattacagacaatcataataaaaaattaaaagaaataaaatctatgtttactgacctaaaagatactacacaaaacgaaatagaaaaaatttataatgtttggaaagaaaagaaaaaaaatattgagaaggaaatcaatagagctattaaatccctagatgatatagaaggtaaaactaaagaagatatagcacatgaatacactgagactcaaaaacaaataacttctattgaaccattagaaacacaattatctcgagttaaaacatctattgaaacattagaaaatgaaaggatacaacttaaagaagatttaaaagaaatatttgatgaacaactaaaaaatcttaacagatgcgtaaaaaaaataaataatagatatttaaaaaaacaagtaaacattaaaattcaaccatatgcaaatgttaataatttaatagagttcctcaaagaggaaaacggattaggagattcaacattaaaatggataaaaaatcatcaaagctttaattttcctaagtttattaaattaattaaggatagagacagtgaagctatatacgaggaatataaagatagcggtttaaaaaaacacacagcagatattctttcaaatatgctctatgagagaattctaaagttggaatcaatagagctagaaaatattatagatatacgattgaatgttggaagtgacaaagatacgaaattccgatctctaaatcatttatccaaaggacaacagtgcactgctattttgaatctattaactttaagtaataatgatcctcttttagtagatcaaccagaagataatttagataattcttttataacaaacaatttagttgaaaatattcgtaaattaaaaattaatagacaatttatttttgctacacataacgctaacatacctgtatttggcgacgcagaattaatagtgacaatggaaaatgaaaacggtcaaggaagtgtaaacaatgaaaacttaggatccattgataatactttagtaagaaattctgtcatccaaattttagaaggtggagatgttgcttttaaaatgagaaaaaataagtatggtctttga

SEQ ID NO: 996 - DNA, 1011 bp, Staphylococcus epidermidis
ggttcttgtaaaatgtcgcgttatgaacgtcaaacacgctttgcaccatttggagaagagggtcagcaaaagctatcctcctctcaaatacttatttttggcgctggtgctttaggaagccatattgtagatcaactcgcacgcatgggggctcatcatattgcaatcgtcgatatggatattgttgaaatttcaaatttacatcgacaaacactcttcgatgaagaagacgcacatactttaatatccaaagttgaagcaatcaagcataaggttaatcaaattaatataaatgtcaatctaacaacttatgatttagaagttacttcatcaaatatcgaaaatttgataaaaaatgtcgaaccagacatcatcattgatggcatggataacttcaaaatacgatacctgattaatgaggtttgtcacaagtatcaaatcccatgggtttatggtgcagctgttggtagtaaaggatcagtatatggaatagatcaccaaggaccatgtctaaaatgtttattgcaaacaattcctgacacaggggaaagttgcgctattaatggcgtaattccccctgttatatcaatgattgcaagctatgaagtagcagaggccgtacgttatctttcaggaaaaggattttcaaagcaattaatcactattgatgcatttaatatcaattataagtcaatgaatgtagatgcactcaaaaataaagattgcccagtgtgtgaaaaacatgaatatacgttactagaaagccaacaagaacgtactattgaggacttgtgtgggaatgcttatttatttagattcccacctaaagcttttaaacacgctgcccatttccctgggaatatggtgaaatctacttcctttgccaaattaattcaatatcaaacttatgaattcaccttgtttaaagatggtcgtatgaatgcatatggtatacacaatgatgaagaagcacatcacctatacaatacgttgttaaaatccatacgctaa

SEQ ID NO: 997 - DNA, 948 bp, Staphylococcus epidermidis
ttaagatgtaatattagtaaagaaaggtgtatcatgataaaaataatcgccacaattatcgtttcaacactaatattaggaagttgttcgacaatgaatgaagaagaaaattatgcatcacaatcaattcccgcaagtcaatacaaaggtcaaggtttccaaccagtagctgaaaaaagtgctatcgcacacgcgaaaaaacatcgtgaagaatacgaaaaacttggcgaacaattttttaaagataattttagccttaatgttaaagccacaaatgttgtaggaagtggtgatggcgtcgaagtctacgttcattgcgatgatcatgacattgtgtttaatgcaagcatcctttttgataaggaagcaatacatgaagaaggctccatgcgaagcaatgataatggagatactatgagtgatatggtaggaactgtgttaagcggttttgagtatagagcaaataaggaaaaaatggataacttagaaaaatacctcaaagataaagaagataaatatcactatactggattcaccgatgaagcaataactaaaactcaaaatataggttatcaaaataattacttttacattactactagttccacgaaattacgagattatagaaaacattttgaacctttaattaaagaaagtaacgatgattttagaaagcatatgaaacaattaaagtctaaaaaagatacgtatcttaatacagaaataacaactacacttttcagtactcttgatgaatatgacgaaaaaatcattagaaaaaatagtatatccatggctaaagaaataagaaaagagccatctattccacataatttcacattccacttattatttagcaataacaaattaaaaatcaacgatccaaacataaataacaatcaaattaatgagtatggggtgttccaccatgacggatttaaaaattaa

SEQ ID NO: 998 - DNA, 159 bp, Staphylococcus epidermidis
caacaaagtaatgccacacaaaacttctttgtgattataattttaataaatataattttgtataataaaaataaacgatttcaacagaacaaagataaaataataacatatgctaatataaaaataaacgatttatttatatttaaaaaatataagtga

SEQ ID NO: 999 - DNA, 156 bp, Staphylococcus epidermidis
gttcttttcaatttatctatatcatgtacaataaaattaaatagggattattttaaacgcattgtttcaataataggaggcaaacatggaagaaagaattggtttgatagacattggttccaacacgattcgacttgttatatttggctacaataa

SEQ ID NO: 1000 - DNA, 141 bp, Staphylococcus epidermidis
ataacaatcaaattaatgagtatggggtgttccaccatgacggatttaaaaattaatgatatggatatagctgaaataaatggcttttgggtatatcaaaatactaaaaataaaaaatttacagttaatggtaaaaattga

SEQ ID NO: 1001 - DNA, 189 bp, Staphylococcus epidermidis
aatctgatcaaaatggaggttatacttttgaatattaaaaagcattggttaccaattgttgtagtcattcttgtagttgttatctttttattagttactttcgctagggcaaatgaaggtttagataattatgagcaacatgaattaaataatggtgaacagcaatatctttcaaaaggggcaagctaa

SEQ ID NO: 1002 - DNA, 1521 bp, Staphylococcus epidermidis
aaatttaacaaacttaacggaggtcgtttgatggaacttgtagataaattatcaaatcgtcaatatattgatggagaatgggttgaaagttcaaataaaaacacaagagatattataaatccttacaatcaagaaacaatcttcactgtagctgaaggaactaaagaagatgttgaaagagcaattttagctgctagaagatctttcgaagacggtgaatggtcacttgaaacaagtgaagtcagaggtaaaaaagtgagagccgttgctgataaaattaaagaaaatagagaagagttagctaaattagaaacattagacactggtaaaactttagaagaatcctatgctgatatggatgatattcataatgtgtttatgtattttgctggtttagctgataaagatggcggtgaaattatcaattcacctattcctaatgctgaaagtaaagtagttaaagaacctgtaggtgttgttactcaaattacaccttggaactatccattacttcaagcatcttggaaaattgcgccagctttagcaacaggttgctcattagttatgaaaccaagtgaaattactccgttaacaacaattcgtgtatttgaattgatggaggaagttggtttccctaaaggaacaattaatttagtacttggtgctggatcagaagtgggcgacgtgatgtcaggtcatgaagaagtcgatttagtttcatttacaggtggtattgaaacaggaaaacacatcatgaaacaagcagctaatcacgtgactgacgttgcattagaattaggcggcaaaaatcctaatattatttttgatgacgctgattttgaattagctgtagaccaagcacttaatggtggatatttccacgctggtcaagtgtgctctgctggttcaagaatcttagttcacaatgatattaaagataaattcgaaaaagctcttatcgatcgtgtaagcaaaatcaaattaggtaacggttttgatcaagatactgaaatgggaccagttatctcaacagcacaccgcgataaaattgaaggttatatggaagttgcgaaaaaagatggagcaacaattgcaattggtggtaaacgccctgaacgtgaagacttacaagccggattattctttgaacctactgtaattacagattgtgatacatcaatgcgtattgttcaagaggaagtctttggaccagttgtgactgtagaaggatttgctgacgaagaagaagctattcgcttagcaaatgattcaatttacggtttagcaggtgctatatttactaaagatattggtaaagcacaacgtgttgcaaataaattgaaacttggtacggtttggattaacgatttccatccatactttgcacaagcgccatggggcggttacaaacaatcaggtatcggtagagaattaggtaaagaaggattagaggaatatttagtaagtaaacacattcttacaaatactaatccagaaccagtggattggttcagtaaataa

SEQ ID NO: 1003 - DNA, 156 bp, Staphylococcus epidermidis
ctcatcaacaaacacccttcttttataaagaaaagctatgagactcaagccgcaagaggtccacaaaccttcacgtttaatcccttagcttttctttttataattcattcaatttattttatttcatatcatgaacagctttttcatattgtctaa

SEQ ID NO: 1004 - DNA, 1389 bp, Staphylococcus epidermidis
ataataaacaagagaaagaaggggaatgcgatgtttggagagatttggccactcatcagtgttgtattaggaattattatcttattaacattaattattggattgaagcttaatacatttatttcattaatcattacctcaatgataacggcgttattattaggtatgccacttaacaaaattatggaaaccattgaaaatggtatgggtagtacgttaggtcatattgctttaatctttggcttaggtgcgatattaggtaaattattagccgatggtggtggggcaacacgtattgctgatacacttattgcaaagtttggtcagaaacatgttcaatgggctatgttgatagcagcatttatcgttggtattgcgctattttttgaagtaggtcttgtactattaatcccactcgtatttacagtagctaaacgcgcaaatgtatcaatattaaaattgggactaccaatggtcacagcgttatctgttacacacggattcttaccaccacatcctggacccgttgtcatcgctaaggagcttaaagcaaatataggtgaagttttgttatatggtatgattattgctatccctgtaacacttattgcaggtccaatctttaatcgatttgcacaaaagatggttccaacagcgtatacgagagaaggggatatttcttctttaggtactcaaaaggaatttaaagaagaagagatgcctggtttcggaataagtttattgactgctattttacctgttattcttatgttgatttctacaattgtgcaactgattacaggacacgaagaagcaacaaatgtattcgaacaaattgtttacttcataggaactgctggtactgcattgcttatcgcagtaatatttgcaatctttacaatgggaatgaagcaacaacgaaaaatggaagacattatgaaatcagttacgcatgctatttatccaatcggcatgatgttactcatcatcggtggtggtggtacatttaaacaagtgctcatcgatggtggcgtaggtgatacaatcgctaagatgtttgaaggaacaagcatgtcgcccattttattagcatggattgtagctgcagtcttaaggatttcattaggatcagctacagttgctgctgtatcaacaacaggcattgtgttaccacttttagagcattcagatgttaatgtagctttggtcgttcttgcaataggtgcaggtagcgtaattctctctcacgtcaatgatgcaggattctggatgtttaaagaatatttcgggctgacagttaaagaaacatttttaacatggtcgttattagagacaattatttcagtatcaggtattatatttattttatttatcggtttatttgtatag

SEQ ID NO: 1005 - DNA, 495 bp, Staphylococcus epidermidis
tcccaatgcaaattacttatatttgtcagtaaccttcctcctcaggtcgtccatcatttcaattttaaattgaggagggacttatctatgaaattatctatttttcatgatggtcaattttttgtaggtgtcgttgaataccaagaaggcttcattcataaatatctaaaagttacatttggcaatgaacctagcgatgaaacagtgttacgattcataacttttaaacttattcctttattaaatcaaacacactgtaagaagaaacctattcaaaagcataaaaagattaatccaaaacgtttacaacgtaaaatcgctaaagaacaaaaagagaccaatttaactacatttgctcaacaagcgattaaagaagaacaagagttgaataagctaaagagtaaaaaacttcagcgattagaaaaagaacgacacagacaatacaaaagaatgttaaaaagaaaaaaagcacatgaaaagcacaaaggtcactaa

SEQ ID NO: 1006 - DNA, 903 bp, Staphylococcus epidermidis
tatatgcgcaaagtattaattttcgcaattgcgggatttttagcacaacttgttgatgggtcattaggcatgggatttggcgcttcatcgtcatcaatattattaacttacggtatagcaccggcagtagtgtcagcaaccgttcatttttctgaaattgcaacaacagctgcatctgggacatcacattggagatttgataatgttcataaaccaacaatgttgaagttagctatacctgggtcaataagcgcctttatcggtgcaggtgttttgacatttattcatggtgattatattaaaccattcattgctttattcttgttaagtatgggattttatattttgtatcaatttctatttaaacgtgcacatgaacatcatcatcatgtgggaaatttgagtagttttaaagtaattccacaaggttttgtggcaggatttttagacgcaatcggtggtggtggttggggaccggttaatacgccgctcctgctttcaagtaaaaaaattcaaccacgatatgcgattggaacagtctcagcaagtgaattttttgttacgtcatctgccgctttaagtttcattatctttttaggagtcactcaaattaattggtttgctgtaattgctttaagtctcggtggaatggtagcagcacctatttcagcgtatttagttaaagtgttacccattaacattcttgcaatttgtgtcggtggtttaattatttttacaaatagtaatgcattattaagctattttgtaaaagataacactatttcaaatacagttcgattcattattattcttgcaattattattttgcttgtttttcaagtcgttcgaaacaagaaattgtctttttcttataagaaaagccgagtaaacaaatataattaa

SEQ ID NO: 1007 - DNA, 135 bp, Staphylococcus epidermidis
atgaatagcaattcctcgataataaataacaatattaatatagggagtgggacagaattcataacgagttcattgtcctactccctatattttaatttaatctataagtctttcatttattttctaggtacttga

SEQ ID NO: 1008 - DNA, 1542 bp, Staphylococcus epidermidis
ctggaaagcaatatgataactactacacaagaggtgaacattatggctatgtctgacaaaaaagacgtcgtgttaatcggtgctggtgtactaagtactacatttggttctatgttgaaaacgattgcacctgattgggacattcatttatatgaacgtctagatcgtcctggtattgaaagttcaaatgaacgtaacaatgcaggaacaggacatgcagctttatgtgaattgaactatactgtacaacaacctgatggttcaattgatattgaaaaagctaaagaaattaatgaacaatttgaaatttctaaacaattctggggtcatttagttaaatcaggagaaattcaaaatcctaaagaatttattaatccattacctcatattagttttgttcgtggtaaaaataacgttaaattcttaaaagatcgttatgaagcgatgaagcaattccctatgttcgataatatcgaatatactgaagatattgaagaaatgagaaaatggattccattaatgatgaaaggccgtgaagataagggctacatggcagcgagtaaaatagacgaaggaactgacgtaaactacggtgaattaactcgtaaaatggctcaaaatcttaaaaactcaccaaacgttgaagtgcaatacaaacatgaagttgttgattttgaacgtttgtctaatggtaaatggtcagttaaaattaaaaatctaaataatggacaagtattcgaacatcaaactgattatgtgtttatcggtgctggtggtggcgcaattccattattacaaaaaactggcattccagaaagtaaacatttaggtggattcccaatcagtggtcaatttattgcttgtacaaatccgcaagttattgaacaacacgatgccaaagtttatggtaaagaaccacctggtacaccaccaatgacggtacctcacttagatacacgttacattgatggtgaaagaacattattatttggaccatttgcaaacgtgggacctaaattcctaaaacatggttctaacttggatttattcaaatcaattaaaccatataacattacgactttacttgcttctgcagttaaaaacttaccattaattaagtattcatttgaccaagtcatcatgacaaaagaaggttgtatgaaccatttacgtacgttctatcctgaagcacgtgatgaagattggcaagtttatacagctggtaaacgtgtacaagttattaaagatactgaagagaatggtaaaggatttatccaatttggtactgaagtggttaattctgaagaccactcagttattgcattactaggcgaatcaccaggagcatcaacttcagtatcagtagcactagaagttttagagaaaaacttccctgaatacgcgaaagactgggaacctaaaatcaagaaaatgattccttcatatggtgaatcacttattgatgatgttcaattaatgagaaaaatacgtaaacaaacatctaaagatcttgaattaggattctataataaagcaaaataa

SEQ ID NO: 1009 - DNA, 1056 bp, Staphylococcus epidermidis
tataatttaaaagattacaaaatatttattataggagggttttatatgcattgtccgaattgcggtaatccaatagaagatgatgatttattctgtggtgaatgtggacataaaataagtcgacatccacagtcagtcagaaatgcagaaagtgaaataacaaaagctgaaaagaatgatgaagaacaaaacataacatcaaataataaagaaaacaacgcagcgactcatcaaaatgttgattcaacatctcatgatgagactagatcaaatgaaaatgacgtagcagattcaacattacaatctaagcagtcacataatgatacccaacaatcaaatctctctacataccatcaaagacctcaacatcgagaaattcctcaaaatcaacacaatcacgatcaacagcaaagtcaaataggtcaacaagctaaacaagtaacaaatgaaagtaaaggtttctttaaaagtgcatttactgcacctgataaaatcattcaaactaatcatgttttcagttttaaattattattatcattattaataatcggttttattgtattagcaattttactcgcttccgtaataccagttgagattggtattttcggtactacaagaggaagtttggtaacgagtatcatttttggtattattctatttttggttgtcatagtaggtgcaatatttgggcttacacgtttagtagttagacaacctattgcatttaaaaaagtattatcagactatgtgttaattaatagtgtttcgttagcaattttaattatttctgtaattttaatattagcagaatcatacagctttggcggaagtatagcattattgtctttattattatttattgcttctggtatttatctaattgcgaagtatagcactggtaatcaaacaagaatatccagcttttatggtgtgattatttatatcattattttgttcttatttattcgtatttttggggaggcatttttccatcaaatatttggtgattttatagaagaactaggggatttatttgaaggaggaacttattaa

SEQ ID NO: 1010 - DNA, 1482 bp, Staphylococcus epidermidis
tgcaatttaaatttaaaactgatctttcagggaatacttctaatggaggtgtttaacatgacaaatcaattatttattaacaatgaatttatagaaagtcagtctaaagagacaatggatgtcattaatccagctactggcgaggcatttgatactatcactcttgcaactgaagaggaagtaaacgacgccattgaaaaatcgcaacaagcacaacttgaatgggagcgcgtgcctcaacctacacgtgcggaacatgttaaattacttatacctttattagaaaaaaatcgcgatgaaatagctcaattatacgtaaaagaacaaggtaaaactttagcgcaagcttatggagaaattgacaaatcaatctcatttatcgattatatgacaagtctgagtatgtcagataaaggacgtgttctacaaaatagtattgcaaatgaaacgattcaaattatcaacaaacctatcggagttactgctggtattgtgccatggaacgcaccgatacttgtccttatgcgaaaagtcattccagctatagtaactggttgttcagtagtgattaaacctagtgaagagacaacgttactcactcttcgattagctgaattattcagagcatcaactataccagcaggattgtttcaaattgttcctggcactggagaaacagtaggtacacaattagcttcgcataaagacattcaacttatttctttaactggaagtatgagagctggtaaatctgtttacgaaaatgctgctcaaactgtaaagaaagtaaatttagaattaggtggaaacgcaccagtcattgtcacatcaaatgccgatttagataaagcagttaactatatcgtgacagcccgtataaataatgcaggtcaagtttgtacgtgccctgaacgtatctttgtacatgaagatgttcacgatgactttttaaataaagtaacttccaaaatgaaaagcttaactgttggagatccatttgatgaaaacaccgattacggcgcaattattaaccaaaaacaacttgatagtattcatgaaaaggttcaagatgctattaaaaatggcgcaacattgatgactggtggacatcaattaaaacgccatggtttcttctacgcaccaacggtattagataacgttagaaaagactataatgtctttaaagatgaaatttttggtcctgttcttgcgataacaacataccgcgattttgaacaagtgattgaagacgctaatgatacaaacgctggcttatcttcttatatcttctctgaaaatttaacagaagtaatgacagcaaccgaacgtctaaaatttggtgaagtatatgcaaattgtgaggctgaagaagtcgttaatggctatcacgcaggttggcgtgaatcaggcttaggtggcgctgacggtattcacggttttgaagagtactacaataccacagtaagttatatcagatactaa

SEQ ID NO: 1011 - DNA, 144 bp, Staphylococcus epidermidis
aacagcttaaaaaaatcattgtcacaaaagagttataatcaaatgagatgtggatacttaatgaaagattataattatgtattcccaaaaataaagcgaactcttgttatcaatagtattgataactcgaattcgcttttttaa

SEQ ID NO: 1012 - DNA, 168 bp, Staphylococcus epidermidis
tgtttattaaattatacgaaagggcttatttttttaaagtattttaatgtaaaattacatataaacacaaagtattttggcgagactcttgagggaacaggacaagctgaagactacaggctgaagctgtcccctaagaaagcgagccaacaatacgaagtattttaa

SEQ ID NO: 1013 - DNA, 141 bp, Staphylococcus epidermidis
tgtttattaaattatacgaaagggtcttatttttttagtatttcacatataaagacaaagtattttggcgagtccttgagagaacaggacaagctgaagctgtcccctaagaaagcgagacaacaatacgaggtattataa

SEQ ID NO: 1014 - DNA, 834 bp, Staphylococcus epidermidis
atgaaattaaagcgtggatttcaaaaaaataagacgcccgggcgtctagaaatgaataaagttattgaaagtgacgtaacgttatcgagtatgctttggctaggaggtgagaagtctatgtcgatttatacttcaggagatatagctcataaatgccatgtgtcaacacgcactattcagtactacgataaacaaggaatcttatcgccaaactatacttctgaaactaacagacgtttttacactgataaggaagtggagaaacttgaactgattttactacttaaggaaataggttgcacaattaaagaaattaaagtgttattaaaagatgattcatcaatgaaatctctttacacgtttcttcaaatcaaaaagcatgagatacaacagtcaataacagataaagaacacaaggtatgtaaaatagagcaaattcaacgctatgttcatcaaaattcaatttctccaattcattatttacaagatataactacttatatggaagaatctcatagactcaaaggtgtcagaaagaaattatggttaagtatagctctgattgggtcattacaatatggtggtttgatcatctcaattgtaactcgaaggaaaaagcctttcttgtcgatgatgcctgtggtagctatgtattcactttggttaacaaaaaagtataaaaagaatgtttcatatgtctgccctaattgccatcatgtgtttaatcctagtgtcattcattttgtaacagcatcacatacacctaaaactagaaagcttcaatgtcctgattgtcacgaaatgcattactgtatagaaattgctaagcaatga

SEQ ID NO: 1015 - DNA, 714 bp, Staphylococcus epidermidis
atacttataaagcgcaaggaagtcaaggttacggtggagagtactttggctctaattgtgaaggttgtggtgttgcagttcaatcaggtaaaactggacaagaaatttataatgaaaatttctatggagggatcttccgtgattaaccttgaacaattaagtctataccaagatagcttaggctatcttggtcaacaaatgaattttccagaaaaaatgacatttcatccaaaaatatttgaagaaactatttctaagtctcaccccggctacgaagatttgcttgcatatagagaagtcatgatgaattatactttgtcagaaattaaagctatctatacagatacatttgattttagtaaaaaacacccactctatatgacatttaataaatttgacacgcaaaaggaacggggtcaaatgctagctaaattaaaggttttatacgaaatgtttggactaaaaatggttgataatgaattatctgattttctcccattgatgctacagtttttgcaagttgctgattttaaaaatgatagtcgagcacaggaaaaccttcaacttgtcattatgattattgaagatggtacgtatgaaatggcaaataccctagctgaaaacaataatccctatgcatatgttgtcagtgcattaagaaaaacgttaaaagcgtgtatcgtgcctttgaaagaggtggaaaatcatgcttaa

SEQ ID NO: 1016 - DNA, 129 bp, Staphylococcus epidermidis
ctttatataaacatttggtattggaatataaaatctaataaatatataaaattgaattatcaattattaaaaacaaatacgttacctgagacaattattgttgtctcgggtttttttatctataaatga

SEQ ID NO: 1017 - DNA, 792 bp, Staphylococcus epidermidis
ttccatataaatcttctaaggaggaacactttaatgaaagcgttaatcgttgatgatgaaccacttgcaagaaatgaattacaatatcttttaaatcttaatgatgctatagatgaaattgaagaagcagaaaacatagaagaaacattggagaagttactctacaacacatttgacttaatattcttagatataaatttaatggatgaaagtggtattgatttagctcaaaaaattaataaaatgaagcgatcaccacatattatctttgcaaccgctcacgagaaatttgcagtcaaagcctttgaattaaatgcaaccgattatatattaaaaccttttgaaaaagaacgtattaatcaagctgtaaataaagttgacatggctaaagataaaccaaaaaacaaagataaaactatcacacctaaatatattgattatagtgatgatgagcgcgctcaaacacatgtacttccaattgaagtggatgaacgtattcacatcttaaatttcacagacattatcgcattatctgttaataatgggattacaacgatagatacaacaaaacaaagttatgaaacgaccgaaacacttaatcattacgagaaaaaactaccttcctctctatttattaaaatacatcgcgctactatcgttaataaagaacatatccaaacaatagagcattggtttaattatacgtatcagctgacgttaacacatgaatttaaatatcaagttagtcgttcttatatgaagacttttaaacaacaactcggtcttcaataa

SEQ ID NO: 1018 - DNA, 123 bp, Staphylococcus epidermidis
tatgatataaatacatactaccatgatttaatatataaaacattaaatccaaaccgacactctatgcacgtcacctatacatatcaacactatttatatattcttactgacatttcgtggtaa

SEQ ID NO: 1019 - DNA, 1773 bp, Staphylococcus epidermidis
aaagagataaaagatatcaaagagacgtgtattaatagaagggacgggggatacatggttaatacaaataatcatatttcggaagaattagataaaaatcttgatgaaatggaatttttaaaagcaaatagtgactttttgcgtggaactattgaacaaagtttagctaatccaatcactggatccattacacaagatgatgcaaaactgctaaagtttcacggaagttatatgcaagatgacagggatttaagagatgagcgtcgtaaacaaaaacttgagcctgcatatagttttatgattcgagttcgtgtacctggggggaaagcgactcctgaacagtggattgctatggatgatatctctaatcaatatgcaaatcatacgattaaattaacaacacgccaagcatttcaatttcatggaattcttaaacgtaatttgaaacaatcaatgaaaaatattaatcatgcagtacttgattctattgctgcatgtggagatgttaatcgtaatacgatgtgcaatcctaatccttatcaatctcaagtacataaggagattaatgattatgcaacgcgtataagtaatcacttacttccaagaacaaatgcatatcatgaaatttggcttgatggtgaaaaggttttagattcgagtgaggaaaaggaacctatttatgggaatacgtatttaccacgtaaattcaaaataggtattgcagtaccaccatctaatgatattgacgtctattctcaagatattggtttaatcgctatcgttgaacaagatgagttaattggatttaatgtgactatcggtggcggtatgggtatgactcatggtaatactgaaacatatcctcaacttggacgtctcataggttttatacctaaggaaaaggttgtagatgtatgtgagaaaatacttacaatacaacgtgattatggtaatcgtgaaaatcgaaaaaatgcacgttttaaatatacagtggaccgtctaggagaaacttgggtgactgaagaattaaaccgacgattaggttgggaaattaaagcgccacgtgatttcgaatttgaacataatggtgatcgattaggttggattgaaggtattaataattggaatttcactttatttatacaaaatgggcgtgtgaaagatactgaagactatttgttaaaaacagccttaagagaaatcgcagaaatccatactggagatttcagattatcacctaatcagaacttagttattgcaaatgtttctcctgagaaaaaggaagaaatacaagctattattgataaatataaattaacagatggcaaaaattatacaggacttagaagaaattctatggcttgtgttgctttcccaacgtgtggtttagctatggcagaatctgaaagatatcttccttcactaattacaaaaattgaagatttattagatgagtctggtttaaaagaggaagaaataacgattcgtatgacaggttgtcccaatggatgtgcgagaccagcgctagcagaaatagcctttatcggtaaagcacctggtaaatataatatgtacttaggtggtagttttaaaggcgaacgtctaaataaaatatataaagagaatatcgacgaaaatgagatattagaaagtctacgtccattgttgttgcgttatagtaaagagcgtcttgacggagaacactttggggactttgtaattcgtgacggtgtgatagccaaagttcatgatggtcgcgattttcatagttaa

SEQ ID NO: 1020 - DNA, 627 bp, Staphylococcus epidermidis
aaagccgtaaatttaatgagagcaaaaaaattgataagtcatcttactgtatctagaataacaagtacaagaaacgtaattattgtaataaagagagaaggggttataataatgacaaaatttaactttgatcaagttcacagtgatattcagtttaaaattaaacatcttatggtgtcccaagtaaaaggaacatttaagcaattcgatgttcaattagatggagatattaatgatttaacttcactaaaagcaacagctactattattccaagttcaattgacactcaaaatgaggacagagacaaccatttaagatcaaacgatttctttggtacagaagacaacgataaaatgacatttgtaactaaagaaattaacgaaaatcaagtagttggagatttgacaattaaaggtgaaactcatgaagagacatttgatgttgaatttaatggtgtaagtaaaaatccaatgaatggacaacaagtcactggttttatcgttagtggaacaattaaccgcgaaaaatatggtattaattttaaccaagctttagaaactggtggcgtgatgttaggtaaaaacgtaaaatttgaagcatcagcagaatttagcatcgacaattaa

SEQ ID NO: 1021 - DNA, 600 bp, Staphylococcus epidermidis
tttaaagtaaagattcataaattaatattagggggatcacatttgaaaaaggaaaaagttatggactggacgaccttcataggcgtagtcattgtgttactttttgctgttatacctatgatggtttttccgaaagcaagtgaaataatcattaccgatatcaatagtgccatttctaattcaattggatcggtatatctctttatgggactggctatattttgttttgttttatacatagcatttggtaagtatgggaatgtcacgttaggaaaagcgactgacaaacctgaatttaataatttcacatgggcagccatgttattctgtgccggtattggttcagatattttatattggggtgttattgagtgggcattttattatcaagtacctcctaacggtgcaaaatcaatgtccgatcaagcacttcaatatgcaactcaatatggtatgtttcactggggacctatagcctgggcaatatatgtgctaccagctttgccaatcggttatttagttttcgttaagaagaaacccgtctataaaattagtcaagcttgtcgaccaattttaaaaggacatacggataaattatga

SEQ ID NO: 1022 - DNA, 129 bp, Staphylococcus epidermidis
aaactggtaaagtccgtcaatggaataattatcatcatggttcctaagcaaaaaatctataaagtaattgaaacaattctcaacactttttcgatatatttcttccttattatcgtaatgataatatag

SEQ ID NO: 1023 - DNA, 165 bp, Staphylococcus epidermidis
ttctcatcaaatacctttagtgattttctactgttaagcacttcgttaaaatcatttatacgtgtcaattttagtactcctccattttttaaaaaattgttttattatcaaattaaactcattcaaatatttgataaatttaatttaaagcaatttgaattatag

SEQ ID NO: 1024 - DNA, 153 bp, Staphylococcus epidermidis
aaagcatcaaatcaaaaagaacacaatgtcgaatgcagaattataagcattttatatttaattgttattacatcttatgtgtataaaatatatcatttacatgataaagggacagtggtcatgacgacgactgtccctttcttattatattaa

SEQ ID NO: 1025 - DNA, 1674 bp, Staphylococcus epidermidis
aagaaatcaaaggtggaattatatatgaaacaacgcgtaggacaatatttaatggacgcggtttattcagcaggtgctgacaaagtttttggtgtcccaggagattttaatctagcctttttagacgatattattgcacataatgatattaaatggattggtaatacaaatgagcttaatgcaagttatgctgccgacggatatgcacgtattaatggcatcggtgcaatggtaacaacatttggagtgggtgaattaagtgctgtcaacggaatcgctggatcttatgctgagcgtgtgccagttattgccatcactggggcacctactcgagctgtagaacaagaaggcaaatacgttcaccattcccttggcgaaggaacttttgatgattatagaaaaatgtttgagcctattacaacagcgcaagcttatattacacctgataatgctaccacagaaattccaagagtaatcaatacggcgcttcaacaacgtcgtccagttcacattcatttacctattgatgtcgcactaacagagattgaaatttcaaacccattcaaaccagaagtcgaaccacaaaaaaacgttcaaagttatatcaatatggttcaagacaaacttgaatcggcatcacaacctgtcattattacaggacatgaaataaatagtttccatctgcataaagaactcgaacaattcgttaatcaaactcaaattccagttgttcagttatctttaggtaaaggtgcatttaatgaagaaaatccttattatatgggtatctttgatggttcaatagcagaacaagatattcaagattatgttaatcaaagtgatgctattttgaatattggtgctaaattaacagattctgcaacagctgggttctcatatcaatttgatattaatgaagtgattatgctaaatcataatgaatttaaaattaatgatacatgcatcgaagcattttcattaccaaatatattaaatggtttaaataagtatattcactacaaaaacactaatgatttcccacaatatgagagaccacaatcacacaattacgaacttagtgatcagccattaactcaagagacttatttcaatatgatgcaagattttttacaacaagatgatattttaatcgctgaacaaggtacatcattctttggtgcttatgacttagccttgtacaaagataatacttttatcgggcaaccattatggggatctatcggctatacactaccagcaacgctaggaacacaaattgcaaatccatatcgtcgaaacattctattaattggtgatggatcactacaattaactgttcaatcattatctacaatgattcgtcaaaatttaaaccctgtgatatttgtaattaataacgatggttatacagttgagagaatgattcatggtatgaaagaaccttacaatgacattcgcatgtgggattacaaatcattaccttctgtatttggtggtgacaatgttttagttcatgatgtaaacacttcagaagaactcatgctcaccttcgaaaatattaaatctaatagtgatcgcatgcactttgtagaagtgaaaatggctgttgaagatgcaccagttaaattaagtaatatagctaaagcattcgcatcacaaaacaaatcatcttaa

SEQ ID NO: 1026 - DNA, 126 bp, Staphylococcus epidermidis
caccgcacaaaatcaataagtgaaaatactaagacgagtaacaatcattttcatattcgtttaataagatgtccgcctaaatatccaaattcaaccctttgtatcattactggacaaaccacttaa

SEQ ID NO: 1027 - DNA, 1113 bp, Staphylococcus epidermidis
cgcatgacaaatcaaaaaactgtgggtctagtcgtcgctccaggtgttactgaacgccttgcagaaaatctcatacaagaaatgcctaaaatgttatctacacattatgatcatcagcaagaatggatttttgatttagttacggatccgcttactggttttgctgaatctgtagatgaaatttttgggaaagtagccgattatcacgataagagacaatgggattatgtgatagcaattacagatttaccgatgtttgcggacaagcaagtgatggcattagatattaatatggaaaatggtgcagctatattctcatatccggcatttggctggcgtccagttaaaaaacgtttcaagcatgcgatttataatattattcaagaattaaatgaagctgaacaagaaagtcgtaattatgataataataagcaaatagaaaattcagtaaaaaaacaatttccgctctctaaaatagataaagaaacaatatatatgaaagaaacagactcttatcacttaagatatttatcaagttcacgttctagaggcatgtttcgccttgttagtggaatgacctttgcgaataatccattaaatatgatggcaagtttaagtaatatagtagctattgcatttactacaggtgcatttggacttgtatttacaacgatgtggcaaatggcttataacttttcaatgtggcgcttatttggaatttcaattattgcgattattggaatgctaatatggataatgatgtcacatgatttatgggagccagttaataaaagcaaccataagcatattacttggttatacaatcttacaacaataatgacattgatttttgccattataatttattatattattctttatttactattcttaattgctgaaatcgtattattgccatcaggattcttaggtcagcaagttggattgaaaggtcctgcaggcattgatttgtatttaagtattccatggtttgcagcttcaatttctacagttgcaggtgcaataggtgctggtttacttaatgatgaactcattaaagaaagcacatatggatatcgtcagcgtgtaagatacgaagaacaacgtcgataa

SEQ ID NO: 1028 - DNA, 1890 bp, Staphylococcus epidermidis
acaatgacaaatatcggaataacaaagtataagaggtggataagattgaacttaagtgttaccaatagtccttttacggaagggcaagctaaacaaatcaatgaattgcttcacactttatcacctaaccaacaagtatggttaagtggctatctgatggcaaatcaacaatcaaatacatctacagattctgtagaacaacataacttagatgacaatacagaagcgatgctacatgaaaaggaaccttcagttgagccggaagctagatcgataacaattttatatggatctgaatctggtaatgcgcaaggacttgcagaaatatttgaacaacgtttatctgatattggaaatgacgttacgctcaaatcaatggatgactttaaacctaagaatttgaagaaagtagaagatctatttattatcacatctacacatggcgaaggagatccaccagataacgctgttgaattacatgaatacatccacggacgtaaagcgccaaaattggatggggtgagattttcagtattagcattaggagatcaaacctatgaattcttctgtcaaactggtaaagattttgataaccgtttggctgaattaggggcagaaagactttatcatcgtactgattgcgatgttgattatgaagaagacgctgaaaagtggatggccaatgttattaatacgattgattcaacaccagctggtactgaaagtgaacaagttgttagcgaatctataaaatcagcaaaagaaaagaaatatagtaagtctaatccttacgatgctgaagtattgaccaatattaatttgaatggtagaggttcagacaaagagacgagacacattgagttattacttgataattttggtgaagaatatgaaccaggagattgtgtagttgtcttgcctcaaaatgatccagctatcgtagacttacttattagcacattaggctggagtccagaaacacaagttttaattaacgaggatggagatactttaaatcttgaagaggcattaacatcgcattttgaaattactaaattaacaaaaccgttaatagaaaatgctgcgatattttttgataatgaagagctttctgaaaaaattcaagataaagaatggattcaaaactacgttgagggaagggatttgattgacttattaaatgacttcgcaacgacagaactacaacctgaaaatttacatcaattattaagaaagttaccacctagagagtactcaatatctagtagttataaagcaacaccagatgaagttcacattactgttggagcagttagatatcaagcacacggtcgggaacgttcaggtgtttgttcagtacaatttgcagagagaatacaagagggcgatacaattcctatctatttaaaacgaaatccgaattttaagtttccgcaagatgaatcaacacctgtgattatgataggtcctgggacaggtgttgcaccgtttagatcctatatgcaagaacgagaggaactaggttttgaaggaaatacatggttattctttggagatcaacacttcactacagattttctgtatcaaacggaatggcaagaatggcttgaagatggaactttatcaaaattagatgttgctttttctagagatactgataaaaaagtgtatgtgcaacataaaattgtagaaaatagtgaacaatttaatcgatggattgaaaatggcgctactatttatgtatgtggtgatgaaagtaaaatggcaaaggatgttcatcaagcgattaaaaatgtgttaatcaaagagcaaaacctatctgaaacagatgcagaagaatacttaaaacaaatgaaaagagataaaagatatcaaagagacgtgtattaa

SEQ ID NO: 1029 - DNA, 597 bp, Staphylococcus epidermidis
aggtcgacaaaaagagatatgtgcaagagtgaaacacatgaaggcacttcgttcatgaatattttaaacattaaagaaggtcaacactatatagctaaaatagaaagtcatagctttgtagatggtgaaggtgttcgatgcagtgtatatgtttccggatgtccttttcaatgtaaaggttgttataacgttaaagcccaaaattttaaatacggagaacctttcgaacttgaaatgcttgaagagattttagattattgtgcgccttcttatatcgaaggcttaagcatacttggtggagaaccattttgtaatttgtttatcacactccaacttgttgaagcttttagacaacgattcggtcatacaaaaacaatttgggtatggactggctttttatttgaatatttgaaacagcaagacgatgcgcgcaagtcattactcgaacatattgatgtattagttgatggtatgtttattcaacatttatatcgtccgaatcttccatataaaggatcacttaatcaacgggtttggtgcattgatgttcaatcttccttacaaaaagaacaggtcattgaatatctaactaaatag

SEQ ID NO: 1030 - DNA, 255 bp, Staphylococcus epidermidis
aaaaaagcaaatgaagcaacaaatttcaaagccaaaattgaagtcgtttcaacattattcagtactaaatctgatttcactaaaaataactctaagaaagatttattattcttaagtgatgatttatatcattacaaagaaaaacctgaaaacacaaacataactttacaattaagtgagccaaaaattaattctacacgcgcattttatgatgctaataacccattagaatatggagtgcataaacatgagtaa

SEQ ID NO: 1031 - DNA, 696 bp, Staphylococcus epidermidis
tgtatggcaaaagttaaagagaaagttgcagtcgttacaggtgcgagtagcggtataggagaggcgattgccaacaagttaagtcaacaaggtgcatcaatagttctggttggtcgtaacgaacaacgcttaaacgaaatagtccagcaattaaataacccggctaaagttgttacagcggatgtcactgtaaaatcgaacatagatgatatgttaaaagctgtaatagaccattttggtcatatcgatattgttgtgaatagcgcaggtcaaagtttatcatctaaaattacagactataatgttgagcagtgggatactatgatagatgtaaatattaaaggtacactccatgttttacaagcgacattgccttatttgttaaaacaatctagtgggcatatcatcaatcttgcatcagtatcaggatttgaaccgacaaagacgaacgccgtttatggtgcgacaaaagcagcaatacatgcaatcacacagtctcttgaaaaagaattagcacgtacaggcgttaaagtgactagtatttcaccaggaatggttgatacccctatgacggaagggactgattttggggaacgcaaaaaacttgaagcacagaatattgctgatgctgtagtatatgctttaacacaacctagtcacgttaatgttaatgaagtaacgataagacctgtttaa

SEQ ID NO: 1032 - DNA, 2409 bp, Staphylococcus epidermidis
agtatggcaaaacaaaaacttgtaatgattggtaacggcatggcagggttaagaacgatagaagagattttagaacgttcacaatcacaatttgatattactattattgggaaagaaccttatccgaactataacagaattatgctatccaatattttacagaagaaaatgactgtcgaagatacaattatgaatccttatgattggtatcaagagaataatattgaacttataaataatgatccagtggaaaaagttgataaagaaaacaaaatagttactacttctaaaggtattgaagtagagtatgacatttgtattttcgctactggatcaaaagcttttgtgttacctataccaggttcaaaccttcctagtgtcattggatggcgaacaattgatgatacaaataaaatgattgaaattgcccaaacgaaaaaacgagcagttgtcattggtggaggtcttctaggcttagagtgtgccagaggacttctagatcaaggaatggaagtgacagttcttcatttagctgattggctcatggaaatgcaattggatcgtaaagctggagaaatgcttaaagcagatttagaaaagcaaggtatgaagattgaacttcaagcaaattctaaagaaatcattggtgataaagatgttgaagccattaaattagctgacggtcgggtgattgaaacagatttagtagttatggctgttggtatcagaccttatactgaagttgctaaagatagtggattagatgtcaatagaggtattgttgtaaatgattatatgcaaacatctgattctcatatttatgcagtcggtgaatgtgccgaacatgatggtaaagtttatggattggtggcgccactttatgaacaaggcaaagtgctagcagattatttaactggtaaagaaacaaaaggttataaaggatctactactttcacttcacttaaagtatctggttgtgatttatatagcgcagggcaaattgttgaagatgaagatattcatggtgtagaaatttttaatagtgtagacaatatctacaaaaaagtgtatttaagtcatgggcaagtcgttggtgctgtcttgtatggtgatactgatgatggatcacgattttataatatgatgaaaaaacatgaaacgcttgaagattatacacttgtttctttattgcataaaggtgatgaagatgcggggacatctatcgctgatatgtctgatgatgaaacgatttgtggatgtaatggtgttgataaaggaacaatcgtcaatgctataacaactaaaggtttaacgtctgtagatgaagtgactaaagcaacaaaagcaggtaattcatgtggtaagtgtaaaggtcaaataggtgagttattacaatatacattaggtgacgactttattgctgcaaaaccaacaggtatttgtccatgtactgatttaacaagagaccaaattgtaactcaaataagagctaaaaatctcaaatcatcaaaagaagtacgacacgttcttgatttcaaagataaagatggttgtcctaaatgtcgacctgcaattaattattatttaaatatggtttatccttttgaacatagagacgaaaaagattctcgcttcgctaatgaaagatatcatgcaaatatacaaaatgatggtactttctcagtgattcctcaaatgcgcggtggtgttacagatgctgaccaacttattcgattaggagaagttgctaaaaagtataacgtaccacttgttaaagtaacaggttcgcaacgtgtaggtttatatggattgaagaaagaagaattaccacaagtttggaaagatttaggaatgcgttctgcttctgcttatggtaaaaagacgcgttctgttaaaagttgcgttggtaaagagttttgtcgttttggtacacaatacacaactcgactaggaataagacttgaaaaaacatttgaatatattgatacacctcataaatttaaaatgggagtatcaggttgtccgagaagttgtgtagagtctggtgttaaagattttggcgtcatatctgttgaaaacggctaccaaatatttatcggaggtaatggtggtactgatgttactgtaggtaaattgttaacgacagttgaaaccgaagatgaagtgattcaattatgtggtgccctcatgcagtattacagagaaacaggtgtttacgctgaaagaacagcaccatggttagaacgtatgggctttgaaaatgtcaagaatgtcttattaaatcaagaaaagcaaaaagaactgtattcaagaattatggaagccaaaaaagctgttgagaatgaaccatgggaaactattgttgaaaataaagaagcacaaaaaatctttgaagttgagaaggtgtaa

SEQ ID NO: 1033 - DNA, 339 bp, Staphylococcus epidermidis
agcattaaaaagaaagaaaggtggctatgctacatggtcaagcccagacagaggcaatatccaacggtaacctcttatttaaatatagttagggagagcttatttattactatatccggagtattttggatgtattgtatcgttgtgatgattgtttatataggaactcttatcaattctcaaatggaaagtgttataacaatacgtattgcattaaatgttgaaaacacggaaatttacaaattattcggatggatgagtttgtttgtacttattatatttatcttttttacatttagtctcgcgtttcaaaaatataagaaaggtcgtgacatatga

SEQ ID NO: 1034 - DNA, 447 bp, Staphylococcus epidermidis
atgtctaaaaataaaaatgattacgaacatatgctgttttacttcgcgtataagacttttattactacagcggatgaaattattgagcaatatggcatgagtcgccaacatcatcgattcttatttttcattaataaattaccgggtataacaattaaagaacttttgattacgcttgaaatatctaaacaaggatcgcatgcaacgttacgtaaattaaaagaagaaggtttaatcgtcgaacaaacatctaagcaggatagacgagtaaaaaaactttttaccactgaagcgggtgatgatttaataggtaagttaaaccaagcacaagatgaattaattcaacagacactacaaaaagtaggccatgattggtacgcgatgatggaagaactagctaattatcgtgaaggattcaaaacaattgaacatttgaaagaagattaa

SEQ ID NO: 1035 - DNA, 927 bp, Staphylococcus epidermidis
aatatgaaaaaattttggggaattttattaattgtgatgtcaattgctcttgtgggatgttcgaatagcaatgattcagatcaatcttctaatgaaaagtcatcatcaaaaagttcggagaaaaaaacggatgtggcgactgaatatacaaaagaggacgaatataaagaactagaaaaagaagctaaggatcttaaacaaaagccagttcttaatgaaatcgatgcacttattacagaaaaaggttttacaaacaaaacgggattgcaaggctgggaagactataaaaaattagtggataaggtaacacttgcagattataaatacacaaaagaatctaaagggtcatctatagaagaagttaataagttctttaaagataaaaaaggtgtagagattaaacgaatgaaaagtaaggaaaaaaatattaagcatatcaattatatgtatgtagatccagatggtaaaaaaacaggtgaaaataagcaacctatgtcctacgctcaaatacttgcaacatttaaagaaggtaaattagtagctacaaatattcaacctggattttttgctttagacaaaaagaaaatggttaaagctaaagacttagaaaaagttaagacattggaagatttaacgcgtttgaaagatcctaaagcgacatcatatggtattttacagacgaaatataaagggaaaccatacactcaagtttcaatattaggcagtgattctgatgaagagaatgatatttcctcagccatcttagcttattatctattttcaccaacggaattagatagtgacgataatcataaatacgttgaagttgcatcagcgccattcttaagtgctcaaaacgatttttcatcttatcaactaggcgtatttaaaaaaattatcgaaagtagtatgtcgttcgatgaataa

SEQ ID NO: 1036 - DNA, 549 bp, Staphylococcus epidermidis
ggagtgaaaaatatgtcgaatattaatattagagtggcacatgaacaagatgctgaagaattacatagcatcatgcaaattgcttttacacctttaagagaactaggtattgattggccatcagttcacgctgatcttgaaatggtaaaggataatttaagacaaaatactacatttgtacttgaaaatgaaaaagaaattatttcaacgattacggtttgctatgcatggagtagtgtaaaacccatttcaggttatccgttcgtttggtggtttgcaacacgaccaacttatgatggacaagggtatgggagtcaacttttaaaatatgtagaggagacatttttacgcgatactttaaaagctgctgcggtaaccttaggaacatcagcacgtttgcacccttggttattaaacatttacgaaaagcggggttatgaaatatacgctaaacatgaaaatgatgatggtgatttaggagtcataatgcgtaaaattttaataccagaacaatttaatgatgacattttgggccgaccgccattttag

SEQ ID NO: 1037 - DNA, 1269 bp, Staphylococcus epidermidis
aaatttgaaaacttactcttcacattgagacgatttttttataatatatcactcatattgatttttgatattaagaaaagggaggaaacactcatgaaagataataaaatgttgttcattatttttatgataggaacatttacagtaggaatggctgaatatgtagtgacaggattacttacacaaatcgctgacgatatgaaggtttctatttcgagtgcaggtttattaattagtgtttatgctattagtgttgcattgatagggcctttaatgcgaatcataacattgaaagttcacgcccaccgtctgttaccaattttagtagcgatttttataataagtaatttagtgggaatgttagcaccgaattttaatgtattgttattatcaagactcatgtctgcggcaatgcatgcgccattcttcggtgtgtgtatgagtgttgctgcgacagtcgcacctcctgctaaaaaaacacaggccattgcacttgttcaggcaggtttaactattgctgtaatgttaggtgtaccattcggatcatttttaggtggctttgcaaattggagagttgtttttggatttatgattgtgttggcaatcattactatgttaggaatgattaaatttgttccaaatgtttctttaagtgcagaagcaaatattagcaaagaattaacagtgtttaagaatccacacattttaattgtgattgcaattattgtgtttggttactctggtgtgtttactacttatacatttatggagccaatgatacgagatttttctccatttaaaattgtaggtttaactgtttgtttatttatgtttggtctaggcggtgtgatagggaatttaattactggtaatgtaccggaagataaattaacaaaaaatttatacctcacatttcttttactatttgtaacaatcatactatttgttactgttattcaaaattcaatattagcattaatcatttgcttcttattcggttttggtacatttggtacaacaccgttacttaatagcaaaattatcttaagtgcaaaagaagcaccacttcttgcaagtacgttagcagcttctattttcaatgttgctaattttcttggtgcaatcattggatctatattattatcaatagggttaccttacattcaaattactttgatatctggtggaattatagtgttgggtatgcttcttaatcttgttaatcaactttatgaaaagaaacatatcacatttaatgaatattcatga

SEQ ID NO: 1038 - DNA, 933 bp, Staphylococcus epidermidis
gacaaagaaaaatgtaggatacagggtttgagacatatgaagtttgcatatattcaatcgattcgtaatgagatttcaattattttaataattctattattttttgcacttatattttatgtgttttctttaccttttgatgcatacgtactagcaatcagtataatattactattgatgtgtgtacgttggtggataaagtatttaagttttaaaaagaatgaacatcttaaagataaagtagcatatttagaacatgagttagcacatgttaagaatcagcaaattgaatatcgtaacgatgttgaaagttattttttaacatgggtacatcaaattaaaacacctatcactgcctcacaattacttttggagagaaacgaggagaatgtagttaatcgtgttcgacaagaaattgtgcacattgataattatacaagtctcgcattaagttatttaaaattattaaatgaagagtcagatatgacaattaccaaagtgacagttgatgatttgattcgcccgttgattttaaaatatagaattcagtttattgaacaaaagacgcaaatccattatgaaaaaagtgaggacattattttaaccgatgcacaatgggcttctataatgatagagcaacttttaaataatgctttaaaatatgctaaaggtaaagatatttggatagattttgatgttgccaatcaaactctacagattaaagataatggtattgggattagtaaagcagatattcctaaaatttttgataaaggatactcaggatttaacggtagattgaatgaacaatcaactggtataggtctatttatagtgcaacacattgcaaatcatttaaatatacaagtaactgtacaatcagagttgaatcatgggacagtattttttatacattttactaaagaaaaataa

SEQ ID NO: 1039 - DNA, 1665 bp, Staphylococcus epidermidis
atggcggaaaaacaatattctgcagcacaaatggtaattgatactttaaaaaataatggagttgagtatgtatttggtattccaggtgcgaaaatcgactacttatttaatgcactagaggatgacgatattgaattagtcgttacgcgtcatgaacaaaacgcagcgatgattgcacaaggtattggtcgtttaacaggaaaaccaggtgtggctattactacaagtggcccaggggtaagtaacttaactactggtttattaactgcaacttctgaaggtgaccctgtattagctatcggtggtcaagttaaaagaaatgacttattacgtttaacacatcaaagtattgataacgcatcattacttagatcctcaactaaatatagtgcagaagtacaagatccagaatcactatcagaggttattacgaatgcaatgcgtacagccacttcaggtaaaaatggagcgagctttatcagtattccacaagatgttatttcatcacctgtcaaagctgatgcaatttcattatgtcaaaaaccacatcttggtgtaccttcagaacaagaaattaatgaagtgattgaggctattaaaaattctaaattcccagtattattagctggaatgagaagttcaagccaagctgaaacagaagctattcgccgtttagttcaaaaaacaaatttacctgttgttgaaacattccaaggtgccggcgtaattagtcgcgaattagaaaatcacttcttcggtcgtgttggtttatttagaaaccaagtgggtgacgaattacttagaaaaagtgatttagttatcacaatcggttatgaccctattgaatatgaagcaagtaactggaataaagaattagatactaaaatcatcaatgtcgatgaagaacatgctgaaatcactaattacatgcaaccagttaaagagttaatcggaaacattgcaggtacaatagatatgatttctgaacatgtaaatgaaccatttattaatcaagatcatttagatgaacttgaaaaattaagaggcgaaatcacagaagcaactggaattaaagcaactcacaaagaaggtgtgatgcacccagttgaaatcattgaaacaatgcaaaaagttttaactgatgatactactgtaactgtagatgtgggaagccattacatttggatggctcgtaaatacagaagttacaatcctagacatttactatttagtaacggtatgcaaactctaggtgttgcacttccatgggctatttcagctgcacttgtacgtccaaatacacaagttgtttctgtagctggagacggtggtttcctattctcaggacaagaattagaaactgcagtacgtaaaaacttaaatatcattcaattaatttggaatgatggtcgttataacatggttgaattccaagaagaaatgaaatataaacgctcttcaggtgtagaatttggaccagttgattatgtaaaatatgcagaatcatttggcgctaaaggattacgtgtgactaatcaagaagaattagaggcagcacttaaagagggttacgaaactgatggaccagtattaattgatatcccagttaactatgcagataatgttaaattatctacaaatatgttaccaaatgctttaaattaa

SEQ ID NO: 1040 - DNA, 1206 bp, Staphylococcus epidermidis
ttaattggaaaaggagatttgattataatgtctaacaatgaaacaataaccaattatacaattaaacctcatggaggagaactcatcaatcgtgttgttgaaggaaacgaacgtgaacgtttgattgaggaagcattaaaatttaaaccgattactttaaatccttggggaatatcggatctagagctcataggtattggcggatttagtccccttacaggatttatgaacaaggaagactacactaaggttatagaggaaacacatttaagcaatggcttagtttggagtattcctatcactttacctgtaacagaatccgaagcagataaacttgaaataggtgatgatattgctttatatggtgaagatggtcagttatatggaacgcttaaattagaagaaaagtacacatatgataaagaaaaagaagcgcgtttggtgtacggaactactgaagaagctcatcctggagttaaaaaggtttatgaaaaaggtaatatatatttaggtggtcctattaaactattaaatcgtccaaaacatgacgcgttttcaaattatcatctggatccttcagagacgagacaattatttcatgatttaggttggaaaactgtcgtaggttttcaaacgagaaatccagtgcatcgagcacatgaatatattcaaaaatcagcactagaaattgttgatggtctacttttaaatccactagttggtgaaacaaagtcagacgatattccagcggatgtacgtatggaaagttatgaagtgatattaaaaaactattatcctgaagatagagcacgtctagtcatttatcctgctgcaatgcgctatgccggaccacgtgaagcgatacttcatgcaactgtccgtaaaaattatggttgtacacattttattgtgggaagagatcacgctggggtaggcgattattatggtacttatgaagcacaagagctgattactcaatttgaagatgagttaggtattcaaattttaaaatttgaacatgccttttattgcgaagcttgtggtaatatggcaactgctaaaacatgtccgcatgacgcttctcaacatttacatttaagtggtactaaagtaagagaaaaactgcgtaatggcgaatcattgccaactaaattttcaagaccagaagttgccgaagttctaattaaaggtttgcgagaaaaataa

SEQ ID NO: 1041 - DNA, 696 bp, Staphylococcus epidermidis
ggagagtgtttaatgatggctaaaagctatgattatcaaagtgctttcgatattattggaccagtaatgatgggaccttcaagttctcatacagcaggtgcagtaaaaattggtaattcagcgagagctgtgttaggagatatgcctaagcatatagaaattcgttattatgaatcttttgctaaaacgcatcaagggcatggtacagacgttgctattgtcggtggtgctatgggctacagcactttcgatagtagaattaaatcatccttagacatagcaaaagatgaaaatattacaattgatattattgaagatgaaggagaaagtattggtcaacatcctaactgtgcttatatcaaagcaaatacgaaagacggacgttatatagaagtgataggtatttctattggtggcggtacaatcaaactaaaaggtatcaatgtaaatggtttaaatgtggaactgaatcatgggcttccaatgttagttatagatggaaatatgaataaagctaaaataaatcatcttattaatgatttatcagatatggacttagacttaggtgaagaattaatagaaacaaatgataatgaaggtttagttgtatttcctttaaataaagcaatctcagaatcagcattaaatattattaaagataaacatagtgatttaaacgtttcctatatcaaatag

SEQ ID NO: 1042 - DNA, 1074 bp, Staphylococcus epidermidis
agaagtttgaaattatatggtcgtgatattgatcacaactcaccattctataaaggaaataaaagtgttcgcgaaggagatattgtaaaacaagataaactcgctaatacattaactaaaatcaaagataaaggtcctgattacttctatgaagatattggtaaaagtgtttcaaaacaattagataataaattaactgaaagagatttcaaagaatttaaaacagaagaaaaagaagcggtaagtactgattataagaataatcaagtgtattcagcacctaatcctttaggaggcacattaatgcttcaaggattgaaaattgatgaaaaagaaaatgtagacaatatggatcgcaataattttatcacagcaatgattaaatcacgtgatgttatgtataagaatagagacattgttaatggtaatgagcctagtaatgaacaacatctgactgatgattatttacttggtgaacttaacaaagttaatattggtgaaaacacagataatggcagtgattttgatcaaattagaacggataatacaagtacaacccattttgtagttattgataagaatggtaagttagcaagtacgactaatacactatccagttactttgggacaggagactatatgaaagagggattctatatgaataactctttaggcgactttagtaaggataaatcaagtcctaatcatggtgaacctcacaaggcgcctagatcatttatttctccgtcagtaattgttggccctaatttctatatgggtattggtacaccaggtgggaacaagattccaacaattcttaatgaagtgattgtcgattatttaaacagtgatggttcattacaagaatctattaataaaccaagattttataatgacggcggcacgatattttacgaaaatgctatgactgatgaagatataaatatctttaaaagtcttggttatggtgttgaagaaaagcataatgatccaaactttggcagtgtccaaggtgctgtttatgataaagataaaaatactgtagatgtcggtcatgatgtaggtaaccgttaa

SEQ ID NO: 1043 - DNA, 243 bp, Staphylococcus epidermidis
ttccaattgaaccccaataagttttttttctttttttttgaaagcctttggggggctaataaaaagggtaataaaaagggggtgatttccggtgctttttttttttattccataaagccatacctctccaatagtacaactgaaggggatcggtgggtttttcaattgttaattggcgcaataagtcggtgccggaaaccagtggggccacttgctgataaattagggtcgtcaacggtctag

SEQ ID NO: 1044 - DNA, 825 bp, Staphylococcus epidermidis
aatgaattgaaaactttaaatcatttaaacaaaatgaaggcatcacagcaaaagatttctatggttacagcttatgattatcctagtgctaagcaagcacaacaagctgaaattgacatgattttggtaggagattctttaggaatgacagtgttaggatatgatagtactgttcaagttacattgaacgatatgattcatcatggtaaggctgttaaaagaggtgcttcagatacatttatagttgttgatatgcctatagggactgttggtttaagtgatgaagaagatctaaaaaatgcacttaagctttatcaaaacacgaatgctaacgctgtcaaagtagaaggggctcatcttacatcatttattcaaaaagcaactaaaatgggtatacctgttgtttctcacttaggtcttacacctcaaagtgtaggtgtaatggggtataaacttcaaggggatacaaagacagccgctatgcaacttatcaaagatgctaaagctatggaaactgctggtgcagtagtactggttttagaagccatacctagtgatttagctcgagaaattagtcagcaactcactattccagttataggtataggggcaggaaaagatactgatgggcaagtgttagtgtatcatgatatgttaaattatggtgttgatcgacacgctaagtttgttaagcaatttgcagacttttcaagtggtattgatggattaaggcaatataatgaagaagttaaagcagggacgtttccttctgaaaatcatacttacaaaaaacgtattatggatgaggtagagcaacatgactaa

SEQ ID NO: 1045 - DNA, 519 bp, Staphylococcus epidermidis
tacattatgaaaaggtttgcaaaagcatttgtcgtaagtggtattactttaggtgcagttttaggtttaaacgtaacagagcataatggtgtatctaatgaagcaaaggcacaaacagcacacagttactggtataaatataatggttatactgcatcgggtggcgactttgtacttagcaattcattttatcaaggtttaaaagctggaaacgttacatttaatggtattaaggtaaatcaaaaatatgaatctaagactgctactaaaaaaatatacgatcagacatttcaacaaattaatggaaataaagcaaacaacgtacaatttaaaattgcttccagaactgttactttagatcaagttaaacaaaagtatggaaaaaattataattatcagccgtcattatctaaaaacaaaacaagtaagacagatggcttgtacggttatcaagtcggaaaaggaaacatcgttttccacgttaaagatgggtatgtcacaagtgctacattgtcataa

SEQ ID NO: 1046 - DNA, 672 bp, Staphylococcus epidermidis
acatatatgaaaattttcattgtagaagacgatttagtgattgctgaaagtttagctaatgagctatctaaatggaattatgaggtgcatgtggttgataattttgaaaagataatggaagattttcgccgagtagaaccacaactcgtattattagatatcaatctaccaacacttaatggcttccattggtgccaagaaatgcgaaaagtatctcatgtgcctattatgtttattagttcaagaacagataatatggatcaaattctggctatccaaatgggtggcgatgattttatcgagaaaccatttaacttgtctttaacagtagctaaaattcaggcactattgcgtcgcacttatgatttatcaatagctcgtgatgaaatagctgttaaaggttgtaaactaattgttgatgaggccaagcttagcaaggataatgaacatgttcaactttccttaacagagctacagatattaaaattgttatttcaaaatgaaaataaatatgtaagtcgtacagctttaattgagaagtgttgggagtctgagaattttattgatgataatacgctcgcagtaaatatgacacgattacgaaaaaaattactttctatcggtgtcgatgatttaattgagacaaagaaaaatgtaggatacagggtttga

SEQ ID NO: 1047 - DNA, 696 bp, Staphylococcus epidermidis
tcactcatgaatgaatacttacaagcagttctaatgattttgttaactattgttctgtactatgtttccaaaaagattcaagataaatacaataatccactattaaatccagctcttattgcatcaattgcaataattattgttttattggtttgcggagtaagctataaggggtatatgaaaggtggtacctggattaaccatgttttaaacgctacagttgtatgtcttgcatacccactttatcaaaataaaaagaaaataaaaaaatatttaacaattattttcacaagcgtgttgactggtgtagttctcaattttgtgttagtatttacaacgttgaaaatctttggttattctaaagacacaattgttaccctgttacctagatcaattacagcagcagtaggtatagaggtttctcaagaattgggaggaacagatacaattactgtgctctttatcataactacaggtttaatcggcagtattttaggttcaatgcttttacgtatgggaggttttaaatcttccattgcgcgaggactaacttatgggaatgcttctcacgcatttggtaccgcaaaagcattagagcttgatattgaatcaggagcgttcagttcaattggtatgattttaacagcagtcattagttctgttctcataccagtactgattttattgttttactaa

SEQ ID NO: 1048 - DNA, 1350 bp, Staphylococcus epidermidis
gagttaatgaaacaatatgatgtagtatttttaggaagtggtcatgcagcttggcatgctgcgttaacattaaagcaaagtggtaagcaagtagctatagttgaaaaagataccatcgccggtacatgtactaactatggttgtaatgcgaaaattttattagagggaccttatgaagtgcttgaagaagccaaacaatatcctaatattattgatagtcacaatttagaagtgaattggaagaatttaatgcgttacaaagaaaaagtcattaatcctatgtctgaaaccctcacatcgatgtttgaacaacaggaaattgatgtaatcatggggaaaggtaaactggtagatgctcatacaatagaggtaaataatacaactttacaatcagattatattgttatagccactggacaacatagtcatcaattagatattgagggtaaagaatatacgcatgatagtcgggaatttttatcaatgcaatctttaccggatagtatcacttttattggagcaggtattatcagtattgaattcgcttctatcatgatcaaatctggtgtagaggttaatgtgattcatcatacaaatcaggcacttgaagggtttaacgaatcacacgtcaataaattaattcaaaagttaaaagatgaaggtgttaaattttactttagtgagaataccaagtcagttaaaccgaatgcgcaacgttttatagtagaaactgagtctggaaaaatgattgaaacagattatgtactggatgcaaccggtagaaagcctaatgttcagcaaataggtttggaaaaagtgggtatacaatttagtgatagaggtattgaggttgacgattatttaagaacaaatgtgaaaaatatatacgcaagtggggacgttatcaataaaatgattcctaaacttactcctacagctacatttgagtctaattatatcgctgcccatatccttggattgaatacagatgctattcagtatccaccaataccttcagtgctttattcattgcctcgtttatctcaaataggtgtcacagttagcgaggctaagaaagatgatacgtatatgattaaagatataccattcggaagacaaatggtatttgagtatcaaaacgaaacagaagctgaaatgtcaattgtattagatagtcacaaacgtttagtaggagcagagatttatggtaatgacgctggtgatttggttaatctcctagtttttatcattaatcaaaaacttactgcacaagacttaaataaaaatatttttgcatttcctggagcttctagtggtgttatagatttattgaaattggcgatgatgtag

SEQ ID NO: 1049 - DNA, 1146 bp, Staphylococcus epidermidis
attaaaatgaacatgaaaaagggtgtttctcagcttacgttacagacattgagtttggtcgcaggctttatggcatggagtatcatttctccattaatgccatttatttcacaagatgttgatatttctccaggacaaatatctgtcattttagctattcctgttattttaggttctgtactacgtgtaccatttgggtacttaactaacattgtaggagcgaaatgggtgtttttctggagttttattgtactattacttccaatttttcttttaggtcaagctcaatcacccggtatgctaatgttatcaggattctttttaggaattggtggcgcatttttttcagtaggtgttacttcagtacctaaatacttttcaaaagacaaagttggtttagcaaatggtatatatggtgtaggtaatattggtactgcagtttcatcattttgtgccccagtgttagcaggtgcaattggctggcaaaatacagttcgtagttatttaattattctaagtatatttgcaattttaatgttttttttaggagataaaaatgagccgaaagtgaagattcctttgatggctcaagtcaaagacctatctaagaattataagttgtattatttaagtttgtggtattttattacttttggagcttttgtggcttttgggatttttttaccgaactttctagttgatcattttagtattgataaagtggatgcaggtattcgttcaggtatatttatagcactagcgacgttcttaagaccggttggtggtgttataggtgataaatttaatgcagtacaagcgcttatcatcgacttcgtgataatgattattggtgcgcttatattaagcttatctagtcatattgttctgtttacgataggctgtttagcaattagtatctgtgcaggtataggtaatggtttaatatttaaattagtaccttcatacttttctaaagaaaccaggttcagcgaatggtattgtatccatgatgggaggaataggcggtttcttcccaccactggtgattacttttgtaacgagtatcactggttcaagtcatctcgctttcttcttcttggctatatttggtgtaattgctcttattacaatgattcatttaaataa

SEQ ID NO: 1050 - DNA, 468 bp, Staphylococcus epidermidis
attgaaatgaagggatgtcttatgttaattagcgatacaaataaaacatatataatagaagaaactagtaattcattcacaattgaaaagaataatgatcagcagcactacgaagtattagaatcaatcaacagcttatctaatgattcattttgtgtgttaaatcacttattcgtcaatggaggtaatgaagaggtttttgagtcacggtttttaaagcgaaatcaacatttgcaagatgtgcctggttttaaagcgttaagatttcttagaccggtagtcaaagggagacattacattatcatcacgctatggaacagtagacaagctttctatgattggcaaaattcacaagcatatgcgcaaactcataaaaaacgtggaactcaaaaaggtgttgatcatcgtatagtcaatagagatttatcctataatataagaatagagttagaaagtcttaataactaa

SEQ ID NO: 1051 - DNA, 174 bp, Staphylococcus epidermidis
ctagaaatgaaaaactatagtcatagaaaattggctgtagaacctatttggggatttatgaaggttattttgggtttcactcaagtgtcagctcgatctataaataaagtcaaagggaaaaaatttttattaatggtgcttaatattaagaaaaatagcgactcagagatttga

SEQ ID NO: 1052 - DNA, 1617 bp, Staphylococcus epidermidis
aaagggatgaataaaaatattaaaatgaaaaacaaacgaaaaataaacaatacgcttgtttatactatctctgttttaattattgttgttattactcttattgcgggtatctttcctaaagcatttgggatgtatgcgcagagcgtttatgattggattacaaattggtttggttggctattccttatcattgtctttattttagatgtatttttaatattcttagctttttctagatatggtcgatttaaacttggttcggatgaagaagaaccagaattttccatgctatcttggattggcatgttattttcagcaggtcttggcgtcggtatagtcttttggggtgttgcagaacctttaacgcattatctccattcacccttccctggaaaaattgcagatcactctgaagaatcagcacgtgttgcgatgggatatacattcttccattggggtatttcacaatggtcaatatttgcaatttcaggattaatcgttgcatactttcaatttagaaaacaacgtaacgggcttatttcaacagctatggaacccgtttttggtgaagcttataaacgtcctttcaggaatattattgatatattagctattatcgcaaccgtcatgggaattgctacgtcgattggtttgggaattatgcaaatcggtggtggattaaaccatctctttgatgttcctaataataatttcactaaaatcttaattactattttgatggtagccatatttttaggatcttcattaactggcttaaatcacggtgtaaaatggttaagtaatttaaatattttattaggtgctattttacttatatttattttgatttttggagatttaaaatttattttagaatcatacacactagcaatttctgattatttgcagcattttatagaatatagtttacgcgtaaatccatactcaggagatgatagttggattcaacagtggactgttttctattgggcttgggttatttcttggtccccttttattgggggctttgtagcaagagtatctcgaggacgtacaattagagaatttgtcgtaggtgtactcattattcctcctctaatttcgtttacatggattgcaggttttggaggtacagctattaaacttgctttaaatcataacgacaagcttgttcatattgtagataaagattatactgttgccttgtttgaattattatcacattttccattgtcggaagtcactagttccttagctattgtacttattttcatctttattgtaacaagtgctgattcaactacgcatattgttgcaggtatggctacaggtggttctatcaatccaactttaaaacataaagtcctatggggtctacttattggggcgatttcagttgctatgacaattgcaggtggtcttaaaagtttacaaactgcatcagttattacaggtctaccattctctatcattttattattaatgatattctcactcatgagggctttaaaaagagaacccatccatcattttaaaatgacatcaattgatgatgaaaaagattactctatttcattagaagagcgtgaaaaacaggacgaacaagataacaagtaa

SEQ ID NO: 1053 - DNA, 1494 bp, Staphylococcus epidermidis
acgatggtgaaagaagtagttctaggaattgatttaggcacaagcgcaataaaaattattgctgttgatcaactaggaaatgtcattgaatcagtaagcgaaacattaaagttataccaagagcatcctggttatagcgaacaagaccctaatgaatggtttgaggctactaagaaagggataaaagaattaattcaatcaacagaaatgtcagataagatagtaaaggggatttctttttcaggtcaaatgcatgggttggtcatagttgatgataatggcattcctttgagaaaagcgattttatggaatgatactagaaattcaatacaatgtagacaaattgaagatatatatggtgaaagattgaattacaatccgatattagaaggatttacacttcctaaaatgttatgggtacaacaacatgaacctgaaatttggaatcgagttgatgtttttatgttgcctaaagattatttacgttattgcttaacgcagacaattcatatggaatatagtgatgcatgtagtacattattattcaatcctgagaattatgaatggacaagagatgttggagatacatttaacattggtgatatctatccacccttagtaaaatcacattcgtatgttggaaatgtaacttcatcactggctaaagaattaggattatctagtgatgttgctgtatatgctgggggtggtgataatgcatgtggtgcaattggtgctggtgtcatccatgataaaagtgcattatgtagcataggtacttcaggtgttgtattaaatgttgaataccaacgtgtgacctcatatgatagtaatttacacttattcaatcatagtgttccagatacttattacgcaatgggagtaacgttggcagcaggctatagtttaaactggttaaaacaaactttttttgaaaatgaatcttttgaagagattttaaatttagctgcatcttcaaagataggtgccaatggactactatttacaccttacttagctggagaacgtacgccacatggtgatgctcaaatacgtggaagttttataggtatcagtgggcaacatactaaagctgactttgcgagagcagtaatcgaaggcataacgtattctttatatgattctataaagattatgagacgagctggtcatgaaatgaactctatcacttcaatcggtggtggtgctaagagtagattttggttacaacttcaagctgatatttttaatgtgcaaataaaaagattgaagcatgaagaaggcccaagcatgggagcggcaattttagcggcatacggtctaggatggtttaaaacaattgagtcttgtgtagaggcatttattaaagtagacgaggtgtttgagccgaataatgaaaatcatgacctttatgaacaatactattcagtttatgaagctatatataaacaaacgaaacagcttactgctgatttgttaacgataacgaattaa

SEQ ID NO: 1054 - DNA, 138 bp, Staphylococcus epidermidis
actaatacgaataaagtcagtaatcactgtaatcaagatattatttatcattatttcgatttacttaacctatatcattacatcacaatatcacttggtattgttgcgaataaaataaaaaagactttacttttctaa

SEQ ID NO: 1055 - DNA, 1101 bp, Staphylococcus epidermidis
ttaatcacgaacaaggagcgcgtactaatgacaaagaaaaaacgtttatcgcctagtgagtggttgcttaaacaatctaaaagacataaaaggaaaaatacactttacacggcaattgtacttttagtagcgttagttctactcatatttgctgttaaatcaatacaagtagaacctgtaaaaagtgatacgagagacaaagatagcattcgtatcacctatttaggtaacgtcactttaaataaacatattcgacaaactaacttgaatgatgtttttaaaggtattcaagatactttagatcatagtgatttttcaacaggttcattaatagtaaatgatttttcaagaaatcaaaaagataacataaataaaaatattgaaaatatcatgtttctacgcaagcataatgttaaaagtgttaacttaatcaacgaatctatggataatattcaagcgacagcaatgatgagaaaaatagattcccaagcaggttataattttttaacaggtaatggttcaaatccaattaatagtaaaactgtacaacaagacattaaaggtaaaaaaatagctaatgtttcatttaccgatatcgaatctaactatactaactctttaaaaaacacgacgtcaattagtttagatccagctatattttatcctttaataaaaaaattaaaggaaaataatgattacgtcgtagtcaatgtagattgggggatacctaatgaacgaaatgtgactacacgtcaaaaagaatatgcacatgcgttagcgaatgctggtgcagatgtcattattggtcataatacagttattcaaaaagttgaaaattataagcgaacgcctattttttatagtttaggtaacacaacgtctgataacttcttatcaaaaaatcagaaaggaatgattgtacaacaagactggaaaggttcgcataatcagttccatatcacaccaattcaatcaaaagatggaaaaatctctaaagataatatgaataaaatggatcatattcgattcaaaaataacattaaagataaatcaattgatttaaaatctgatcaaaatggaggttatacttttgaatattaa

SEQ ID NO: 1056 - DNA, 420 bp, Staphylococcus epidermidis
gaagggacgaataagatgaagaaaacagcagtattaaatagtcacatttcaagcgcaatctccacactaggtcactatgatttattaacgattaatgatgcgggtatgcctatacctaatgatgacaaacgtatagatttagcagtgactaagtcattgccatgtttcattgatgtgttggagacagtgttaactgaaatggaaatacaaaaaatatatttagcagaagaaattaaaactgcgaatgcacagcaattaaaagcaattaagaaattaatcaatgatgatgtagaaattaaatttattgcgcattctgagatgaaagaaatgttaaaatctcctttaaataaaggaaatatacgtactggtgaaatcacccctttttctaacattatcctagaatctaatgtgactttttaa

SEQ ID NO: 1057 - DNA, 900 bp, Staphylococcus epidermidis
tgtattaagaataagaggatgtatatgattaagcaaaattttacaactaaagtttatccacttaaacaatttgagggagagtatagtgaagttgcctacgcaggagatagccaagctgatgatgtgattgtatttattcatggtgcactcttaacatataaaattatgacgatgttcgagccttacttcagagattacaaattaatatttattaattgtccaagtcgtggtaaaagttcagatttagatcgtgacacacatacattagatgattacgctgcacgtatatatgatgtattaacgcaaattgttaaggagcaacaaataaaagaactgagtattgttggttattcaatgggtggaatgattgcgacacgattacttaagtacaatacattaccagtctctcatcttatttatttacatagcgcagcgaaaattactccagatgcaagtatgttagcacgattattcactagtgagagtaagagagcagtgttaaaagatgaaattaaggcagtaaaaaatcttcctcaatatatactagataaaacgatttatgcacaaaaggaaaacgcacttgatttggtacaatttattgcaccaattaaaactataattacggatatgatctacacgattaatacagattatttaccagatatcgatgagattaaacaatttccgaaaatattatttatgtctggaaaagaagatcaaattattccttatacggattctcaagctacgttagaaaagtttaaggcgttaggtggaaaaactaaagaagttatttatccaggaattggtcatatcgatttcccaagtgttttagaaacccaatcagatggacaaactggcgtggtagatgaaattaaagcgtggatttcaaaaaaataa

SEQ ID NO: 1058 - DNA, 213 bp, Staphylococcus epidermidis
ttcgctaagaaagaatataaaaaatcctccaacgaagttggctcgacttcgttggaggtatcaggggtaggggttaattttgtttctaaatttatttactctaatttaatattaattaaggttttgagtatagggagaaatattttatacttatttattttctcttcatcatttttatattttacagggaaagtattttatttagattcgtaa

SEQ ID NO: 1059 - DNA, 126 bp, Staphylococcus epidermidis
atttttgagaaaaaattagttgaaattaaacgactttatagatgtaatatgacgagaagatgggtgaaaagagtattatttttaatagatttgattctattagacgtctatacaataatcgaataa

SEQ ID NO: 1060 - DNA, 870 bp, Staphylococcus epidermidis
gagggtgagaaaatgaatgaacaatggatgagcgcattgccacttgacaatgtgaaagacatttctccagtaagtggcggagatgtaaatgaagcatttaaagtcactacagttgaagaagatattttttttctactcgttcaacgtcaacgatcagaagccttttatgccgcagaaattgcaggactaaatgaatttgaaaatgcaggtataacagctccaagagtaattgcaagtggagagataaatggagatgcatatttattattaagttttcttgaagaaggtagtcaagggagtcaaagagagcttgctcgattagttgctagaatgcatagccaataccaacaagataataaatttggattccgtttaccacatgaaggtgcagatatttcctttgataattcatggactgagacatggaaagagatttttataaatcgtagaatggatcacttacaagatgagttattacgtgtaggattgtggaaacaagaagataaaaaaatgtatgaacgtgtaagaaaagttattgttgatgaactttcaaatcatactagtaagccctctctgttacatggtgatttatggggaggtaactacatgttcttaacaaatggccaacctgctttatttgatcctgcaccactatatggagatagagaatttgacataggaatcactacagtatttggtggatttacacaagagttctatgatgaatataatcaacagttaccactagccaagggatcacaaaagcgtatagaattttatagattatatttacttatgatacatttacttaaatttggaggtatgtatgctgatagtgtacaacgctctatgaaaatcattttagaataa

SEQ ID NO: 1061 - DNA, 1809 bp, Staphylococcus epidermidis
atgaacgagaacaattatagacgtctcaacaaaacttataaaccgcactatttgcctggtttagatggtttgagagctatagcagtcattgggataatcatttatcatttaaatacgaaatggttatctggtggattccttggagtagatactttttttgtcatttctggttatctcataactagtttattattaagtgagtattatagaaataattctattaatttagttaatttttggcttagaagatttaaacgattaataccagcaatgatgtttgttgtcacggttgttttaatatatacattactatttaaacccgaattaattattagtataaaacatgatgctatagcagcacttttctatgtttctaactggtggtatatcatacaagacgtagactattttaatcaatttgctgtagcgccattaaagcatttgtggtcattagctattgaagaacaattctatctattctttccatttatacttttaggcttattaaagtttttcaaaaagagaactacaatgattattctattaatcatctctttattatcattaactgcaatgataacgatacatatgtatacaggtaacaattctagagtttatttcgggactgacacacgtttacaaacgttattattaggatgcttactagcatttatttggccaccgttctctttcagaaaggatatatctaaaggtgctaaagcaagtataagtgcaataggcatagtcggaatggcagtgctcatttatttgtttgtagtggttagtgatcaagataaatggatatatagtggaggattttatgccatctcgttcttaacactgtttgtcattgcaagcgttgtgcatccatcaagtgttttaaagaaaatactaagtttcaagttatttatttatataggtaagagatcgtatagtttatatttatggcactatcctatcattatttttatgaatagttatttcgtacaaggtcagattccttggtttgtatatatttgtgaagtgatacttatgtttgtcatggctgaagtatcttataaatttatcgaaacacctattagaaaaaatggatttaaagcattcacggtgataccgaaaaatttaacaagattttcaagaacgattattgtgttaatcttgcttgttccttctgcattcatagtatttggtgcctatgatagtttgggtaaagagcatgataaacaacaagctgcgaaacaaaaatcttttaaaacgaaccagaaagcaaaacctaaaaagccagatgaaaataatcaagataagtcttcacaacaacattttaatcctaaagaagcgtctccattattgctgggagattcagtaatggtagatatcggtcaagtctttagtgaaaaagtaccaaatgctaatattgatggaaaagttggccgacagttaattgagggtaaagatttaatcaatcaaaagtaccaagattatactaaaaaaggtcagagtgttgtgatagaacttggtacaaacggtgagtttacgaaagatcaaatgaatgaattaattgattctttaggtgaagcagatatttacttaattaaggtaagagtaccgagagactacgagtctactaataataaaattatggaacaagtagctaagaaacataaaaatgttcatattgttgattggtataaaacatctgaaggtcattctgagtattttgcatatgatggtattcacttggaatacagtggtgttaaggcattatctaatgaaatcattaagaaaatgaaagaagttaatgaaaaataa

SEQ ID NO: 1062 - DNA, 693 bp, Staphylococcus epidermidis
aagaggtggaaaatcatgcttaatcaatttgtatgggttatttatccatatttatgtttagcaatatttgttattggacatatcgcaagatataaatatgatcaattttcatggacagcaaagtcgagtgaaatgattgaaaagaaacgattaaaatggggaagtttactttttcatttaggtattattccggtattctttggtcatgttgtgggattattgattcccgctaattggttagaggcgataggagtaaataatcatatctatcatataggtgcagtttatataggtagtgtttttggtataataacattaataggaatgttgttgctaactttaagacgactatccatcaaaaacgttagacgattaagttcattttcagatatatttgtgaatatcgttttgttgattattttaataatgggttgttattctacgcttgtaaccaatgcgattcaacctgaatttgattatcgtcaaaccattgcgatatggtttagacatttattcatgttttctccaaatgctgacttaatgttaaacgtgccttggtcgtttaaactgcacatattattagggtttacagtgtttgcgtgttggccatttactcgtttagtacatgtttggagtgtaccactgtcttatatgaacagaagatatattgtttatcgcaaaaacaaaatttaa

SEQ ID NO: 1063 - DNA, 234 bp, Staphylococcus epidermidis
gtacttcgtttctttttaggaggatttggagcacacagattttaccatggtaaagtaggaagtggagttggattattagtcttaacattattaactgtttggtttacttttggaattcctactttaatatgggctattattgatgcttttttaattccaaactgggttaaagaagatgaagaaagaatacgtcagcaagctttaagcgaagtaaaattaatgaaaaataaataa

SEQ ID NO: 1064 - DNA, 216 bp, Staphylococcus epidermidis
ttggaatacctaattcatgagtacgtcgacttaatcgagctacttttaattgtaattcttctagtttccctgacatcgtttcaccctctatatatgttaaagttagatgttatattgttatattttaacatagaaaaatctcttcaacgttctaaacgtcgaagagatacgaagctttatcccataaatttaaaaatatcattctcatacaaatga

SEQ ID NO: 1065 - DNA, 153 bp, Staphylococcus epidermidis
cttatttttttgcatcatactcccaagattaatatttactatattcattttgctttttattcaattcaactatgttattctgtacatagattaactagtatcactaggggtgcaattcaatttgctgagagaaagtttactttcaacccttga

SEQ ID NO: 1066 - DNA, 198 bp, Staphylococcus epidermidis
ctaaaatttgattcgcttcaatcacaatatgacctctctttcatctacataacacattatttaataatattatatattagcgaatatataaaggaaatatcgaatgtacaagacaattcgactttaactcttaaaaaattaaaaaaagcgaccgaatttgaattgcgtgtatttccacattttaacaacaagtcctaa

SEQ ID NO: 1067 - DNA, 129 bp, Staphylococcus epidermidis
atggcacttgactatacgcacttatctgccatcttatttaatcataccatacttaaacgtgcaccctatttatacaatagtacatatgtggcgaactttactgtttattttttcggtaaaatcatctaa

SEQ ID NO: 1068 - DNA, 1356 bp, Staphylococcus epidermidis
ttgaaaattgatcaaacacttacatcacgaattagacaacttgaggcttatatcatgaaacaatttttaaacatcactcaacgtaaatttatcgaatggttgattatcttatccatttttatagttagcattcctaataaatggacattaatgatatctatcgctttatctttattacttcttaaaagaggggcgctaggtgtcgttcaattaatcatactttatatgctcagatcgcaaatatacactccctatgatacacaagagatggcgcattacatagtaagtatgaaatatatcttgatttatgtaattggagtattttttctatttaaatatgtaaaacattggataagaaatgaaatgatattaagatttatcaagtctactatgattcttatgctactttatatcataatgagtttagtcgtatctaatgatccgatagaatctattcttaaattgcttaacttctttataccgctaattttgattgttatgtatgttagtttaataaaaaagataaagaatctcattaactggattaatcaatttatcacgctagtgattgcctttacttttttatttatagttatagcgccaaaatcatatttaattgatgaggaatcacttagaagtgttttcaaggatgcacattcattcgcagttattcttgctatgggtctagttctatatatggtaacaataatcaaacaacaagattatgatgtattcaatttattattattaaatattggaatgatagagctctatttatcaaactctcgtcatattttcatatctgttattttatgtctaatgcttctattaccgttatctcacataaaaaagagaattaaacatcccataattggtgctatgatactaatggcaattgctataataaatcaaccatatatttatcatctttttattaaactaatcttaaaagggaagaatagccaagaggtctttatgccgagtgatatgaatattaaagctattgattatgcgctaactgagcatccttttttaggaagcggttttggtataccaatgataaaagcgagttcagaaatacaatactttaatgtagcaacgagtaatatcatcttcggtatgattatctttactggaataataggacttactttatgtacgatatacatgcttcatatggtacttttagttacttttccaatgagtattactattttattatttttaatcactatctttgttaatatggattatattattttatttgattccgtggggctaggtatattgtgttatatattttggggaatatatttaaaagaaggtatgtatcaatacaacaacggacaatggtaa

SEQ ID NO: 1069 - DNA, 705 bp, Staphylococcus epidermidis
gcaatgattgaacatttaggaattaatacaccttattttgggatattagtatcattaataccatttgtcatagcgacttatttttataaaaaaacgaatggtttctttttactagcacctttattcgtaagtatggttgcaggtattgcttttttgaaattgacaggaattagttatgagaattataaaatcggtggcgacattattaatttcttcctagaaccagctacaatatgctttgcgattcctttatatcgcaagcgcgaagtattaaaaaaatattggttacaaatatttggtggtatagctgttggtacaattattgccttgttattaatttatcttgttgcaataacattccaatttggcaatcaaattatagcatctatgctacctcaagctgcaacgacagcaattgcattacctgtatctgacggtatcggtggtgtcaaagaattaacctcactcgcagttattttaaatgcagttgtcatttctgctttaggtgctaaaatagttaaattatttaaaatatctaaccctattgccagaggacttgcactagggacaagtggacacactttaggtgtcgcggcagctaaagaattgggtgagactgaagaatcaatgggaagtattgcagttgtcatcgttggcgttattgttgtagcagtagttcctatacttgctccaatcttattataa

SEQ ID NO: 1070 - DNA, 1791 bp, Staphylococcus epidermidis
atgaggattgacgttatgcttaatttatttattttattacttgaacgcgtgggattaattattttactcgcatatatactcatgaatattaatcattttaaaacaatgatgagcgaacgtgacaaatggcgttcaaaattccaactaatcattatttttggtatattctctatgatttcaaattttacaggaattgaaatagaaaatggccatatcgtatctggtgatatttattaccacttaagcaaagacgcctcaatggccaatacccgtgtattaacaatcggtgtttctggtctaataggtggaccgtgggtagctataattgtaggcattatttcaggattatgtcgtttatatattggcggggctgacgcatatacctatcttatttcatccatagttatcgctatcatatctggttactttggtcatcaaacaataaaacaaaatacatatccgtccattaaaaaaggtgctattatcggtgcaataactgaaattattcaaatgggctgtatattattatttacaaataacttacatcacgcaattacattagtcagttttatagcactaccgatgattatcattaatagtttaggtacagccatatttttaaccatcattttgtcgaccatcaagcaagaagaacaaatgcgtgcagtccagacgcatgatgtattacaactcgctaacgaaacactaccttactttcgatctggacttaatgaaaaatcagcccaacaagctgctgaaattattttaaaattaatgcaagtgtcggcggtcgctattacaaataaaaaagatattttaacacatattggtgcaggcagtgaccatcacgtagcacgtaaagagataattactgatttatctaaagaagtgattcaatctggaaaattaaaagtcgctcatacgagagaaggaattggatgtcaccatcctaattgccctcttgaaggagccattgtcgtccctctttatatacataatgaagtcgcagggactttaaaattttatttcacagataacaatattatttcaacttcagaccaacagctcgcaaaaggtctcgccaatatattttcctcacagctagaactaggtcaagctgaaatgcaaggacaattattgaaagacgctgaaattaaatcattacaagcacaagtcaatccacatttcttttttaatgctattaacactatatcagcactagtaagaattgatagcgaaaaagcacgacgtttactgattcaactcagtcagttcttccgctctaatcttaatggtgcacgtaataatacgattactttacaaaaggaattacaacaagtagcagcatatttatccttagagcaagcgcgctatccaaatagatttaacatacactatcgaattgatgatcagtgtcaagatgcgctcatcccaccttttataattcaaatattagtggaaaattctattaaacatgcatttaaaaatcgtaaaaagaataatcatattgatgtggatgttagcatgaagcaagactacttaagtatatctgttcaagataatggtcaaggcataccagctgatcaattagatactattggatatacgacagtaacgtctaccactggtactggtaatgccttagtcaatcttaataaaagacttactggactatttggaacaacatcggcactgaacattcaatcttctcaatcaggcacgactgtaagttgtttaattccatataaatcttctaaggaggaacactttaatgaaagcgttaatcgttga

SEQ ID NO: 1071 - DNA, 144 bp, Staphylococcus epidermidis
aataaacatgattgtcgtaatgagattatagtttttactttcttccatcgatttccatactcctttctaaattttattcaatacgattattatgacagtttgtttcaaattcctaaagagatatttaaattgacgaaaaattaa

SEQ ID NO: 1072 - DNA, 543 bp, Staphylococcus epidermidis
tggtttaatgagaaaattttaactgtgagcatatatattgtgaatatatgcgagtcattttacactataatcaatcgtgcgcgattgaaaagaggtggatatgtgaaacaagaacaaatgaggttagcgaatcagctttgtttttcagcatataatgtaagtcgtttatttgctcaattttatgagaaaaagttaaaacagtttggtataacttattctcagtatttagtattactgacgttatgggaagagaatcctcaaacattaaattcaattggtagacatttggatttatctagtaatactttaaccccattactaaaaagacttgagcaatctggctgggttaaaagagaacgtcaacaatctgataaacgacagttgataattacgttaactgacaatgggcaacaacaacaagaagctgtttttgaagcaatttcaagttgcttaccacaagaatttgatacgactgagtatgatgaaatgaaatatgtgtttgaagaactagagcaaacattaaaacatctcatagaaaaataa

SEQ ID NO: 1073 - DNA, 1377 bp, Staphylococcus epidermidis
aaggaggacctcataatgaaatatattgtggtaggtacatctcattcaggatatgaagtgatccaaacattgcttaaagaagatgaaaatgctgatattcaagtttttgaaagtgcagatcaaccgtcctttttatcttgtggtattcaaagttatcttgaagacatctcatcatcattagatgatttacattacgcatcagttgactcttataaggcacaaggtgtaaatattcatacgaatagcacagtcacagatttagatactgacaataagactgttgtagttgaacaccaaggtcaaacagcaacttattcttatgataaattgttcctaagtcctggtggcaaacctgttacccctccagtcgatggaattgaaaaatataaacatgtattatttatgcgtggacgtgattgggcaaatcaaattaaagaacgcatgaaagatgccaaaaaggctgttgtagtcggaggtggctatatcggtattgaagctgctgaagcttttgctaaagcaggcatagatactacaatcgtagatgtcgctgatcgtatattaaacacttacttagataaagaatttacagacatattagaaacaaatgcacagcaacatggtcttcattttaaaggtggcgaaacagtaaaatcaatttcaggaaatcaaaatggcgaagtaactactgtagttaccgacaaaaatgaatatgacgcagatactgtcttatttgctgtaggtgtcgaaccagctaccgagtggctaaaagataaaattgatttaggtaagaaaggaattataaacattaaccaccaacaacaaacatctgctaaagatgtctatgcgggtggcgatgcgacattagttccttttgcaccagtatctgaggatcgttatattgcattagcaacaaattcaagacgtcaaggcgttgtcgcagcaaaaaacatgttgggtaaagaaatgacaatgccacgcgtttctggtacttcaggtttacaattatttgattataaatttggacaaactggcattcacggtacagaaatcgataattatgatggcaatttaggtcaaacatacgtagaagaattgattcgtcctcagtttatgcaagatgatacgaaaattcatatgaaaattatttatgataaagacactcaccgtatacttggtggtcaagtcatgtcaaaagaagatattactgcttctattaacacaatttcagtagtaatatctgctggtttcacacttgaacagctcgctgtccaagatttcttcttccaacctgattatgatagaccttggcattatcttaatgtgttagcccaacaagcattgggagatacatttggtagcgataagatgttattctaa

SEQ ID NO: 1074 - DNA, 135 bp, Staphylococcus epidermidis
ttaggtaatgatgttccaatcacccgaattataagtaataataaatatacgacaatcgcaactattacaattttaattattttattctttgcaattatccattgttgcttcatcacatcatttattacagattga

SEQ ID NO: 1075 - DNA, 276 bp, Staphylococcus epidermidis
acaaaaaatgagcaagttgagcaatttttagctaaagaaagccaatggcaagattgttataaatttttgagaaatttaatttttaatgaaactgaacttgaagaaaattataaatggatgcatccttgttatacgataaacaataaaaatgctgtgctaatacatggatttaaaggttatgtagcgttgctttttcaaaaaggagcaatacttgaagaaaagtatcatacattgattcaacaaactgaaagactacaggctgaagctgtcccctaa

SEQ ID NO: 1076 - DNA, 1632 bp, Staphylococcus epidermidis
tgtttagatgaaagtgaattgaaaggaagtacacttatgaataaatcaaatttactagcacctgagaattataatattgttacagaaatagaaaaatatgcctcagaagatcataaaaaagccattatttacaaggataacgagcatgaaaatatttctgtaagttataaagaacttatcagtaatgctaataaagtagggaatgtattcctcaatcatgggctaaaaaagggagataaagttctcatcatgatgccacgtgcaatcgttacatatgaattatatattgcagcattgaaactagggatagcgattgttccaagttcggaaatgttacgaacaaaagatttacaatatcgaattactcacggtgagattgatgcagttatttcatttgattctctaactaaagaatttgaaaacgttaaagaatatgaccaattaaaaaaatttatagtagctggtcacaaagaagattgggtttcaatagaagatgaaaaagaaaaagtaagtgatgaccttaaaggcgcagatacaacacgagatgatttggcgattctttcttatacatcaggtacaacaggcaatccaaaagcagtaacgcattcacatggatgggggtatgcccatttacaaatggcaccaaaacattggttatgtatacaagagaatgatcttgtatgggcaactgcagcaccagggtggcaaaagtgggtgtggagtccatttttatctgtattagggatgggagcaacagcatttgtctataacggtcgtttccaccctgaaacatatctcgagttacttcaaaattatcaaattaatgttctatgttgtacaccaacagaatatcgtatgatggctaaacttagtcatttagaacagtacaatttagagtatttacacagtgcggtgtctgcgggtgaacctttaaatcgagaagttgttgaacaatttaaacgtcattttaatattactgttcgagatggatatggacaaaccgaaagtacattgttgatcggatttctaaaagatactgaaccacgtatgggttctatgggcaaaggtatacctggtagttttgttactgtcattgacgatgatggtaaagaggttggtccaaatgttaaaggtaatatcgccgtgcctttagacttaccggctttatttaaaggttactttaaagatgaagcacgcacaaaagcagcttcaacaggtgattattatgttactggagaccaagctcatattgataatgatggttatttctggttcgaaggtcgccgtgacgatattatcattagttcaggatataccattggacctttcgaggtagaagatgcactaacaaatcacgcagctgttaaagaatgtgcagttgttgcaagtcctcatgacattcgtggaaatattgttaaagcatttatcatcttgcaagatgattatgaagcaagtgatgagttaatccaagaattacaagtattttgtaaaaatgaagtagcaccgtataaatatccaagagcaattgaatttgttgaacatctaccaaaaacaaattcaggtaagatacgtcgtgttgaattacgtgacgcagaaataaaaaaatataaacaacaagattcatcacattaa

SEQ ID NO: 1077 - DNA, 147 bp, Staphylococcus epidermidis
ttttgttgtgaaattttaataaattcacttttcattacctcactttatgttttacatttaaattcccataaagttttatcatcaaacacgtacagtaattatattagaaaatctaatatgctattgtttaatcaaactaagggatga

SEQ ID NO: 1078 - DNA, 306 bp, Staphylococcus epidermidis
ataccgagtgaggttaaactcaaaaagttcctaaaaatcattcaaaaaacaattcattacatcaatcatcatttagaaagtgcaattgaaatttactcaacgtatactcaaaccgatatctctaaccaattaaacaaagatacaattgaagcaacagctaaatgttttacaaatgatttgtctatgagttccgactactacaatgatttacagttgtggcttaaagaagtcaatgatattaaagacacgattaacccaactttatattttacaaatcaactactattcagtcgatatacaaaataa

SEQ ID NO: 1079 - DNA, 813 bp, Staphylococcus epidermidis
aaggaacacgaaactatgacaaattttcattctatagatgctacacaagtaacaaacgtcactttaaatgttaaagatttaaataaattaactgatttctattctaatgtattaggtttttctattgaaaaacaaacgaatcaacaaaccgtattcaacatcggaaatcttggttatactttaactttaaatgaacttaacaacggtcgacaaccggaatttagagaagcagggttattccatgttgcttatcttttaccgactcgtagcgatttagcagacttcctttatcatgctaacaatctcaacatcgcaatgggtggtggagatcaccttgtcagtgaagcgctatatttcactgatcctgaaggcaatggtattgaagtctatcatgatcgcccttcagaagactgggtgtggcgagacggttttgtcaaaatggatacattggaagttaatgtcaatgatttaatggctcaacggtcaaatgaaggttggcaaggttggccggaagaaggaaaaatcgggcatttacatctcaaaacacacaatttagaatctgcttatgaattttatgttgaaaagctagggttcgaacatatatctaatttcccacaagcactatttatgtctactcaaaagtatcatcatcatatagctacaaatacttggcagtcaaataagattagaactcaaaatgaacaaacttatggtttatgtcactttgacatatatcaacctaatgcaaatactactcatgttacctcacctgaaggctttgacattacaattcatggtaacgaaacaaaataa

SEQ ID NO: 1080 - DNA, 141 bp, Staphylococcus epidermidis
atgagtaacgacacatctttgatagtcattgtcagaagttctatatcagcctctcaacatgattttgaaaaaagttatttttattatgtgacaatatttgcaaaattaaatattcgtttatttaatgaagcatacacgtga

SEQ ID NO: 1081 - DNA, 132 bp, Staphylococcus epidermidis
gtcgattgcgaccatgtcgtgtcttttttatttttaaaattcaaaattattttaattatatacaaagtagataaaattccaaatattaagtataatatctttcgcgagttctacatattaaagatgaaataa

SEQ ID NO: 1082 - DNA, 1818 bp, Staphylococcus epidermidis
atcgaattagaaataaagaaggtgtttaatatgtcattggaattgcccgtgatgctaacgattgtattgttcttagcactaggcatttttagtcaatggttagcgagtagaataaaatggccatcgattgttgtcatggccatcgtaggtttgcttgtaggacctatttttggactagcaaacccaaaagaggcacttggacctgaggcatttagttcaattgtatctcttgctgtagcaattatattatttgaaggtagtagtaatctagattttagagaattaaaaggcatttctaaagctgttataagaattattacaataggagcgggaattgcatggattttaggagcaatcgctttacatgtcactatgaatttccctctgtctatttcatttgttatcggaggactattcctaatcactggtccaaccgtgattcaacccttgctgaagcaagcgaaagtaaaaagaaatgtcgattcagtattaagatgggaaagtattatcttagatcctattggacctattattgcactcactgcattttatgtattccagatttttgaggaagggataggcttagtcgttattattctctttatcttgaaactcttagctgcaattttaataggttttggtgcagcctttctatttaattggcttataagtcaagataaaattcctcaaagtttaatgccacccattcaacttgtatttattcttttaacatttagtatctgcgatgagatattatcagaatcaggtttactagctgtaacaatttttggcttaatgatggcgcgtaaaaaacgtcacgatctcatctttaaagaatcagaccactttatagataatgcatcatctatacttgtgagtactgtatttattttaattacgtcttctctcactaaagatgtgttgctcaatgtgttatcttggcagctcatactctttagtttggttatgattgtattagtaagaccaatttcagtgcttctttcaacattaggtactgaaataactaaaaaggaacgtgcagtagtagcactaatggcgcctagaggtattgtggttttaacagtggcacaattcttctcaagtttatttatggacgataaaattcctatggctcaatatattacaccagtaacttttggtcttgtatttatcactgtagtcatttatggatttggttttacacctttaagtaaactgttcggtgtagcaagtacggagccaccaggcgtaatcattgtcggagaaagtgaattttcgttccatcttggtattaatctaagggatcatggtatacccgtcatgatgttcaacttatttgaaaatacatcagaaaaagcccacgaagctgggttcgaagtatttaaaggtaatcttttatctagcaatgatagaatttattctgatttattacgttataataaatgtattttgatgacacaatcgtttatctttaacagtttagcatttaatgaattagtgcctgaatttggcttgaataatgtagatatgatgccagtatcttttaatgatgaacaagcacgaaacaatttaaatggtccaatcagaaatcatatattatttgatgaaaatcataccccacgttggtttaatcaatttattacacaacataatattgttgaagtaccggcagaagattatgaaaaaattacagaaaatgatatgttaatctatcatatcaatgaagataaagaagtgacgtttaaacgaagcaatagagatatacctgaacatgaaacaggtgtttatggtattttaaaaaatgcttatttaacttaa

SEQ ID NO: 1083 - DNA, 975 bp, Staphylococcus epidermidis
aagtatctagataaatgggaggaattgacattgaagaagtatcttaactatacactgattctgattgcattatctctcatcgtgttatctggatgcagtttaccaggcttaggtgatggaaatgctaaagatgatgtgaaaattacaacgactgaaacaagtgaaactaagattataggtcatatggaaaaattattaattgaacatgaaactgatggaaaaatcaaaccgacgttaattggtaacctagggtctagcattattcaacataatgcgttacaacgtggagatgcaaatatgtcagcggtacgttacacaggtactgaattgacgagtgtattagcagctaaacctactaaagatcctgataaggccatgtctgaaacacaacgcttatttaaaaagaaatatgatgaaaagtattatcattcacttgggtttgcgaatacatacgcattcatggtgacaaaagaaacggctaaaaagtatcacttaaaaaaagtatcagacttagagaaatataaagatgaactacgtcttggaatggatacccaatggatgaaccgtgcaggtgatggatatcctgcttttgttaaagattatggatttaaatttgatagtgcgcgtccaatgcaaattggtttagtatatgatgcattaaaaaataataaattagatgtagcagttgggtattcaacagatggacgtattgcagcttatgatttgaaaatattggaagatgatcgcaaattcttcccgccttatgacggtagtccacttgcaaatgaacaattaataaaggataatccagaaatcgataaggcactaaaaaaattagaaggtaaaatctcaacagaagaaatgcagaagttaaattatgaagcggatggaaaaggtaaggaacctgcagtgatagctgaagaatatttaaagaaacatcattactttgaagaaaagaaaggtggtcataagtaa

SEQ ID NO: 1084 - DNA, 129 bp, Staphylococcus epidermidis
aactacatagatttattttacaacttaaattacgatttattcttatactatttcactacaaattatatatatcgtaaattcataccgcataatcatttaaatgtagtcaacatagaaacactattttaa

SEQ ID NO: 1085 - DNA, 132 bp, Staphylococcus epidermidis
tatcagatagaattaaatgaatttttgagtttaattcataattactggtatattaaaaagcttgagacaataatgatagtcccaagcttttattataaatattttatattctataagctgtcgtcttattga

SEQ ID NO: 1086 - DNA, 447 bp, Staphylococcus epidermidis
atgtatgtagagaatagttatttgagcaaacaattatgttttttattttatgtttcctctaaagaaatcatcaaaaaatatacagattacctaaaagagtatggtcttacatacacaggttatattgtattaatggcgatagaagatgatgagaaacttaacattaaaaaactaggcgaaagagtcttcttggattctggcacgctgacaccattattaaaaaaattagagaaaaagaattatgtcattcgaactcgtgaagaacaagatgaacggaaccttcaaatttctttaacagaacgtggcaaggatattcaaaatgttctatctgatatttcacaaagtgtttttaatgaatttaatattactcaagaagaaacccaaaatttagttgaagacttgcaaaattttgtaacgaaaaattttgataaaacagtggaaaagtga

SEQ ID NO: 1087 - DNA, 576 bp, Staphylococcus epidermidis
cacatgcaagaagataggaaatttgaagtcaaatggcgactagttaattcatcaacttttatgtatggtacaaaattacgttttaatcaagataatatctattttgagaaccctttgatgccatccggtacaatcattcacagttggtatatgttaactgattttgcagaagaccgtgtaagccctaagctacctattttaaaaaaagggcgccaatatcaatttcaatttaattttgaagttgaacctgagggtgcggcttattttaaaatgaaattttatcgtaagaataaagaaattcttagtcatcaaattctaaaaaataaaaaagaaaatattgtctatcctagagaagcatattcatatgaattagaacttattaatgctggcatgaatcatctatcttttcacaatataattgtgcaagaattaagagaagatagtaatcaagcttatgaggcaacgcaatatatagatcctaagaaaaaacttaaagtaattaatcaaataataaccaatataaggacacatcatctagacacatcaaactatcacaggagtgatacgaatggctaa

SEQ ID NO: 1088 - DNA, 1263 bp, Staphylococcus epidermidis
tgtagcgaagaaaaggaggaaatgagtatgacaaatggacctattcaagttaacagtgaaatcggcaaactaaagacggtattacttaaaagaccagggaaagaattagaaaacttagtgcctgattacttagatggattattgtttgatgatattccatttttaaaggtagctcaacaagagcatgatcattttgctcaagttcttcaagatgaaggaatagaagtgctttatttagaaaaattagcagcacaaagtatagaagattcaaatgtcagagagcaatttatagatgacgttttagcagaatctagaaaaactatcctaggtcatgaaaaagaaataaaaaaactcttttcaactttgtcaaatcaagcattaattaataagattatggctggcgtacgcaaagaagaaatacaacttgaatcgacacatcttgtagagtacatggatgataaatatccgttttatcttgacccaatgcctaatctatatttcacacgtgatcctcaagcttcaattggtagaggtatgacagtaaatcgtatgttttggagagcgagacgcagagaatcgattttcatttcatatattttaaaacatcatcctagatttaaagatgagaatattcctttatgggtggatcgtgactgtccgttcaacattgaaggtggagacgaactggtgttatctaaagatgtacttgcaatagggatatctgaacgtacttctgcacaagcaattgaacgtttagcacgacgtatttttaaaaatccgttatctacttttaaaaaggtggtggcgattgagattccaactagtcgaacatttatgcacttagatactgtttgtacaatgattgattacgacaaattcactacacattcagcaattcttaaatcagaaggaaacatgaatatatttattatcgaatacgatgataaagctgaagatatcaaaatccaacgttccagtcatcttaaacaaacattagaaaaagtgctcgatgttgatgaaattacattaataccaactggaaatggtgatatcatcgatggtgctcgtgaacaatggaatgatggttcgaatactttatgcatccgtcccggtgtggttgtaacttatgatcgtaattatgtttctaatcaattgttacgtgagcatggtatcaaagttattgaaattcctggaagtgaacttgtacgtggtcgaggaggccctcgatgtatgagtcaaccattaataagagaagatctatag

SEQ ID NO: 1089 - DNA, 1398 bp, Staphylococcus epidermidis
aatggagaagaaaagattatggcagataaactgcaaagagaattaagcaatagacatatacaattaattgctattggcggggctattggaacaggtttatttcttggtgctggccaatctattcatttagcaggcccatctatcttactaacatacataatagtaggttttgttctctttatgttcatgagagctatgggagaattactgttatccaatttaggatttaaatcgtttggtgacattgctcatcatcatattggttctatggcaggttttatggtggggtggacatattggttaacatggattatttcaggaatggcagaagtgactgctgttgccaagtatgtttccttctggtatccaacaattccaaactggttaacagctgcagcgactattttagttttagttgctttaaatctattcagtgctaaattatttggagaattagaattttggctatctattattaaagttttgactattttagctttgatagccgttggtgttgttatgattgtatttggaatgaagacaagctatggccctgcaacggtaacgaatatatggaaagacggaggctttttccctaatggtgcacaaggtttcttcatgtcattccaaatggcaattttctcatttattggtattgagttgattggaataactgcaggggagactaaagatcctcacaaaacaattcctcaagcaattaataatgtaccgtttagaatattattattttatataggatcgttggcagttatcatgtctgttgtaccatggcaacaattgaatcctgctgacagtccatacgttaaaatgtttggattagttggaatcccttttgcagcaggtattattaactttgttgtacttacagctgcagcctcttcttgtaatagtggtatatttgctaatagccgtacgatgtttggattagctggaagaaagcaaggtccagcattcttacatagaaccaataagcacggcgtaccacattatgctattttagtgacatgtggcttattaagtatttcagtcgtgttaaatgcaatttttaaagatgcgactaaagtgttcgtacaaattacaacattttcaactgttttaaatattatgatttggacaattattatgatcgcgtatctaggttatttaagacatgaaccgaaacagcataaagaaagtaactataaaatgtggggcggaaaatacatggcttacagtattttagggttctttgcatttatttttattatactattgattaatagtgcaacgcgttatgccgtactttctgcacccgtatggtttgttatcatgctattgatgtatcaaaaatataaaaaagaatctcgcaaagctaaaattaaaaatgaggaagagtaa

SEQ ID NO: 1090 - DNA, 1437 bp, Staphylococcus epidermidis
gtaaaggaagatggtgtcgtgggaagtactgttaaatatcgtaagtttattctacctattgtcgttggtttaattatctgggcattgacgcctattaaaccagatgccttaaatgatcaagcttggtttatgtttgctatttttgtgtcaaccatcattgcttgtattacccaacctatgactataggtgcagtatcaatcattggttttacaatcatgattttggttggaattgttgatacaaaaactgccgttcaaggcttcggtaatagtagtatttggcttattgcaatggcctttttcatttcaagaggatttgtaaaaacagggctaggtcgacgtattgctctgcaattcgttaaattatttggaaagaaaacgcttggtttggcttattcacttgttggtgttgaccttatcttagctcctgctacgccaagtaatacagcacgtgctggtggtattatgtttccaatcattaagtccttgtcagagtcatttggttcatcgccgagagatggttctgagagaaaaatgggtgcgtttttaatctttactgagttccaaggtaatttaattacttcagctatgtttttaacagctatggccggtaaccctatagcgcaaagtttagctgaaaaaacggcacacgttcaaattacatggatgaattggtttgttgctgctattatacccggattgatttctctcatcgttgtccctttcattatttataaattatacccacctactgttaaagaaacgcctaacgctaaaaaatgggctactgaacaactagaagaaatgggacatatgtctatagccgaaaaattgatggttggtgtctttatcatagcattggctttgtgggtattaggaagcttcattaatgttgatgccacgctcactgcatttattgctttagcattgttactattaacaggtgtattagcgtggtcagatattttaaatgaaacaggcgcatggaatacactcgtttggttctcagttcttgtattaatggcagaacaattaaacaagttaggctttatcccatggttaagcaaactcattgctcaaggtttgaatggctttagttggcctatcgttttagttttactcatcttgttttatttctactcacattatttattcgcaagtgcaacagcacatgtcagcgccatgtacgccgcgttactcggtgttgcagtcgcttcgggtgcaccgccattattcagtgcattaatgttagggttctttggtaacttactggcatcaacaacacactatagtagtggaccagcgcctatattatacgcagctggctatgttacacaaaagcgctggtggactatgaatattgtacttggtatagtctattttattatttggattggtgtaggttcactatggatgaaactcattggtatgatgtaa

SEQ ID NO: 1091 - DNA, 126 bp, Staphylococcus epidermidis
ttagaacgagaattaaaacttaaaattaaaaggtattcattacactatatgagggtgtggagaagaattcgtgttaaatttcgtcatcgtcgtgcaactggcttaatctgttcgatttttctataa

SEQ ID NO: 1092 - DNA, 129 bp, Staphylococcus epidermidis
aaagggagagaagtaaaaaatattaaaattgaagtgaaatatagcgagaatagtcaaaggcctaataaatttgacgttagttgtgaaattaatggagaagagcgtttgtattcaatagaaaatatttag

SEQ ID NO: 1093 - DNA, 789 bp, Staphylococcus epidermidis
aaattgttggaggcggttaatatgtttaaaataggaaatttagaattacaatctcgtttacttttaggtactggaaaatttgaaaatgaagaggttcagtcaaaagcaattgaggcatctgaaacaaatgtacttacatttgcagtaagacgtatgaatttatatgatcgtaacctacctaacccacttgcaaacgttaatttaaaagattttatcacttttccaaatactgcaggtgccaaaacagctcaagaagctatcagaattgctgaaattgctaatcacgcaggtgtatgtgacatgattaaagtcgaagtcattggtgatgacgaaacattattacctgatccattcgaaacatacgaggcatgcaaagtattgttagaaaaaggttacactgtttgtccttacatctctaacgatttagttttagctcaacgtttagaagaattgggtgtacacgcagttatgccacttgcatcccctattggtacaggaagaggtattaataacccattaaatttaagttatattatcgaaaatgctagtgtacctgtaatcgtagatgctggtattggttcccctaaagatgcgtgtcatgccatggagcttggcgcagatggtattttactcaacacagccatttcagcggcaaaagatcctgtgaaaatggctgaagcaatgaaattaggtataaatgctggcagactttcatatgaagctggacgcattcctgttaagtatactgcacaagcatctagtccatcagaaggtttagggttcttgtaa

SEQ ID NO: 1094 - DNA, 621 bp, Staphylococcus epidermidis
cgttgtatggaacaaattatcactgattttattagtaagtggggttatacagcgatattcattttaatcttattagagaacgtattacctgtcgttccatctgagattattttaacttttgcaggcttattatctgtgaaatcacacttatctatttggacattattaatcatagcaacaattgcttcattcattggtttactcattttgtattatatttgtagacttatctcagaagagaaattatatcgtttcgttgatcgacatggtaagtggatgaagttaaaaagtaaagatttgaaacgggcaaatgattggtttaaaaagtatggtgcatgggctgtatttttatgtcgttttgtcccagtacttcgagtattaattacaatacctgctggcattaatcgaatgaacgttatacagtttacaactttatctttaataggtactacaatttggaattttgctttaatactgctcggtcgtttgctcagtgacagttttgacgctttgatgaatggtattcatacatattcacgtatcatgtatgtcattattattattgcagtcatatattttgttatacgttatttaatgaaacgtcgtcggagtgttaaataa

SEQ ID NO: 1095 - DNA, 792 bp, Staphylococcus epidermidis
ttagtaatggatatacaaaagtttgaatcttatttaaaaattaagcattcatattattcaaacccttctcttgaagcattgaattactatgtaagacgctttatgataactgtgccatttgaaaatattaatgttcaaaacaagattcctatctcaatcgatatcaaagatttatacaataaaattgttattcaacggcgtggcggtttttgctatgaattaaatcatttgtttgctacgtatttagaacataaaggcttccacgtcactcgtgctgcggcaacagttcacacaccaaatggtgggcgtagtcctgaaggctcgcatatgtcactttacgttaatatcgaaggaacactttatattactgatgttggatttggtgatttacctacaagtattatcgagataggttctaaaacacaattcattccaacatatgataaaaatggagtttactgtgctgtttggattaatgacaatcaatatgccttacagaagcttagacaaaataaatggatgacactctatgaagcgcatttaaaacctcaaagcattaaagactttaaagataaaataagctacaatgagcatcatcctcattctatttttgtacgacatttgcttattacacaaccacaatcgtttggacgtgcaacaatgacttatcattctttaactttaagcaatgacagtactaaacataaatatgacgttactaccaataactacaagtattttttaaaaaaatattttaatttaaatgtatcaatcatcccatttgaaccataa

SEQ ID NO: 1096 - DNA, 825 bp, Staphylococcus epidermidis
ctttggatggaacgtttagaaaacaaaatcgcagtgattaccggtgcgagtactggtattggacaagcatcagccgtggcgttagcaatagaaggagcacatgtgttagcgcttgatatatcagatcaattagaagaaactgtgcagtctattaatgataatggtgggaaagcaactgcatatcgcgtagacatttcagatgataaacaagtcaaacaattctcagaaaaaatagcacaagaatttggacatgtagatgttatttttaataatgcgggtgtagataatggcgccggacgtattcatgagtatccagttgaagtgtttgataaaattatggctgttgatatgagaggaacgtttttagtaactaaatttttattacctttaatgatgaaacaaggtggttctattattaatacagcttcattctctggacaagctgccgatttataccgttcagggtataatgctgcaaagggcggtgtcattaatttcacaaaatctatcgctatagaatacggacgtgaaaatattcgtgctaatgccatagcacctggaacaatcgaaacaccacttgttgataatttagcaggtacatcagatgaagaagccggacaaacattccgagaaaatcaaaaatgggtaacaccattaggtcgactaggaacaccggatgaagtcgggaaacttgtagcatttttagcttccgatgatagttcatttataactggtgaaactattcgtatagatggtggcgttatggcttatacatggcctggagaaatgttaagtgatgaaagttggaaaaactctactaaataa

SEQ ID NO: 1097 - DNA, 192 bp, Staphylococcus epidermidis
aattctacggacaaggcaagttggggttcggggccccaacaaagagaatttcaccgagaaattccacggacaaggcaagttgtcggtaacttggataacttattcaaaataaggtgtgtattcaactacgataagttatcatccttattttgtttcgttaccatgaattgtaatgtcaaagccttcaggtga

SEQ ID NO: 1098 - DNA, 450 bp, Staphylococcus epidermidis
atttatagtttacttattaataataaggagatttgcccattggacctaacaaatcaaaaaatcctacacttacttgagcaaaatagtaagctatcgctttctgaaattggaaaggaagtaaatttatctacaccctctgttcgagaacgaatctataaacttattgattcgaaaatcattgaacgatatacaatcgatattaattacgatgcattaggtttcgatattaatgttttgatagaagtaactataaaaaataacctatataaagatttcaaagcatttatttcagttcaaaacaatgttgatttttgctatagaatttctggagatagttgctttatatttaaagcgcattttaaaaagatgagcgaagtcgaaacactcatcaacgaaatccaatattatggtcatacaaaaacacattttatattttcagaaacaaaatag

SEQ ID NO: 1099 - DNA, 1062 bp, Staphylococcus epidermidis
ccacataaggaggtttttacgatgagtgaagaacgcaagttaacatttatgggggctattaatgaagctattgaccaatctatggaaaaagatgaggatgtcattttaattggtactgatgtctcaggtggtgcaaaagtagaccacatcaaagatgacgatacattcggtggtgtatttggtgtaacaaaaggacttgcaaaaaaatatagtcgtaaacgtgtaatcgatacaccaattgctgaacacattacattgagcacggcagtaggagctgctgcgacagggctacgtccaattgctgaactcatgttcaacgactttattggatttggtttagatccaattttaaatcaaggggcaaaaatgagatatatgtttggtggaaaagccaaaatcccactagttgtacgtactgttcatggagcaggggcaagcgctgctgcacaacactctcagtctttatataatatgtttgcagcaattccaggagttaaagttgttgttccatctaatccatatgatgcgaagggtctactgatgtcagctattcaagagaacaatcttgttgtcttttcagaagataaaacattattaggacaaaaaggtaatgttcctgaagaaccttatactatagaaattggtaaagccaatgtgacgcgtgaaggtgacgatttaacaattgtggctattggaaaaatggtagctgtagcggaagaaactgctgaaaaacttgcagaagaccaagtatcagttgaggtcatcgatttacgctcagtgtcaccatgggatcaagaaacagttttagattctgtgaagaaaacgggtcgcctaattgttattgacgaatctaatccacagtgtaacattgctggagacgttgcttcagtgattggagatgtaggatttgattacttagatggtccaattaagaaagtgaccgcaccagacactcctgtaccatttgcagcgaacttagaggcggcatatatgccgaatgctgataaggtattagacattgcatctgaattaattgatgatttaaaaaaggctaacgcatag

SEQ ID NO: 1100 - DNA, 954 bp, Staphylococcus epidermidis
aattgtaaggagatggaatatatgaaaatagcaattgcaggttctggcgcattaggtagtggatttggtgctaagttgtttcaacatggttatgacgtcactttaattgataattgggaacctcaagttactacaatacaacaggacggtctacatatcgatattaatggtgaagcgcatcatttcaggctacctatgtatagactaacggaaattcctaaagcaacgtcctatgatattgtttttctatttcctaaatctatgcaattagaagaggtgcttagtcatattcaaccccatcttcatgataatacaattgttgtgtgcactatgaatggtttgaaacatgaacgtcttatacaacaatatgtttctatagatagaattgtacgtggagtaacaacgtggactgccggtattgatcaacctggtcacacgcacttaatggggcaaggtcctgttgaaattgggtgtctcgtgcccgagggaaaagaaagcgtagatatcattgttaatctgctacaaaatgcagaattaaaaggtgtaaaaagtgaacatttacatcaatcaatttggaagaaaatatgtgttaatggaacagctaattcattatgtactatacttgaatgtaatttggcagcactgaataatagtgatgacgctaaaaatttgatatataaaattacacaagaaattgttcatgttgcaacagttgatgatgttcatcttaatgttgatgagatttttgattacttaattgctttaaatgataaagtaggcccacactatccttctatgtaccaagacttaattaaagataatcgaacaactgaaatagattatattaatggagcagttagtaaattagggaaagagaatcatattgctacacctgtaaatgattttgtaacaaatcttgtacatgctaaagaaaatcaacgtggtgcacaatga

SEQ ID NO: 1101 - DNA, 1278 bp, Staphylococcus epidermidis
atgaaaagtttagataaaggatttagacatttaacacgaaaagataaattaaaaaaacttgttgaatacggttggctagatgatgaaaactatgaaatattacttaatcatccgttaattaatgaggaagtcgcaaacagtttaattgaaaatgtcattggtcaaggtgcactaccagtagggttattacctcgaattatagttgatgataaagaatatgtagtacctatgatggtagaggaaccttctgtcgtagcagcagcaagttatggcgcaaaactcgttaatcaaagtggtggatttaagacaatttcaagtgaacgtctaatgattggacaaattgtctttgatgatgttgaagacacaggcacattagctaactcaatatatcaaattgaatcacaaattcatcaaatcgctgatgaagcttacccttctattaaagcaagaggtggaggatatcaacgtattgaaatagatacattccctaatcatcgattattatctttgaaggtttttgttgatactaaagatgctatgggtgctaatatgttaaatacaatattagaagcaatcactgcacatctaaaagttaaattttcaaatcaaaatgttttaatgagtattttatctaatcatgcgacagcatcagtagtaaaagtacaaggggaaatagatattgaagatttacatagaggagagagaagtggcgaagaggtagcacaacgtatggaacgagcgtcagttcttgcacaagtagatatacatcgtgctgcaacacataacaaaggtgtgatgaatggtatacacgctgtagtattggctacaggcaatgatacaagaggagttgaagcaagtgctcatgcatatgcaagcaaagatggtcattatagagggatagctacttgggaatatgatcgctcacgtaataaattggttggaactattgaagttcctatgactttagcgacagtaggtggaggtacgaaagttttacctattgctaaagcctcattaaatttgcttaatgttgaaaatgcacaggaactagggcaagttgttgctgctgttggattagcacaaaatttctctgcatgtagagcgctagtgtctgaggggatacaacaaggacatatgagtttacaatataaatcattagcgattgttgtaggtgcaaaaggcgaagaaattgcgcaagtagctgaagcgctcaaatatgaatcacaagctaatactgccaaagctcaagaaatcttgatgaatataagaaagtcataa

SEQ ID NO: 1102 - DNA, 138 bp, Staphylococcus epidermidis
acacatttactagtaaataagtataaatttaaggtgaactatagtgtcaaaattgaatgttatgtgaattttttgggtgagactgacgtaagtctaaatacaatatatactcttctcaatagtgaaaagagtgcgtaa

SEQ ID NO: 1103 - DNA, 927 bp, Staphylococcus epidermidis
ttaaacttactattgaattatatcaaaactagggggatatgcatggatataaaacacatgaaatactttgttgaagttgtcaaacaaggtggtatgacaaacgcttcaaaatccttgtatattgcgcaaccaactatcagtaaagcaattaaggatattgaagcagagatggctgtccctttatttgaccggagtaaaagaagtttagtacttactgatgcaggtaaaatttttttcaagaaatgtcaagaaatcatcgcactatatgataatttgcccactgaaattaatagtttgtatggtttagaaacaggtcatatcactattagtatgtctgcagtgatgagcatgcgtaaatttattggcgtattaggagactttcatcaactttatccgaatatcacgtacaacttaatcgaaagtggtggtaagacgactgaaaaccttatacttaatgatgaagtggatattggtgtgacaacattgccagtagatcatcaaaaatttgaatgtatatctttaaacaaagaagaactgactgtagttttaaataaagaacatcctttagcacaaaaatcttctattaaaatggaagaattagctgatgagaacttcattttatttaatgaagatttctatctcaacgataaaattattgaaaatgcgaagaatgctggattcgtgccgaacatggcctcacaaatctcacaatggaatgtgattgaaaatcttgtcattaatcaattaggtatttccatattgccagccactatagcacaattacttaatgatgacgtcaaaattgtacatttggaaaatgcacatacaacttgggagcttggtgtcgtttggaaaaaagataaacgtttaagtcatgctacaaataaatggatagaatttttgaaagaaagattatccgaagaataa

SEQ ID NO: 1104 - DNA, 1440 bp, Staphylococcus epidermidis
caacgcttacttggatacttaaaatttactcgtaattatttttcagttttatacatcatcatacgattaggaggttacaacatgtttaatttcttaaaaccagctagacatatcaaatcattgccagcagaaaaagtagatgatacatataaaagactacgctttcaagtctttttaggaatatttatcggttatgctggttactatttattaagaaagaacttctctttagcaatgccttcattaattgagcaaggctttattaaaggggaattaggtattgcattatctgcagtatctatcgcatatggctttagtaaatttgtaatgggaactgtcagcgatcgaagtaatgctcggatgttcttaactttaggtttagtattgacagcaattattaacttattattaggatttattccattctttacttcaagcataactattatgtttatcatgctgtttttagttggttggttccaaggaatgggctggccaccatctggacgtgtgttagttcatgggtttagtgtcagcgaacgcggaagcaaaacgtcaatatggaatgtagcacataatgtaggcggaggtttaatggcacctattgctacgtggggtatttccatgactgcattatacaacttcggttatttaaaagggtttgaaggcgtctttatataccctgcactattggctatcattattgccatcttctcttacatactaattagagatacaccacaatctcagggtttaccaccaattgagcagtataaaaatgattatgccacttcaactaaacaaacaattgaaacagaactaactactaaagaaatattatttaaatatgtacttaataacaaatgggtatgggcgattgcttttacaaacattttcgtttattttgtgcgttatggtgttttggactgggctccgacatacttaagtgaggaaaagcattttgatttaagtgcttcaggttgggcttacttcttatacgaatgggcaggaattccgggcacgctactctgtggttatctatctgacaaactatttaaaggtcgtcgtggtccagcaggcttcttctttatgttaggcgtaacaatctttatccttatatattggttaaatccaccaggtcacgcatggttagataatctttcattaattggtattggtttcttaatttatggtccagtcatgttaattggtttacaagcgttagattatgttcctaaaaaagcagcgggtactgcggctggtctaactggtctatttggatacttgttcggtgcagttatggctaatattgtattagggtttgtagttcaacattttggatggcatattggctttgtgttattaacagtcatcagcatactcgctatgttatgtttcattttaacttggaataaacgtggtcaagaacaaatcgactag

SEQ ID NO: 1105 - DNA, 189 bp, Staphylococcus epidermidis
tcaaagctactgcatccgcttaacattaaaatgatgattgacactataattaatttcttcaatataagtgctccctgctatgaccaatttatacgcttatcactatatctgttacattataaaaaagcaatagttatcaatataaatgtaaactgtaaactaattatgtttgaaaacgtcaaagcgtga

SEQ ID NO: 1106 - DNA, 135 bp, Staphylococcus epidermidis
atgtgtatactagatgtaaataaaatcattgcgtgttactggttatgcaggcatgagcaaataagagtgtctatctttcgtgatatgaaattgatagtcttatttgttcatgctttttttgtggcacgtaaataa

SEQ ID NO: 1107 - DNA, 954 bp, Staphylococcus epidermidis
caaatggtactttttcttcaacccgtatttcaagaacgtttatggggtggcaccaatctcactcaatttggctacgatattccgaataattctaccggcgaatgctgggcaatttccgcacataaaaacggtcctaacacaattctcaacggaaaacataaggggaaatctttaaaacaagtttgggacgaagataaagcacttttcggaaatgactcacgtaaagattttccacttctcactaaaattttagatgcacatgattgtttgtcagtacaagtacatcctgatgatgaatatgcgcttaaacatgaaggcgaatacggtaaaactgaatgttggtatattttagacgctcaacctggtgctgaaataatctatggtgttaatgctacaagtaaaaatgaacttgaacatatgattgatcatcatcaattcgactatttatttaaacatgtacctgttaaaccgggtgatttcttttatgtaccagccggtacagttcatgctattggttccggaatcctcattttggaaactcaacaatcttcagatacaacatatcgtatatacgattatgacagaaaagataaaaatggtcatacgcgtgaattacatttaaaccaaagtaaagatgttattgatatcactacaactgaacctaatacaacacctaagactgaaatgataaatggcaattgtcacactcaatttgttgccaatcatttctttacggttgaagaatggtctatcaaagacatattagattttcaaaaaccacacacttattgcctagtgtcaatgattaacggccacgggcaagtttcaatcaataacaaagtatataaaatcgataagggcgatcattttattttaacttctgaagatcaatatattaaatttgttggtaatatggatttaatagtcagttttagtaaagatgaggcatattaa

SEQ ID NO: 1108 - DNA, 156 bp, Staphylococcus epidermidis
tttaattcactaaacaagttacttcataggtcttttaaatttctaaattatactaactatataagtgagctgaagagattagaaatcaattactttagttactttttgaagtcgtatataatttgtatcaacagaagtaaagagaggaaggtatga

SEQ ID NO: 1109 - DNA, 363 bp, Staphylococcus epidermidis
gtagcatcactattagaatgtattgttactgcaccagccggtttaatctatgttatttacctatggcagcaacaacacataacatttggattaaatatatcatcattttggctactattttcaggtgcaattacagcaataccattgattctgttctcagcaggtgctaagcgaattccattatcgttaactggcttcattcaatatgtagggccgacaatcatgtttatcttaggtatctttgtctttaaagagccatttaacactgatcaattgattacctttatttttatatggataggtattgtgttatatagtatttctcaatatgttcaaattaagaagaacccagttgtaaaatag

SEQ ID NO: 1110 - DNA, 1365 bp, Staphylococcus epidermidis
aaagagtcactattgggagggaactcaatgagtaaggttaatcatttgatagatgaagatgaacgttattttgcacattctggacggattaaatattatcctctagttattgatcatggttatggagccacgttaatcgatatagatggtaagtcttatattgatttattagcaagtgcaagttcgcaaaatgtgggtcacgctccgaagccagtagtcgaagcaattaagaaccaaactgagaaatttattcattatacaccagcatatatgtatcatgaaccgttagtgcgattatcaaaaaaattatgtgacattgctcctggaaattatgagaaaagagttactttcggattaagtggctctgatgctaatgatgggattataaagtttgcacgagcgtatacaggacgtccatacatcataagttttactaatgcataccatggttcaacatttggttcattatcgatgtcttcaattagtttgaatatgcgtaagcgttacgggccattacttaatggattttaccatataccttttcccgataagtatagggggatgtttgagcaagctaaacctaacacagttgaggaatatttagctcctttaaaagaaatgtttacaaaatatgtccctgcggaggaagttgcatgtattgtggttgaaacaattcaaggtgacggtggcttacttgaacccgtgccaggttattttgaagcattacaagagctttgccacgctcacaatattcttattgcagtcgatgatatccaacaaggattaggtcgtacaggaaagtggagttccgtagatcattatcattttactccagatttaatgacatttggaaagtcattagctggaggtttaccaatgtctgcgattgtaggtcgtaaagaaatcatggaaagtcttgaagcacctgctcatttatttacaactggtgcaaatcctgtaagttgtgaagcagccttagctacgataaagatgattgaagatgaagatttactaaacgcttcatggaaaaaggggagttacgttagaaaaagaatagacccatggatagaacgttaccaatatgtaggtgatgttcgaggtattggattatcaattggaatagacatagtatcaaataaaattgagaaaactagagattctgaagcagcattaaagatatgtaattactgctttgaaaatggtgtgattatcatagcagttgcgggtaatgttttaagatttcaaccaccacttgtgattacctataagcaacttgataaagcattagatacaatagaagaggcgcttgaaaagttggaaagaggagaattaaatcaatatgacattagtggtcaaggttggtaa

SEQ ID NO: 1111 - DNA, 195 bp, Staphylococcus epidermidis
ccaatgacacttgacgctatataccaagcattaggtaaaaacgtcaaagataataatattaatcctatgacggtcaaggcacttccgagtaacaaaggtcttttaggtcctaacgattgtaatatcatttcacccacacgtatcataattaatactgcaattaggtatgtaagtgaaatatatcctgtttcctga

SEQ ID NO: 1112 - DNA, 126 bp, Staphylococcus epidermidis
aacgagacactttacaggatgcatgcgtatgcgtgcgtcctgttttttgttgaaattttacttcaattaaaagccgaaaatatttttgattattacactaaaatttatttatctggtgaaaaataa

SEQ ID NO: 1113 - DNA, 963 bp, Staphylococcus epidermidis
cagggagcacttatattgaagaaattaattatagtgtcaatcatcattttaatgttaagcggatgcagtagctttgatcatcgtaaacgcgaaagtattaatgacaagaataaaatgaaagtatacacgactgtatacgcatttcaaagtttgacacaacagattggtggaaaatatgttgacgcgcaatcaatatatcctgctggtgctgatttacactcatatgaaccaacacaaaaagatatgattgatattgccaaaagtgatctgtttgtctattcaagtcatcaattagatcctgtcgctgcaaagattacgaattcgatgaccaataatagcatgaaattagcgcttgccgaaggactcaaacaaagtgattttattcactctaaagaccatgatgaaaatcatgagcatcattcacatcatgaagaatcgaatcaagatcctcatgtttggttagatcctgttctaaatcaaaaattcgctttcatgattaaagagaaattaatagagaaagaccctaaacatcaagcttattacaataaaaattataaaatagtaaataaagatattgtgcatattgatcaacaactacaatcaataacgaagcattctaaaagagataaagttgtgatatcacacgattcgcttggatatttagcgcatcgttatggttttaaacaacaaggtgttaaaggtatgaatgatgaagaacctagtcaaaaagagattttgaatatcgttaaagatatacagcattcgcatgcgccttatgttttatatgaacaaaatattacctccaaaattacagatgttattaagaaagaaacagatactaaaccattaagttttcataatttagctgtattgactaaagaggagcaaaatgatgattcaatttcataccaatcattaatgaaaaagaacatttacgtattaaatcgcgcactcaataattaa

SEQ ID NO: 1114 - DNA, 138 bp, Staphylococcus epidermidis
atacaattttgtcgaagaaaagttcaaaaattgaaaaactgtctactaaaaatgataagtaaaaatttaattattaaaatgaatattgacattgatttaaattatacgtttaatataggtatcatttttaagatttga

SEQ ID NO: 1115 - DNA, 765 bp, Staphylococcus epidermidis
aaaggagtttgcatagtgttattagaggttaaaaatgtaaaaaaagtctatggcagaggtatgaacacgacaatggctttaaatcaaatgaaccttgaaattgatgaaaatgaatttgtagcaatcatgggagagtcaggttcaggtaaatctacattactcaatttaattgctacttttgatcgtacaactgaaggcttgataaagttagacgggttgccacttaatcaattgaagaataaagacattgcacgttttcgtagagaaatgatgggatttgtgtttcaagattttaatgtgttgaatacgatgtcgaacaaagataatattttgatgcctcttgtacttgcaaatgaacgtccaaaaataatgcaaaaacgcttaatggaaataagtgaacaattaggaattgaagacttgcttgaaaaatatccgtctgaaatatctgggggacaaaaacaacggatagctatagcccgtgcgttgatagcacgacctaaattattattagctgatgaacccactggtgcacttgattcaaaaacctctaaaaaccttatgtgtttatttcgaaaaattaatcaaaagcatcaaactatattaatggtgacacattcaaatattgacgcgtcatatgcgaaccgtgtcatcttcatcaaagatggtcgtttgtatcatgagatttatcgtggtgaagaatcgcaaacagattatcaaaagcgtattgccgatagtttggccatattgaatggagtaggtgactaa

SEQ ID NO: 1116 - DNA, 135 bp, Staphylococcus epidermidis
acaatttcttgtgtaattttatatatcaaatttttagcgtcatcactattattcagtgctgccaaattacattcaagtatagtacataatgaattagctgttccattaacacatattttcttccaaattgattga

SEQ ID NO: 1117 - DNA, 417 bp, Staphylococcus epidermidis
acgatgccttggacgatggaagattatcctcaaagttggaaaaactttgaagaactcgaacggaaaaaagcgattgatattggtaatgcgatgctcaaagatggctataaagaatctgatgtgatacctattgctacaaatcaagctgaaaaatggtatcaacatgcttcaaaagaagaattagagacgttaaaaaacaaacatatcacgcaacatcaagaagatgaatcagcaaatcctaaacttaacgaagaaaatgttcatgtatattatgaagatcagctatggaaagtaaaatctacagaggctaaacgagcttcagatacatttgacacaaaatctgaagcagttaatcgtgcacatcatatcgcagagaataaaggtactaaagtggtcgagcatcgaaaagatgagtga

SEQ ID NO: 1118 - DNA, 165 bp, Staphylococcus epidermidis
atgttgaattgctcgagtgacgttacttatgtttcccaatccataatcaataatcgcaatcattcaattactcctttagacgatggaatacgtccatcttcattttgtgcaagagaaatctttaatgctcttgcaaaagatttaaatattgcctcaatctcatga

SEQ ID NO: 1119 - DNA, 126 bp, Staphylococcus epidermidis
gtcatcgattggtatttatctattttacgttctgtagatgctaaacttactaaagatttactgctatcagttttagaagtagttggcgttgaaaattgctttgctttagtagttgtactaacttga

SEQ ID NO: 1120 - DNA, 243 bp, Staphylococcus epidermidis
atgaattgttgccacaggctgctaaaacaaaaacaagtgcaacaatgcaaagtaaaagtcttttcatttaatcaaaccccttattcttattattctaatcggaataaaaatattttatcccgttattacataatagtcaataaagagttacttgctaacaagtgttcagaaagttcaaactctattaactattattttaaactatttacaaatcgtaataattactatttacaaataacttaa

SEQ ID NO: 1121 - DNA, 750 bp, Staphylococcus epidermidis
atgaaattctgccctcattgtggaaatccgataaaaaaggaacagtcattttgtaataaatgtggaaaacatttaaagacatcgacacaaagaaaaagtgaaaatcaaattgaacatatgcgtgaacagcaatcgtatatttctcgtgaggaaagacaacatcatgattcaacattttataaagaacaaaaacatactggttggctaattgtattatcaattatatttgtcttgttgatagcagcgctattgtatggtgcgtactatgcttacaatcattatattagtgatgagcaaagtcaccaaacaacagagtctcagcaatcaaatgaaagtgatcaaaatagggaccaatccactggtccaagcattgatgtttttagtgatgactttgatcaaggttatatgaagtcagcttcaacaagtggatatagaggtgtttataatggaatgacacgtgaagaagttgaagataaatttggaacatccaatggttctgtagaaagtttgaagtggagttacgaaacatatggtgatttagctgtagcctacgatgataatgaagttgttagcgtaggtgtagcacctaatcatatttcagaagatcaatttttaagtatgtataatgaaccggatgatagaaattcaagccagctcatttatgatagtaacaaagataatgacttctctgtattagttaatgttaaaaatggagatgttactgtcattgaaaatgtaaatcaaatttaa

SEQ ID NO: 1122 - DNA, 129 bp, Staphylococcus epidermidis
gtttgtagctgttttattttagtcaaaatcaatagttacgttattactttgaaaggggcatctagttgttatgactgtcgcacgcacaacaacatttatattaagtgttttcatcgtaggtatggttga

SEQ ID NO: 1123 - DNA, 789 bp, Staphylococcus epidermidis
atgaaaagacttttactttgcattgttgcacttgtttttgttttagcagcctgtggcaacaattcatctaacaataaagataatcaatcaagcagtaaagacaaggatacgttaagagttggtacggaaggtacatatgcgccctttacttaccataataaaaaagatcaattaacaggttatgatattgatgtgattaaagcagttgcaaaagaagaaaatcttaaacttaagtttaatgaaacgtcatgggattcaatgtttgcaggattagatgctggtcgttttgatgttattgcaaatcaagtgggtgtgaataaagatagagagaaaaaatataaattctctgaaccttacacatattcaagtgctgtacttgttgttcgtgaaaatgaaaaagatattacatcattcaatgatgtaaaaggtaaaaagttagcacaaacgtttacgtctaattatggtcaattggctaaagataagggtgcggacattactaaggtagatggatttaatcaatcaatggacttactattatctaaacgtgtagatggtacatttaacgacagtttatcttacttagattacagaaaacaaaagcctaatgctaaaattaaagcaatcaaaggacatgcagaacaaaataaatcagcatttgcattctctaagaaggttgatgaaaaaacgattgagaaatttaataaaggcctagaaaaaattagagataatggtgaattagctaaaattggtaagaaatggtttggtcaagatgtttctaaacctgaataa

SEQ ID NO: 1124 - DNA, 165 bp, Staphylococcus epidermidis
gttattttatgtaatgatagtgaggtttatttctttgatattcagagacaaaagagatactttataagtattcaaatctctgagtcgctatttttcttaatattaagcaccattaataaaaattttttccctttgactttatttatagatcgagctgacacttga

SEQ ID NO: 1125 - DNA, 531 bp, Staphylococcus epidermidis
actttgagactaaaagtaaaggggagtatgaagatgaagtcttcagttcgattgttgaatcacatcataaagataatgaacttacaacaatcattaattataagagatgaacagtggaatcaatcttatgaggcatacaatttcaatattaatggctacgtatttaaaagtaggttagctaagaaaacaacaaagaaaaaaggatattttttatcgctttgggaaaaagataaaacaaagaaaaatcgagcatttgactatgagtcatttcctgggaaattaattgtacacgtgttggatgattctcaagtaggtcagtttatttttccaaaacatgtactttttcataaaggtattttaagaaatcatgcatctaaagggaaaatggcttttcgagtgtatcctacatgggagaaagatttaaatcgtgtcgctcacaagacacaagagtggcaaaaacaatactttatagatatgtctcaaacaattgatgtaccaagtattaaacgtgcttattttaatgaagattga

SEQ ID NO: 1126 - DNA, 135 bp, Staphylococcus epidermidis
cattatctatgtttaaatatctcatttaacttatgcttatcaagagaattttttaaattaatcgcttcattgacttattcttacgttattatcattgaacgtaaaaatttattcgattattgtatagacgtctaa

SEQ ID NO: 1127 - DNA, 1191 bp, Staphylococcus epidermidis
aaaggagtatggaaatcgatggaagaaagtaaaaactataatctcattacgacaatcatgtttatttcaggtatcattgtaatggcaagtttatatacggctctacctcttacagcaactttcgcagaagactttcatgttcctaaatctatagcaactttaaacggtgttttattctcattaacatattcaatcagttgtctattttatggaacgatttctgaaaagtatggcagaattaaaactattttagtaggtatgagtgcattagttatcatctgtcttatgataggtattgttcattcatttacagtgttattaatattaagagcactacaaggcgtatttgctgcatcattttctcctgtagtcatgacttatacaactgaaacttatccacgtgtgaaacgtgtaacagcaattagtttcatcagtacaagttttatgttatcaggtgtgttagggcaaaatatgagtgaattagtcgtaagttatttgaattggcagtgggtatattttattttaacaatcttatatttaattctcgtattagttatttataaaaatgtacctgagagtccacataaaaatcctgatatacaactcattaagtttttcaataactttaaagatttcaaagacaatcttaaagttttctattgtttatttatttcactaacattactgattatgtttataagtatgtatgatattttaaatgaatatgtcacatcacaccaagttgggggagacatgtctgtgtcctcaatgatgaaattgttcggtgtgataggcatgttattatctctattagcagggcgtgtaagcagtcgtataggtatgaagcgcttgctaactatcgcattaacaacatgtattgtgtcgatcatactcatgggtgtaactacgaatattatacttattacaacatttagtgtgttgtttgttgcaggtatcgcatttgcgattcctactgttatttcaaaaataggtgtagttgttaaaaacaatcaaggtttctttttatctgttaatacatttgtattattcttaggaacagcgattgcacctattttaatgttatttgtaggcgaactgtctaactttttcttacagtttttaatgattgctattgtcggactgattgctttagttgtatcaatatttatgccaggtgaccaacgttcttga

SEQ ID NO: 1128 - DNA, 162 bp, Staphylococcus epidermidis
ataatttttttagtttcttctgattatcttctagtaactcatttaattttttgctacccttcatacatttattcctcccaattagcaattaacttatatacatacattttacatgtagtatatcactttttaaaacttttaatcattattgtatcgaactaa

SEQ ID NO: 1129 - DNA, 642 bp, Staphylococcus epidermidis
ttaaatggatggaggaatttttttatggacaaattaacagtaggtttagaatggtttttaaatcctgatcatatgccgttaatcttaggtatcgaaaaaggttggtttaaagaagaatcattagaaattgagatgattgaaccaaaggaacactttgacgcactagacgagattgaaaatggttcaatggatatcgcgattactgaacctattcatctggttcaagatagagctaaagaacaaaaagtcatcgggtttgcgagatatcttcacactaatggaggtattatgtataacaaagataaaaatatcgctcgccccaaagatttaatcggtaaacggcttcaatatcccggtgctcccggtccaggtggtattgctatggctaaaacgatgattgaagctgatggtggtacatttgaagaaggtgacatcacaccagttaatcatagtttttatcatactgatgcacttttaactgataaagctgatgctgctacactcattttcgaaaattttgaaattcttgaagctagaaatcaaggacttaatgtagattattttccacttaaaaattataatgtacccgatttttgtcaactcattttcattacaacacctgaagtattaaataccgagtga

SEQ ID NO: 1130 - DNA, 1533 bp, Staphylococcus epidermidis
agtagaggatgctcaatgaagataaaactgtttgtcattgttgtcatttttttgatgactattttatcgataatttcaataacaacacgagaaatcgcacatagtaagaatgagacgatattgacacatgcttctcaaaaacatattgataaaatggttgagacagcaatgaagaaaggagatatccccggactagcaatattgatcatcaaagacaataaaatctttttaaataaagggtatggttatgccaatattgaaaaaaaagcaaaggtaaatccacatactcaatttgaaattgcatccaatactaaagcttttacaggttatgcaattctacaactagctcaagaaggaaaaataaatttaaatgacaaagtaagtacatttatacccggatttaaaatgaagtatgaagacaaagaaagagatattactattgaacagctattagctcaaactagtggtatccctggagatatcactgaagaaaatcgttactctaaacagtacgatagtattgaaaatatcgttaattttgcaaaaggaaaacgtctgaaccatgtacctggagaaacttttgaatattcgaatatgaattatgatattttaggtcttattattcaaaatgttacccatcaatcctatacatcatacatccaaaagcatgttttagcccctttaaagatgaaacataccacttttaaagtaaataataccaaatctaataacgaagcattaggttatatatgggaagataatgaaaataaagttgcacaaccagagtttaacattggggatactcctgcggcatatatgatgtcaagtacaagtgatttagcaaaatgggtccaactacagatccaccctacttcaaaatcacaagccaagttaattcgtcaatcgcatcaggtattatctaactcattaaatagtgagcctaacgcagatagctacggttcgggatggtttataaatactgatgaccatctcgtatttcataccggcgttttagataatttctcttcacaaattttattaaatattcgtaaatcttatggcattgtcgtattagccaatacaaattcaaatcaagtgactcgtttagcggaacatttaaatactcaaattatgaataatcgtcattacacaactatagaagaaaaagtgaaccaaacgaaagatatgcaacttatcatttccacattggccgatatattcatggtcatatttagtatcttagtttttagtaaaatcttaaaattacgtgaaggccacatcttcatccgtaaatgtttacgaacttcaatcatgttcagcatcattttgttgggatttgtagcaatgaatattcttttttatctacttcccttgataatattaggagatgcaacttgggggtttgttttatcatggttacctttacattcgaaatatttagttgtaagtgtctatctagccataaccatgttactggtttggttatctttaataagtataacttaccgttctgataaaaagaaaaaacattaa

SEQ ID NO: 1131 - DNA, 1953 bp, Staphylococcus epidermidis
ttgaatttgtgggatgttagagaaaggaagattgggatgcaacaaatcattaactctttgatacacttcgaccgttcaaaaattgatatagctaaaggaatacgacaaggatttttaatgatactaccagcattgataggttacttattaggattccctatgtttggtattctaatatcaacaggtacgctagcacatgtctacgtttttagtggatcaccacaatctatgttaaaaacagtcatcacctgttcactatcatttactatttgcatgattcttggcaccttaacagtatctcagcctattttatttggattactattactgattgttgttacaatcccatattatacgtttaatgcactaaaaatcgctggtccatcatcgacattctttttagtaacgttttgcttatctataaacttaccgatagccccagaagaagcacttttacgtggatctgcaattctcattggtggtatattggctaccataacagtaattttaacaatcatatttgctaaagagaaagcagaagacagagcaattcatgcggattttaaaacattacataacttgctacatcattttgatgagccagaggatttcaaagcatatgctcgaaacgctgttacagaatttagaaattctgaaaaacttttaattacctcaacatcaggtggtaatggaaaattaagtaaaaggtttcagaaattaattttattacacacatcagcacaagggatatattcagaattactagaactcaatgaaaatcatattcgtccattaccaagtgacttagttgaaatgatggatcatatcattaaaaatgttcaacaacctaaacaacaatatcgaccgtggtcaaaagttgttgatgtggcaccagaatttcaaaatttaatggatcatattttgaaaatagatgaaatgattcacgcaaacgataatcaaattaaatatgaagcagatattcgcaagcctttatatagtaagcgaatatatcaaaatctaactttcgactcaattgtatttagaaatgctttgcaatatacagttattatggcagtagctatatttattgctctagcgtttaacattcaaaaagcgtattgggtgccattgtcagcgcataccatcatgttaggtaatgtgacaacgattcgtacgttagacaggtcacttgctagaggtattggaacgataatcgggactattgttttgtcgggaatcttggcatttcatatcgatcctattttcgctattatcattatgggattttctgccatgatgacggaagcgtttgtggcatctaactatgcatttgcagtcatttttattacgacacaagtcattatgctcaatggtctagcctctcaaaatttaaatattgagatagcgtacacccgaattattgacgttctgataggtatagctattgcagttattggtatattcatactcgcgcgtaaaactgcatcctcaatgttatctgatgctattgccgaattggtacgtaaagaaggtattttatttcattatttattttcaaaaaataaacaggaaacgaatgaacgtgatagggtagaaagtttgaatttaaacgttaaaatcagtaatgtgacacaaatttacaattcagcgaatggtgaattgtttagtaataaagaagcggtaaggtattactatccaagcatatttgctctagaggaaataagttttatgctagagcgtgccatgaataataaacaccgacaaacaataaatgatgatttaatgggtgaatatttagtcgtatttgaaaatatagctaagcatttccaatttcaagcagatttaaatatcagagacatgcaaccattacctcaatataattacatccgtgcttcgcttatgaatatacagcgtaattgtgctgaacaacgtcaggccatcacaaaagattag

SEQ ID NO: 1132 - DNA, 612 bp, Staphylococcus epidermidis
atgaagcagtggatgaatagattaatcaccttaataggcgtattgttaatcattttagctatttatttattctcaaagccatatatcgataattatctacatgaaaaagataacgatcataaaattgaaaattatgataaaaaggaaaaagaacagacaaagacatctaaatcgacgccaaagataccttccgataaatctaaaatggctggttatatagaagttccagatgcacaaataaaagaaccagtataccctggtccagcaacaccagaacaactcaatagaggtgttagttttgcagaaggtgacgaatctcttaatcaacagaatatttcaattgctggtcatacgtttacagatcgttcgcactatcaatttacaaatttaaaatcagccaaaatcggtagtaaagtgtattttaaaactggaaatcaaactagaaagtataaaataactaaaatacgtgatgttaagcctacagaggttaaggtattagacgaacatcctaataagaaaaatcaattaacattaattacttgcgatgactataacgaagaaacgggtgtttgggaaacaaggaaaatattcatagctacacaaattaactaa

SEQ ID NO: 1133 - DNA, 141 bp, Staphylococcus epidermidis
aaattatgtcgtacgtcatacccctttttttataataaatttcttttaatcacagaaaaatcgtattacaaatttaaatataccctatttttaaaattttcaatcaatcttatgtttaaaaacctcactaaagcccgttga

SEQ ID NO: 1134 - DNA, 129 bp, Staphylococcus epidermidis
aagtgtagtcgtgtagctataatgacatttaatataaatttttataaaatgagaataaagtcactgaataaagagagggattcaatcgatggcaaatcaaaaattaccaacattaaaatatactggtaa

SEQ ID NO: 1135 - DNA, 174 bp, Staphylococcus epidermidis
aaacctatgctatatgtcccatttctaataaatacacacgagaatcattataaagccttttatgaaaaaaagaaaagtaattttctgaacaaaaattatttcttaaacatagataagttcgattgtaaaatacaaacatttttaaagaaattgacactttttcatcaattatga

SEQ ID NO: 1136 - DNA, 699 bp, Staphylococcus epidermidis
ggagttatttttatgactggaaatcaaatgttttgtagagaaaatgaacttgatgaaagttttaaacaattagcatcttatatcaatattcctgtaggcgtattactgccatttaaaagtcaatgttttgtgagacattacaacaaaggacaaattgtctactattcgtctgatgaaaccacgcatatttatctactcttaaaaggtaatattatgagagaaaattttaatttgaatggtgatgtatatcgatatctgaatagagaaaaagtgctctttcctttaaataacttatttcaagataaagttcctaatgaaatgtgtacagccctaacagattgcgaaatgattggaataccaagagatttaatagaatatttatgcaaaaatcacgaagagatttttgtgaaattattctccttattaagcgaaacacagtgtcaacatattgaatacaatatggctttaacgagtaaattagctaaagaacgcgtgactaagattttacgttacctatgtcaaacagtaggttatgatcatgacgagttttatgaaattaagcattttatgacaatacagttattgagtgatatggcaggaatatctagagaaacgacgagtcatatcataaatgaacttaaagaagagaaaatactctttaaaaacagtaaaaattggttggttagtaaagacttataa

SEQ ID NO: 1137 - DNA, 576 bp, Staphylococcus epidermidis
agaagttcccgcaagtcaatacaaaggtcaaggtttccacaaccagtagctgaaaaaagtgctatcgcacatgcgaaaaaacatcgtgaagaatacgaaaaacttggcgaacaattttttaaagataattttagccttaatgttaaagccacaaatgttgtaggaagtggtgatggcgtcgaagtctacgttcattgcgatgatcatgacattgtgtttaatgcaagcatcccttttgataaggaagcaatacatgaagaaggctccatgcgaagcaatgataatggagataccatgagtaatatggttggaactgtgttaagtggttttgaatataaagcacaaaaagaaaaatatgataacttaacaaagttctttaaaaacaatgaagaaaaatatcaatataccggttttactaaagaagcaatacataagacacagaatgttggatatcaaaatgagtattattatttagcaggtaacgttactaatattaataattatagaaaatattatgaacctttaataaaaaaagattctaagagtttcaaagaaggtatgaaaaaaagcaaatga

SEQ ID NO: 1138 - DNA, 978 bp, Staphylococcus epidermidis
aattgcacccgacaagaatatcgtggctcactaggttcacttaatcaactaatgattacaattggtattttagcagcatatttagtcaactatgcatttgcggatattgagggttggcgttggatgctaggattagcagttgttccatcggttattttacttgtgggtatttattttatgcctgagagtccaagatggttacttgaaaatagaaacgaagaagccgctcgtcaagtgatgaagattacttatgacgatagcgaaattgataaagaacttaaagagatgaaagaaattaacgctatctctgaatctacatggacagtcattaaatcaccatggttaggtagaatattaattgtaggttgtatatttgctattttccagcaatttattggtatcaatgcagtcattttctattcatcttcaatctttgctaaggctggactgggtgaagcggcgtctatattaggttcagttggtataggaactattaatgttcttgtaacaatagttgccatttttgtagtagataagattgatcgtaaaaaattacttgttggtggtaatattggtatgattgcctcattattaattatggcaatcttaatttggacaattggaattgcttcatcagcgtggattattattgtttgtttatcattatttattgtattctttgggatttcttggggacctgttctatgggttatgctacctgaattattcccaatgcgcgcacgtggcgctgctacgggcatttcagcgcttgtgctaaatatcggaacgcttatcgtgtcattgttcttcccaatattaagtgatgcattaagtacagaatgggtatttttaatctttgcgttcataggtgttttagcgatgattttcgtaattaaattcttaccagaaacacgcggacgtagtttagaagaaatagaatatgaattacgtgaacgtacaggggcaagaactgaataa

SEQ ID NO: 1139 - DNA, 2082 bp, Staphylococcus epidermidis
atagaggtgctaattgtgaagacaagacaaaataaatacagtattcgtaaatttagcgtaggtgcatcatccattctgattgcagcattattatttatgggtggaggatcagctcaggcagctgagcaacaacaggataagggaactgttgaaaatagcacaacacaatctattggggatgaaaatgaaaagttaagtgaacaacaatcaacgcaaaataagaatgttaatgagaaaagtaatgttgattctattactgaaaatgaaagcttacataacgaaacaccaaaaaatgaggatttgattcagcaacaaaaagattctcaaaacgacaataaatctgaatctgtagttgaacaaaataaagagaatgaagcatttgttaaaaaacattccgaagagaaaccacaacaagaacaagttgaactggaaaagcatgctagtgaaaacaatcaaactttacactcaaaagcagcacagtccaatgaagatgtgaaaactaaaccttcacaacttgataatacaactgcccaacaagaagactctcaaaaagagaatttgagtaaacaagatacacaatcatctaaaactactgatttactacgagcaacaggtcaaaatcaatcaaaagatagccaatcaacagaagaggtaaacaaagaagtaaaaaacgacactcaacaagtgactgctaagaacgatgacgacaaagttgaaacatttaatttaaatagtaaagaggaacctcttaaagttgacaagcaagcgaatccaactacagataaagataaatcttctaaaaatgataaagggtctcatgatggtctcgctaatttagaaagtaatgctgttgctacaactaataaacagtctaagcaacaagtaagtgaaaaaaatgaggatcaaacaaataaatcagcaaaacaaaaacaatataaaaataatgatccaattattttagtacatggtttcaatggatttacagacgatatcaacccatcagtgctaacgcattattgggggggcgataaaatgaatattcgccaagatttagaagaaaatggatatgaggcttatgaagcaagtataagtgcatttggtagtaactatgaccgtgctgttgagttatactactacatcaaaggtggacgtgttgactatggtgcagcacacgcagctaaatatggtcatgagcgttacggtaaaacctatgaaggtgtgtataaagattggaaaccaggtcaaaaaatacatttagttggtcatagtatgggtggtcaaacaattcgccaattagaagagctattgagacatggtaatccagaagaagttgaatatcaaaaacaacatggtggggaaatttctccattattccaaggtggccacgacaatatggtgtcatctattacaacactcggtacaccacataatggtacgcatgcgtcagacttattaggtaacgaagcaattgtacgtcaacttgcatatgatgtaggtaaaatgtatggtaataaagattcacgtgtagactttgggttagaacactggggattaaaacaaaaaccaaacgaatcatatattcaatatgttaaacgtgttcaaaattcaaaactatggaaatcaaaagatagtggtttacacgatttaacacgcgatggcgcaacagatttaaaccgaaaaacatcattaaatcctaatattgtatataaaacttatactggcgagtcaacgcataaaacattggcaggaaaacaaaaagctgatcttaacatgttcttaccatttacaattactggtaatttaattggaaaagctaaagagaaagaatggagagaaaatgatggacttgtttcagtcatttcttcacaacatccatttaatcaaaaatatgttgaagctacagataaaaatcaaaaaggtgtatggcaagtaactccaacaaaacatgactgggatcatgtagactttgtaggacaagacagtacagatacaaaacgtactagagatgaattgcaacagttttggcatggtcttgctgatgatttagtacaaagtgaacaattaacatcaacaaataaataa

SEQ ID NO: 1140 - DNA, 168 bp, Staphylococcus epidermidis
ggtcgtcaacggtctagtaatgcctcatccgctatagtatttattattgggggcacttattcgttgctgcatcaacccaatttagcattatttaattattgggccgttttaattattgcgtttaaccagtggggtggttcgatgttttcgggtacttgttttatttaa

SEQ ID NO: 1141 - DNA, 123 bp, Staphylococcus epidermidis
atgcataaacgaattgtgtcattcttgaccacctcttattttttattatgtcatactatttatttacaagtatgtcataataaaaagagaattacaacatttttaagaaaaggctttcattaa

SEQ ID NO: 1142 - DNA, 471 bp, Staphylococcus epidermidis
aatggtaaacgatgccgagaaaagattattaatcaaaatcgtgatattgtcgcaactgagaaatctttaccaccgtggaaacgttttttaagtcatttcagtttctacgcaatcgcattgcaatactttgtagttcagtttgttatcgcgttgttcctaatatggttaccaacatatttaactgaacaatatcatgtgaatttcaaagaaatgactatcagtgcattaccttggttatttatgttcttcttaattttatttggctggagctatttcagacaagattttgaatacaggtcaatcacgttttgttgcacgtggcgtaattgcgattgcgggatttgtggtattctcaatttcaattttcttagcagtacatacagacaacttatatgtaaccattttctggttatcactttgtttaggtggcgtacgtatttctatgggaatgagttgggctgcagccactga

SEQ ID NO: 1143 - DNA, 150 bp, Staphylococcus epidermidis
gtgaacaagcgagacgatatacgtataccattttcaagtgaaaacgatgttaaaaataaattgtttaatattgtttatgcttacaatgctgtaaaaaagaactttaaacaggctgaagactctagaaatcctagaggtcaaaacctttaa

SEQ ID NO: 1144 - DNA, 627 bp, Staphylococcus epidermidis
gggaaatggcgtttttttattgtagaaattggggggatatttatatttattgcgattacatatcataaacaactgactaaggacgatttacagcattataaacatatcgaagaagctattgatggcttgttatttcgcacttccatgaataacgaagaaaacaaggagatgattcaatctttacttcaattgggttttagtaaagataaaataattattcatagcgatgtgacactgttagaggatttacaccttaaacgtatccattttaaagaaaatgacacaactgctttcacatataaagaagctcatcctgatatttgtgtaagtatgtctacacatgacgttgaaacagtaaaacgatgttacgaaaatggtttggattctgtcttttttggacatatttttcctacctcttcacatccaaatgtaccaccgcgttctaaagaagctattcaacaggcattaaatgttcctatccctatttatgctattggtggtattaatgaacattcacttcaaaagatgccacctggatttaaaggtatatgtgccatatcatattttaacaatgcttcactagaagaaattaaacaattaagaaaggagtggtctactcatgcatga

SEQ ID NO: 1145 - DNA, 597 bp, Staphylococcus epidermidis
tatatttttagaaaattgaataagggggagattttagaattgaaagataagattattgataacgcaataaccttattttccgaaaaggggtacgatggtactacacttgatgatatttctaaaagtgtaaatataaaaaaggctagtctatattatcattacgataataaggaagaaatatatcgaaaaagtgttgagaattgtttcaattactttatagattttttgcttaggaaccatgatgataattattccattgacggactttaccagtttttattcaaatttatattcgacgttgatgagagatatattaaattatatgttcaattatctagtgctccagaagcactgaattcagaaatcaaacaccatcttcaagaaattaatactaccttacatgatgaattgataaagtattatgatcctacgcacatcgctttggataaagaggactttataaacttaattcttctttttcttgagacttggtattttagagcctccttttcacaaaaattcgggattattgaggacagtaaaaaccgttttaaagaccaagtatattcactgttaaatgtatttttaaaaaaataa

SEQ ID NO: 1146 - DNA, 123 bp, Staphylococcus epidermidis
acaatatttagacaatcggagtttatagagaattcaagtaagcctcacattaaagaatgtgcaggcttatttgtatatttggaatttttaacttggaagttaaaacaaattctaaaactatag

SEQ ID NO: 1147 - DNA, 471 bp, Staphylococcus epidermidis
agggaatttagaataaaatgttttacggaggagattaatatgaattggttaaaaatattttatcatttattatgcgcaaccacgattagcgtgatattacttattataactatattaatggatgtgttactacaaaacacacatttaactcagttattactcaatattgattttttaatcaaccctgatgaagtgccaacaattattgaagtactgattcatttaagtattggaatattgatttatctcgcctttttaattatctatcattattcaaaatccttgtatcatctagcatacttacctttagtattgatatttactttgatgtatccacttctcgtttttcttgcgcaacgtccatttttttcctttagttggaacgaatttgcatggtggttagttgcacatctttttttcatcattttaatggcgacttgtctacctatcatttcgaaaaaaattttatga

SEQ ID NO: 1148 - DNA, 375 bp, Staphylococcus epidermidis
actattcttagagaacgtctttcaatttctttatgcttatctgcacgtctttctaacttgatacgatctcgtccgagtataattaagaacgaaatcatcattagcgtaaatataacaattaaaggtacactagcaagtaatgatgctgttttcaatacttctaatgcacgttctcctccaactagcattaaagagaacggtagtaaacataacgcaaacgcccagaacaaacgattagcacgtaacggttctcctatcacttttttctgtgacgctgctgctaaaatatatgaaccagaatcgaatgttgttgctaagaataagaaagctgatattaagaataagataatagtaattgtcgagaatggtagttga

SEQ ID NO: 1149 - DNA, 1557 bp, Staphylococcus epidermidis
ggggtaattagaatggtagtacctttcaaaaatgaacctggtattgatttttcagtacagacaaatgttgagcgttttaatgaagaattaaggaaagtaaaagcgcaactaggacaagatataccacttgtgattaacggagaaaaacttactaaaactgatacttttaattcagtgaatcctgcgaatacatcacagctcattgcgaaagtgtctaaagcaacgcaagatgatattgaaaaagctttcgaatcagcaaatcatgcgtatcaatcatggaagaagtggtcgcataaggaccgtgcagaattactgttacgtgtagccgcaattatccgtcgtcgaaaagaggaaatttccgctattatggtttatgaagccggcaagccttgggatgaagcagttggagatgcagctgagggtattgattttatagaatattatgcaagatcaatgatggaacttgcagatggtaagccagtattagacagagaaggtgaacataatcgctatttttataaacctattggtacaggcgtgacaattccaccatggaattttccatttgcaattatggctggtacaaccttagcccctgttgttgcaggtaacactgtattattaaagcctgctgaggatacagttttgactgcttataaattaatggaaatattagaagaagcaggtttaccacaaggtgttgtaaattttgttcctggtgatccaaaagaaattggagattatttagtcgaccataaagatacacattttgtcacatttacaggatcccgagctacaggtacacgtatttatgaacgtagtgctgtagtgcaagaaggacaacagtttttaaaacgtgttattgcagagatgggtggcaaagatgcgatagttgtagataataatgtagatacagatttagcggctgaagcaattgttacatctgcttttggtttctctggtcaaaaatgctctgcgtgttctcgtgccatagtccatcaagacgtacatgatgaaatattggaaaaagcaattcaattaactcaaaaattaactttaggtaatactgaagagaacacatttatggggccagtaattaatcaaaaacaatttgataaaatcaaaaattatattgaaattggtaaaaaagaaggcaaactagagactggtggtggaacagatgattctaccggttatttcattgaaccaacgattttctccggactacaatctgcggatcgtatcatgcaagaagaaatttttggaccagtcgtaggctttattaaggtcaaggattttgatgaggctattgaagtagctaatgatactgactatggtttgacaggcgctgtaattactaatcatcgtgaacattggattaaggctgtgaatgaatttgatgtaggtaacctttacttgaatagaggttgtacagctgcagtagtgggttatcatccatttggtggattcaagatgtctggtacagatgctaaaacaggaagtccagattacttacttaatttcttagaacaaaaagttgtttctgaaatgttttaa

SEQ ID NO: 1150 - DNA, 2871 bp, Staphylococcus epidermidis
aggagaattagattgagtaatttgatacaagatattaagcaatctttatataagggatttatagataaagatagttcccataaaggcaattttgttccaagattactagtaaataacaaagaagaaaatgtactttctactattatagatcagctgcataattgccaatcattttgtatttcggttgcatttataaccgagagtggtttagcaagtctaaaatcacatttttatgatttaagtaagaaaggcgtaaaaggaaggataataacatcaaattacttaggatttaatagtccgaaaatgtttgaggaattattaaaattagagaatgtagaggttaaattaacaaacattgaggggttccatgctaaggggtacatatttgaacatcataatcacacttcttttattatagggagttcgaatttaacttctaatgcattgaaattgaattatgaacataatttatttttatctactcataaaaatggagatcttgttaacaatattaaacataaatttgatgaactttgggattctagcttttctttaactaatgaatggataaatgaatataaacagtcttttgaatatcaaacattgcaaaaagtatttgataacactgtcgttcaaaattcagaaattaaaaagtttaatgagtcaaaacttataaaacccaatttaatgcaagaacacgctttaaagtcattagaatctttgagaaatgtgggaggagaaaaggggttaattatatctgcgacaggaactggaaaaactattttatgcgcacttgatgtaagagcatattctccagataaatttctatttattgttcataatgaaggtatattaaatagagctatagaagaatttaagaaagtatttccatatgaagatgaaagtgattttggattattaacaggaaagagaaaagatcatgatgctaaatttctttttgcaacaattcaaacactttctaaaaaggaaaattataaattctttaactctaatcattttgactacatcgtttttgacgaggcgcatcgaactgctgcatctagttatcagaaaatatttaattattttaaacctaactttttgctaggaatgactgcaacaccagaaagaactgatgaattaaatatttttgaattatttaattataatattgcttacgaaattcgtttacaagaggccttagagagtaatattttatgtccttttcattattttggagttacagattatattcaaaatgaaatgagtcaagaagatgcatttaatctaaaatatttagcatctaatgagcgtgttgaacatatcataaaaaagactaattattatggttactcaggtgatgttgtaaaaggtttaatatttgttagtagtaggggtgaggcgtatcaattagcaaaccaattaagtaaacgtggtatatcatcggttggtttgacaggaaaagattctatagcttatagaactgaaacaattcaacaactaaaagaaggatctattaattatataattactgttgatttgtttaacgaaggaattgatattcctgaaataaatcaagttgtaatgttaagacctactaaatcaagtattatatttattcaacagcttggtagaggattaagaaaaagtactaataaagaattcgttactgttattgattttattggtaattataaaactaactatatgatcccaatagccttatctggaaataaatctcaaaataaggataattatagaaaattcttaacagatactacggttttaaacggtgtttcaacaataaattttgaagaagtagctaaaaataaaatttataattcactagattctgttaaattaaaccaaccaaaattaattaaagaagcttttaacaatgtaaaagaccgtataggtaaattacctttactcatggactttataaataacgattcgatagatccaagtgtgattttctcacgttttaaaaattattatgagtttttaataaaaaataaaattattgagaatgaattaagtattaatgaatttaaaaatttaacatttttatcaagacaattatcacctggacttaaaaaagtagatattgatgtattgaaagaagttatacaaaatgacgtaacttatgaaaatttaacaaaaaaaatgttaaacattaataacgatatttctgaatatgatattaacacttcattaagcattttagattttacttttttcaaaaagactataggtaaaacttatggactacctttaatacaatataaggataatcttatttgtctagcaaatgaatttaaagaggctttaaataaaccactatttaacacatttgttcatgacttaattgatcttgctaattataataatgacagatatcaaaataagaaaaacagtttaattctatataacaaatattctagggaagattttgttaagttattaaactgggataaagatgaatctggaacaatcaatggttatcgtatgaaacatcgtacacttcctttatttatcacttatgataaacatgagaatatcagtgataatactaagtatgacgatgaatttttgagccaagacgaattgaaatggtacacgcggtctaatcgtaaattaacttcaccagaagtacaaaatattttaaagcatgaagaaaataatacagatatgtatatatttgtgaaaaaaagagatgatgaagggaaatatttctactatttaggtaaagccaaatatattaaaggaactgagaagcaagattatatgcctaatggaaatagcgtggtaactatgcatttatcaatgaatacgtccattcgagatgatatttatagatacatcacttaa

SEQ ID NO: 1151 - DNA, 156 bp, Staphylococcus epidermidis
aacattgttagttacatgctttcgttacgctatttacagacttcgtttaacgaaataactctatgtaaacattacaaaatgataacaccgcacacaaacgtacatttttctgataaagtaatgcttgtcgttaaaaaagaacgaaaccaaggataa

SEQ ID NO: 1152 - DNA, 129 bp, Staphylococcus epidermidis
acgacacctagcgcccctcttttaagaagtaataaagataaagcgatagatatcattaatgtccatttattaggaatgctaactataaaaatggataagataatcaaccattcgataaatttacgttga

SEQ ID NO: 1153 - DNA, 210 bp, Staphylococcus epidermidis
cctttttatagttgttttaaagtgaaattttttaaaaagtatgaaattgatttaaaaaaagatattttgtttatgaaaagtaaattgaatgagagattggaaatgaaaaacagagactgtggaagtatgaaagtatataaaaagagtagaacagaattcaatttgaattcattattctactctttaatcttgtatagaaacatttgctaa

SEQ ID NO: 1154 - DNA, 864 bp, Staphylococcus epidermidis
aagtctaatagaaaaacattaaaattattgtacggctatattaagatgaaaataaatgttttatgcgagaagagggacaatatggatattaaacaatcttcagagaaacaaggtcgaccgcatcatttatcagacagtaggacagttttgaaaagaaattttatattaataccaacttatattttattacaaagtatcataccaatcattgttgttttcggctcattaggcatcactgccatgataacacaacaggcaccaccacaatggttgtatcattgttcattgagtttaagttttgtgattgctcaaggtctaatattaattatcttttataaaatacatcaatctgtaataaatgatgtgatgaagcaacaatggataattgcaaagaataaaataattaaaattgtaatagttgcgattgtcgtatatttattattacttataattcgggtgattggaacatcattacctaatcatttaagttatcatctcactcaatccgaacaacgtacgctagggctatttaaatcaccatatgtgttgttagttacttttatatccatggtattcttacgtccaatggtagaacaaatcatttatagatatctcatcatccatgaattaggaaaagtatggaatagacaatttgtaattggtttgtctattgttattgaaacgatcgtacatgtttacgacatggcatcgatttttgaaatttttccatatatcgttattgcttcagcagctacaatactatatattaaatcgcgggataatttaattgtcgcttatatatttcaagtgattttgcaatgtatcctttttatagaaattttatgtaagtataccaacttttaa

SEQ ID NO: 1155 - DNA, 141 bp, Staphylococcus epidermidis
aagtatttcagagtttgcgtcgatgtattgaactttgagactaaaagtaaaggggagtatgaagatgaagtcttcagttcgattgttgaatcacatcataaagataatgaacttacaacaatcattaattataagagatga

SEQ ID NO: 1156 - DNA, 858 bp, Staphylococcus epidermidis
ctacagctcagagtcaagcggaggaaagcgagcgataaggtgaaggataataatgaagtattaaagttatttatagtttcagattcaattggagaaacagcgcaacggatgattcatgcgacgctgacacagtttccagatttaactcaagtagaaattaagaaatttccatatattaaggacgaacaagaatttttaaatgtcttacaattagctaaagaacagaatgcaattgttgcaacaacattagtgagtgagtcatttaatgcattaggtcatcagtttgcaaatgaacatcaaattccctatgtagattacatgtctgagttaattagcataattaaacaacatacacacgctaaaccattaatggaaagtggtgcgttgcgtaagcttaatgatgagtattttaagcgtatagaagcaattgagtattcagtgaaatatgatgatggtaagcattttacagatattggagaagcggatgctttaatagtaggtgtatcacgtacctctaaaacgccattaagtatgtacttagctaataaaggatataagattgcaaatattcctttagtccctgaagtggctattccagataatgtatttcaacaaaagaatttaaaggtatttggattaacagcaagtcccaattatatcgcaaatatacgacgtaatcgtgcagaaacattagggctatcttcagaatctaattacaatagtttagagcgtatcaaaaaagaattatcttatgctgaagaagtttttagaaaattaaatgcaacggtaattaatacagaatataaatcgatagaggaatcggcattttatattgaaaagtttttagctaaacgttaa

SEQ ID NO: 1157 - DNA, 129 bp, Staphylococcus epidermidis
agaatgtgcaggcttatttgtatatttggaatttttaacttggaagttaaaacaaattctaaaactatagcaatggctaaagatatgattaagttcattaaaaaaggtgtcttaagaatgatttattag

SEQ ID NO: 1158 - DNA, 153 bp, Staphylococcus epidermidis
acttctttaagtaagtgggggacaagcagcgctgaatacattggtatagcgagtacaatcgctactactattgaaccgaaccaacaaatacgacgtgctttactccctagaaatttttctgtctgctgtccaggttgtataccctcgaagtaa

SEQ ID NO: 1159 - DNA, 660 bp, Staphylococcus epidermidis
gtctacttaaggagtgtttgcatggaaatattagtcacagcatttgaaccatttggagatgaaaaaattaattctgcactagaggctgttagccatttggaaactaaaattggctgtcataaaattgatcgattgatacttcctacagtatttcatgactctgcggatatgattgctaaagtgttaaaatctaaaaattatgatgttgctctagctatcggacaagcaggtggtcgtagtgaaatcactcctgagcgtgtaggtataaatatagatgacgcacgcattaaagataatcaaggacaccaacctattgatcaagttatacgtcacgatggcgcacctgcttatttttctaatttacctatcaaaagaatgacaatggcaattcaaaaggctggtcttcctagcagactatctaattccgctggaacatttgtatgtaatcatatcttatatcaactcggatatatggcagaccatttttaccctgacttattatttggatttatacacgtgcctttgattcctgaacaaacaatcaatcattctcaacaatcttcaatgtccgttgaagatatcgtaaaaggattaactgaagcaatcaaagctatcgacttcgttgaagataacaagatcgcattaggagaaatccaatag

SEQ ID NO: 1160 - DNA, 1383 bp, Staphylococcus epidermidis
aaatatataagcaaaggcctttgtcttttgtttaactttagtcattatttgtttaacaattgcatcagaggtctttttttaggtcatggaacaagacattctttatataggaaggggaaaacaattatgttaagtattaaaaacttaaccaagatttattcagggaataaaaaagcggtagataatatttctttggatattcaatctggtgaatttatcgcttttattgggacgagtggtagtggtaaaacaactgcactacgcatgattaatcgtatgattgaggcgacagatggacagattatgatgaatggaaaagatgtccgtaatatgaatcctgttgaattgcggagaagtatcggttatgtcattcaacaaattggtttgatgccacatatgactattcgagaaaatattgttttagtacctaaacttttaaaatggtctaaagagaagaaagatgaaaaagctaaagaacttattaaactggtagatttacctgaagaatatttggatcgttatccagctgaattgtcaggagggcaacaacaacgaattggtgttgtgcgcgctttagcagctgaacaagatattatattaatggatgaacctttcggtgcattagatcctattacacgcgatacattacaagatttagtaaaggaattacaacaaaaattaggaaaaacatttatttttgtcactcatgatatggatgaggctattaaattagcagacaaaatatgtattatgtctaagggaaaagtcgttcaatacgatacacctgacaatattttacgatatcctgcaaatgactttgttagagattttattgggcaaaatcgcttgattcaggatcgtcctaatatgaaatctgtggaaagtgctatgatcaaacccgtcactgttaaagcagatgattcattgaatgatgcagtaaatattatgagaacacgtcgagtagacactatttttgtagtcaataatcaaaataaattattaggatttttagatattgaagatatcaatcaaggattacgtgcgcgtaaagaattaattgataccatgcaaagggatgtctacaaagtacatatcaattcaaagttacaagactcagtgcgtactattctaaaacgtaatgttagaaatgtacctgtggtcgataatgatgaacatctcattggtttaattacacgtgcaaacttagtcgatattgtgtatgactcaatttggggcgaagaagattctgatagttatgagatcccaaatgaaagcttagatgagaataatcacgatttaccacaaaatcaaactgatacacgaacaaatataaatgaagatgtgaatgattatcatgatgctcaacatagaggtgaggattaa

SEQ ID NO: 1161 - DNA, 123 bp, Staphylococcus epidermidis
aacttaataagtaacaaaacaaaagtgtacgttaaggacgtttatcagcgtgatcacgtgcactttttaactatgaataaagttgatttaaaaattagaaaggaggaacaacgacgatgctaa

SEQ ID NO: 1162 - DNA, 1761 bp, Staphylococcus epidermidis
aaagggaggctatttgtaaaaatggcacaaattaaagcaaatgaagcattagttaaggcattacaaacctggaatattgatcatttatatggtattcctggcgactcagtagatgctgttgttgatagcttacgtacggtcagagatcaatttaaattctatcacgtacgtcatgaacaggtagcgagtttagctgctgcaagttacacaaaaatgacagggaaaattggtgtagctttaagtatcggaggacctggtattgtacacttattaaatggtatgtacgatgctaaaatggataatgtacctcaacttattattgctggacaaacaaatagtacattattaggtacaaaattcttccaacagacaaacatttctaaaatggttgatgatgttgctgtatatcaccaccaaattcaaaaaggtgataacgtatttgaaattacaaatgaagcaattcgtacggcatacgagaaaaaaggtgtctctgttatcatttgtccaaatgacttattaactcaaaaaattaaagacactacaaatcgtgcagttgatacaactaaaccaaaaccagcttcaccaaaattcaaaagtattaaaaaagcagctaaattaattgataaagctaaaaaaccagtaatgcttattggtttaggtacacaacacgctaaagatgaattacgtgaatttattgaagctgcaaaaattccagttattcacacattacctgcaaaaacaatcttacctgacgatcatccttatagtattggtaacttaggtaaaattggtactaaaacatcttatcaaacaattcaagatgcagacttattaattatggctggtacgaactatccgtatgttaactatttacctaagaaaaacattaaagctattcaaatcgatacgaacgaagaaaatattggtgcacgctttaaaattaatgtaggtattttaggtgatagtaaagttgctttccatcaactaactgaaaacattaagcatgttgcaaaacgtccattcttagataagacattagaacgtaaagcagtttgggataaatggatgaaacaagatttgaataatgacaattcaccattacgtccagaacgtttaatgaaagcaatcaatgctaacttaaaagatgatgcaattatctcagcagatgttggtacttctacagtatggtctacgcgttacttaaacttatctgtaaataataaattcattatttctagttggttaggtactatgggctgtggtttaccaggtgcgatggcagctaaaattgcttatccaaaccgtcaagcagtagctatcacaggtgacggtgcgttccaaatggtaatgcaagactttgctacagctgttcaatataacttaccaatgacaatcttcgtattaaataacaaacaattgtcattcattaaatatgaacaacaagctgctggtgaattagagtatgccattgatttttctgatatggatcatgctaaatttgctgaagctgctggtggtaaaggctatgttgtgaaagatgtaagtcgtcttgacaacatcgttgaagaggcaatggctcaagatgttccaacaatcgttgacgttcatgttgatcctaatgctgcaccattaccaggtaaaattgtaaacgaagaagcatttggttacagtaaatgggcttatagatcaattactgaagataaaaacttagactttgatcaaatcccaccaatctctgtagcagctaaacgtttcttataa

SEQ ID NO: 1163 - DNA, 327 bp, Staphylococcus epidermidis
gaaggtgtaagaatgaaaggtaaagaaaaggttaaagttacaacaatgaatgaaatgattcctcaaataggcaaaaaagtagttgtaaacgaaaaagaaataggtatttttcttacagataatggtgatttatatgccattggaaatatatgtccacataaagaaggaccgttgtctgaagggactgtaagtggtgattatgtttactgtccgttacacgatcaaaaaatagctttaaaaactggagaagtacaacaacctgatacaggatgtgtagaaacatatgaagtagaagttattgatggagatatttacttatgtctataa

SEQ ID NO: 1164 - DNA, 156 bp, Staphylococcus epidermidis
catgttacaagttatctgacaagtatttttcggaaaattctttcttttataatgaaatctttctacgttcttaattatcaattttcaattaaaataaaaacctcttgcaaagtaactaatactttacaagaggcatatattattgatcagtattaa

SEQ ID NO: 1165 - DNA, 147 bp, Staphylococcus epidermidis
acaaatcaaagtatcaatctttgttcacctaaagattatctaataattgcaattgctagatttcatatcatttctagatttgagagtaactatttttctgagcgtatacctgttgtaataaatattgaccattttctaataagttaa

SEQ ID NO: 1166 - DNA, 711 bp, Staphylococcus epidermidis
attatagaaaggaagtttttatttatgccaaaattaatactatgtcggcacggacaaagtgaatggaatgcgaaaaatttatttacaggttgggccgatgtcaaactatcaaaacaaggaattgaagaggcgcaatcagcaggtaaaaaaatttacgacaatcaaattgaaattgatattgcgtttacctctttactcactagagctttagaaacaacacaatatattttagcaggttctgaccaacagtggattcctgtttataaaagttggcgtttaaatgaacgacattatggtggtttacaaggtttaaataaagatgatgcgagaaaaaaatggggggaagatcaggtgcatcaatggagacgctcatatgatgtacgtccgcctagagaaagtgaagaacaacgagaagcatatttaaaaaatcgtcgttatcaacatattgatcaccgtatgatgccttattgtgaaagtttgaaagatacattagaacgagttgttccgttctggactgatcatatttcacaacacctattagatgataaaactgtacttgtttcggcccacggaaattccattcgcgcattaattaagtatttggaaggtttatcagaagaagatatcgtcggatatgaaattaaaacgggtgcaccgctagtatatgaactcacagatgatttagttgttaaggataaatattatttataa

SEQ ID NO: 1167 - DNA, 903 bp, Staphylococcus epidermidis
ggagtggaaagtatgaataaagaacaattagaaaaaatgactcatggtaaaggattcattgctgcattagaccaaagtggtggtagtacacctaaagcacttaaagaatatggtgtgaatgaagaccaatacagtaatgaagacgaaatgttccaacttgttcacgatatgcgtacacgtgttgtaacttcaccttcattttcacctgataaaattttaggtgcgattttattcgaacaaactatggatcgcgaagttgaaggtaaatacactggagactatttagcggacaaaggcgttgttcctttcttaaaagtcgacaaaggtcttgctgaagagaaaaatggcgtacaattaatgaaacctattgatgatttagatgaaactttagatcgtgcaaatgaacgtcatatcttcggtactaaaatgcgttctaacatccttgaacttaatgaacaaggaatcaaagatgttgttgaacaacaatttgaattcgctaaaaaaatcatcgctaaaggtttagtacctattatcgaaccagaagttaatattaatgctaaagataaatctgaaattgagaaagttttaaaagctgaaatcaaaaaaggtttagattcattaaacgatgatcaattagttatgttaaaattaactattcctactgaagctaacttatataaagatttagctgaccaccctaatgttgtacgtgtagtagtattatcaggtggttacagccgagatgaagctaacaaattgttaaaagataacgatgaattaattgcaagcttctcacgtgcattagcaagtgacttacgtgctagccaatcacaagaagaattcgataaagcattaggcgatgctgtagattcaatctatgatgcgtcagtaaataaaaactaa

SEQ ID NO: 1168 - DNA, 855 bp, Staphylococcus epidermidis
caaaaaggaagtatcactatgcataaacgacttttcatcactttattaggttttatcattttactagctggatgcgattattctaaagaagagaaccaaactggtatattttataacgtttttgtaaaatctatggatggatttcttcattttcttggcagagtctttcaggataactatggctttgctattatttctattgtactcatagttcgtttcatcctattacctttcatgttaatacaagttaagaatatgcatatgatgcgcgaaaaaacaaaagtcgtccaaccagaattggatgctataagagataaaatgaaacacgcaacatcacaagaagaacgtaatgcagccaatcaattgcttatgaaaaagtatcaatcgtatggaattaatccattaaaaaatatgttagggtgtcttcctgttcttatacaaatgcctatattaatggggctttatatgagtttgaagtacccttcgagtcacggaattactgaatacccacatttcttatggtttgatttaacgcaacctgatttgattatgacaataatcgcagcaatcatgtattttgttcagccacttgtaaactcaatccattatccaaaagatcaaagaaaaacatattactttatgatggtattttcaccgatattcataacatatgcgtctctacattctgctgcagctttgggcttatattggagtataagcgctgcttttctaatagtgcaaatgcattttgctcactctcattataagaaagtggcactacatgaagctaaaaaactcaaacaaaaattagagcaaaataaagacaatagtgagttattaaccgaagagtcataa

SEQ ID NO: 1169 - DNA, 1362 bp, Staphylococcus epidermidis
aattcgttgagagtttacaaatataatcatgccaaatgtatttatatttactacataattacatttttaaatatctcaaataattcatatttagagaggatttcatttatgaaaaaattgattactcttattgtcatgatatcttttgttttagcgagctgtgggggcacatcaagtacagacaaagacaccctcaatgttgaaatacctttgaaaactaaatcaattgcaccttacgaaactgatatcccagttaaaacaggtgccttggaatcgctttttaaaatgtcgaagaatggtaaagtaaaacctttattagtcaaaaattatcatcaagtatctgacaatcaactagaactcactttaaaagataatattaaatttcaaaacggtcatcatttaacaggcgaagctgtaaaacgcagtctcgaagaaggaatgaaaaaaagtgatttgttaaaaggatcacttcctattaaatcaatcaatgctcatggacaaaaagtcacaatcactactaaagaaccttatccagaattaatgtctgaactcgcaagcccatttgctgctatttacgacacaaaagctaaaaacaaagtaactgatcaacctgttggtacgggtccttataaaattgatcagtataaacgttcgcaaaaaatcgtactaaaacaattcaaagactactggcaaggtacgccaaaattaaaaagaattaatgtcacttatcatgaagatggtaatactcgtgttgatcacttattatcaggcaaatcagatttgactactgatgttccaattgaacgcgttgatgatgtaaaaaaatctaacaaagcaaacattcaaagtacatcaggctttagaacgcatttaatgttatacaatcatgatagtaaaaaagttaataaaaaagtaagagaagcactagatatgattattaatcgaaaagacattgctaaaaatgtttctaaaaattatgctgagccagcatcaggtccttttaaccatcgattaaaatcattagaaaaagaggaaattcaatcacaagacatcaagcgtgcaaaagaacttttagctcaagaaggttattccaaatcgcatcctcttaaattaaacatggtcacatacgatggcagaccagaattgcctaaaattggacaggtgatacaatctgaagctaaaaaggcaaatgttgatatacaattacgcaatgtagatgatatcgaaggatatctcaaaaacaaacagagttgggatgtttcaatgtatagttatttaagtgtgccacgtggtgatacaggttatttctttaacactgcatacttacctgatggagcattaaataaaggtaattataggtaa

SEQ ID NO: 1170 - DNA, 1431 bp, Staphylococcus epidermidis
gggcacatgaggtatcgtatgacattgcagaatcatttaaaacatcgcatattgttgatctatggagacaactcattgaagaggtgctatatgattaatttattcgaaaattataatcaagaaacacaggaattacatcaatctcttaagcgtgctggttacaatcactttacgattgtaattaatgatgatggatttttacctgatgatgtgacatcgccgtatcgttttttcacagcatatcaaatttatgaagatgatacccctgctttttttaatgatattgatacgccgcctttttgggaaattaaaggagatgcgacaatggctaccattacagatatgggtgagcttagaggtaaaatcttttataaggaacattataagacacgtgtagttagccatgtagagtggcttgattcaaaacagcgtttgcgttcggttgattattatacaaaagaaggatttaaatttgctgaaacagtttacgatttgttaggtaatgcaatattaaaaaagtatatgacacgtgaaggtaaagaagtgatttatgagaattatgtaactaacgatgtagttgtagaatatgaagggaaatcttatttttttgagtcatatacagagtggattaaattttacttgagtgaaatgggcattgagataaaagaagttatatttaatactttatcaacaccatttttagcaatttatcatttgccgacattgaaaaaaggtattttattttggcaagaacaatctcagggttatgtcccaggaaatatgaaagtcatgttatcaccaaaccttcaaagtcgctttgccgttattgtccctaatcagaatgaatacaaattgatcaaggaacaactatctagggaggaacaacaggcagtatatgcatctggttacttatatgacacgtataaacggaatcattattctaagaatgtattaacattaacaaattcagatcaaataccacatgttgaaacgttggtacgtttgcataaagattatcaatttcacataggcgctaaaactgagatgtcttcaaaattattaagtttatcgcaatatgaaaatgttaaattatatccaataattaaagaacaaacagttcaaaccttatatcaacaatgtgacatctatttagatattaatgaggggaacgaaatagggaatgctgtaagaagcgcatataatcatcaattgttaattatgggatataaagaggttgttcataatcaagatttcgttgcaatagaaaatcagtttcttgtaaatgatataagtcagttgagtaacgctttgaaagagataggaaatcatcgtggtcaatttgaaacacgtttagcactacaacaacgtcatgctaatgctgtgccggtatcaacatttaaatacgcattagtacaagcattaagtggttaa

SEQ ID NO: 1171 - DNA, 783 bp, Staphylococcus epidermidis
atggtaatgagtaatacagcactttgtctgacagcacttttattactaatccctatctttatttcttataaagaaggattgcatattatcaaagatttagttattgctacaattagagcaaccatacaactattgattttaggctttttattacattatattttcgaaattaatgaaaaatggttattagtgctatgtgtgttagtcattattatcaatgcatcttggaatacaataagtcgtgcttcacctgtcatgcatcatgttttttggatatcatttgtggctatatttgtgggaacagcgctaccattggcagcaactgttgctacaggtgcaattaaatttacagcgaatgaagtgattccaattggaggtatgttagctaataatggtttaatcgcgattaatctcgcttatcagaatttagaaaaagcatttgttcaagatgtttctgatattgaatccaaacttacgttagcagcgacacctaagctcgcatcaaaatcatctattagagaaagtatacgcttagcgattgttcctacaattgattctgtaaaaacatatggtctagtttcaattccaggtatgatgacaggattgattatcggaggcgttgacccacttcaagcaattaaatttcaattgcttgtcgtgtttattcatacaacagcgacgattatgtctgcactcattgcaacgtatatgagttacggtcaattctttaatgctcgtcatcaactcattgctagaacgcaacgcacaagacaaagtagttaa

SEQ ID NO: 1172 - DNA, 831 bp, Staphylococcus epidermidis
agagaaatgaggattgagaagatgaaaataggtactatttctgacctacacattgaccgtcatccacacttaaatcctgaaatatatttagaaaagctttgtcaggtgattaaacaaaggtctattgagttacttatcatagcaggggatatatctaatgactataggataagttacgattttattcaaagcattcaagaattaagcgggatacctacttattttgttccgggaaaccatgatttatggtctgaccaagcagataaaacttcaacagaaatactatcattctttcgctcaaaagaggaatgcttgatcggcaatccaatcattattaatgatcaatatgcaattgtaggccatgtcggttggtatgattatagctatgcagatcatcgtttttctcagcaaaaaatagcaagtggtaaacattatggtgcaacttggcaagataaagtgagaacagattggtcattatcagacccgaaactatcccttttagctgctcaagaggtggaaaaagacattaacaatgtaagcccacgtcaaattattttagttacgcacgttgtaacacatcctcaattcgtagtaccaacgcctcatcgtatttttgacttttttaatgcatttattggtactcatgattttgatactatttatagaaattatcctattcgatttagtataatggggcatgttcattttagaaaaaaacttgttgaaaataacatattatatatatgtccgtgcttaggatatcaaagacaatggatgacagatgatatagcatatgaaataaatcatgctttagtcgattttgatatttag

SEQ ID NO: 1173 - DNA, 375 bp, Staphylococcus epidermidis
gtaggagtgagtatgttgaagaagttattagtcggggttagtgtactaactttattattagcaggttgcatgagtcacgagtacgcagacaaaatagataaagcggttaaactacaagagaaaaagcaacaaaaaattgctaaaaacgattcaggtgatgaagttaaacattttgataaaaaagatgccaatatttatgtgtttgacaaaggaaaatatgttgtattggagtataaaccacttagtgatgatgctgaagcgcgttactatacttatgaatttaaagataaaaaagcatattataataaagactttaatgcaaaagcatactaccaatctcatgagcctgactataaagaagagaatatgtattaa

SEQ ID NO: 1174 - DNA, 474 bp, Staphylococcus epidermidis
agaaaacagaggggaatggttattttggaacaaacgcatctcgttaaaaacaaaacggttgataacaagaagtcaatgaaatacagtatttttcaacaagcattaacgattgcagtgattttacttatatcaaaaattattgaatcatttatgcctattccaatgccagcttcagtaattggacttgtactattatttatcgcattgtgtacaggcattgtgaaattaggtcaagttgagactgtgggaactgcattaaccaataatattggattcctattcgtaccagctggtatttcagtcattaactctttaccaatccttaagcaaagccctattttaattattttacttattattatttcaacacttttattattaatttgtactggctttgcgtcacaattattagtgacgaaatcacttttcccttctaaagagaaaaatgaagaaacaagtcacgtaggagggtaa

SEQ ID NO: 1175 - DNA, 1491 bp, Staphylococcus epidermidis
agaacagagaggtcaacaatgaattacttaaaacaatatgaatcatttttttggttaataggaatttttatcttttatcttataatggcaattctaacaccattatcaactacggattggcatgcatataaagttaatctaagtcaatatttgactcaagaaaatggtcgttatttaggacatttatttgaatgggttgccgtacataatatcataataagagctttaatatatgcgataacttcgtttttagttatctatttagttgcttatatggttcaattacatacgaatcgtttttattttattttgagttttgtgttaatggttactgtacctaatacaatttatagcgaaacttacgggtggtttactggattttttagttatatacctgctacagtcctatcactttttattctttttactgtagttaaaatgattgagtcgcacgatacagtttctgaaatgcaattatgggtatttttattagtaagtttgtttggacaattcttcttggagaatctttccatcgctaatagcttaattattttaataggaatggtagtctatttctttgttaaaaaaagactcagttatttcttaattgtaggatttatgcttagttgtataggtaacattataatgtttttaaacttcaattattttttaattaaggatggattaaatacgcattattcaatttccgatagtcatggaatgatacataaagcaggtgtgacgttatttaagcttgtaccagaatatatgtttattaatcaaatgattattcttaccgtgatatcaatagtaagtatagttttacttaagcaaaataaaagcctgaagcatatgagagtttatattaaaataccactactcttaggtttaattactttacctatttataagatcttcgtttacaatcaatttcattttgaattatataaagcttcattttctatagccgttttgaatacaacgatttgcttcatttacatgataagtgtgatatacgttgtgtttaaaatgatacagcaaagatacataagaatgattgtgatggggagttttatagctatggcttcatctgttttgccacttttatttgtgacgcctataagttatagaaatttttattttatttatactttatggatcgtgatattactttgtttaattcagcaatgtgatgtgctatttaaacaacttgaacatataattaaaatatttgcgattatcatcagcatcattatgatgattggatttacttttatacatattagtagtgtgcacagaatagacttcattaaagaacaaataacacaacatcatcgctatcagaaaataacattggaaagattaccatttgagcgatatactcatatgactacaccaaagtcgaaggaacaacttcaagatttcaaacactattatgatttgcccaaagacatcacatttaaagtagtcccatatggtacaaaacaataa

SEQ ID NO: 1176 - DNA, 525 bp, Staphylococcus epidermidis
aaaggatggaggatatacgctttgaaaaaattttcagctacaatagtagtaatcattcttatatgcgcattgggcttttcattatatgcagctattaaccaccatacgaattctaataagaatgataaaaaaatagaacacaatcgcaaaaataaacaaaatgatacttcaaatcagaatcgtgatactaatcaacaccaagaccaaactcaaccaacaaataatgactataacaacgataatcaatcagatactgaacaaccagcacaacaacctaactatcatcaatacccaaataataatcaacagtctggttcaaataaaaataactcttcagaaaataacaaacagaaaccgaatcagaacaaaactaatcaatcagattatcaaccatcacaatcaacaccacaacagtcgtcacaacctaataataatcaatctgattcacaacaaaatggcaactcaaataataattccaacaatcaaaatcatggaacaaatgataatcagaataaaaatcgttaa

SEQ ID NO: 1177 - DNA, 1356 bp, Staphylococcus epidermidis
ttcataaggagaattgatatgaaagtcaaaagtatttcacggttcttttcaatgaagaaagtgacgctaagtttcgttactttatttattggagtagggacaataggttcatacaatcagtatgctgatgcaagtatgaaaacgcaacaaacacatgtaactaagtcatctccaactcaaaagacgacgtccaattttaaacgttcagttaaagatacgtctgttaaatctagagctacatcaataaaaagagctacatcaaccaaacaagctatatcacccaaaacgtcatcaactaaaaaaactacaatagcaaaaaaatctaccacagtaaataaaacgcgcacaacaaccaagactcagcctaccattcgtaagagttcaacaacttcaacacgttcaaaaacaatgcctacttctgtgaaacgcacaacttctcataaagcaactactgtgtcgccaacttctaaagctaaaatatcaacaaagacacaacaatcaactaaaagtcatacaacttcagttaagaaaaacactacacaactaagtaaaacaaaatctccgtcaacgtcaacaaaatctaaaacagttcaatcctctacgacaaaggcacaacctactttatcgactcaagttagtacaactactaaagcaaagcaattttcaacgccaactacttctaaaactgatagcagtaaatctttagtaagtttagcatctacagaacgtaaaatagataaataccaatcgatgactcagttagaaaaagaaacaactgaaggtgtacattggagaaaagatacgaaaaacacagggaatcaagtactcattgtggctccacatggcggaagtattgaacaaagtacaacagaattaactaaaacattagcagataaaggtaattatgattattatgcacttgaaagcattcgacctaaaaacaactctgaattacatgtgacgtctacacattatgatgatccgacattaaatcaaatgattaaaaaccgtactgcaactatttcgattcatggcgcatcaggtactgaggagattatctatcttggtgggccccgttcagatttaagaaatgctatagagaagcaacttgtaggatgtggatttacagttaaagttccaccagagtatctaggtggtcaaaataataaaaacttcattaataaagaagacaataacactggcgttcagttagaattaacgactgctttaagaaaagcattctttaaaaatggagatactagtacaaaaaatcgtaccaataaagaaaattggacaccaacaatggaagcatttattaatgcattatatgaaggtatcaatcaaacgtattcataa

SEQ ID NO: 1178 - DNA, 489 bp, Staphylococcus epidermidis
ttgctaattgggaggaataaatgtatgaagggtagcaaaaaattaaatgagttactagaagataatcagaagaaactaaaaaaattatttaagtacgatcataaaaaggctttggcgtttacaccagaggatagagaaaaagttaaggataagtttggtgtctatgtgattttcgatgagaaaaaaccagtgtttgtaggtcaaactggaggatattcatccacacatcaacctataaatagtgatttgtatacaaaattaggacaatacaattcacgttcagaaacaggtacaactaaatttagaaaagcttatgctcaaaataaggacttaaatccaaatcatttaaaagacattactgcagataaatacggcttcacttttcaatatataaaagtaaaagacgaacctgcgtttattaatgttttagaaattctcgcattagaatatgcaaaaaataaagggtatgaactttataattttcaataa

SEQ ID NO: 1179 - DNA, 6414 bp, Staphylococcus epidermidis
gaaaactatggggagtttattatgacaaagaaagaaaaggattataaaaaaagtcttgagcaacaaaaaacacgggtaaaaatatacaagtcaggaaaaagctgggtaaaagcaagtattaatgaaatagaattgttaaaaacaatggggctaccatttttaagtaaaaacgaaatacaagaaaatgtgactgaaaagacgaaaggtcataaattaaaaaaaagtgcagctaaaacaacagccctagttggtggagcatttacatttaatatgttgaataatcatcaagcatttgctgcctcagaaacaccaatcacctctgaaatttcatccaatagtgagacagtagccaatcaaaattcaactacgattaagaactcacaaaaagaaacagtcaattctacaagtttggaatctaaccattctaatagtacaaataagcaaatgtcttcagaagttacaaatacagatcaatccagtgaaaaagctggaattagtcaacaaagtagtgaaacatcaaatcaatcatctgagttaaatacatatgcctccacagaccatgtagagagtacaactactaacaatgataatactgcacaacaagatcaaaataagtcttcgaatgtaacctctaagtcaacacaatcaaacacgtcatcctcagaaaagaacattagctccaatttaacccagtcaatcgaaacaaaagcaaccgattcattagcgactagtgaagcacgtactagtacaaatcaaatatctaatctgacatcaacatctacttcgaatcaatcgagtcctacttcctttgcaaatttaagaacatttagtagatttactgttttgaatacgatggcagcaccgacaacaacgtccacgacaacaacttcaagtctgacatctaattctgttgtggtgaacaaagataactttaatgaacatatgaatctgtctggatctgcgacgtatgatcctaaaacaggtattgctaccttaacgccagacgcatatagtcaaaagggtgccatatctttaaacactcgattagattcaaaccgtagcttccgttttacaggtaaagttaaccttggtaatagatatgaaggttattctcctgatggtgtaacaggtggagatggcattggctttgcattttcaccaggccctttaggacagataggtaaagaaggggctgccgttggaataggtggtttgaataatgcctttggttttaaattggatacgtatcataacacatcaactcctaaatctgatgctaaagcaaaagcagacccacgtaatgttggtggtggtggcgcttttggtgccttcgtaagtacagatagaaatggtatggctaccactgaggcatcatctgcggctaaattaaatgtacaacctactgacaattcattccaagattttgtcattgactataatggtgatacaaaagtgatgacagtgacgtacgctggacaaacttttacgagaaatcttacagattggattaaaaacagtggtggtacgacgttttctctatctatgactgcctcaactggtggcgcaaaaaacttacaacaagttcaatttggaacattcgagtatacagaatcagctgttgctaaagtacgctatgtagatgcaaatactggtaaggatattattccacctaaaaccattgcaggtgaagttgatgcgactgtgaatatagataaacaattaaacaacttgaaaaattcaggttacagttatgttagtacagacgctttacaaaactccaattattcagaaacatcaggtacacctacacttaaattaactaactcaagccaaacggtgatttataaattcaaagatgttcaaggtcctcaaattagtgttgatagtcaaactagagaagttggaaagaccattaatccaattacaattactacaactgacaatagtaaagacgtattaactacaactgtgacaggtctaccttcagggttatcttttgatcaaacgacaaatacaattactggcacgccaagtgaagtaggaactacaactgtgacagttaatactactgatgctactgggaacgtaacatctaagcaatttacaataacgattcaagatacaatcagccctgttgtaaatgtgacgccaagtcaagcatcagaagttttcacgccgattaatccaattacgataactgctacagataatagtggcaaagtggtaacgcatacagtaactggattgccacaaggacttaaatttgatgcatctacgaattcaattgttggaactccaactcaaataggaacaaatacaatcacgattgagtcaacggatgcgagcggaaataaaactacgactaaaattaattatgaagtaacgagaaatagcgcaagtgactctacttccactagcatagtaaatagtgtttcaacaagtataagtaatagtacatcgctaagtgatagtgtaaaagcgagtcaatcattatcaacaagtaagagtctctcagagtcgttaagtgcgtcgacgtcgaatagtacgtcaatccaagcgagcgaatcagcaagcacaagtaaacaattatcagaatcagcgagtacgtcgacatctgatagtgcatcagagtcagcaagaaagagtgagtcaacgagtaaaagtacgtcattaagtgaatcgacaagcacaagcgtttcagattcagcaagcgtgtcaacgtcagaaagtgcgtcaacatcaacaagtgtgagtggctcaacaagtacaagcatttcagactcaacgagcacatcgacgtctgatagcgcatcaataaaagcgagcgaatcagcaagcacaagtaaactattatcagaatcagtgagtacgtcgacgtctgatagcgcatcaacgtcaacgagcgtaagtgactccaatagcgcaagtacgtcattaagtaaatcgacaagcacaagcgtttcagattcaacaagtacatcgacatccgacagtgcgtccacatcaacgagtgagagtgagtcagacagtgcaagtacgtcattaagtgaatcgacaagtacaagcgtttcagattcaacgagtacgtcgacatccgacagtgcatcaatgtcagcgagcgagagtgaatcaaacagtaaaagtacgtcattaagtgaatcgacaagtacgagtctttcaggctcaacgagtgcgtcgacatccgacagtgcatcaacgtcaacgagtgagagtgagtcagacagtacaagtacgtcattaagtgaatcgacaagtacgagtctttcaggctcaacgagtgcgtcgacatccgacagtgcatcaacgtcaacaagcgagagtgactcaacaagtgaaagtacatcgttgagtgaatcattaagcacaagcgtttcagattcaacaagcgcgtcaacgtcagaaagtgcatccacatcaacgagtgagagtgagtcaaacagtgccagcacatcgttaagtggatcattaagtacaagcatttcagattcaacgagtacgtcgacatccgacagtgcatcaacgtcaacgagtgagagtgagtcagacagtacaagtacgtcattaagtgaatcgacaagcacaagtctttcggactcaacaagtacgtcaacgtcagaaagtgcatcaacgtcaacgagtgagagtgactcaacaagtgaaagtacgtcattaagcgagtcgacaagcacaagcgtttcagattcaacaagcgcgtcgacatccgacagtgcatcaacatcaacgagtgtgagcgactcggaaagtgcaagtacatccataagtgaatcattaagtacgagcgtttcagattcaacgagtacgtcgacatccgacagtgcatcaacgtcaacgagtgagagtgactcaacaagtgaaagtacgtcattaagcgagtcgataagcacaagcgtttcagattcaacaagcgcgtcgacatccgacagtgcgtccacatcaacgagtgagagtgagtcagacagtgcaagtacatcgttaagtggctcgacaagtacgagtctttcagattcaacgagtacatcgacatcagacagtgcatcaacgtcaacaagtgagagcgactcggaaagagcaagtacatccttaagtggctcgacaagtacgagtctttcagattcaacgagtacatcgacatcagacagtgcatcaacatcaacgagtgtgagtgactcaaacagtgccagcacatcgttaagtggctcattaagtacaagcgtttcagactcaacaagtacatcaacatccgatagtgcatctgcatcaacaagtgagagcgactcggaaagagcaagtacatcgttgagtggctcaacaagtacaagcatttcagactcaacaagtacatcaacatcagacagtgcatcaacatcaacgagtgtgagtgagtcaaacagtacaagcacatccataagtgaatcattaagtacgagcgtttcagattcaacgagtacatcgacatcagacagtgcatcaacatcaacgagtgtgagtgactcggacagtgcaagtacgtcatcaagtgaatcagtaagcacaagtgattcagaatcaacaagcacatccacatcagatagtgcatccacatcaacgagtgtgagtgagtcaaacagtacaagcacatcattgagtggctcaacaagtacaagcgtttcagactcaacaagtacatcgacatcagacagtgcatctgcatcaacaagtgagagcgactcggacagtgcaagtacgtcatcaagtgaatcagtaagcacaagcgtttcagattcaacaagcgcgtcaacgtcagaaagtgcgtcaacatcaacgagtgtgagtgactcgaatagtgcaagtacgtcattaagtgaatcgacaagtacgagtctttcagattcaacgagtatgtcgacatcagacagtgcgtcaacatcaacaagtgagagcgactcggacagtgcaagtacatcgttaagtgactcgacaagtacgagcgtttcagaatcgacaagtacatcaacatcaacgagtgtgagtgcctcaaacagtacaagtacgtcattaagtgactcgagaagtacgagtctttcagactcaacgagcacatcgacatcagaaagtggatcaacgtcaacaagtgagagcgactcggacagtgcaagtacatccttaagtgagtcaacaagtacaagcatttcagactcaacgagtacatcaacatcagatagtgcatctacatctatgagtgtaagcgactcaaacagagcaagtacgtccttaagtgactcgacaagcacaagcgtttcagattcaacaagcgcgtcaacatcagaaagcgcatcaacgtcaacaagagagagtgaatcaacaagtgcaagtacgtcattgagtgaatcgacaagcacaagcgtttcagattcaacaagtacatcgacatccgacagtgcgtcaacgtcaacaagtgagagtgactcaaacagtgaaagtacatcgttaagtgagtcgacaagcacaagcgtttcagattcaacaagcgcgtcaacgtcagcaagtgcatcaacatcaacgagcgtgagtgactccaatagcgcaagtacgtcattaagtggctcaacaagtacaagcgtttcagactcaacgagtacgtcgacatcagcaagtgcatcaacatcaacgagcgagagcgactccgatagcgcaagtacgtcgttaagtggctcaacaagtacaagcatttcagactcaacgagtacgtcgacatcagacagtgcgtccacatccacatcagaaagtgcatccacatcaacgagtgtgagtgagtcagacagtgaaagtacatcggtaagtgaatcatcaagtacaagcgtttcagattcaacaagtacatcgacatcagaaagtgcatcaacgtcaacaagcgagagtgaatcaacaagtgaaagtacatcggtaagtgaatcatcaagtacaagcatttcagattcatcaagcacgtccacatcaatgagtacatctgaaactttcacttctcaatctcctataaatagtgaaagtcaatttattggtgatagcttgtctgaagatacaatcgtgactcaatcaaaaaatacgaatatgcttaataaaactggaaaagattatgatttacaagaacaaagaggttatactgattcagaacaacacaatgaaacacaaagtaatcaagctgataatcactcaaacaacctcgatttacttcatcaaaatcgtttacaagataaagtcgttaaacaaccgactaaaggagaagatggagttgtaagcaacggttttatagtagcagtagcaatagtattggctatcttcggtttggcaaaaaaatctagaaaagacgatgatgatcaagatggtagtaaataa

SEQ ID NO: 1180 - DNA, 1137 bp, Staphylococcus epidermidis
gaaaggagtggtctactcatgcatgatgtactaatcattggttcaggagttattggtatgtcaattgctagacacctcagtgcaacacacttagatgttgcagtcatagatagagatgtacctggaaagcatgcgtcatataaagctggaggtatgcttggcgcacaaaatgaatttacagaggatagtgacttgtttcaattagccatcgaatctcgtgctatgtttccacaattaagtaaatcattattagatgaaacaggcatagacattcaatttaaaaattcaggacttatcaaaattgctaatgaacacgatgatatctcatctataaaacgacaatatcaatttctgaatagtcaagaccgtagtgtcaaacaattatcagatgatgatttgctacaacttacacatggtgaagttaaaccttcatacgcggccattcacataccacacgatggtcaaattaatgcacatcattacacactggcattattagaatcaatgaagttaagagatattaagcgttatgagtctacagaggtcacttcaatagaacggcataatggctattattcagtgaaaaccgatcaatcttcaacaattgaagcgcacaaaattatcgttgcaggtggcgcatggtcttcgcaattattaacacaatatcatctacaacgacaagtgattggcgttaaaggtgaagttatcttattagaaaataacgatctttcacttactgagacattatttatgactaatggttgttacatcgttccaaaacaacccaatcgttttttaattggtgcgacgagtgaatttaataattattctgtcggtactacagatgaaggtatggattggcttcttcgccatgcatatcatcgtgtacctcaactaaaagacagtcatatactgaagaaatggtcaggagtaagaccatacacagaaaaagaaatgccagtcatggatcaaattgatgatggcttatacgtgataagtggtcattatcgaaacggaatattattgtcacctattatcggtcgtgacattgccaattggctactttctggtattaaaccatcacgttattcaagttttacagttacaaggaggaataatcatgaagtgtatcattaa

SEQ ID NO: 1181 - DNA, 831 bp, Staphylococcus epidermidis
gggaggggtggcttaagtatgaacaataccatcatttcaatgaaagaaaaggaattacgttttttaaagttttttcatcaacaaaaatataatgttgtagattttaacttaattgaagaattggattggcaacgattgactcatgaagatttgcaacaaatggatgaaagaagcttttggcaacaaaataaatctatctatgcattaagaaatgattttaccgatcaattattcagatattattcgaactatccaacacattttaaaaaagtagcttatgcaggggatattatcagagataacagagttataaagcaagtcggcattgagaattacgagccacaatttgataatatcactcaaaatttcttagatttccaatattttattcaaaacgtacttcatgatgacattcaatttatcattttaggtcactatcaattgattgatgcacttttagagaaaaatcatcaaactagagaagttatggagatgatagaagaacgtaatttatcagggcttattcaaacactaactttcaatcatcccatcattcaaattcttaaagagaacacattaaatcaacttaaaatactctctcattatttaccagagcgacaccctgcaatggtggcaattcaatcttggtcacaatggtttactgatcatgggattactgaaatccaccttgatgtaactgcacaagcgcctagatcttattacaaaggtatttttataaaatgtcatcttaaaaatactgctcatagcgttttgacaggtggatattatcacggttcactagaaggttttggtttaggattaacactttaa

SEQ ID NO: 1182 - DNA, 162 bp, Staphylococcus epidermidis
aaatacattttggactatgtttatatagattattattgttgttcaactgctcaaatgacaaatttgcctaaagtcaaaattattttacttcttttttatgtgagccaacacaatatttaccgtatgactcagaacatttgtgaagcactgctatttgaataa

SEQ ID NO: 1183 - DNA, 156 bp, Staphylococcus epidermidis
aataacagcggtaattcccttattaatcttatcaaggaattaccgcttcttttatgttatctatcaatgaagaacaaaggcattcaattcatcagtctagatgaatacgacaatgattatttcttgtatttattaagcaatgctggaggaacatga

SEQ ID NO: 1184 - DNA, 1584 bp, Staphylococcus epidermidis
atattggtagggaggaggttttggaatatgaaacgatttataccagcttggtatagccgtaacagatggtgggaaagtacctcaagaccattctatctaaaaaaacagtatacagattttgacgatatgattagtttaatgacaatgcatagttcgaataatgtggattatcaattgatagttttaaattttagtccatatcttagaacattcctccatcgatatgatttgtatgaaagtcattattggtctgtatttgatgagatacagggcgttggacatcaaacgcctcaagctattgattatcgcgatctttcatggccagaaggcactgaatttatttttactccctttcaaattcaagcgattacaggtgataacacgttttctaaaattcacttcagccaagaggggtacctgatgtgggtagaggattacaagtatagtacaattcaaagacgatttgtattcgatgacagaggatttatatcggcagtgcgtacttatacacctgatggtgataacaataaaaaacactatttttcaaaagatggggaagaaatatttgttgaagacttaaatgttaatacagtaacgattaataaaaatttccaatcaaaatttaaaagggttacgtattcatctatggctgagttgatagaagagaaattccaatcatatgtagaaagagaattgaatgaagatgattctgttatagtggcatctgatgaacgtcataattcaatgatggcacgcactattgatgcatcgtctttatgtttttctatttttactgagcgaaataaagtggtgacacaagatttatatgactctatttctagagcatattattgtctcgttgatacacaagctaatcaaaatatgattgaacactacgcaggattgaacatgaatgatattaatcttttaagggtaacgccttttgatgcgaagtcattacctaaccaaagtagtcaattgtatgacacttatattggattatggatagatggtttggacgagattgaaatacgagagattgtaaacagcttatttcaatatattcaacataaagatggctataagttgaaaattttaactaagagtagagataatcttacggaaaatcttatagatgaagttgctcatctcaatgatttatatcaccaagagaaaaaggaaataagtgatgtaattgaagacgtgatacagaataaaaaagaaacaatcattgatattgaaacagtaccgtttgaagaagatcttgtaagcgttatttcaaaattaagagttgtagtagatttatctttagagccgaaactttttttacaaatctgttgtattggcgcgggtataccacaaattaataaaaagagaacagattatgttaaacatatgcataatggatatattattgatgacatatcgcaaactgtagaatctttagattattttttggcacatttaaaaaattggaattattcttatgcatattccatgagattaacggatgattttagttcaattaatattattcatcaaattaatcagttatttaaaggtgatgtttcaagtggcacgtaa

SEQ ID NO: 1185 - DNA, 1257 bp, Staphylococcus epidermidis
cgaaaggtaggtgaaaaaatgcatgtatttaactttttacttttctatccaatttttatgtcaatttactggatagtaggatcgatttactatttttttattaaagaaaaaccctttaatcgatcattgttagtaaaatctgaacatcaacaagttgaaggcatctcctttttattagcttgctacaatgaaagtgaaacagttcaagacacgctttctagtgttttatctctagaatatcctgaaaaagaaattatcattatcaatgatggaagttctgataatactgctgaaatcatctatgacttcaagaaaaatcatgattttaaatttgttgacctcgaagtcaatagaggtaaagctaatgcactcaatgagggaatcaaacaagcatcttacgaatatgttatgtgtttagatgctgacactgtcattgatgacgatgcgcctttttatatgattgaagactttaaaaagaatccaaaattaggcgcagttacaggtaatccacgtattcgtaataaaagttctattttaggaaaaatacagaccattgaatatgcaagtattattggttgtatcaagcgaagtcaatctcttgcaggagcaatcaatactatttcaggtgttttcacactatttaaaaaaagtgcactcaaagatgtaggttattgggatactgacatgattactgaggatattgctgtttcatggaaactccatctttttgattacgaaattaagtacgaaccacgtgctctatgctggatgttagtgcctgaaactataggtggtttatggaaacaaagggttcgatgggctcaaggcgggcatgaagtacttttaagagacttttggccaacaattaaaactaagaaattatcactatatattttaatgtttgaacaaatcgcatcgattacatgggtctacatcgtactatgttatttatcttttttagtaatcacagccaacatcttagattacacatatttaaaatatagtttttcaatctttttcttttcatcctttacgatgacctttatcaatatcatccaatttacagttgccttatttattgacagtcgctacgaaaagaaaaatatagttggcctgatatttttaagttggtatccaacgttatactgggttatcaatgccgcagttgtcattatggcatttcctaaagcattaaaaagaaagaaaggtggctatgctacatggtcaagcccagacagaggcaatatccaacggtaa

SEQ ID NO: 1186 - DNA, 888 bp, Staphylococcus epidermidis
ataggtaaaggagtttatagattgaaaaagataaaaaaagcaataattcctgccgctggtttaggtactcgttttttaccagcaactaaggcgatgccaaaagaaatgttaccaatattagataaaccaacaatccaatatattgtagaagaagcttctaaagcagggattgaagatattattatagtgactggcaagcataaacgtgcaattgaagatcactttgataatcaaaaagaattagaaatggttcttgaaaataaaggaaaagcagacctgcttgaaaaagtacaatattcaacagatttagctaatattttttacgtacgacaaaaagaacaaaaagggctaggacatgcaattcatactgcaaaacagtttatcggtaacgaaccatttgcagtgttattaggagatgacattgtagagtctgatacaccagctattaaacaattaatggatgtttatgaagaaacaggccattcagtaataggtgttcaagaagtaccagaatctgatacacatcgttatggtgtgattgatccttctgctaaagggggaagtcgatatgaagtacgtcaatttgtagaaaagccgaaacaaggtactgccccgtctaatttagcaatcatgggtcgttatgtattaacaccagaaatttttgattatcttgaaacacaacaagagggtgctggaaatgaaattcaattaactgatgcgattgaacgaatgaatagcaaacaaaaagtgtatgcatatgattttgagggtaatcgttatgatgttggagaaaaattaggatttgttaaaacaacgattgaatatgctttaaaagatccagaaatgagtcatgacttaaaagcattcattaaacaactagatatttaa

SEQ ID NO: 1187 - DNA, 699 bp, Staphylococcus epidermidis
gtaatgaaaggtaatttgttacattcaatcatcgaatattactcactgaactgggcctttcttctagaactgttcttcaaacatctattaatgtcggtatatggtgtgttgtttgcatgtataattggaattcctattggtattttcatagccaagtataaacgtttatcgtggccggtaattacaattgcaaatattatacaaactgttccagcaatcgctatgttagccatacttatgttggctatgggattaggaccaacaactgttgttgtaactgtattcctatattcgttattacctattattaaaaatacttatactggtattgtagaagttgatgaaaatattaaagacgctggtaaaggtatgggaatgacggggaatcaaatattaagaatgatagagttaccattatctttatctgttattattggtggtgttagaattgcacttgttgttgctatcggaatagtagcgattgggtcatttatcggtgctccaacactaggtgatattattattcgtggtacaaattcaacagatggaacaacattcatcttagcaggtgccataccaattgctttaatagcaattatcatagatataggattacgttatctagaaaaacgtttagatcctactcgtaaaaacaaaaaagattcaatgcaaaaacatcaagtacaaaaattacattaa

SEQ ID NO: 1188 - DNA, 132 bp, Staphylococcus epidermidis
tattgtgaagggtatcaaattattgatgatatagtaagacagaatgaacagagtaatcaagttgataatatggaacctgatacatcaatcataggtacaggttcttttcttattttgattgtaattgaatga

SEQ ID NO: 1189 - DNA, 681 bp, Staphylococcus epidermidis
agagaggaaggtatgattatgaatcagatgaatcaaacgattattgatgcattccattttagacatgcgacaaaagaatttgaccctacgaaaaaaattagtgatgaagattttaatacgattttagaaacaggtagattatctccaagttcactaggtttagaaccttggcactttgtagtggttcaaaataaagaattgagagaaaaattgaaagcctatagttggggagcacaaaagcaacttgatacagcaagtcactttgtattaatttttgctcgtaagaatgtgacggctcatacagattacgtgcaacatttacttcgtggcgtcaaaaaatatgaagaaagtacaattccagcagttgaaaataaatttgatgatttccaagaaagtttccatattgccgataatgaacgaacattatatgactgggcgagtaaacaaacatatattgcattagcaaacatgatgacaagtgctgcattactaggtatcgactcatgtccaattgaaggatttgatttagataaagtgactgaaattctttcagatgagggtgttttagatacggaacaatttggtatttcagttatggtaggctttggttacagagcacaagaacctaaacatggcaaagttagacaaaacgaagacgacatcattagttggattgaataa

SEQ ID NO: 1190 - DNA, 780 bp, Staphylococcus epidermidis
tacagtagaggagtgacatatatggctttaataacaatgaattacaattcaccaacgataggaatgcatcaaaatttaacgattattttaccggaggatgtaacattctttggtagttcaacaacagcgaaacatttgaaatcaatgttgttattacatggattgtctagcgatgaaacaacttacataagatatacaagtatcgagcgttatgcaaatgaacatcaacttgcgattataatgcctaacgtcgatcatagtggctatgcaaatatggtatatggacatagttactatgattacatattagaaatttacgaatatgtacatcaaattttaccactatctagaaaaagagaagataattttattgcaggacattcaatgggcggttatggaacgattaaatttgcgctaactcaaagtgataaatttgctaaagctgcaccactttcagcagttttcgaagcacaacgtttcattgacttggattggactgatttttcccctcaatctatcacaggcaacaatactcaaattaaaggtacagaactcgatacgtactacttacttgatcaagccatcgatgctaatgtagatattcctgaattgtttatcatgtgtggtaaagaagactttttatatcatgataaccttcaatttattgagacattaaataaaaaaggggtttcttataagtttgaagatggtccaggagatcatgattatgcttattgggatagagctattaaacgtgcgattaagtggtttgtccagtaa

SEQ ID NO: 1191 - DNA, 999 bp, Staphylococcus epidermidis
ataaagagagggattcaatcgatggcaaatcaaaaattaccaacattaaaatatactggtaaatcagaaagtgcagtgccaattgtgtcagaaagtgaattgcaaacggtaacagcagagccgtgggtgaaaatttcagataaagggttacaactagaaggacttaattttaatcgcgaaggtcagttattcttattagacgtgtttgaagggaatatttttaaagttaatcccgcaacaaaagaggttacaacaaaatttcagtctgttaaagataatccggcagcgattaaagtacataaagatggtcgtttatttatctgttatctaggtgattttaagacaactggaggcatatttgcgacaacagaaaaaggtgaacaaatagaagaaattatttctgatttaaatacagaatattgtattgatgacatggtttttgacagtaaaggcggattttatttcactgattttagagggtattctacacaacctttgggcggtgtttactatgtagatccagactttaagacggttacgccaattattcaaaatatttctgtggcgaatggtattgctttaagtacggatgaaaaagtgctatgggtaactgaaactacaactaatcgacttcaccgaatcgcattagaggatgatggcgtgactattgcaccatttggagcgacaataccatattattttacaggtcatgaaggaccggattcttgttgtattgatagtaatgataatttatatgtggctatgtatggccaaggacgtgtattagttttcaataagagaggttatcctataggtcaaattttaatgccaggacgtgatgatggaaagatgttacgtacaacacatccacaatttatacctggtacaaatcaacttataatttgtactaatgatattgaaaaccattctgaaggtggatctatgctttatacagttaatggttttgctaaaggatatgagagttatcaatttcaataa

SEQ ID NO: 1192 - DNA, 1542 bp, Staphylococcus epidermidis
tttataggaggtaataaaatgaagaatttttctaaattcgcacttacaagtattgctgcattaactgtggcaagtcctttagtcaatacggaggttgacgctaaggataaagtatcagcaactcaaaacatcgatgcgaaagtaacccaagaatctcaagcaactgacgcattgaaagagttaccaaaatctgaaaatataaaaaagcattacaaagattataaggtcactgatactgaaaaagataacaaaggatttacgcattacacattgcaaccgaaagtgggcaacacgtatgcaccagacaaagaagtaaaagttcatacgaataaagagggtaaggtagttcttgtcaatggtgatactgatgctaagaaagttcaacctacgaataaggtatcgataagtaaagaaagtgccacagataaagctttcgaagcaataaaaattgaccgtcaaaaagctaaaaacttaaaaagtgatgtcatcaaaaccaataaagttgagattgatggagaaaaaaataaatatgtatataacatagaaattattacaacttcaccaaaaatctctcattggaatgtgaaaattgacgctgaaactggtcaagtggttgataaattaaatatgatcaaagaagcagctactacaggtacaggtaaaggtgtactaggtgacacgaaacaaattaatattaatagtgtcagtggtggctatgcactacaagatttaactcaacaaggtacactttcagcttacaattacgatgcgaatactggtcaagcttacttaatgcaagataaagatagaaattttgatgatgatgaacaacgtgcaggtgtagatgcaaattattacgctaaagaaacgtatgactattataaaaatactttcggccgagaatcatatgataatcaaggcagcccaatcatttcactcgcacatgtaaataatttccaaggtcaagataacagaaacaatgcggcttggattggtgataaaatgatttacggtgacggagatggacgtacatttacagcgctgtctggtgcaaatgatgttgttgcacatgaaattacacatggtgtaacacagcaaactgctaatcttgtttaccgttctcaatcaggtgcattaaatgaaagtttttcagatgtatttggttacttcgttgatgatgaagatttcttaatgggtgaagatgtatacacacctggtgtaggcggagatgccttaagaagtatgtctaatccagagcgttttggacaaccatctcatatgaatgattttgtttatacaaattctgacaacggaggcgtacatacgaattcaggtattccgaacaaagcagcttacaacacaattcgtagtattggtaaacaacgttctgaacaaatttattatagagcattaactgtttatttaacttcaaattctgatttccaagatgctaaagcatcattacaacaagcagcacttgatttatatggcgacggtattgctcaacaagtaggtcaagcatgggacagtgttggtgtgtaa

SEQ ID NO: 1193 - DNA, 777 bp, Staphylococcus epidermidis
attctgggagggattatcttgattaaaaaaagagtgattccatgtttagatgttaaagatggacgcgtcgtaaagggtatccagttccagtcattaagagatatcggtaatccagttgatttggctctttattataatgaagccggtgcagatgaactagtctttcttgatatttcgaagacggaagcaggacatgatcttatgatagaagtgatagaagcaacggcaaaacaattatttatccctttgacagtaggaggagggattcaaaatttagatgatattacacaactattaaatcacggagcagataaaatatcactcaattcaagcgctttaaaacatccagaattaattcgacaagcaagcgagaaatttggtcgtcaatgtatttgtattgctattgatagcttttatgataaagacagagaggattatttctgtactacgcacggtggtaaaaaactaactgatgtcagtgtatatgattgggtacaagaagtagagcatttaggtgctggggaattgcttataactagcatgcatcatgatggaatgaaacaaggttttgatattgaacatttagcaaaaattaaacaattagttaatattccgattatcgcctctgggggtggaggaaatgcacaacattttgttgaattatttcaacaaacagatgtttcggcaggtttagcagcaagtattttacatgatcaagaaactacagtggcagaaattaaagataaaatgcgtgaaggaggtatcctcgtgagatga

SEQ ID NO: 1194 - DNA, 771 bp, Staphylococcus epidermidis
ctgtcaatgggttggaatgagtctcattttttaatcatttatattgagggagggttaatggtgtcttcggagtataaaaaaggaatatttttagctttaggtgcttatattttatgggggattttacccatatattggcgtttaattgatgaaataggcgcttttgaaattttggcattccgtattattttttcagtgatatttatgatttttgtgctcattataggaaaaaatcaacggaacgcttttttaagagatgttaatcagttggtatcgcatcccgtgcaacttattgccatcatagttgcagggtatgttattacagtgaattgggggacatttatttgggcagtatctaatggtcacgtgctacaatctagcctaggttactacattaacccactagtgagtatcgtcttggcgcttatatttttaaaagagagatttaataaattcgaatggttagccatcatttttgcattaataggcgtactttatatgacaataaaaatcggtgaatttccatttatttcacttctgttagcattttcttttggtatttatggtttattaaaaaagattgtgcatatcgatgcgataagtagcatcactattagaatgtattgttactgcaccagccggtttaatctatgttatttacctatggcagcaacaacacataacatttggattaaatatatcatcattttggctactattttcaggtgcaattacagcaataccattgattctgttctcagcaggtgctaa

SEQ ID NO: 1195 - DNA, 801 bp, Staphylococcus epidermidis
acgagagggggagtggttcatatggggaaagtatatttagttggagctggacctggtgatccagaattaataacgttaaaaggtttaaaagccattaaagaagccgatgtcatcctttatgaccgacttgtaaataaagaaatacttaattatgcttctccttctactaagttcttctattgcggtaaggatcctcacaggcactccttaccgcaggaagaaacaaataaaatgatggtaaccttagccaaaaaagggcacatagttacacgtttaaagggtggcgatccatttgtttttggacgtggcggagaagaagcagaggaattagcatgtcataatatccactttgaaattatacctggaattacatcgggaattgcagcaccagcatatgctggaattccagtaacacatcgtgattatagttcttctgtagcatttgtaactgcagtgaataaacctggtatggataaaggcaaatactggcaacatttggccaatggtcctgaaactttatgtatttatatgggggttaagagactcagtgaaatttgtgagttgttaatacaatatggtcgttcgtcagaaacaccagtagctctcgtgcatatgggaacgtcaaaacagcaaatgacagtgactgggacactcgatacaattcaagaacgagcacatcatattcagaatccagcaatgattattgtaggcgaagtggttaagatgagagaaaaaattaattggtttgtagaacaggcaactgttcaaaatgaaacgttaacggaaatgtcatcaacttag

SEQ ID NO: 1196 - DNA, 147 bp, Staphylococcus epidermidis
cttcaaattttcattttgagtcaccttcacttaccacctttattttttgctaatattagtatgaattatcagttccacaatgacaacgtttttttatttctacattttttatattcctcatctaattatttcattagatatgcctaa

SEQ ID NO: 1197 - DNA, 1065 bp, Staphylococcus epidermidis
ggggtttttattatgaaagcagcagtatggtatggacaaaaggatgtacgcgttgaagatcgcgaacccaaagcaataaaagacaatgaagtgcaagttaaagtctcttgggccggtatctgtggtactgatttacatgaatatttggaaggacctatctttatttcaactgatcaaccggacccactacttggtcaaactgcacctgtgactttaggtcatgaattttcaggtgtcgtagaaaatgttggtaaaaacgtatcacgttttaaaaaaggggatcgtgtggtagttaatccaacagtgtctaaaagagaaaagccggaaaatgttgacttgtatgatggttattcatttataggactaggttctgatggtgcatttgccgagtttactaatgctcctgaaacaaatgtttatcatctaccagataatgtttcagcacgagaaggtgctcttgtagaaccaacagccgttgctgtccaagcagttaaagaaggcgaattattattcggtgatactgtagcagtatttggcgctgggccaattggtttgttaactattgttgcagcaaaagctgctggtgcaagtaaaatatttgtctttgacttatcagaagaacgtttagcgaaagctaaaagtgtcggtgcgactcacgtgtataactcaggtaacgtcgatccagtacaaacggtttatgaacatactgacaacggtgtagatgtgtcatttgaagttgctggtgtaggtattactttacaacaatctattgaagtaacacgtccacgtggtactgctgtcatcgtatcaatcttcggtcatcccgtagaattcaatccattattacaaatgaataaaggtgtcaagttaacaactacaattgcttatacaccaactacattccaacaaacaatagatttaatcgctaacggtagcttaaatgttaaagacgtcgtaacagatcaaattgaattagataatattgttgaaagtggcttcaatcaacttgtaaacgataaatctcaagctaaaattttagtccgtttaaatggtgaccaaaaataa

SEQ ID NO: 1198 - DNA, 396 bp, Staphylococcus epidermidis
cttttctttataaaagaagggtgtttgttgatgagtcaaatcgaatttaaggatgttagtaaagtgtatccaaatggccatgtgggattaaaagatattaacttaaatatagaaaaaggtgattttgcagttattgttggactgtctggagcaggtaaatcaacattactacgatcggttaatcggctacatgatatttccaaaggtgatattactatcgaaggtcagtcaataactaaagcacgtggtaaaaaattattagaaatgcgtcgaagtataggtatgatttttcaacattttaacttagttaagcgttcaacagtgcttagaaatgttttgagtggccagggtaggataccatcttacttggaaaatgatactgggtctttttcctaa

SEQ ID NO: 1199 - DNA, 234 bp, Staphylococcus epidermidis
ttatactttatcattttattgttgaaaattataagaatttttatgtcgtttgtgacaaagtacgtaaacatacattcaaatttaaaattaatctatttatttaattatcattttatctatatttcctttttattgttagtaggttttatatcattattactatgcggtcacacttacgctagacaaaccgtagccttacctcaaggtgcaataaggagctttgtatttttttga

SEQ ID NO: 1200 - DNA, 891 bp, Staphylococcus epidermidis
aggtgtcttatggactttatagctattttaatcggattagggccactattaggttggggattatttccaactatcgcttctaagtttggtggacgtccagtcaatcaaatctttggtgctactgttggtactttgatcttcgcaattgttctagcactatttaaaggtataggtttaccaggaggtatggcattagtattttcgctcatatcaggtgcaggatgggcatttggtcaaattattacttttaaagcgttcgaattagtaggttcatcaagagcgatgccaattactactgcatttcaattacttggtgcatctttatggggcgtttttgcgcttggcaactggcccggtataacaaacaaaatcattggatttctagctttactcgtaatccttataggtgcacgtatgactgtatggactgaaacaaagcaacaagaatatagtaaaaatctacgaagtgcagtgatcttattacttgtaggtgaaattggctattggatatattctgctgcacctcaagcaacggatattggtggatttaaagcttttttacctcaagctataggaatggtcattgtggctgtcatctatgcgttgatgaatatgtctaaaggtaatgcttttaaagagaaagtaagttggcaacaaataatatccggatttttctttgcgtttgctgctttaacttatttaatttcagcacaacctaatatgaatggtttagcaacaggatttgttctatctcaaacatctgtagtattagcaacgctaacaggcatttttttcttaaatcagaaaaaaacatcaaaagaattaatgattacaattgtgggattagttcttattttagttgcagcatcaatcacagtgtttattaaataa

SEQ ID NO: 1201 - DNA, 141 bp, Staphylococcus epidermidis
aacttacttatatacaaggagtcaattttagtcctcgttgctgagagaacaacgaatgctgtctcactctttctaattatattattagatttggattacataccccaagcagataaaccttgtgctttatatgctttataa

SEQ ID NO: 1202 - DNA, 123 bp, Staphylococcus epidermidis
cgcatacttatatacatggagttaatcatctcgtacctgagtgagattacattttatttgaatgtagtctcactcttttttactcaaacgattattacgataaaaatatgtatatttcattaa

SEQ ID NO: 1203 - DNA, 126 bp, Staphylococcus epidermidis
atatggcttatacatttttatacgcttatcaccttgaatacacacaaccagattgatatcttaggtaaattagtcattataaaatatgaccttttctcaaaaaaaatatatttattctacaaataa

SEQ ID NO: 1204 - DNA, 324 bp, Staphylococcus epidermidis
gtggtcattatcgaaacggaatattattgtcacctattatcggtcgtgacattgccaattggctactttctggtattaaaccatcacgttattcaagttttacagttacaaggaggaataatcatgaagtgtatcattaatggcgacctcttcactttcgatcagaatcaatcgatacaagaggttttacattcacttgaattagacccaaaacgagtgattgttgaactaaacaaagaacttatcaagcaagacaaatatgaagaatatactgtaagagaagacgacagattagaattactagaaattgttggaggcggttaa

SEQ ID NO: 1205 - DNA, 150 bp, Staphylococcus epidermidis
caacccattattaaaataatcaacaaaacgatattcacaaatatatctgaaaatgaacttaatcgtctaacgtttttgatggatagtcgtcttaaagttagcaacaacattcctattaatgttattataccaaaaacactacctatataa

SEQ ID NO: 1206 - DNA, 195 bp, Staphylococcus epidermidis
ttcattgttattaaagccatatatgtcactcctctactgtattatctattattttacttattcttttcattaatttatagaaaaaacgcaactttgactatagattatataaatttctatactttccaatgcggaactaaaattttattctctatattaaacaagttgattcagtatcgattgtctaacctttaa

SEQ ID NO: 1207 - DNA, 201 bp, Staphylococcus epidermidis
ggtaaccctattgataataatatagatccaatgattgcaccaagaaaattagcaacattgaaaatagaagctgctaacgtacttgcaagaagtggtgcttcttttgcacttaagataattttgctattaagtaacggtgttgtaccaaatgtaccaaaaccgaataagaagcaaatgattaatgctaatattgaattttga

SEQ ID NO: 1208 - DNA, 480 bp, Staphylococcus epidermidis
ggtacatatatgacgatagaaaaaaagaaaaataagattatttttactagaacttttagtgcaccaattaataaggtatttgatgcttatacaaagcgggaactatttgaacaatggtttcatcctcaagacgcatctgtcacagtttatgattttaatgctacgaaaggaggaaacgctttttatgctattcaagctcctcagatgacaagttatactattgctgaatatctgcaagtggatgcaccatattatatagagtatttagactattttgctacgtcaaaaggggaaaaagacacaagtatgcctggtatgcatatcactttgaattttgaagaagtaaaaggaaagactactgtaacatcgacatcgacttttccaactgaaagtgccgctcagcaagcgatagacatgggtgtagaaacaggtatgaattcaacacttaatcagttagagaaattactaaatcaaaagtga

SEQ ID NO: 1209 - DNA, 630 bp, Staphylococcus epidermidis
atacatcatatatcatcaattcgaaatggggttatcaatgtgaaaaagatttctctaattgcaacgactgtattaacaggattattattatttccaagtgtcaatgacacaacgacacatgcagccgaagtaacatctcatgatgcacaagctgtagcaattcaagctatgaaaaatagtggtggcaatccggacttacaaaatttcaaaaaagttaaggataaaggggattatttcacaattgatataaataataaatctggtgcaggtgtcggtacttataaagtatacaaaaatggagtggtgctatataaaagtggaaattatggagaatatagtcaactcaatacacgacaatgttatgttgcacaagatattgctacaacatcttcacaagtaaaacgacactctactcaacagacacaagcagtggatagtacacgtgagctcaattcatactacgtaggtcaagttcaatcttctgacttaccacaacaaagttcatctgatatgctaccgaatactggtatgaaagataaaaatttcaatacaaatggtataataagtctatttttactcactgctggtttcattacactttaccatcaacctttacgtaaaatgtcatag

SEQ ID NO: 1210 - DNA, 192 bp, Staphylococcus epidermidis
cttaatcatatatttttctttcatataagagaagcatcgataattacaacagtgcctgtttctatagcaataaaatctgtcactgttaaatttaggataaacaaaaacggttatccaccttttgttaaggtgaataaccgttttttaatttatctttctaagataagaacaatacaacatgttttcctgtaa

SEQ ID NO: 1211 - DNA, 141 bp, Staphylococcus epidermidis
tatatacatattgctcatcgtcaattttatattcttattattatacaattcacgtatgatttccattttaattatcaagatttctttagtttaatttcatttttggatagaataaatataaaccaattgtttaggaagtga

SEQ ID NO: 1212 - DNA, 621 bp, Staphylococcus epidermidis
  modified_base (509)..(509): a, c, g, t, unknown or other
aggatacatattatgaagataattttaccagtaaagcctataagtcagctattccctatcccttttgtaatggggtgtgagggagtatccgcagcgatgctattacaatttaataattacgatattaaagcaacacaaattatgagtcattggcctaaacatccaaccaatccctacaaaggctatgttggtcatcctttgttagttaaatttggccatcatcaaacaatatttcctgatgcttttgcgccatttcttaaacaatatgattctcgaattgtagatggtacaggtacatcattaaatcaacttgaaaaatttatcgacaaaggtcagccagtgatcatttatcatactagtttgggttctaaaccgcttcgacgtgtatttcatttcgacaatcaaccaacaaaactagtctcaaatattcacgttactttattaatagggtatgatgatgactattattattatattgatccgttatggagtcgtttatcaaaatttgntattttcccatctattattcctaactctaaacaattcattaaaattaaaaagcacactttggaaaatagttataatgccccaggaaaaaaatgcatatatatcgataattaa

SEQ ID NO: 1213 - DNA, 135 bp, Staphylococcus epidermidis
acacttaatatcatttttatttcgtttgtaaaatttaattttttaacacattgttcaagtcaatcatcaacaattcttttcactttgttacttgctcacatttcatctaaatataatttttcatgttatagttaa

SEQ ID NO: 1214 - DNA, 2022 bp, Staphylococcus epidermidis
gtgactaatatgactttcaagattttgtggaaaatgattaaacaaaattttgttaatcaacgtcatatcattgttccatttattagcgtaataagtattttattcggtattgaatacatattgttatcgttaacaaccaacatttactttaatgagcatcatcctgaattaaaaatatctgcgattattggaatagtgtttatgacgatgttattattcatatttttaatttatgcaaatcactttgttatgaatcataggaaaaaggaatttgccttaaatatggttcttggtatggagaaaaaacatctaagactcatcatcttgattgaacttttcattcagtttattatatctgcaatattgagcattgttggaggttacttatttggtgagctcttttttatgttatttaataaactagttaatacgcatcaacctcagttgtctgattatccatttgatgttttatcaatgaaaatcacattaaccatgctactcagtttgatgatcatattgtttgttattaacaattttaaaatatcatttaaaaactccttacagttattgcttaaaaataaaagtaagacgcatgaaaagtcacgtgtacggttaataatatttttaattttaggattaatttttatagggattggctattatttagctataaaacctaacacagctatcggttccttggggattatattttttgcgattttgtcaacgcttattggtacctatttgctctttgttagcttaggatcaatagttttagaaatgttacaaaaattagattattattattataaacccaatcattttttctttattgcaggactcaaatcacgcgtaaaatctagtgcgattggtttagctaccatttcatttatgtgtacatttctgattgttacgttaagtatgacagtctcaacttatagaaatatggatcataggtttgaatttgcatttaaaaatgattacgcaggttattatattggtgattttcataaagatagcaaacttcaacgtaagatagaaaatttaaaaaaagatattcgccaagaagttccaactggtcaatttaaaatttatgcacgaggtatggttggagccgaattgcagggaggcttaaaacataaaaagctaaaaagacaaactgtatcgagtggtttatttaatttcggaaataagcaaaaattcaactcttttatttctatatataataaaagtgattataataaaaacaataaaaaaataaaattagatgatgatgaaattgcaataagtacaagtgtgtcattatttaaaaaaatgaaaacgctcaatatatttgggaaaacatatagagttaaatatattgagtctacaaatatagataacttactctatgcagatggtataactttaattgtgaatcaacaacaactgatggatcgtatcgttaatgaatatcgtaatcacaatgatgaaaatttaatcatcactcctaatcaagtccaaactgccgttgaatttaatgtattaaaagaaaaggataagttgaatcatcgtattaagaaaataggtgttcaacacgatattgaatttcaagtgaaaaaacaaaacctattgatgtggaaacaagtcaactcaagtttagtttttgttggaagtgttgtatctctagttttattgataggtatatttcttatgatgtattataaacaagtttcagaaggacatgaagatagagatgcatatataacgatgaaacaactaggattagatgaaattttaatcaaaaaaacaattaataaacaagtaatatgggtatttctcattcctgtaattgttgcaatcatacatacgttagctgcttttcgcatcatatactctgtattaggaatcgttggtcaatatgacttgggactgtatgctacaagttatgtcggtgtgatagttgtatttattattttttattcaataatgtactggattacttctagaatttattatacgatgataaacggtaagcattaa

SEQ ID NO: 1215 - DNA, 1626 bp, Staphylococcus epidermidis
cggatgattttagttcaattaatattattcatcaaattaatcagttatttaaaggtgatgtttcaagtggcacgtaaatttagagtacttcaagtaggtggtcatgatttaggttctttatttaatcaaaaaagtaatgtcgaatgggattattttgatgttggtttgtttgattttgaaagtggctatcaagatgttgtagtacatattttagatgaaaaaggacaatttgattttgtttttgtacgtgaaaaatattctgattcattaatgaaacttttatcattagtcagtacaccgtataatactgtgattgacaatgagtattgggataatcaataccaacaagataagacaatacaacgtaattttataaaaccactcatttatgaaaatgaagaacaattacaacaaaaactagaggcagttacatttcctgggcaatatggagataaagttaaacctattcattgtcgcgttagtattcattttgatggttcttatcaatttaatggaaatgagtctattgaagtatcaggacgatttggggaatcataccaacccctcattacatggagtcaaaatatcattgctgatgccaataaggtgaatcaaatatggccagaatttaaagttgaaggtgatgctaaaatccaatatacattgagattgacgcctgtttattcaactgatcaaccagtagaaaagctaatatatgaacaagacgatttagacactcccatagaactacctgctcgtccttatcaaacatatgtgagtgtatcaatcaaagctaaaggtaaaggaacattatttataggtgctattcataaacgttggtcacgcttggaattagggcagttcatattaggcggaaaacgatatagtgatgaaaataagcaagaatttatacattacttccatcctggagatttaaaaccaccactcaatgtatattttagtgggtatcgtactgctgagggctttgaagggtactttatgatgaaacgtatgaatgctccatttattttaatagctgatcctagaatcgaaggtggtgccttttacctagggtcagagaattatgaacaggcaatccgtaaggtcatccaaaatgctttggattatttgggatttgcgaacaaccaattaattctttctggattatcaatgggatcatttggcgcactttattacgctacaaaattaaatccagcggctgttattgtaggaaaacctttgataaatctcggtactattgctaataatatgaaactcgttcgtccaaacgattttggaacgtcacttgatattttgcgattgaatcaaaatggcataactaacaaagatgttgttcagttagataatcatttttggaagcaaattcagcatagtgatttgtcaatgaccacatttgcgattgcttacatggagcatgatgattatgacaaatatgcatttcaagatttattgcctgttcttacaaaacaacatgcacgtgtgataagtaaaagaattcctggtagacataatgatgattctgctactgttactcattggtttattaatttttatcatttaatcatggaagagcgatttgggagggtaacacatgcaagaagatag

SEQ ID NO: 1216 - DNA, 711 bp, Staphylococcus epidermidis
ggtgacaatatgaaaagaacagataaatatagagattcatacaaatatgatgaccaatatcaaaatcatcgtaaacgttcagaagaagatatgtatcgacaacatcaagagtcccaacagagagcaaattcaaatcgtgcaacacaaagtgaaaatgatagagagtatgaaaatcatcctgaacgttattacaatggaagagactatcgacgtgagcagcaattggaagaagaaaatgaaaaatcaagcaaaactaaaaaatggctgattgcaatcatagttattttactcattattgtagctatctttatcacgcgtgcaattatcaatcataataatgataaagtaagtaatgaccctaacgtttcacaaaactataaaaaagaagttgaaaatcaaaacgacgacattaatcgacaagttgattcagccaaaagcgatataaaaaataaaaaggacacccaatcccaaattgataaactacaaaatcaaattgatcaattaaaacaaaatgaagaaactaatgcggattctaaattcacaaaattttatcaaaaccaaatcgacaaactgaaaaatgcaaataacgctcaacttaataacgaaaatcaaagtaaagttaacaacatgcttgaagacatcaatacaaaatttgatagtattaaagctaaactagaaaatatcttgaatggatcaaattcaggaaactaa

SEQ ID NO: 1217 - DNA, 1044 bp, Staphylococcus epidermidis
gtggtaaatatgttggagcaaactgatttaagtttagagcaattacttaagaattattatgaaaccacgaacgagaaaattgtatttgttaatagacaaggcaaaattattgctatgaatgacgcagcaaaagatattttaactgaggaagataattataatgctatgacaaatgcgatttgtcatcgatgcgaaggatactctaatgaatatgatgtacaatcgtgtaaagattgttttttagagacaacgcaattacaacattccaatttccaagtatttatgaagacaaaagataatgaaattaagccttttacagctatgtatcaaaatattgatgaacaaagaggtattagtgcatttaccttacagaatgtggcgcctcagattgaaaggcaagaaaaaatgtatcaacaaaaaatgttacatcgttcaattcaagcacaagaaaatgaacgaaagcgtatttctagagaattacatgatagtgtaatacaggatatgctcaatatagatgttgaactaaggcttttgaagtataagcacagggataaggtgttagctgaaacatctcaacgtatagaaggcttattatcacagcttattgatgatattagaaatatgtctgttgaattaagaccttcttctctcgacgatttaggcattgaagcagcttttaaatcatattttaaacagtttgaagaaaattatggtatgcatattaaatatgattcgaacattaaaggcatgcgttttgataatgaaattgaaacagttgtgtatcgtgtagttcaagagggtgtatttaatgctctaaaatatgctgaggttaatgaaattgaggtaagtacgcatagtgatggcaagcagcttgtagcagaggttgtggatcgaggtaaagggtttagtttagatcatcaccctaaaggctctggacttggattgtacggaatgagagaacgtgcagaattagttaacggtcatgttaatatagagacacatattaatagaggtactataattacattagatataccgatttaa

SEQ ID NO: 1218 - DNA, 534 bp, Staphylococcus epidermidis
gaaacaaatatgaaagaaaaacgtagtaatgttcgttggtattttgcaatagggttcttctttattggggttattgcttacatggatcgatctaacatatcttatattgcagtaccgatgatgaaagatttggggttaactaagacacaatttggtttattagcatcatttttctccctaggatatgcattaatgcaagtaccttcggggatgttagcagagaagtttggaccacgtaaaatgattactgtcgctttagtttggtggagtgcatttaccatcttaacagggatgattaaacatcatggtttactttactttattagattcttatttggtgttggtgaagcgccaatgtatccatccaatgcagtttttaactctttttggttcgctaaaaatgaaaaaggtcgtgcatctagtgcgttgttagcaggatcttattttggtccagttttagcacctatcatcactatagccattgtcaatgcttttaactggcaagccgttttctatattttcggggttgtatga

SEQ ID NO: 1219 - DNA, 591 bp, Staphylococcus epidermidis
aagtatgatattaacgagatgggtgacaaaatgtataaatatttaaaaagaaatcgattctcaacgcagacttcaattataaaaaatgacgctcagcaacctgttggtatgatatcgaaagtgtataaaaattttattcaaaaatgtattggttatttgaccttaggtttaaaattaaatcaatatgagatatgtgatgtgaataataatagtgtagcttatattaaggtatcgcgatatatggagaaaaaacattttaaagttgaatatcatgattcaaaaggtaggcagtgtgaagcgttatttgataagcaaagtaatggttatgaggagacgtatggaatattaaaaattgacggtataatattaaatattcatgctaatgagaaacatcatactactatcaaagatataaagcgagatacacaaattgcgagttggaaacaaattggtgattatgcttatgcagaagggaatgatgggctatttaaagaacatcaattactctatattcttatcatgcacgcttttgctaatacatatgtgagcaaacgtcaaacgagcttgatgttcccagggccacctgtttaa

SEQ ID NO: 1220 - DNA, 144 bp, Staphylococcus epidermidis
atcttcgatataaagtgcaggctttctctctacatacatctttctcaacctccgatttctcttcaaacccattatagcgaattaaaatttaatatagaaactttatgtcatattacagttgtatcatatatcatttatagataa

SEQ ID NO: 1221 - DNA, 141 bp, Staphylococcus epidermidis
gacatcgatatttgtctcaggtgttttgtatattggaagttaatggctgaatttaaaatgtgccgaagtaaatctttatattataaattctttaaaaaggtatacgacggtagatattttaatcaattactatttttttga

SEQ ID NO: 1222 - DNA, 1149 bp, Staphylococcus epidermidis
gtaaaatgtattttttcacaaaaattatatatatccattcaacaaacgtggtataattattgtgaaaaatttcacataataaatggaggtattgatatgaaagcttatgaatacttaaaacctggtcatgcacaacttacggataaagagaagccaactattacgagcagtactgacgctattattcgcatagttaagacgacaatatgtggtacagatcttcatatcataaaaggagatacacctgaagttaaatcacatacgacactaggtcacgaaggtattggaatcattgaagaaattggtgacaacgttaacaacttcaaagttggagataaagtgattatctcttgcatttcatcatgtggcaaatgctactattgcaaaaaaggtatctatgcacattgtgaaaacggaggaggatggatattaggacatttagtgaatggtactcaagcagaatatgttaaagttccttttgcagataattctttatatcacgccccttcaaatttaaaagacgacgcccttgtaatgttatcagatatacttccaacaggttatgaaattggtgttttaaaaggtaaagttaaacctggctgtacagtagccattgtaggcgctggtcctgtaggtttagcagcattacttacagcacaattctattcaccttcaaaaattattatgattgatttagatgataatagattagaaaccgctaaagaactaggtgctacgcatttaattaactctaaagagactgaaaccgcaattaaaaaggtaaaatcgttaaatccacgtggtgttgatgttgctattgaagctgtcggaattccacaaacctttgatttatgtcaaaatttaattggtgtcgatggtacgattgctaatgttggtgtgcatgggttacctgtacaacttgatatagataaattatggattaaaaatattaacgtaactactggtttagtttcaggaaatacaactgaagaattacttgaagcgttaaaaagcaaaataatacaaccagaacaactcgtgacacattatagtaaactgagtgaaatcgaaagtgcctatgatttatttagaaatgcaacagatcataaagcgattaaattaatcatagagaatgatatcacaatttaa

SEQ ID NO: 1223 - DNA, 162 bp, Staphylococcus epidermidis
ctcaaacgtatgatttgggtgtatattaattatggagtgaaaataaatgtcggctatgcgagggtattatccatggatcaaaatttaaaaagacaactggataatttgaaaacgtttggtgtgaaaaacatttacagaaaaacagtctggggaatctattaa

SEQ ID NO: 1224 - DNA, 201 bp, Staphylococcus epidermidis
aggaggcgtatcatgttttctactggtaataaagctaaaaagactatatttggagctatgacttgttcaaaatgtggtaagacactcaataatgatgaaaatattaccatcaaaatcaatactaaagaattaaaaggttatactcacttatcaagttgggctgatgcacagtataaattgtgtgaaaactgctcagaataa

SEQ ID NO: 1225 - DNA, 126 bp, Staphylococcus epidermidis
tataaaagtatagcgtattgtgcttgcttaacagtttttttacaatttcttacgatttattataaaaaatttataattttaattaaaattaaatacccatcacttataagatatgctaatctataa

SEQ ID NO: 1226 - DNA, 270 bp, Staphylococcus epidermidis
attatattcatatttaagttatttttatcgttaaacttgaaaacaaataaatatgtatataaaatttataatttaatacacacaaaaaagcaccttaaatgttttcattactcatttaaggtgcttattaaattaaatatttattttaacggttacctacatcatgaccgacatctacagtatttttatctttatcataaacagcaccttggacactgccaaagtttggatcattatgcttttcttcaacaccataaccaagacttttaa

SEQ ID NO: 1227 - DNA, 336 bp, Staphylococcus epidermidis
gtgtatatcatgtatgagaatatacaaaatattgaagatttttaccgatttataaatgcacacgctttagctgttgttcatattatgagagataattgtacagtatgtcatgcagtattaccccaaattcaagatttactaaaggactatccgaaagcacaattaggtgtgattaatcaatctaatgttgaagctattgccggagaactttctatttttacagtacctgttgatttaatttttttgaaagggaaagaaatgcatagacaagcacgttttatcgatatgcaatcgtttgaaaaacaattgtatatgatgcaaaatgccatcgattaa

SEQ ID NO: 1228 - DNA, 1566 bp, Staphylococcus epidermidis
ggagtaatcatagagatgaaaatatttaaaactttaagttctatactagttacatctgttctttctgtgactgtgattccctcaacatttgcatcaacagaatctactgctacaaatcagacacaacaaacagtactttttgataattctcatgctcaaactgcgggcgctgccgattgggtgattgatggcgctttctcagattatgcagattcaatgagaaagcaaggttaccaagttaaagaactagaaggagaatcaaacatttctgatcaatctttacagcaggcgcatgtattagttattcccgaagctaacaatccatttaaagaaaatgagcagaaagcaatcattaattttgttaaaaatggtggtagcgtcattttcatctcagaccactataatgccgatcgtaatttaaatcgtattgattcttcagaatcaatgaatggttatcgacgtggcgcatacgaaaatataactaaagatatgaataatgaagaaaagaattctaacgttatgcataacgttaagagttctgattggctctcacaaaacttcggtgttcgctttagatataatgcacttggagatatcaatactcaaaatatcgtttcaagcaaagatagttttggtattactaaaggtgtacaatcagtttcgatgcacgcaggttcaacattagcaataactgatcctaataaagctaaaggtattatttatatgccggaacatttaacgcatagtcaaaaatggtctcacgcagttgatcaaggtatttacaatgggggtggcatcaacgaaggaccttatgtagccatttcaaaaatcggtaaaggtaaagctgcatttattggcgatagctctctcgtagaagatcgttcacctaaatatcttcgtgaagataatgggaaacctaaaaaaacgtacgatggttttaaagaacaagataatggaaaattattaaataatttaacaacgtggctaggcaaaaaagaatctcaaccttctatgaaagatatgggtattaaacttgataataaaacaccgctacttaactttgagcaacctgagaattcaattgaacctcaaaaagaaccttggactaccccaatagaaggttacaaatggtatgatcgttcaacatttaaaaaaggtagttatggaagtaatcaacggggtgctgacgatggagtagatgacaaaagctcttctcatcaaaatcaaaatgccaaagttgaattaactttacctcaaaatatccaaccgcatcatccatttcaatttacaatcaaactcacgggatatgagcctaatagcacaattaacgatgtaagagttggactttataaagatggaggtaagcaaatcggtagcttttcttctaaccgtaaccaattcaatactcccggctatagtcctagccaatcaattaaaacaaatggagcgggtgaagcctcattcacactcacagctaaagtgacagatgaaattaaagatgctaatattcgtgttaaacaagggaaaaaaattctattaactcaaaaaatgaatgaaaatttttaa

SEQ ID NO: 1229 - DNA, 624 bp, Staphylococcus epidermidis
gaggaaatcatcatgaatatgcccttaatgattgatttaagtaacaagaaagtcgtcattgtaggtggaggtaaagtggcaacacgtcgtgctaaaactttattagcttatacaaaacatattcatgttgtaagtccaacaattaccgatacattacaaaaatatctagaaacgaagcaaatcacttatgaaaagaaacacttcgaaccacaagatgttgagaatgctgatgtggtcatcgcggctactaatcaatctgatgttaacaacgatgtgggggcagctttgtctaagaacgtattatttaatcatgcaggacaagcagacctaggtaatataacgttccctaatttcttaaaaagagataaattaacaataagtgtatcaactgatggtgcaagtcctaaattaggtcaacgaattattaaagatttaaaagatacatacaataaagactattcaatgtatattcagtttttatatgaaagtagacaatatattaaatcacttaaaattgagccatctgataaacaagcgttactcgagcaaattttgtcagacaaatatttagatgagaagaagcaacaagatttcatccgatggctaaaatcacaagtcaaatga

SEQ ID NO: 1230 - DNA, 123 bp, Staphylococcus epidermidis
gatgactccatgtattctaacgctaaaagtcatgtttgtaaaaaattagtcacaattaaaaaaggagcggaactgaattcatctaaaaattctatgtcccgctctatcgctcttattgactga

SEQ ID NO: 1231 - DNA, 435 bp, Staphylococcus epidermidis
agtagtcccatatggtacaaaacaataactgttcaaaggagaaatattatgaagttaacccgaatacattatgagattataaagtttatcatagttggtggaattaatacctttaactactatataacatacttatttttgttaaaggtgttacatgtgaattatatggttagtcacattgttggatttattgtaagttttattatttcatattatttaaattgttattttgtatataaagtaaaacctacaatagaaaagtttttaagatttcctatcactcagatagttaatatggtaatgcaaacgttattattatatatattcgtaaagtggttgaatatcgcttcagaaattgcaccttttgcgggtctaatcattacaatcccagtgacattcatactttctaagtggttacttagagataaagtttaa

SEQ ID NO: 1232 - DNA, 207 bp, Staphylococcus epidermidis
tttttatacataagacacctcgttaatttagtttattggtatttattaaattatacgaaaggtccttatttttcaaagtattttaatataaaattacatatatgcacaaagtattttggcgagactcttgagggaacaggacaagctgaagactacaggctgaagctgtcagataagaaagcgagccaacaatacgaagtattataa

SEQ ID NO: 1233 - DNA, 1707 bp, Staphylococcus epidermidis
ttattcaacatatacaaaggagtatttatgaaaaataatagcaaatcaaaaagtaataagataagtctttctcaactcgtcctccttggtcttggttcactaataggatcaggttggttatttggagcgtgggaggcatcttcaatggccggtccagccgccattatttcctgggttatcggtttcttagtaattggaacgattgcctataactatattgaaataggaactatgttccctcaatcaggcggtatgagcaactatgcacagtatactcacggctcattacttggttttattgcagcatgggcgaactgggtatcattagtaacaattattcccattgaagctgtgtctgctgttcaatatatgagttcttggccttgggattgggctaaaccaatgggatctttaatgaaagatggctcaatcagtacttacggtttgattgctgtttacatcattattgcaatcttttcattattaaactattggtcagtaaagttattaacatcatttacaagtttaatttctgtattcaaattaggtgtccctattttaaccataattatgttattagtttccggttttgatacaggtaattatggacactctatcggtacatttatgccttacggaagtgcacctatttttgctgcaacaacaacatctggaattatcttctcatttaatgcattccagacaattattaacatgggatcagagattaaaaatccagagaaaaacatcgcacgtgggattgttatctcacttacattaagtgctatattatatatagttttacaaagtacgttcattacatctatgccaagctcaatgttgcacgagcatggatggagcggtatcaatttcaattctccatttgcagatatggcaattttattaggtcttaactggttagcaatattactttatatggaagcagttgtgtcaccgtttggtactggggtttcttttgttgccgttactggacgtgtgttacgcgctatggaagaaaatgggcatattcctaaattcttaggtaaaattaataaaaagtataatatcccacgtgttgccattgcatttaatgcaattatcagcatggttatggtgacattgttccgtgactggggtacactagctgcggttatttctactgcaacattagttgcatatttaactggtccaactacggttatttcattacgtaaaatggcaccaaaaatgactcgtccattcaaagctaatattttaaaatttatggcacctttatcctttgttttagcatcattagctatctattgggcaatgtggccaacaacagcagaagttattttaattattattttaggtttacctatttatttcttctatgaatataaaatgaattggaagaatactaaaaaacaaattggcggaagcttatggattattatctaccttattgttctcgcatttttatcatttattggaagtaaagagttcaaaggcttaaattggattcactatccatgggatttcttagtcattgtaatcgttgctttaatcttctatcaacttggtacaacaagttactttgaaagtatttatttcaaacgtgcaaacaagttgaataagaaaatgggcgataaattgcgtaaaacacgcaaaaaagcgcgtcataaagattggaaagaacgcgatcgacaagagcaaaatcaataa

SEQ ID NO: 1234 - DNA, 1542 bp, Staphylococcus epidermidis
gaggcaaacatggaagaaagaattggtttgatagacattggttccaacacgattcgacttgttatatttggctacaataaaaaaactgggctcaatgaaatactgaatataaaaacacctgcacgattaagtcaatatctcactaagtccaatgaaatgaatgatgaaggtattcatgttttaaaagagacattaagcagttttagaaaagttgcggataaatttaacgttgatgcattatatcccatcgcaacagctgctatccgtcaatcaaaaaatcgtgaagctatcattaaagaaattaaacaagatattcatatcgaaattcaaattgtacctgaagaagatgaagcattttacggttactatgcgattacacatactactgatattgaaaatggaatttctgtcgatatcgggggcggttctaccgaagttacccttttcaaagacaagcaacttaaagaggctcatagctttccattcggcgtggtatcacttaagcgtcagttttttggtgataaagcacacaatgacaaaacagccattaaaaatatggaacagtttttacgtgagcaatttagtcagttagactggctatccaaccaacatattgcgcttgtaggagtaggtggttctgcacgtaatgttgcacgcattcatcaatcagcacatgcataccctatcggtggcgttcataactataagatgacttcgaaagatattaacaatgtttatgatttaatccgtaaaagttctcgcgatgaacttacaaatttagacggtttaagccgcgatcgcgtcgatattattctgccagctatctccgtctttaaaacacttttcaaaaaaattgacgccacacaattcaccttctcaagaaaaggaattcgtgaaggatttattatgaaccacatcagcaaacgatatcctgatgagtttaataaaagtaacgtacgtaaagatgcattacgtcatttagcgaatgaatatcatattgaagaaacgagtgctaatcgtcgtgtaaaattagctcaatccttattgaatcaaattataagtgaacgatcacttaatatttcagcaatggaaaaagaattatttattgaaggttcctacatttattacctaggtagtttcattgattcagactcaagttcaccacatacgtattacttaatcgcaaattcaatgattaacggcttttcacataaagatcgtgtgaaattagctttgttagctagttttaaaaacaaatctttacttaaattttattgcaaagaaacacagtggtttagtaataaagaaatagatacaatacaagctttaggggggattattaaatttgcaaacaccttgaatatctcacatactagttttgtagaggaagttaaactaaaagcaaagaaagatgacaaatacgatttattagtttattacaaaggttcacctattgcagaagaataccaagcaaatcgtcagaaaaagcatattgaaaaaattttaaaaggtaaggtttctattatatttacaaaatcttaa

SEQ ID NO: 1235 - DNA, 174 bp, Staphylococcus epidermidis
cgcttacgcatattcaaactaattgaagacatcgataatgaaccaaatgttgaaccatggtatgcattagtaaaacttatgatgtatggacgtcctgtatacgctcgtgcaaactttataatcccatcattagcatcagagccacttaatccgaaagtaactcttttctcataa

SEQ ID NO: 1236 - DNA, 1080 bp, Staphylococcus epidermidis
aataggagcatttatatgtacaaattagttaagcctttattattcaaattagatcctgaacgagcacatggtttgaccatcaatgcgttgaagtgtgttcaaaaatgttcacccattttacctatcgttaataagttatttacttataacaatccaatattaacgcaacacattcacggtatttcttttgataatcctatcgggttagctgcaggttttgataaatcttgtgaagttccaaaagcacttgaaaacattggcttcggtgcaattgaactcggcggtataacacctaagcctcaaccaggtaatccaaaaccacgcatgtatcgtttactagaagatgatgcactcatcaatcgtatgggattcaataataagggtatgaataaagcactaagtaatttacgtaatcattcatgctcaataccagtaggattaaatgttggtgtgaataaaacaacttcctatgaaaatcgctatcaagattacattaaagtgattgacacatttaaaaatgacgtctcattctttacagtgaatattagctccccaaatacagaaaatctccaaaactttcacgacgaagatgaattttcgatgttatgtgatgctttaaattcatttaaagctaagaacaatattaatgtacctatctttttaaagttaacatctgatatggaattagatggttttaaaaaaatcttgccttcaattacagatacattcgatggggttatgttggcaaatacgacacgacaacgcgatggattaaattcaaaaaataaaatacaaaaaggtggcttgagtggcagaccattattccaaagaaacttacaactggttaaatatgcctatcaacaaacacgaggtaacttcttaattattggaactggtggtatattcagttctgaagatgctatcaaaatgttaagaaacggtgcatcattactacaaatatactcttcattagtcattgaaggaccaggtttgactaagaaaatgaataaagaaattgcgcattatttaactcgacatggttatgctaatgtaagtgatattattggtttagatgcataa

SEQ ID NO: 1237 - DNA, 318 bp, Staphylococcus epidermidis
aacaacttttttcccaaattttttcattttaacgaactccttcataataaagttacacaaataactgtgttagcttatttgtataatatttctattaaaataactagaattttacttcagttcagatataaaaaattcattttaatgacaatttttcaacacttttctgaagcaatcaattcagcgactaactttattacgtttattattatagtacgtgacaaagtattaataaaatacataataacgatgttaaccattcataaaaggaataggtttcctatagaaaaatgtaatactttgtttattcatatatga

SEQ ID NO: 1238 - DNA, 141 bp, Staphylococcus epidermidis
tcgcttttaatgatgatgcaaacagataattttgcattatttacaaaagaggttaaaataggtattacattaagtaaacgcttacattttattagggataagcgattacttcaaatatcactaaaaaaggatgggttttaa

SEQ ID NO: 1239 - DNA, 1185 bp, Staphylococcus epidermidis
attattttaatgaggaggcatagcatggaaatgtcagaaaggctagcttcaattcctgatagctactttggcaaaacaatgggccgtatagttgaacatggtcctttaccacttataaatatggcagttggaattccagatggagaaacgccaaagggtattatcaatcatttttcagaggcgctatgtattccagaaaatcaaaagtatggtccatttcacggcaaagatgcctttaaacaagctattgttaacttctaccaaagacattacgatgttgaattagacaaagaagatgaagtttgtattttatatgggactaaaaatggtcttgttgcattacctacttgtgttgttaatcctggtgaaattgtacttttacctgatccgggatatacagattatttagcgggggtcatgttagctgatgctaagccactccctttaaaattgtcgccaccaaattatttgccgaattggaatactataagtgctaaagttcttgagaagactaagctaatttatttaacatatcccaataatcctaccggttcgacagcgacacaagatgattttgatgaagcgattcatcgttttaaaggtactcaaacaaagatagttcatgactttgcatatagtgcttttggatttgacgccaaaaatccaagcatattagcttctaaaaatgcaaaagatgttgctatcgagatattctctttatctaaaggttataatatgtcaggctttcgtgttgggtttgctgttggtaataaaaaaatgattcaagcgttaaagaagtatcaaactcatacaaatgcaggtatgtttggagcacttcaagatgctgctacgtatgcactcaatcattatgataagtttttagaaaagcaaaatgaaatatttagacgtagacgtgataattttgaatcacaactaaaacatgcacatttaccgtttgttcactctaagggaggtatttacatttggttacatacacccccgggttatgatagtgaagcattcgaacagttgttattaaaagaaaagtcaattttagttgcacctggtaaaccatttggtgaaaatggtaatcaatatgtgagggtttcattggcgctcgatgataaacaattagaagaagcggcgaatcgcttaacacaattacggtatttgtatgaaagataa

SEQ ID NO: 1240 - DNA, 147 bp, Staphylococcus epidermidis
tgttgtttaatgctttttttatttctaataagtttagtatcaataagttttgtaattgctgtgtatcaaatgttagaatttctaaaaaatggaacgcaatattatgctgtttggacgaccgatacattttttgatatggttcactag

SEQ ID NO: 1241 - DNA, 144 bp, Staphylococcus epidermidis
gacgtattaattttaaataaaaatctcgggagtgagaccatggatgaagcattattcattggtctcactctcttttttaatataatgaatgaaatgtttatgaatgagaacgatgtgtttcttctattatatagtctaaaatga

SEQ ID NO: 1242 - DNA, 135 bp, Staphylococcus epidermidis
atcacattaatgtcctattctctaacaaaacgttatgataaagttgttcaaaataattctatgataaggagtaatgatgtatggcaaaagttaaagagaaagttgcagtcgttacaggtgcgagtagcggtatag

SEQ ID NO: 1243 - DNA, 135 bp, Staphylococcus epidermidis
ctggaattaataaaaaaagtcccttattcaagctatggcttatgtatgtgcttgaataagggattttatcttactatagtttcacattatgaaaataaattttttaatattctgtataaagagcctaataattga

SEQ ID NO: 1244 - DNA, 180 bp, Staphylococcus epidermidis
gtaaagttaattctagagaatttaacatttctagaattaacttttttaagtataaaatataacaatcttccatcctgtaaaaataacttaagctatttaaggtgctttaacttattagaaaatggtcaatatttattacaacaggtatacgctcagaaaaatagttactctcaaatctag

SEQ ID NO: 1245 - DNA, 123 bp, Staphylococcus epidermidis
atgtgtctaatcaatgatcatattgtgtctaaaatattacaaaatggaataggtagtattataaatatgtatttttgttatatagcctatcgtcttataataggaatcagcgcaataatttaa

SEQ ID NO: 1246 - DNA, 447 bp, Staphylococcus epidermidis
attacgctaatcacaataattatagcttatcatagttgggtcataataaatttacttataatttacattagattaaaacaacgatgttacattatatatgaaagatattacgactttaggaggagaggtatggagaagtcagttaaacttgctgttggcatctatctagcaattattttaattatttgtagtatttacctcgcatttatacttattggaagcttaaatggtaaagacatgagtaattctgttctagatactgatcactctcgtatcaacaatacttcaagaaacagtaacgaagatgttacgtcatcaaataatgagtcaaacaatacaaaagcgcactcatttgcaaactctgaatataaagctattaacataaacgaagcatttaaaaataataagcaaattaaaaaagcgaattcgagttatcaatactattga

SEQ ID NO: 1247 - DNA, 744 bp, Staphylococcus epidermidis
ttcgctataatgggtttgaagagaaatcggaggttgagaaagatgtatgtagagagaaagcctgcactttatatcgaagatttacgagacgaattcaaaaatagcttaaaacattttaaagatgatgatgaagcatttaatacattagttggatttgtggaactggaccacctatattcttcagcacttaaagaaataagtacaaaattaagtattttagatgataactttaactatcaatataaacacaatccaattcatcatatggaacgacgagtaaaagagatgcacagtttagttaaaaagttgaatcgtaaaggatttgaagtgagtgcacaaagtgctaaagataacattatggatattgctggtatacgggtcgtatgtaactatttagacgatgtttatgtcattgaaaaaatgttattaagacaagaagatgttaaattattaaaacgtaaagattatatcacacatcctaaagaaaacggctatcgaagtttacatatcgtcgtatctattccagtgtttttagcagattcagtagaagtaacaccagtagaaatacaaattcgtacaatcggcatggatatgtgggcaagtttggaacacaaaattcgttataaaaatgatacagacactgaaaaatataaaggactattagaacaatgtgcatcagaaattacaaatgtagaaagtaaaatgcaacaaatacattcagaaatttcaaatcgagagaagtag

SEQ ID NO: 1248 - DNA, 417 bp, Staphylococcus epidermidis
atggctataattaacttatctcatcgtggtgatacttcttttgacaaacttctcggacatctccctagtgttcaagaaaaatggaatgcattggaagatatattaaaaaatgaggggcaattatctgttgatttaaaagaagaaattaggaaaatactagctcaaaacagtggttgtctatactgcaaatctaaaggaaaacccaataagaaatttaccgatgaaaaatctttagtttgcataggatttgttgatgtttatgtgtcacaaaatggacgggttccacaatctacaatacaggttttaacaaagacactaactgatatagaaattgtagaattgttagcattcatatcatttacccactgtcaacaagaatttggtgccatgatgaatttacaacctagcaataactga

SEQ ID NO: 1249 - DNA, 1257 bp, Staphylococcus epidermidis
agaaatataatgaaatttgtaaatttaacttctgaagaattcgagcaatttacttcagaaaatttctcgcattatacacaatccagtatacattataataatagatcgaaaacaaaaggtgacgtacatttagtgggagttaaagatggtcaagaagatgtcattgctgcgtgcttattaacagaggcacgttctttaaaattctttaagtatttttacacacatagaggaccagtcatggactttaacaatttagttttagttcgcttcttttttaaatcacttactgcttatttaaaaaaacacaattgtttatatgtactcgttgacccttatgtattagaaaatttacgtcaacctaatggagaaatcattgaatcctttgataatcgcgcattgattaaaacaatggaagaattaggttacaaacaccaaggatacactgtaggttatgatacaatgagtcaaatccgctggttatcagtacttaaccttaaagataaatctgaagatcaattattaaaagaaatggattaccaaacacgtcgaaatattaaaaagacttatgaaatgggtgttaaagttaaaacattacccattgaagaaacaaatacattttttgaattattcaaaatggctgaagaaaaacatggctttaaattccgtgaagagccttactttgttgagatgcaaaaaacttatgaagatcatgctatgttaaaacttgcttacatcgatttacaagattatttagatacgttgcaaactaaacatcaaaaccttaatcaacaactaaaagatgttgaaaaaacattagaagaaaatccaaattctaagaaaaataaaacgaaacatacacaagtcaaacaacaattcgatagtaatgcgcgtaaaatcagacaaactaaagagaaaatagcagaagaaggtcaagttcttcatcttgctgcagcattatatatatataatgatcacgaagtgtattacttatcaagtggctctaaccctaaatataatgcttatatgggagcatatcgattacaatgggatatgattcaatttgcaaaagaacataatatcgatagatataatttctacggtgttaccggagactttagtgaaaatgctgaagatgctggcgttcaaaaatttaaagaaggatttaacgctaaaatttatgaatatattggtgattttatcaaaccaattaaaccactattttataaagtaaaacaagaattagaaagtcgtagataa

SEQ ID NO: 1250 - DNA, 2661 bp, Staphylococcus epidermidis
tatgacataataaaaaataagaggtggtcaagaatgacacaattcgtttatgcatttaatgaaggaaatatagctatgaaagacttacttggtggtaaaggtgccaatctttcagagatgaagagactcggactaccagtaccagatggttttacaattacgactgaagcttgtattacatatttaaaacaaaatgaagaactacctacagaagtaaagacacaattaattgatcatttagcagctttttctaaacgaacaggaaaagccttttcctctgatgataacttgttattagtatcagtacgtagtggtgcaaaaatttccatgccaggaatgatggatacaattcttaatttaggacttaatgatgataatgtaaaaaagcttgttgacaaaacaaatgatgcacgatttgcatatgattgttaccgtcgtttactacaaatgtttggagaggttgtttatggtattccaatgacagctttcgatacatattttaatgattttaaaacaaagcatcgttatcaaaatgatgctgaaattccggcagaaggactacaaactatatgtgaaaaatataaagaaatctatgtagaagaggcatataaaccttttccccaagaaccgttaaagcaattagaagaagcaattgaagcagtatttaaatcttgggataatgatcgtgcacgtgtatatagagatttaaatgatattccacatgatattggtacagccgtaaatattcaggaaatggtatttggtaatagtggtgaaaatagtggtacgggtgtagcatttacaagaaatccagttactggagaaaatcatttattcggagagtacttacttaatgctcaaggtgaagatgttgttgcaggcattcgtacccctaaggatattgacactttaaaacaacaaatgccagatgtacatcaagagtttgttgatgtaaccaaacaacttgaaaaacattacaaagatatgcaagacatagaatttacaattgaaaatggtaaactttatttattacaaacacgtaacggaaaacgtactgctaaagctgcaataaaaattgctgtggatttagttcacgagcaattaattacacgtgaagaagcagtatcaaaagtagaagtaaaatcaatagaccaattattacatcctaattttaatgaagaatcattaaagcaagcgacagtggtttctaaaatgggcttaccagctagtcccggtgcagcaacaggaaaagtagtcttctctgctgaagaagcaaaacttcaagctgaaaatggtaataaagtagtgttaatgcgaccggaaacatcacctgaagatattgaggggatggtagcaagtgaagcaatcgtaacaactcatggtggtatgacatcacacgctgctgttgtagcaagaggaatgggcaaatgttgtgtgacaggatgttcgaatgtagagatagatacagtgaacaaaacagtatattatcctgaaggtgaattacatgaaggggatatcgtttctgtagatggttcagctggtgatttatatttaggagcaattgaaacagtcaatgctgaacatagtgaagagttcgatcaatttatgacttggtctgaagagattgcaagactgcaagttagaatgaatgctgaaacaccacaagatataaaagctggatataattttggttctaaaggaataggtttagttcgtactgagcacatgttctttggccctgaacgtttaatagaaatgcgccgttttatcttagcttcaaatcatgacgaacgtgtacaagctttagaaaaaattaaaacataccaagtagaagattttgaaacaattttcagattatctcaagatagacctacgattgttcgtttacttgatccaccgttacatgagttcttaccatcatctgaagaagatataaacaatgtttctcaacagctgaatgtatcttcagagttcttacgcaagcgaatcgttgacttaaatgaggtcaatccaatgcttggtcatcgtggttgtcgtttggctgtgacttatccagagttatatgagatgcaagttgaagctatcattgaaagtgttattaagcttcaaaaagagggcataacgtgcctaccagaaattatgattcctctcgtgtcaacagtagaagaatttacaactttaaaagaacgattagttaatacaattacacatttagaaaaagaatcacaacaagatatacaatatatgataggtactatgattgaaacgcctagagcatgcttgattgcgaatgaccttgcgaaacattgtgatttcttcagttttggtactaatgatttaacgcaattgacatttggtttctctagagatgatgcaggaaaattcataaatgtgtatactgaaaataacattttacagcttgacccattccaaactttagatagagaaggtgtaggacgactaattcaattagctgttgaacaagctaaaaatacaaatccagagataaaaattggtgtatgtggtgagcttggtggcgatgcaaaatcaattcgtaaatttaaccaatgggaaattgattatgtttcatgttcaccatttagagttccgggtgcaattttagctacagctcagagtcaagcggaggaaagcgagcgataa

SEQ ID NO: 1251 - DNA, 645 bp, Staphylococcus epidermidis
ggattaataatgaaagcattcttacaagaatacggtagtcaacttttatcaaaagcagtagaacatttttatatttctatgtttgcattattgttagcgattgtagtagctgtccctttaggtattttattatcaaaaacgcaacgcacagctaatgtggtattaacagttgctggcgtgcttcaaaccattcctactttggctgtgttagctatcatgattccaatatttggggtaggaaaaacaccagctattgttgcattatttatctatgtattattaccaattttaaataatacagtattaggtgttaaaaatatcgataaaaatgtcattcaagctggtcaaagtatgggaatgactaaatttcaattaatgaaagatgtagaaatgcctttagctttaccacttattattagtggtattcgtctatcaagtgtatacgtcattagttgggcaacactcgcaagttatgtaggtgcaggtggacttggggatcttgtatttaatggattaaatctctatcaaccacctatgattattagtgcagcgattgttgttactttattagcattagttattgactttatactttcattagttgaaaaatgggttgtacctaaaggattaaaagtatctagataa

SEQ ID NO: 1252 - DNA, 138 bp, Staphylococcus epidermidis
catgaaataatgtcgcagactttcttcacttataaagagggaatctctaaattttataactgtttaaataatgtcaaaggcccaataaaaagagattatagaaaaatcgaacagattaagccagttgcacgacgatga

SEQ ID NO: 1253 - DNA, 2889 bp, Staphylococcus epidermidis
aaaagaataatgataattaggagtgtgaaaatgaaaaacgcactaaaactttttatcacggatttaaaaagagttgctaaaacaccaggtgtatgggtcatcttagctggtttagcaattcttccttcattctatgcatggtttaacctctgggctatgtgggatccgtatggtcatacaggacatatcaaagttgccgtagtgaatgaagaccaaggtgaaaaagttcgtggtaagaatattaatgtaggaaataaaatggtcaaaactttaaaaaagaatgatagttttgactggcaatttgtgagtagagaaaaagccgaccatgaaattaagatgggaaaatattatgcaggtatttacataccgaagaaatttacacatgaaatcactggtactttaagaaaacatcctcaaaaggcggatatagattttaaagtaaatcagaagattaatgccgtagcagctaagttaaccgatacgggatcgtcgtttgtgattgataaagcaaataaacaatttaacaaaaccgtagcaaccgctttactttctgaagctaataaagtcggactatcaattgaagataatgtacctacaatcaataaaattaagagtgctgtatatcaagctaataattcattgcctaaaattaatcaatttgcagacaagattattgaactaaataaacatcaagacgatttggatgcttatgctaatcaatttagaagtttaggaaagtataaagggaatgtattagacgctcaagaaaaacttaatgctgttaattcgtctattccggcgcttaatgaaagggctaaattgatacttgcacttgatagctacatgcctaatattgaaagaattttaaatgttgctgctaatgacgttccagcacaatttcctagaatcaataggggtgtcgatattgcaagtgaaggtattgatgcagcgagtggtcagttaaatgatgcaaaaggttatttgactcaagctaaagcgagagtgggagactatcaagaagcagctggccgcgctcaagatgtgaacaaccaagcaaatcaaaatctaagaaatcaaacatcaactacaccccaaagcgctataaagtcatcgcattcggaagggaagagtcattcaagtattaaaacagtacctgtgagtcaatcaggtgagaatcaacccgtttatggtgataacattttatctaacagtgatgtaaaatcaatgaatacagctttaacagaagctttattatcattatctaatcaaacagatcaacaagcacaagctacccaacaagacattaagtcattaaaaaatatagcatatggtgttatcgcttcagataaaccatcagagtttaaagaaccattaaaaaatataaaatcacgcttagaaaacgcatctaagtataatcaacaatttatagatatcttgtcagagttggaaaaaagtgaacatgttgatctatctaatgaaattaagcaagtgaaagaagcaaacaatagcattaatgataatttaaaaagtactaatcaattaatagatgcattgtcaaatggtagctccggacaattagaagcagtcaatgtattacgtgacttacctaacttaaataaaaggttagatacattacgaaattacattaaaaaagaacttaatcgtaatttactagctgtttctaatgagattactgatcaacttaataaaggtcaaaatacattatcgacaatccaatctaaattaaatactattaaccgagtgattaacgctggtcaagatattttaaatagcggtaaaaagagaattgatacgattcaaactgcattgccagcaatcgaaaacgcatatataaatgcaatgcgaactgcacaagcttacttcccaacagctaaaaaagatgtcgcgaaagctgcagactttgtacgtaatgacttgcctggattagagagagaattagctaatgtaacacagtctgtaaaccaaaaaataccatctttatttagtcgttatgataatgctgtagatttattaaacgagaaacagcctcaagcaaaagaagcacttgcttcgcttgccgatttctcagaaaataaattgccagatgttgagaaagacttgaaaaaagcaaataaaatcttcaaaaagttagataaagatgatgctgtagataagctaatagatacattgaaaaatgatttgaagaaacaggcagatattgttgctaaccctattaataaaaaaacgacagatgtgttcccagtaaaagactatggttctggtatgacgccgttctatactgcattgtctatttgggttggaggattattaatggtcagcttattatctgtagataacaaacatgaacacttacaacctattatgacgaagagacaagtgtatcttggtaaatctggtttctttttcttattaggtatcatacaggcattaatagtatctatcggtgatttagttatccttaaagcatcgatagaatcaccgatattatttgtctctattgccgtgtttagttctctcgtatttaattcgattatttacacatctgtatcattgttaggtaaccctggtaaggctgttgctattatcttacttgtgttacaaattgctggtggaggaggtacattcccaattcaaacaacgccagaattcttccaagcgatatctccatatttaccattcacgtattctatcgacgcattacgtgaaacagttggaggtatagttccagagatactgattacgaaagtgatcattttaggtttattcggaatcggattcatggttgtaggttattgcttgaaacctgtgactgaccctattatccgtaaaattgctgaaaaagctgatgaaagtaaagtaactgaataa

SEQ ID NO: 1254 - DNA, 234 bp, Staphylococcus epidermidis
aaattgataattaagaacgtagaaagatttcattataaaagaaagaattttccgaaaaatacttgtcagataacttgtaacatgttagtgtattactacatttttactttaatgtattatcgaactaaagaattcggcgtgagggaggggtggcttaagtatgaacaataccatcatttcaatgaaagaaaaggaattacgttttttaaagttttttcatcaacaaaaatataa

SEQ ID NO: 1255 - DNA, 138 bp, Staphylococcus epidermidis
aaaaatgtaatactttgtttattcatatatgaaataaacgaatatgagttaatcgcggtctttttcgtcaataaagacatcaattcaatgcctttattaaaagactacctactaggccatacccacctctatgtataa

SEQ ID NO: 1256 - DNA, 759 bp, Staphylococcus epidermidis
ttattcgtaataatgataatacaaaagggtgggataattatgataggtaatattctagtcgctcacggcatgagaaaaggaaatcagaatgaagctttagaagaatttatcggaactttattaaaagatgagcaatattattatgagttagcatttttagaaagtgaaacacaaaatcttgaaatcataatggagaagatgattaagcaaggaattacaaaatttcgtattgtacctttactcatttttagtgcaatgcattatatcagtgatattccacaaatacttaaagagatgaaagctcgatatccacaaattgatagtaaaatgagtgcgcctcttggtacacatccatatatgaaaacattagtagaaaatagaattgctgatgaaaaagtcagtgaaggttcaaccaaagcaactatagtaattgcccatggaaatggaagtggacgttttacgaaagcacatgatgaattaaaagcatttgttaaaacgcttgatagtcatcatcctgtttatgcaagagctttatatgggacattagcatttaaaaatgatttagataaaatctcagagcaatatgacgagttagtcattgtcccattatttttatttgatggtagattggtgaataaagtaaaacgtcttttaggtgaaatgacattgcatagtcaattacacattacgccatcgattaactttgatccaattttaagattaattattagagaaagacttgaagcgttagatatttaa

SEQ ID NO: 1257 - DNA, 1569 bp, Staphylococcus epidermidis
aggaggtcaattggcttgaagattaaagcgcaagttgcaatggtattgaatctagacaaatgtattggttgtcatacttgcagtgtgacatgtaaaaacacatggacaaatcgacctggtgcagaatatatgtggtttaataacgtagaaacaaaaccgggtgtaggatatccaaaaagatgggaagaccaaggacaatataaaggtggttgggtgctaaataaaaaaggaaagcttgaattaaaatctggtaacagatggtcaaaaattgctttaggtaaaatcttctataatccagacatgccactcattcaagattattatgaaccgtggacatataactatgaacacttaaccaatgctaaacaaggacagcactctcccgtggcgacagctcactctttaatttcaggtgatagattgaatcttaaatgggggccaaactgggaagatgatttagctggaggtcacattacaggaccagaggatccaaatattcagaaaatagaagaagatattaaattccaattcgatgagacatttatgatgtatttaccaagactatgtgaacactgtttaaatccaagttgcgtagcatcttgtccatcaggagctatgtataaacgagatgaggatggtatcgtactcgtcgatcaagaagcctgtcgaggttggagatactgtatgactggatgtccgtataaaaaagtatattttaactggaaaacgaataaagctgaaaaatgtacattttgtttcccacgaatcgaagctggtatgccaactgtttgttccgaaacttgtacaggacgtatgagatatttaggtgttttattatatgacgcagatcgcgttcaagaagcggcttcagctaaagatgaaaaagacttatacgaaaaacaattagacctattccttgatccatttgatgaggaagtcattgcacaagctgaaaaagatggaataaatcaagaatggattacagcagctcaaaactcaccagtgtataaattggcaatagaatataaaatggcctttccattgcatcctgaatttagaactatgccgatggtgtggtattgtccacctttaagtcctattatgagttatttcgaaggtgaaaatgcaggtcaaaatccagatatgattttcccagctattgaggaaatgcgtttacctattcaatacttagcaaatttattaactgctggcgacacaaaacctgttaaagagggcttacaaaaaatggcgatgatgagaagttatatgcgttctcaaataacaaaccaacctttcgatacttctaaattagaacgattaggacttactgaaagacagatgactgaaatgtatcgcttactaggtattgctaaatatgaagatcgttttgttgtgccttcttcccataaagaaacatatttagatacttataaagcgcaaggaagtcaaggttacggtggagagtactttggctctaattgtgaaggttgtggtgttgcagttcaatcaggtaaaactggacaagaaatttataatgaaaatttctatggagggatcttccgtgattaa

SEQ ID NO: 1258 - DNA, 210 bp, Staphylococcus epidermidis
acaataccaatcattttacctctgttttttgctgatgtgagcatcgctgtgagtgctaaaactttcacaataatgagtgaagctgcggcagaagataaaatacgtcctacaactattattccaaaatgtggcgcaatggcaatcataccattcccgaagataaagacaattaacgtccataataatactgatcgcgaagaaaaccgatga

SEQ ID NO: 1259 - DNA, 201 bp, Staphylococcus epidermidis
acaagtgcaatggcctgtgtttttttagcaggaggtgcgactgtcgcagcaacactcatacacacaccgaagaatggcgcatgcattgccgcagacatgagtcttgataataacaatacattaaaattcggtgctaacattcccactaaattacttattataaaaatcgctactaaaattggtaacagacggtgggcgtga

SEQ ID NO: 1260 - DNA, 231 bp, Staphylococcus epidermidis
accaggcaaatagtgcggtttataagttttgttgagacgtctataattgttctcgttcattcaattacactccgtttaatttttaaaatacttgctcttaatattatcacaattacatcctcaattgcattgacatgtcatctttttactttaatattatactttaacaaattaaataggtatacatttattagagcatcttcatataagttgtgtaggcaagcaatttaa

SEQ ID NO: 1261 - DNA, 141 bp, Staphylococcus epidermidis
cgaattaaaatattaaagacttatcgctcacttttaatggcgatgagtctttttattatagtcaattataaggaaatgaaaaaaataattatatttattaacagtaaatacaattttgtcgaagaaaagttcaaaaattga

SEQ ID NO: 1262 - DNA, 135 bp, Staphylococcus epidermidis
tatcctaaaatggttttaataacaaatcctgtaatgacggatactgttataacaaaaaatcctggtatcataaagctcgtaggtcttgttctacctgtttcatctagttctacagcaaataatagtgtcggttga

SEQ ID NO: 1263 - DNA, 186 bp, Staphylococcus epidermidis
aatcataaaatttttttcgaaatgataggtagacaagtcgccattaaaatgatgaaaaaaagatgtgcaactaaccaccatgcaaattcgttccaactaaaggaaaaaaatggacgttgcgcaagaaaaacgagaagtggatacatcaaagtaaatatcaatactaaaggtaagtatgctagatga

SEQ ID NO: 1264 - DNA, 249 bp, Staphylococcus epidermidis
acatgtaaaataatctataataggtatcataattattgggggctagagaccctaagagaaggtgagacaatgatatttgtaatgttatctccaatattaattattttgtttattgtactaagcgtattagaagaaaaacgtagaaagaaaaattcaaaagaacaaaattcgaatcatgtagatcagcaacaatatgattataccgacaaagaacaacaacaaaataaaaattcaaatgatgataaataa

SEQ ID NO: 1265 - DNA, 141 bp, Staphylococcus epidermidis
aaactcaaaatacttgaagtagaatggaatcgaaggaataagaaagcgcttacaaatgtaaaatttcttattcctcatgcaaatgaaattgggatggcacaacgtactattggtgaaaggaggcatttattatatgagtaa

SEQ ID NO: 1266 - DNA, 1209 bp, Staphylococcus epidermidis
ggtgaaaaaatgtttaagaaattcgaatataaaatcttatataaaagaatattttttacatgcttaattttagttatatatattataggaagtaatatttcaatcgtaagtaatgaaaatttaagaactcataaagactccttttttaagttagctattactaatgtaggtggggatttacatacattaaatatattttcactaggacttgggccgtggttaagttcgatgattattttgacactaataaaccacaaaagtaatgataaggttaaaacacaaactcgtagggaacgacatttcaaagagcgagcgttaacacttatcattagtgctgctcaaggattttacattattcattcatatattaataaacatgcgattaaagatagtaatatgctcattttattattagtcttaattacaggaacgttgttaatggtgtggttagcagatcaaaatacaacgtatggcatttcgggacctatgccaattgttttaatgagtcttgttaaatctatatttaatacaccttttcctaaattaaattcaagcgcatctttaattactatgattattgtcttattagtgctggacttatttatactcttctttattgagttaacagaatatcggatagaatataatgatattatgaatatttctgctaaagatataccatcatatttatcatggaaacttaatccagctggtagtatctctatcatggtgagtttgtcattatttatgttaacgaataatatcgttaatttcataggacgctttatcgtgaatcataattttgaaacacatgtctttaattttacaaatccagttggaattactatatatcttctgttacaaatgattttgggttactttttatcaagattattaattaatacgaaacgtaaatcaaaggaatttcttaaaaatgggaattacttcgagggtatacaacctggacagcagacagaaaaatttctagggagtaaagcacgtcgtatttgttggttcggttcaatagtagtagcgattgtactcgctataccaatgtattcagcgctgcttgtcccccacttacttaaagaagtttactttacaactcaaatgattgtatttgtctatattggaattaatatcgctgaaacaattagagcgtacttatactttgacagctataagcaaattttaaataaatattggtag

SEQ ID NO: 1267 - DNA, 1116 bp, Staphylococcus epidermidis
attgttgaaatcgctttctttagggtgtacgataactatggcctaaaaataaagaaagaaggttttggggaaatggatattattttaggagtagggactttagtactcgttcttattatcatgacgcttttcttaaattttgcgccatatggtaaacaaggtttacaagctttatcaggggctgcttgtgccacgtttttaccacaggcgttcttaagttacgcaattggtggcgtattccatgttaaatttttccaagaaattggtgatctagcagggagtttaagtggtatagctgttggtatattaacttgtctaaagttagaagtgtctccagtatttgcagtcattgtaggtttagtattacatgactcaaaattattacctgcgtttatcgcagcgtatgttgttgcatttggaatcaagtttgttgagaaaaaagttccagagggactagatttaattgttgttattttattggctccagcagttacatttggtcttgcaaacttaatttctccaggggttattgcagtacttaaacaaattggtagtgcaatcacttcagtaggtgataacaacccatatgcattagcagtcattttaggacttgttattcctgtaactggtatgacgccattaagctcaatggtgcttacaagcttattaggtttaactggtattccaatggcaattggtgcattaacatgtacaggagcatcttttgttaatggaatcttatttagcaaattaaaaattggtaataaaggtaatgccttcgcggtatttgtagaaccgttaactcaaattgacttaattgccaaatatccactacaactgtttggtgcgaatgccattattggtgttgtaaatgcttgtattgtcacatacagtggactaattattgatattaaaggtatggcaacacctatagcaggtgctattgtactttatggctttaacgacgctgtaagatctacaattacaattatcgcagtagcaattgcaagtgtgatattagcgtacgttattagtgctattattaataaatttaacttgatgaatgtcggattcaagttaccacgtagaaaaaaccaagttaaggagagtgtttaa

SEQ ID NO: 1268 - DNA, 537 bp, Staphylococcus epidermidis
gttgggggaattgaagtgaaaatagttatagcggatgaccatgcagttgttaggacaggattttcaatgatattaaattatcaagaagatatggaagttgttgcaactgcagctgacggggttgaagcttatcaaaaagtgttagaacatcgaccagatgttttaattttagatttgagcatgccgccaggagagtcaggcttaatcgcaaccagtaaaatttctgaaagttttcctgatactaaaattttaatacttacgatgtttgatgacgaagaatatttatttcatgtgttaaaaagtggtgctaaaggatacattttaaaaaattcacctgatgagcaattaatattggccgtacgtacagtatatcaaggtgaaacttatgttgatatgaaattgacgacgtctttagtcaatgagtttgtcaatcaatcacaaacggatgaagtgtcatcatcttcagatccatttaaaattttatcgaaacgagagttagaaatattacctcttatagcaaaagtgctatggcaataa

SEQ ID NO: 1269 - DNA, 459 bp, Staphylococcus epidermidis
aataaaatgataggttcagaattatatttctccttattcgtaggtgtcgtactcagtttgatatttgctgagaaatttgggattaatccagcagggttagtcgttccaggttatttagctttgatttttgatcaaccgatcatgttgttatcagtattaatcattagttgcttaacttattttatcgtaagcaacggtattagtaagtgggttattttatatggtagaagaaaattcgctgccatgatactgacgggaatggtgattaaatttatatttgatctcttgtacccattgaccccatttgaaatggttgaagtttcaggtataggtgttgtcattcctggtattattgcgaatacaattcaaaaacaaggtgtagtcattacactttctacaacaatgttattaacatgtattacatatatcatcttatttttatatagttttattaattaa

SEQ ID NO: 1270 - DNA, 1878 bp, Staphylococcus epidermidis
ttaatcgtgattgatagacaaatcaaactcatcaaattgttattaaattatacagatacgtatataagtggccatgatattgccaaacagttaaatgtatctaatagaactatacgtaatgatattaaaactatacatactacatttctaaatgaattaattttaagtgtacaatctaaaggttatatgctaaatacatgtctttatacacctgatgagatacaatctgctttagagtcagttattgtaaaagagaataaattgcttatcacaattgcttataggttatttatggaaaagcatacattcactatcaaagagctatcttcaacttaccatttaacaaaatcaaaagtgattgattatgtaacacgtatacaaacgtgggctataaaatttgatatttatttatcaataaaaaagaagcaaggtatcatgatcgatgcgagtacaacgagtatcagtaatgctgtacttcatatcaatcaacttacagacgatgactttaaagttgaaaaccttattttacaagagttacctcaagcccatactagaaaaataaaacaaattatctcaaagcatatagataatcatcaattatcaacttctgaaaataaaatacaacaattacttgtgcatctaattttaattatcaaacattctcaaccagaggaagaagattggagcactgatacagaatctttaactattgcgaaaaagtgtataaaagatatcaatgaaacccttggatatcaacttaacaataaaacaagtgaatgcttttccttttttattagctaccatttcaataagtttgatttagggatccaacaactatttattcaaagttatatcgatcgactcattgaattaatggagcaacatattggttttcccttttcacaagatacaattttaaaagataatatgaacgtccactttagtcgtacatatttgcgattaatgagtcatgtttatctaaataatccattaacaagtcaaatcaaacgactatatccctttgtctttaatacactatatgatagtattcgacaattatcacaagataccaatatccaattaagcgaagatgagattgcctttttaactatacattttcagtcttctatcgaacgccataagtcatcacatattcatgttgtaattgcttgttattatggcttaggcatttcaacgttgcttgctgagaaaatcaaacaacttaatcatgcaatacagatcgtagatacattaaaacttgaagatattaacaactatcattttgaagggattgacttattaattactactcacgactttgatacaagtcaacttttacaaatacctaaagtcatacaagtatcacctttattttcagatgaagatgctaaaaaaatcgaattctttgtaaaagacatgcaaaacccattatcaaaagatgatatattatcaaaaattcagttgagtgttgagtccaatttcaaaatgaatcattcaaatcacattcttccaatttttgagaaatccaaagaaattttagattatcatcatgcaactctagatggctatatagaaagtgccatagatcgcgaaaaacaatcttcaacatatataggtaaagggatagcactcccacacggcaaccctgaaaaagtactgaaatcacacatgattatatttaaaccttctcaacctataacatggaaacaacatgaagttaaacttgttttctttttagcaatgagtaaaaaagatttaaatattaaccgtaaaattatacaaacaattgctcaattagaagaagatgacatccatcaattatgtcttttagatgatttacaactaaaaaacactttgtatgcacgttttaaagaataa

SEQ ID NO: 1271 - DNA, 222 bp, Staphylococcus epidermidis
aaaggagtgataattatgacacaaaaaatcataaaagttgaaggaatgagttgcgaacattgtagaaacgccgtagaatcggcactagctaaactaaatggcgtatcaagtgctgaagtaaatttagatgaaaatcatgtacgcgttgagtataatgattcaaaagttacatttgaaaatatgaaagaagcaattgaagaacaaggttatgatgttaaataa

SEQ ID NO: 1272 - DNA, 366 bp, Staphylococcus epidermidis
attgaggtgattaattgtatggaaaattttgataaaagttatcatgataaaacgggtgatgtattaggggctttaagttatctaagtgtatttttcgcacctgtattgtttccattaatcgtatggattgttggacaaccaccagcatctacgtattcaagaaatgcattatttaaccatattttgagttgggtgtgtttggtattaggacttatatcatttgctgctggactatccttgattgattcgacaaatggagtcgctgtactagtgataggagtaattattggaggtattctacttatcgcttcgcttgtattatttattattaatattgtgaagggtatcaaattattgatgatatag

SEQ ID NO: 1273 - DNA, 579 bp, Staphylococcus epidermidis
atgattgcgattattgattatggattgggaaacataagtaacgtcactcgagcaattcaacatttaggatatgatgtgattttgacatgtgatgataaagacgtgcaaaaagctgaagctatcgtacttccaggtgttggacattttcaggatgcgatgcattctatagaagaaaaaagcattaaagatatgcttaaaaatatacatgataaaccgataattggaatatgtttaggtatgcaattactttttcaacatagcgcagaaggtgacgttagtggattggaacttgtcccgggaaatatagtgccaatccaatcatctcatcctattcctcatttgggttggaatgaattaaagagtacacatcccttactgcaaagtgatgtgtattttgttcattcatatcaagcagaaatgtcagaatatgtagtagcttatgctgactatggtacaaagattccgggagtcattcaataccgaaattatataggtatccagtttcatcctgaaaaaagtggaacgtatggattagagattctaaatcaagcgcttaaaggagggtttattaatgattga

SEQ ID NO: 1274 - DNA, 504 bp, Staphylococcus epidermidis
ggaattgagatgattagatttgcgcgactagaagatcttcaaggtattttgacaatttataatgatgccatccttaatacaacagctgtttatacgtataagccacaacaattagatgaacgtcttcaatggtatcaatctaaagcaaaaataaacgaacctatatgggtttatgaaaaagaagggaaagtagttggttttgccacttatggttcctttagacaatggccggcctatttatatactattgaacattctatatatgttcatcaacagtacagaggactaggtatcgcttctcaattattagagaatttaattcgttacgctaaagaacaaggttatcgcactattgttgctgggattgatgcatcgaacatggatagtatcgcattgcataagaagtttgacttctcacatgcaggtacaattaaaaatgtaggttataaatttgatcgatggctcgatttatcattttatcaatatgatttatctgattcataa

SEQ ID NO: 1275 - DNA, 405 bp, Staphylococcus epidermidis
ttattggagatgactatattgattagaacatttatgaactcaaaaatccatagagctagagttacagaatctaatttaaattacgttggaagcataacaatagatgccaatatattagatgcggttgatattttacccaatgaaaaggttgctattgttaataataataatggtgctcgatttgaaacatatgtcattgctggagaacgtggtagtggaaagatgtgtttaaatggcgcggcttcaagactagttgaagttggagacgtcattattattatgacatatgcacaattaaatgaagatgaaatggtagatcactcaccaaaagtagctgtgttaaatgaaaataatgaaattatagaaatgataaatgagaaagaaaatacgatatcaaatgtataa

SEQ ID NO: 1276 - DNA, 1593 bp, Staphylococcus epidermidis
atgaattggatatcgattattttatttattatggtcgtaggtggcatttctttttatgcttatttgcaatcaagaaaaattaaaacgagtagttcagatggttattttatgggaggaaatagccttactggatttacagttgcctctacaattatcatgaccaatttgtcgacagaacaaattgttgggcaaaatggtcaaagctatgcacaaggaatggaagtaatggcttgggaggttacggctgccgtagcagttgtattgttggcttgggtctttcttcctaaatatctaaaatacggtgttaatacaatttctgagtttttggaattacgttatgatacatttactaaacgttttgtctccattttatttatctttacctatgtcgtatctttcttgcctgtagtattgtactctggttccctagtgttcaataaaatgtttaaagttgatgaatatttaggtgtaagtagttcaactgctgtcatcattatttcatctattattggtataattggcattatttacttatttataggtggtttatcgttaagtgcttttagtgattcaatttatggcatggctttaatcataggtggacttgcgattacaatattaggtctaggtcaattaggagatggcaacttcctacatggcttcgacaaaatcgtgcaagacacacctgagaaattgaatggttttggtaaggtggactcggatgttgtaccttggccaaccctattcttcggtatgttctttaacaatttattcttctggtgcgcaaaccagatgatagttcaaaaagcactcgcagctaaaaatttaaaagaatctcaaaaaggtgcaatatatttaagcttatttaaagttttcggaccattaattacagtcttaccaggtgtagtagcatttaactattttaatggtagtattgacaaatcagataacgcttaccctgcacttgtaacttcagtattaccagaatgggcatttggcttatttggtgcggttatttttggtgcaatattgagctcatttgttggctcattgaatagtacaactacactattgacactcgatttctataaacctatttttggaaaaaataaatcagataaacatattgctcgagtaggccatattgctactgtagtcattggagttattgttgtagcacttgcaccagtcatctcattattccctagtggtctttatgcagtagttcaacagtttaatggtgtgtatagtatgccagtgctagctttgattttagtggctttcttttctaaacgcacatctaaattgggcgctaaagtgacactcttcacacatataattttatacgctatcatcagctttgtatttacagaaattaattacctatacacatttagtgtattattctttgtagatttaattattattttgatctttaacaaagttaaaccatctagtgagtttgatttaagcacgcaccaaccgaaagtagatatgacgccatggaaatatcgttacgttgcaggtattattgttcttgcattagtagtagtaagttatattatcttctcaccactcgtgttagcaaaataa

SEQ ID NO: 1277 - DNA, 1602 bp, Staphylococcus epidermidis
gacatagtttttaatttatatatcataaaactatgtctcttccccgtacttgaggaggttaattcaatgtcccaaattgctttctatatccttagtgatgtccacggttttatattcccaacagatttttcatcaagagaaaaagatttacctatgggtttgttaaaagctaatcatctaatcgaacaagactgcgtgcactatgacggcagtgtaaagattgataatggagacttcttacaaggttctccattatgtaactacttagtatccaaattaaagagtagtctcccattaacatcaatatataatcgtttagggtttgattttggaactgttggcaatcatgaatttaattatgatttaccttatctaaagcaggccatcaatcaacttcattaccctgttttgtgtgcaaatataattgaaaatacacaaccattcactggccaaggtattcattattttaaagtaaatggtttaactataggaactattggattaaccactcagtatatccctcactgggaacaacctgattacattaaaacactcaattttaacagtgctatccacacattaaaatctgagttacctacacttagggaaaagagtgatattgtagtagtaagttatcatggtggttttgaacgtgatttagatagtggcctcccgactgaggcgcttactggggaaaacgaagggtatgatattctaagacagtttagcgatagtatcgatgtgttgataaccggccatcaacatcgtgatattgcgacaatcaagaaccaaacagccatcattcaaccaggttcaaaaggtacaaaagttggaaaaatagttattgaatatacacatgataaaaaagtattaattaaagaatgtaacttaatgaatgttcataacagtacctcctttaagccgaatgacgaagatatcgctttacgtaatcaattggaagattggcttgatactcaaatcgcagaactcccctacgctatgagaataaacaattcatttgaggcaagaaaatcaccgcatgcatttgttaaccttcttaattatattttattagaaaaaagtggtgcagatattgcatgtacagcactatttgattccgcaaatggctttgatgagaaagtaaccatgcgcgatatcatcaataattatccttttcctaatacttttaaagtgatagaacttagtggaaaagatattaaacttgcaattgaacgaagcgcaagttattttgacattgttaatcataaaatcacagttaataaagagtttctagaacctaaacctcagcatttcaactatgacatatttgcaggtatccaatatacaattcatgttagtcatccttacggtgaacgtgttagtgatttactaattaatgatgcaccactacaaagtgatcaaatatatacaatatgcgtaaataattatagagctgttggtggcgggaattatgatatgtacgttaacaaacctgtgataaaagatattcaaatcgaaggtgctcaattgttaatagattacttgtctcacaatgatttatctcaaatcccacaagtgattgatttcaatgttgttaagtaa

SEQ ID NO: 1278 - DNA, 1509 bp, Staphylococcus epidermidis
aaggtggggattaaaacaatgatatatacagtaacaagcacattacccttagtgcacggaggaagaactaaatcattattaacaagaattcgatttcttgataaagaaatgggcattcacaataaaatattaacaacgaattataacgccaattataacgaagtttatcaaaagttcgaagagaatcaactcataacgaaaaatacgcaaatcgaaaacatatatgattggttatctgatttcaaattactttcaatacctaaaagtagatttaagaaaaaaacgctttactctgaaaaagatagagacatagaaggtttaacttctaaagcattcaatgatggcaatgtgatgagatattatgatcaagaaacttatgttttatatcggaaattttatgaagatacaaatatcatagaatttgaagacgtgatgtcaccaatttctaagaaaaaaattgaacgtagagaatataatcacttcggtcaattgcatagaaagatttacttctcaagccgtacatatcacaaaattttggaagaatattttgacactgagggaagtatttactgtaaaaaattcttcaattcacaaaaggcaaatgaattagattttattcaaatttttaaaaatcaacgtatcatgaaggcttttaaaaacgaaaaagatctctttaaatattatttcgaacatcgctttaaacaaaatgatattgtgtttaatgatgctagacttttagataaaccacttttaaataactgtatgaacacaaaaaatgtgcttgtatttcataatagccacatcgatggcgataatattaaatcttcatacaaaattgcattggaaaattctgataaagtagctcaatacctcttgctcacacatatgcaaaaagacgatatacaacatgcatatggtattagcgatgaaaaaatatcgattgtacctcactttattaaaagctatggacaaaaagatactcatcacaaagaggatagattcgtatttattggtagactaggcaaacaaaaacaagtggaccatttaatcaaatcttataatcaattcttaaaaaatggacatcaaacgaaattagcgatttatggtgcagatgaacaaaatcaaaaacaagtcatactagatttagttaaagaatatcaaattgaagataaagttgatttaaatgattttaccaagcatcctcttgaagaatttaaaaaatctaaagcctcactattaactagtgaatacgaaggttttggtttaaccgttatggaaagtattgaagtaggttgcccagtcatttcttatgacgtaagatacggtcccggtgaaatcatagagcacggtgaaaatggctatcttgttgagccagataacattgaagcattcgcagcttatatggataaaataattaaaaatccactcaaacatgttaaaacaaaagaaacattaaagtatgaacaagcaaagaataactatcaaaagttgtttgagagagtaaagtaa

SEQ ID NO: 1279 - DNA, 138 bp, Staphylococcus epidermidis
acggcagtttttgtatcaacaattccaaccaaaatcatgattgtaaaaccaatgattgatactgcacctatagtcataggttgggtaatacaagcaatgatggttgacacaaaaatagcaaacataaaccaagcttga

SEQ ID NO: 1280 - DNA, 792 bp, Staphylococcus epidermidis
ggagtggttttgttgagtaactcaaaaaaagtagccgttgtcacaggtgcagcacaaggtattggcttgaaaattgctgagcgtctatttgaagatggatatagcatcgcgcttgtagactttaatgaagcggtagctaaagagtcagctgaaaaattatcaaaagaagggcaagaggcagttgcttttaaagcagacgtttcaaatcgcgatcaagtatttagtgtgttaaatcaagtcgttgaacactttggcgatttaaatgtcctagttaataatgctggtcttggaccaatgacaccaattgaatcagtaacacctgaacaatttaatcaagttgtaggtgttaacgtaggtggtgtattctggggtatccaagctgcaattgaacaatttgataaattaggacatggcggtaaaattatcaatgccacatctcaagcaggtgttgaaggtaatgcaggcttatctctatacagcagtactaagtttgctgttagaggattgactcaagtagcagcacgtgatttagctgagaaaaatattacagtcaatgcatttgcacctggtattgttgaaacaccaatgatgaaaggtatcgctgaaaaacttgctgaagaaaacaaccaaccaatggaatggggttggaaacaatttacagatcaaattgccttaaaacgcttatctaaacctgaagatgtagctaatgtagtaagcttcttagcaggtagcgattcagattatattactggccaaacaatcatcgttgacggtggtatgagattccactaa

SEQ ID NO: 1281 - DNA, 177 bp, Staphylococcus epidermidis
aactttaactttatcaatgtaattacaacttcaatcctacaatgtatctcgtgtatttatattaataccattacaatacttatatacaattcattattaaagtcatctcttatatttaattattataacaagcataatggttcagtcatgacatcatgcttagacgttaaacgataa

SEQ ID NO: 1282 - DNA, 126 bp, Staphylococcus epidermidis
aatgaatttgtgattggtactttgtttataattttgttttatattattaattttgacctcttattaagctctcacaaagtaccaatacaccttataattaaatcagatgaaggtgaattaaaatga

SEQ ID NO: 1283 - DNA, 132 bp, Staphylococcus epidermidis
ttggttattgtttcattgttagacattataatcaaatctccttttccaattaattatatttgtttactcggcttttcttataagaaaaagacaatttcttgtttcgaacgacttgaaaaacaagcaaaataa

SEQ ID NO: 1284 - DNA, 138 bp, Staphylococcus epidermidis
ataactgttgtcaactatatttttaatctaaaaaaatatgtaatacaaatccttttgaaatctcgaatttgttacatactagttacaaaaattatttttttaaaaatacatttaacagtgaatatacttggtctttaa

SEQ ID NO: 1285 - DNA, 183 bp, Staphylococcus epidermidis
gtcttggttgttgtgcgcgttttatttactgtggtagatttttttgctattgtagtttttttagttgatgacgttttgggtgatatagcttgtttggttgatgtagctctttttattgatgtagctctagatttaacagacgtatctttaactgaacgtttaaaattggacgtcgtcttttga

SEQ ID NO: 1286 - DNA, 3780 bp, Staphylococcus epidermidis
tataatgactttgtgaaaaaatgtacaataaagataagacacaatacctatgcattgagaaaggatataaccttgtatggtgggaggattaataaaatgggaaaatttggattgaatttctttaaaccgacagaaaagtttaatggaaattggtcggtattagagcataaaagtcgagaatgggaaaagatgtatagagaaagatggagccacgacaaagttgtaagaacgacgcatggtgttaactgtactggatcatgttcatggaaagtatttgtcaaaaatggcgtaattacatgggaaaatcaacaaattgattatccaagttgtggacctgatatgccagaatttgagccaagaggttgtccgagaggtgcatcattttcttggtatgagtatagtccgttaagagttaaatatccttatattagaggtaaattattagatttatggaccgaagcgcttgaagaacaaaatggaaaccgaattgcggcatgggcatccatcgtagaaaatgaagaaaaagccaaacaatataaagaagcaagaggtaaaggtggacacgtcagagcaaattggaaagatgtcacagatatcattgcagctcaaattttatacaccataaaaaaagatggaccggatcgtattgctggatttactcctattcctgctatgtcgatgattagttatgcttcaggagcaagatttattaatttgttaggtggagaaatgttaagtttttacgattggtatgctgatttaccacctgcatctccacaaatttggggtgagcaaacagacgtgccagaatccagtgattggtacaacgcctcatacataatgatgtggggatcaaacgttccattaacacgtacacctgacgcacattttatgactgaagttagatataaaggggcgaaagttatttcagtagcacctgattatgctgagaatgttaagttcgccgatcattggcttgcaccacatccagggacagatgcagcggtagcacaagcaatgacacatgttattttacaggaatattatgaaaatcaaccgaatgatatgtttattaactatgctaagcaatattctgatatgccgtttgttattatgttagatgaagatgagaatggctataaagcaggtagattcttgcgtgcttctgatttagggatgtcaggtgaaaataatgaatggaagccagttattcaagacaaattgagccaacaattacttgttcctaatggcacaatggggcaacgctgggaagaagggaaaaaatggaatttgaaacttgaaacagaggatggtacaccaattgatccaatgttatcaatggttgaaagtgactatcatgttgaaacgattcaatttccatattttgatagcagtggtgatggtatctttgagagacctattgcaacgagaactattcaattagctaacggagaagaagttaaaattgctacggtttatgatttaatgacgagtcaatatggtgttcaacgttttgaacatgaactagaagctacatcttatgatgacgcatcttctaaatatactcccgcttggcaagaacaaattacaggtatcaaaaaagaattagtgacgaaagtggcaaaagaatttgcacaaaatgctattgatactggtggacgctcaatgattattatgggggctggtatcaaccattggtttaactccgatactatttatcgttcaattcttaacttagtactattgtgtggttgtcaaggcgttaacggtggtggttgggcacactatgttggacaagaaaaatgtcgaccaattgaaggatggaatactattgcatttgctaaagattggcaaggtcctccacgtttacaaaatggtacaagttggttctatttcgctacagatcaatggaagtatgaagaatcaaatgtagataaattaaaatcaccattagctgaaaatattaagcatcaacatccagctgattacaatgtaacagctgctcgtatggggtggttgccttcatatccacagtttaataaaaacagtctattatttggtgaagaagctaaagatgaaggtgatgattcaaatgaagccatcttacaaaaagcgattgaatcagttaaaaataaagatacacaatttgcgatagaagatccagatttaagaaaaaaccatcctaaaacattatttgtatggagatctaatttaatttctagttcagctaaaggacaagaatactttatgaagcacttgttaggtgcgcgctctggtttaatggcagagccaaatgaagatgataaaccagaggaaattaaatggcgcgaggatacagaagggaaacttgatttattagtatcacttgatttcagaatgactgcgacgccattatattcagatatcgttttacctgctgcaacttggtatgaaaaacatgatttatcttctacagacatgcatccatttattcatccatttaacccagcgatcgacccattatgggaatcgcgttcggactgggatatttataaaactctaagtaaagctgtttcagaaatggccaaagattatcttccaggtaaatttaaagatgtcgtaactacaccattaggacatgattcaaaacaagaaatttcaactgaatacggtattgtaaaagattggtctaaaggagaaattgaaggtgtgccaggtaaaacaatgcctaatttttctatcgtagagcgagactatacacaaatttacgataaattcgttactgttggtccaaaactagaaaaaggaaaaataggtgctcatggtgtgagttatagcgttagtgaagagtacgaagaacttaaaagtatggttggaacttggaatgatgataatactacttcagttaaaaatgatagaccgagaatagatacagcgagaaaagtagcagatgtcattttgaatatatcctctgctacaaacggcaaattatcacaaaagtcatatgaagatttagaaaatcaaacaggtatggaacttaaagatatttctaaagaacgtgcttctgaaaagatatcattcttaaacattacttctcagccaagagaagtgattccaactgcagtattccctggctctaataaagatggaagacgctactcaccgtttacaactaatgttgaacgtttagtgccatttagaacgctaacaggacgtcaaagttattatattgatcatgaggtattccaacaatttggtgaaagtttaccggtatataaacctactttacctccaatggtatttggtgctcgtgataaaaaagttaaaggtggacaagatacattagtgcttcgataccttacacctcatggaaaatggaatattcattcaacttatcaagataatgaacgcatgttgacattgtttagaggtggaccagttgtatggatttcaaatgaagacgcagctgaccatggtattaatgataacgactggttagaagtatacaacagaaacggagttgttactgccagagctgtaacatctcatcgtatgcctagaggcacaatgtttatgtatcatgcacaagataaacatatagagacacctggttctgaaattactgatactcgtggaggttctcataatgcacctactcgtattcacctgaaacctactcaattagtaggaggatatgcacaaattagttatcactttaactattatggaccaattggaaatcaaagagatgagtatgtagctgttagaaaaatgaaggaggtcaattggcttgaagattaa

SEQ ID NO: 1287 - DNA, 504 bp, Staphylococcus epidermidis
ttaccgcctgtgccttttatcttgttaatgtctaatcctttatcctcagccatattacgtgcgaggggtgagataaagattctttctcgtgctgcgcttttaggcgaattatctttattatcggaagacggttgtgatgtatctttaacttcttgcgtttccttctcatgctcgttgtcttcttttactttttctgatgctaaatcatcttcatctttatcaatagcttccccttcttctccaattatacctaataccgctttaacctctgcatcttctccggcttgcactttaatttctaacaatgtcccactcgccggcgcttcaacatcgttggttaatttttcagagcttattgtaacaatactctctccttgttttacggtgtcaccctctgatttaaaccactcttcaacagttccctctttcattgtcattccaagctttggcataataatattttcactcattgtgatacacctcctatgcgttagccttttttaa

SEQ ID NO: 1288 - DNA, 135 bp, Staphylococcus epidermidis
cactacgctgtacctcatttcactactttttcacgtaaaagtaatagtcacattatcttatttctcatgtacaaatcacataatattcataatttcattttgattacaaaacacttaccaatgttttacgaatga

SEQ ID NO: 1289 - DNA, 705 bp, Staphylococcus epidermidis
atgactaatgtattatatcaacacggaacattaggaactttaatggcaggtttattagaaggaactgcttcaattaatgacttattagaacatggtgatttaggtattgctacgcttacaggttctgatggagaagtaatttttgttgatggtaaagcttatcatgcaaatgaacataaagaatttatagaattgacaggcgacgaaatgacaccatatgcaactgttacaaaattcaaagcagactcaagttttaaaacatctaataaaaatcaagaagaagtattcgatgaagttaaaaaacaaatgaaaagtgaaaatatgttctcggcagttaaaatttcaggaacgtttaaaaaaatgcatgtacgtatgatgcctggtcaagaacctccatacacacgtttaattgattcagctcgtagacaacctgaagaaacacgtgaaaatatcaaaggttcaatcgtaggtttcttcactccagaattattccatggtattggttctgcaggtttccatattcactttgcaaatgatgatcgtgattttggtggtcatattttagactttgaagtggatgatgtgactgttgaaatacaaaactttgaaacatttgaacaacacttcccagtagatgctaaatcatttactgatgctgacattgactataaagatatagccgatgaaatcagagaagctgaataa

SEQ ID NO: 1290 - DNA, 1773 bp, Staphylococcus epidermidis
gaaagagatgttaacaaacaaagaaaacaaatcaatttttggaggtctttaacgatgagaagaaaacgcgattcatacgattatgtcatcattggtggcggtagtgcaggttcagttcttggtgcacgcctttcagaggataaagataaaaatgttttggtattagaagctggacgtagtgactatttctgggatttatttattcaaatgccagcagcattgatgttcccatcaggtaatcgtttttatgactgggaatatcaaactgacgaagaaccacatatgggacgtagagtagatcatgcgagaggtaaagtattaggtggctcaagttctattaacggtatgatttatcaacgaggtaacccaatggactatgaaggatgggcagaacctgaaggaatggacacatgggactttgcacattgtctaccatacttcaaaaagttagaaacaacatatggtgcagcgccatacgataaagttagaggccatgatggtccaatcaaattaaaacgtggaccagctactaatccattatttaaatcattctttaatgcaggtgttgaagcgggctatcataaaactgcagacgttaatggatacagacaagaaggttttggaccatttgatagccaagtacatcatggacgtcgtatgtctgcttcaagagcgtatctacgcccagcattaagacgtagaaacttagatgttgaaacacgtgcattcgttacaaaattaatttttgatgaaaataatagtaaaaaagtaacaggcgtgactttcaagaaaaatggtaaagaacatactgttcatgcaaacgaagttattttatctggcggtgctttcaatacaccacaactattacaattatcaggtattggtgactcagaattcttaaaatcaaaaggtatagagccacgtatgcatttaccaggtgttggtgagaacttcgaagatcacttagaagtatatattcaacataaatgtaaacaaccggtttcactacaacctagccttgatgtcaaacgtatgccgttcatcggtttacaatggatttttgcacgtaaaggtgcagcggcgtctaaccactttgaaggtggtggctttgtaagatcaaatgatgatgttgattatccaaacctcatgttccatttcttaccaattgctgtaagatatgatggtcaaaaagcaccagtagcacatggttaccaagtacatgttggaccaatgtactccaactcaagaggtagtttgaaaatcaaatctaaggatccatttgaaaaaccaagtatcgtgtttaattacttatctacgaaagaagacgaaagagaatgggttgaagcaattagagtagcaagaaatatcctaaaacaaaaagctatggacccatttaatggtggcgaaatttcaccaggaccacaagttcaaacggatgaagaaattctagattgggtacgtaaagatggagaaactgcattacatccatcttgtagcgcgaaaatgggacctgcatctgacccaatggcagtagtcgatccattaactatgaaagtacatggtatggaaaatttacgtgtcgttgatgcttcagcaatgcctagaacaacaaatggtaatattcatgcacctgtattgatgttagctgagaaagcagcggacattattcgtggtagaaaaccgcttgaacctcaatatgttgactattataaacatggtattgatgatgaaaaagcaggtgcaatggaagatgatccattctaccaatattaa

SEQ ID NO: 1291 - DNA, 138 bp, Staphylococcus epidermidis
gaagcatgtgtcaatatcgtctcattcttactatgtgcgatttctcgtgttgttattgaaattatcgataaaatagtcatcaaaaaaatgacaacaatgacaaacagttttatcttcattgagcatcctctactttaa

SEQ ID NO: 1292 - DNA, 132 bp, Staphylococcus epidermidis
agcaaatgtgttaactcacttttcaatcataaagaattcaaaataaatctctcagttcattcaattacaatcaaaataagaaaagaacctgtacctatgattgatgtatcaggttccatattatcaacttga

SEQ ID NO: 1293 - DNA, 462 bp, Staphylococcus epidermidis
ggtgaaagtgtggaaccagaatctttaaaacataatcaacatttacaaatgaatttagataagttgagagcacaagagggttatgattttggtggtatcgctttatatgattatcatcacacttcatcaccaattaaatggcaatatgtttcaggtaacacaaatgatagatataaacttatcattttgagaaagggtagagggcttgctggaatggtgatgaaaaccggtaagcgtatggttattgctgatgtagatacagctttatctccagaagagaaagttaaatttccaatcattcttagtgagtcattgacagctgtagttgcagtccctttatggttagaaaattcaatgtatggcgttttattattaggtcaaagaaatcatcagccgttacctcagtcattggaccaacttaatattgaaaaacaaatcggtatttttacagaaataaactag

SEQ ID NO: 1294 - DNA, 246 bp, Staphylococcus epidermidis
ttagagagtgtgaacaatatgattagtgtaaacaatggggtaaaaaataaaaaatataaagtgaagcatatagggatttcaaataaaaatatgttgtatcgtttaggggcattaggcttaaacattggaagtgaaattagcatcaaacagaaatgtttactcaacggtcctagcgttgttgaagtaaatggtcaacatttaagtttacgacaacgtgatgcacgactcataacattagaggagtag

SEQ ID NO: 1295 - DNA, 615 bp, Staphylococcus epidermidis
atcaggagtgttaaaatgagtgaatcaaatcatattacatggcatgactcagaagttacgaagaaacaaagacagcataaaaatggacacaaaagtgctgttatatggtttacagggctatctgggtcagggaaatcaacggtctctgttgccttagaaaaagaattatttaatgaaggaaaacaaacataccgtttagatggtgataatgtgcgtcatggtcttaataaaaatttagggtttagtcctgaagatcgttcagaaaatattcgacgcattggagaagtagcaaaattaatggtagacgctggagccttaacagttactgcttttatctccccatataaagaagacagagaaggtgttagagcattactagaggataatgagtttatagaagtatatacaaaatgtagtgttgaggaatgtgaaaagagagatcctaaaggattgtataaaaaagcacgatctggggaaatacctgaatttacaggtataagtgcaccttatcaagcacctgaaaaccctgaaattactatagatactgaacacgacactattgaacaatcagtggtacaaattatacgttatcttaaagaacacgaatatatttaa

SEQ ID NO: 1296 - DNA, 150 bp, Staphylococcus epidermidis
aggaatttcgtctgtatatgtacatccagaaccctatactacaaaagacgaagtaaaataaaatatataagaagtcaatcattacctgaccataaggtagtggttgactttttttattttaaaccagaatcattaccgggaaattactaa

SEQ ID NO: 1297 - DNA, 219 bp, Staphylococcus epidermidis
ggaaaaatcgtagatattttatttattttcggtttgctcggtggtgctgcaacatcactcgctctaggcgtgccgatgatctcagctggtattgaacgattgactggtttagatggatctaatatgattttacgttcaatcatcttactaactattacagtttattttcgcaatcagttcttacacaggtttgaaaaaaggtattcaaaaattaagtga

SEQ ID NO: 1298 - DNA, 915 bp, Staphylococcus epidermidis
gaaacgaccgttgcttataaacaatttatacgttttgcacaacatcatttacattttcatcatctagggaggcattttatggttatttcaaaaaaattatcacttatcactataggtatcttaataagtattcttttaatttctctacttattgatcaaactatctcacatcaattcatgaatcagaattcaattttcggtactttatttcaaaactacggtttatttccgcctacgctcatattaattatttcaactgtaattttaaattattatattttcactacatttcaaaataaattagctaaaatattaacattgcttatatctttcatattcaccctaattaaaaccaatgaattcgtgtcagaaactgctcaatatatgctatcaacttcagcaaacataaaaaatcataaaccaatggggatggcaaataatgaaggaaacgctggaaatgctttatctttaggaatgagtttctttatttctttgattatacttataattatcacttttatttgttatcaattttggttaaaacatacaaataaccaagaactttatcatttattcaaagtttcacttattagctttatgattttatttattggattagaactcgttgatagcttgaaacatttatggggacgttttagaccatatgaaatcactgacaaagctggacatttcactcactggcttacaataaatggaaatactggacatagttccttcccttcaggacacactggaaatggtgcatttctaatgtttatcgcattttactttaaaaaattacgcactcaaaaaatagtgtttagtatcggattatgttatagcattttaatggcattgagcagaattcgtattggtgcacatttcactaatgattattgcagattttatcattaa

SEQ ID NO: 1299 - DNA, 1050 bp, Staphylococcus epidermidis
atgaacaacgttaaagaatccatcattgttgccttcgcctttgtaggcgttgtagttggagcaggatttgcaacaggtcaggaaatctttcagttcttcactagtcatggtatttacagtattggcggtatttttattactggacttatcttaactcttggaggaatattcgtattaaatactggctttcgtcttagatctcaaaaccactccgaatctattcgttattatttacatccaacaatagctaaattatttgatattatacttacagtatttttattttctctagcaattattatgacagccggcggagcatcgactataaatgaaagtttcggcttacctttttggttaagttctttcattttagtgatacttattttgataacattatttctaaagttcgatcgtcttatcgctgttttaggaggggtaacaccatttcttgtggcagtcgtagtaatgattgcagtgtattactttattaccggtgatttaaactttagtgatgtcagtcaatattcaaatcaaaataagtcgatttcacctggttggtggtttgacgcaattaattatgctagcttacaaattgctgctgcatttagctttttaactgtaatgggcggtaaactacgatatcaatcgtccacaatttatggtggacttatcggtggtattattgtgactttactattacttttgattaattttggtcttgttacagaatttaatcaaattaaagaggtagcattaccatcattgctacttgctaagcagatttctccatccattggtattatcatgtctgtcattatggttttagtcatatacaatacagtagtaggtttaatgtacgcctttgcatcacgctttagtcgaccgtttacgaaacgctattatattcttatagttatgatggcgataataacatttgcttgtacttttgtgggattcatttctctcattggtaaagtgttccctatcatgggactttttggttttatcttattgattcctgtgatatacaaaggaattttacgaaaataa

SEQ ID NO: 1300 - DNA, 732 bp, Staphylococcus epidermidis
atcaagcgcttaaaggagggtttattaatgattgatttatggccagctattgatttaattaattcaacaagtgttcgattaacagaaggcaaatatgattcaaaagaaaaaatggaaaaatctgtagaagacagtatccgattttatagtcaatttaaatgtgtgaaacgtatacatattgtagatttaattggggctaaagcaaaagaggtaaaagaattcgactacatccgttccttaagaaagttgaccactaagcctatagaagtgggtggcggcattcgttcaaaacaaacaattgaaaattatattcattcaggaatagactattgtattgtaggtacaaaaggtatccaagatatagagtggttaacacatatgacacatcaatttccaaataaactctacttatctgtagatgcttttggagagaaaataaagattaatggatggaaagaggatgctaaactcaatttatttgattatgttgccaaaattgagcatttacctttgggtggtgtgatttataccgatatttcgaaagatgggaaactttctggacctaattttgatttgacaggtcgtctcgcactttatacatcgttacctgtgattgcttcaggaggtattagacatcaagaagacttgtttcgattagaatcgttaaatgttcatgctgctattgtaggaaaagcagcacatctggatgaattctgggagggattatcttga

SEQ ID NO: 1301 - DNA, 138 bp, Staphylococcus epidermidis
aatgtaagcgtttgcaaatatataagcttacatagtaaaataatacaaaggttatggcgaagaaaaatctttaaaataaaagaagatgacaagtcatacctttatgcacaaaggatggtagaaatgataaattcatag

SEQ ID NO: 1302 - DNA, 147 bp, Staphylococcus epidermidis
agcagtttagtattatgctcaaaatgtaataagaattattacatcacattaaagactgatattcatattttacagtcaaatttatatttaaggggtttttattatgaaagcagcagtatggtatggacaaaaggatgtacgcgttga

SEQ ID NO: 1303 - DNA, 147 bp, Staphylococcus epidermidis
tttgtactagtacgtgcttcactagtcgctaatgaatcggttgcttttgtttcgattgactgggttaaattggagctaatgttcttttctgaggatgacgtgtttgattgtgttgacttagaggttacattcgaagacttattttga

SEQ ID NO: 1304 - DNA, 207 bp, Staphylococcus epidermidis
actgtaatagttagtaagatgattgaacgtaaaatcatattagatccatctaaaccagtcaatcgttcaataccagctgagatcatcggcacgcctagagcgagtgatgttgcagcaccaccgagcaaaccgaaaataaataaaatatctacgatttttcctcataatttatccgtatgtccttttaaaattggtcgacaagcttga

SEQ ID NO: 1305 - DNA, 144 bp, Staphylococcus epidermidis
atgaagccagttaacgataatggaattcgcttagcacctgctgagaacagaatcaatggtattgctgtaattgcacctgaaaatagtagccaaaatgatgatatatttaatccaaatgttatgtgttgttgctgccataggtaa

SEQ ID NO: 1306 - DNA, 141 bp, Staphylococcus epidermidis
tttgtagcagtagattctgttgatgcaaatgttgagggaatcacagtcacagaaagaacagatgtaactagtatagaacttaaagttttaaatattttcatctctatgattactccttatataaaagatggaattttttaa

SEQ ID NO: 1307 - DNA, 132 bp, Staphylococcus epidermidis
tataataaagtaaaagctcaacgagctgaaaatcatcaaaaaaaatataaaaaagacaatttctacattatttcaatagaaattgtctttatttacttatcctggaactttctgtcccagccactcttttaa

SEQ ID NO: 1308 - DNA, 948 bp, Staphylococcus epidermidis
aaagataaagtaggtgaagttgaaatgaataaaaataaagtgattgtaattggatcaacaaatgtagataaatttcttaatgttaaaaggtttccaaaacccggtgagacattacatattaatcaagctcaaaaggagtttggtgggggcaagggagccaatcaagccatagcagctagtagattagcagcagatacaacatttatcagtaaagttggtaaagatggcaatgctaactttatattggaagatttcaaaaaagcaggtattcatacacaatatattttaacttcagaaagtgaagaaactgggcaagcatttatcactgttgatgaagcaggacaaaatacgattcttgtttacggtggtgcgaatatgacattaagtgcaactgatgttgagatgagtgtggatgcgtttattggtgcagactttgttgtagcgcagcttgaagttccatttgaggcgatagaacaagcatttaaaattgctcgtaaacaaaatatcactactgtattaaatcctgcaccggcaattgaattgcctaagtcacttttagagttaactgatataattattccaaacgaaacggaagcagaattattaacaggtatttcaatcaataatgaaagtgatatgaaagaaacagcaacatattttctcgatttaggtatatctgcagtattaattactttaggggagcaaggcacgtattgtgcatatcaagaacaatacaaaatgattcctgcgtgtaatgtaaaagcaatagatacgacagcagcaggagatacatttataggtgcttttttaagtgagttaaataaagatttgagcaatttagaatcggctattcgacttgcaaatcaagcgtcgtctctaacggtacaacgaaaaggagcacaagcttctataccaacacgtaaagaagtagaggcagaatataattaa

SEQ ID NO: 1309 - DNA, 3561 bp, Staphylococcus epidermidis
gaagtgaaagtttcagatgtactcattgatgtggacgtgcttgatgaatctgaaatgcttgtacttgatgattcacttaccgatgtactttcacttgttgattcactctcgcttgttgacgttgatgcactttctgatgtcgatgtacttgttgaatctgaaacgcttgtacttgatgattcacttaccgatgtactttcactgtctgactcactcacactcgttgatgtggatgcactttctgatgtggatgtggacgcactgtctgatgtcgacgtactcgttgagtctgaaatgcttgtacttgttgagccacttaacgacgtacttgcgctatcggagtcgctctcgctcgttgatgttgatgcacttgctgatgtcgacgtactcgttgagtctgaaacgcttgtacttgttgagccacttaatgacgtacttgcgctattggagtcactcacgctcgttgatgttgatgcacttgctgacgttgacgcgcttgttgaatctgaaacgcttgtgcttgtcgactcacttaacgatgtactttcactgtttgagtcactctcacttgttgacgttgacgcactgtcggatgtcgatgtacttgttgaatctgaaacgcttgtgcttgtcgattcactcaatgacgtacttgcacttgttgattcactctctcttgttgacgttgatgcgctttctgatgttgacgcgcttgttgaatctgaaacgcttgtgcttgtcgagtcacttaaggacgtacttgctctgtttgagtcgcttacactcatagatgtagatgcactatctgatgttgatgtactcgttgagtctgaaatgcttgtacttgttgactcacttaaggatgtacttgcactgtccgagtcgctctcacttgttgacgttgatccactttctgatgtcgatgtgctcgttgagtctgaaagactcgtacttctcgagtcacttaatgacgtacttgtactgtttgaggcactcacactcgttgatgttgatgtacttgtcgattctgaaacgctcgtacttgtcgagtcacttaacgatgtacttgcactgtccgagtcgctctcacttgttgatgttgacgcactgtctgatgtcgacatactcgttgaatctgaaagactcgtacttgtcgattcacttaatgacgtacttgcactattcgagtcactcacactcgttgatgttgacgcactttctgacgttgacgcgcttgttgaatctgaaacgcttgtgcttactgattcacttgatgacgtacttgcactgtccgagtcgctctcacttgttgatgcagatgcactgtctgatgtcgatgtacttgttgagtctgaaacgcttgtacttgttgagccactcaatgatgtgcttgtactgtttgactcactcacactcgttgatgtggatgcactatctgatgtggatgtgcttgttgattctgaatcacttgtgcttactgattcacttgatgacgtacttgcactgtccgagtcactcacactcgttgatgttgatgcactgtctgatgtcgatgtactcgttgaatctgaaacgctcgtacttaatgattcacttatggatgtgcttgtactgtttgactcactcacactcgttgatgttgatgcactgtctgatgttgatgtacttgttgagtctgaaatgcttgtacttgttgagccactcaacgatgtacttgctctttccgagtcgctctcacttgttgatgcagatgcactatcggatgttgatgtacttgttgagtctgaaacgcttgtacttaatgagccacttaacgatgtgctggcactgtttgagtcactcacactcgttgatgttgatgcactgtctgatgtcgatgtactcgttgaatctgaaagactcgtacttgtcgagccacttaaggatgtacttgctctttccgagtcgctctcacttgttgacgttgatgcactgtctgatgtcgatgtactcgttgaatctgaaagactcgtacttgtcgagccacttaacgatgtacttgcactgtctgactcactctcactcgttgatgtggacgcactgtcggatgtcgacgcgcttgttgaatctgaaacgcttgtgcttatcgactcgcttaatgacgtactttcacttgttgagtcactctcactcgttgacgttgatgcactgtcggatgtcgacgtactcgttgaatctgaaacgctcgtacttaatgattcacttatggatgtacttgcactttccgagtcgctcacactcgttgatgttgatgcactgtcggatgtcgacgcgcttgttgaatctgaaacgcttgtgcttgtcgactcgcttaatgacgtactttcacttgttgagtcactctcactcgttgacgttgatgcactttctgacgttgacgtacttgttgagtccgaaagacttgtgcttgtcgattcacttaatgacgtacttgtactgtctgactcactctcactcgttgacgttgatgcactgtcggatgtcgacgtactcgttgaatctgaaatgcttgtacttaatgatccacttaacgatgtgctggcactgtttgactcactctcactcgttgatgtggatgcactttctgacgttgacgcgcttgttgaatctgaaacgcttgtgcttaatgattcactcaacgatgtactttcacttgttgagtcactctcgcttgttgacgttgatgcactgtcggatgtcgacgcactcgttgagcctgaaagactcgtacttgtcgattcacttaatgacgtacttgtactgtctgactcactctcactcgttgacgttgatgcactgtcggatgtcgacgcactcgttgagcctgaaagactcgtacttgtcgattcacttaatgacgtacttttactgtttgattcactctcgctcgctgacattgatgcactgtcggatgtcgacgtactcgttgaatctgaaacgcttgtacttgtcgattcacttaatgacgtacttgcactgtctgactcactctcactcgttgatgtggacgcactgtcggatgtcgatgtacttgttgaatctgaaacgcttgtgcttgtcgatttacttaatgacgtacttgcgctattggagtcacttacgctcgttgacgttgatgcgctatcagacgtcgacgtactcactgattctgataatagtttacttgtgcttgctgattcgctcgcttttattgatgcgctatcagacgtcgatgtgctcgttgagtctgaaatgcttgtacttgttgagccactcacacttgttgatgttgacgcactttctgacgttgacacgcttgctgaatctgaaacgcttgtgcttgtcgattcacttaatgacgtacttttactcgttgactcactctttcttgctgactctgatgcactatcagatgtcgacgtactcgctgattctgataattgtttacttgtgcttgctgattcgctcgcttggattgacgtactattcgacgtcgacgcacttaacgactctgagagactcttacttgttgataatgattga

SEQ ID NO: 1310 - DNA, 1344 bp, Staphylococcus epidermidis
aatattgaagtgaaaattgttcggcataagttaggagattcttccatgttattgtttatcatagaaatcataatcatgattctagcgatattattaggattaagaactgctggtgcactgggatgtggcatctttgctatagtagcgcagcttatcatgatatttggattccagttacctccaggttcagcaccagtgacggcagtgttaatcatattatctattggtatagcaggtggtacgttacaagccactggtggtattgactatttagtatacattgcatcacgtgtgattgaacgctttccaaaatcaattatatttatagcgccaatgattgtctttgtctttgtttttggaattggtactgcaaatatagctctttcacttgaacctatcatagcgaaaactgcacaaaaagcacgaattcagcctaaacgcgcattaactgcttcggtacttacagccaatttagccttactttgtagcccggcagcttctgctacagcttatattatttctgtattagcagggtatgaaatatcgatgggcaagtatttaagtattgttttacctacagctttaattagtatgttaatgcttagtacattttgtacatttgtaggacgaaaagaacacgtgcgtgatgagtcagaacgtttagttcagatgccagaagtcgaaatcaaaaatgacttttcattaaaagtaaaaataggtgttatctcattcctattatgtgtcatgggtattttaacgtttggcatatttcctaatctcatgccgcaattcaatgtgaatggagatgtagttaaagttgagatgactgaaattgttcagttctttatgtatctcagcgctacaatcaatttattattaataaaaatcaatacttctgatattctgtcatcgaatattacacaatctgcaatgggagcactttttgcagttcttggcccaggttggttaggtgcaacaatatttaatgctccacataacttaaaaatattgaaaaatgatattgggtcaattattagtgaagtaccttggcttgttatcatacttgtttctgtagttgcaatgattgtcatttctcaaacagctacagcatcaattatggtgccgatagttatgagtttaggtatacctcccatctattttgttgcgatggtacaaacattaaatgtgaatttcgttattccagctcaaccgacactattatttgctgtagaactagatgaaacaggtagaacaagacctacgagctttatgataccaggattttttgttataacagtatccgtcattacaggatttgttattaaaaccattttaggatattaa

SEQ ID NO: 1311 - DNA, 126 bp, Staphylococcus epidermidis
gctatacgagtgaggaacataaagttttattcaacctttgttctacttcttttatttatacataacaacttattctatacgctttttcaagagtttattgaaattgataactctcatatcctttag

SEQ ID NO: 1312 - DNA, 843 bp, Staphylococcus epidermidis
gtatcatttttaagatttgagcaatcaagactatataagcatcgagaggatgatactatgtttatttcaaaacaagaattatatgaaaagttacaatatgttacgccaagaacgtttgcctacttgaatgaaatagattattataacttattaatgataattgaagagcatcaaatatctattccaccgattcatcaacttcgaaaaacattgcgaggaagtaaaattatgaagcctaagaatcgcgtagacaattgttatattcatttaaaggatgaaattccgacccctattaacaatgaacaattaagtttcctgcatttttatccacgtcagcaaatacatttaattttgagtgcttattctagaatgaaaagtctaaagttacaatctcaaaaacattgtttaaagctcaaattccccttagatcagcattctattcgtaaagaaattacaccacctcaaagctctgataaagacaatgatattttaatttgtctattacaaaaattaatcaacgaaattaccaaatgtcaagttcctgtttctctaaagaataattctttcgaaataaaactaccaaactatatcataaaggttgatttaaactatcacgaacagcaagaccatttatatccattacaatatagcatccacgcatggcatagagatttccaatatctcgaaatctcaaataccttcacaataccgtctttgaatgatcttattttccatatacaaaagctttttttacttatatttcaattacctgaacatctcgcgagacaagaatattcattgagtcaatattatttttactcgcaatgccatacaaaaaattaa

SEQ ID NO: 1313 - DNA, 750 bp, Staphylococcus epidermidis
ctaaaattggtaagaaatggtttggtcaagatgtttctaaacctgaataatgaacaacaacatgcattagatgcagccaaacaagcatttggtccaatgttagagggattggtgaaatactcaatccctattactttggtcactttcattctaggtttaatcattgcattgtttactgcacttatgcgtatatcaaccagtaaattgcttagaggtattgcgcgtgtctatgtatcaattattcgtggtacacctatgattgtacagttatttattattttttatggtataccggagcttggaagattggtaactaacaatgctgataatcaatggacacttgcacctgttattgctgcagtcattggtttatctttaaatgttggtgcttatgcttctgaaattatacgaggaggtatattgtctattcctaaaggacaaacagaagcggcttattctataggtatgaactatagacaaactgtgcaacgtattatcttaccacaagctattcgtgtatctataccagcactaggaaacacatttttaagtttaattaaagatacatcattacttggatttattcttgttgcagagatgtttagaaaggcacaagaagttgcttcgacaacgtatgagtatctaactatttatttgttagtagctttaatgtattgggtcgtatgttttatcatctcaattatccaaggatggtatgaatcacgcattgaaagagggtatcgctcatga

SEQ ID NO: 1314 - DNA, 189 bp, Staphylococcus epidermidis
ttaagaaaggttttaattagtttgaattttaaagtatttctaattatcatttttcatgattttcttatttattatgaacacggttttatgtatagccgtttcaaagaacatgctgaacaatcatcacatttatttatattaaaatcacatttaaagccatttccaccatttcgatatacatatgattaa

SEQ ID NO: 1315 - DNA, 411 bp, Staphylococcus epidermidis
agtgtgaaggtgatgaaattgaaaaaggaaattaatgtagtaggtgctattatatattctgataacaaaatattatgtgcgcaaagaagcgaaaatatgagtttacccttaaaatgggagttcccaggtggaaaaatagaaaatggggaaaccgaaaaagacgcattaataagagaaattaaagaagaaatgaaatgtgatttaattgttggtgataaggtaacaaccacaacttatgagtatgattttggaatagttaacttaacaacctataagtgtgaacttaacaataaaaaaccaactttaactgaacataaggaaataaaatgggtaggaaaaaatgaactagataaattagattgggctccagcagacgtacctgctgtaagacgtataatagaggagaattag

SEQ ID NO: 1316 - DNA, 210 bp, Staphylococcus epidermidis
attattgaggtgatgactatgagaaatgctatagaagaattaatcttctccgatgtaagtagttatgacatctatgtaaacacaggcgttaaccaagggttggttggagacataaaagatggatatttgacgattgattctatcccatatattgatgctgaaagattatactattatagtttagagcgcaaagccctcgttacaagttga

SEQ ID NO: 1317 - DNA, 345 bp, Staphylococcus epidermidis
gttaaagaggtaggagtcatgttcattcaatttaaaagacttttgattggtagacctaaaagaaacagagacttaaaaaacgagaaaatttcaaaatttaaaggattagctatcctatcatccgatgcattgtcatcagttgcatatggtcctgagcagatattaattacattatcggtgataggagctgtggcatcttggtatacgctgcctattgccggagcagttttaatattattaacagctctaattttatcttatagacaaattatttatgcttatccaaaaggtggggagcgtatattgtttctaaaacaaatcttggtgagaaatggggattgctag

SEQ ID NO: 1318 - DNA, 1722 bp, Staphylococcus epidermidis
acgttggaggttgaaaatatgaaaagtgcccaagcacttaaacagaatttaacatcgttagacggtcaaaagtacggtgcgtataagcaaataaaagacctatacgaatttaatttatttaaactacgtattaatcatatccaagctgatccatttgcgccaccatctaagatgagtgttgttatagatcgccaacaagcaaaatttcctgattctttattaaattctgaactgaaacaacgggctgtgagtgattacttaacgcgcgtgtttcataagcagattcaatcaatagtagcccaagataaaaaagtaagtaaaattcaaattgatagttgtggccaagaaatcttagagcgtaccgcaatagtaattaagaatcatcaaattgaagcacgtattgaagttggattaccagcacgaggacgtaccatattaggtagaatagcaagacatacacttattaatgtattacctcaaatagtagaacatgccttatgttatcgcaacattaatggttcacaattgcaacaacaagttgaattaatgatggatcaagaggagattagacaacagttagtaaaacgtgaccttgttgcatttgtagcaaatggtgctattttaccaagaaaaagtggtgtttcagatctccctatgaataacgctattgaatttaaaagtcctaaacaatatgagattgtaatgaaactatcgagtggcaaagttattaagggtatgggtattcctaaaggcattacactaatagttggaggcggttatcatggtaaatcaacattacttgaagcgttagaacgaggtgtatataatcatattgctggtgatggtagagaatatgtgattacaaatcaagatgcaatgaaaattcgtgctgaagacggaagaagtattcaaaatgttaatatccagccatttattgatcatttgccaggtgaaaaagatactacacatttttcaactgaaaatgcgagtggtagtacgtctcaagctgcaaatgtcatggaagctttagaatcacaagcatcattgttactcattgatgaagatacatctgcaacgaatttcatgattcgtgatggtcgtatgcaacgtttaattgctcccgaaaaagagccgattacacccttttctaataaggtaaaagcattatatgacgaccataacgtgtcgactattctaatcgttggaggttcgggagattattttgacgtggcagatcaagtattgatgatggatgaatatgtgttgaaagatgttacgcaacatgctaaagacattgcgcagtcagatggttatcaaagaaggctttcttctcactatcagttcggtcacattccatcaagaattccgttgagagcgagttttaatcaaaaagggaaacgtgatcgctttaaagctaaaggattgaatgtagtaacgtatggtaaggaaactattcatatttctggcttagaacaacttgtcgatgacagtcaaacacaaggtttagcgatgatgttaagttatgtaaaaaatgaattgctagatgacaaaagtacgattgtagaattgaccaatagtttgtatcaacggattgagaaacacggattagatgttatatcaaatcatcaggggcatcctggtcatttagcgctacctagaaagcaggagtttattgcgacacttaatcgatatcgtagattaaaaataaagcaaagggaataa

SEQ ID NO: 1319 - DNA, 1002 bp, Staphylococcus epidermidis
attgaggaggttggcacattcatgtttaaaaagattgctactataataggttcgacattatttggtacagttttattcgcaaaagtgaaagaaaagcgtagttataaaagttttttacaagagaaaatgattagaatatcaggaatgaaaaagacatttgaaagtatagatgacgcgaaaaaagctttgaatgagactaaatatcaaacttcaggtaaatataatggaacaacatatgaatttaagcataaagttcaaataagagattattatggttctttagtctatgttgttaatgatcatggtcttccagatcaacgcacggtcttatatgtacatggaggcgcatggttccaagatcctttggaaaatcattttgaatatttagacttactcgttgatgcgctcgatgctagggtgattatgcccgtatatcctaaaataccacacagagattatcgtacgacatttgaattattaacaaaaatatataagcgattattgactaaaattgatgaacctgaaaacttggtcatcattggagattcagccgggggacaaattgcattagctttcgcacaaatgttaaaaaaagagcaactcagtcaacctggccatattgttcttatttcaccggtgcttgatgcgacatttaagaatccagaagcaagaaaatatgaaaaagaagatccaatgcttggaattgatggcagtaaatatcttgtagagttatgggctggtgatgcaccactagatgactataagatgtctccaatgaatggtgatttagaaggcctaggacatattacacttactgtaggaaccaaagaaacattatatcctgatgcagttaagttctctcacatgttaaatgataaaggaataaagcatcagtttatcccaggttacaatttatttcatatttatcccttattccctatcccagagcgtcaacactttttagaacagcttaaaaaaatcattgtcacaaaagagttataa

SEQ ID NO: 1320 - DNA, 465 bp, Staphylococcus epidermidis
gtggccagggtaggataccatcttacttggaaaatgatactgggtctttttcctaaagaagataaagtcaaggcattggatgctttagaacgtgtaaacattttagataaatatgaccaacgctctgaccagttgtcaggtggtcaacaacaacgtatatcaatagctagagcgttatgtcaggaaccaaccattatattagcagacgaaccagttgcttcattagatccattaactacaaaacaagtgatggatgacttaaagaaaatcaatgaagaacttggtattactattttaattaatttacactttgtagatttggcaaaggaatacggatcgagaataattggtttaagagcgggagagctcgtttatgatggacccgcgtctgagacaaatgacgaagtatttaatcatatatacggtcgctctattaagaacgatgaaaaattaggggtggaataa

SEQ ID NO: 1321 - DNA, 147 bp, Staphylococcus epidermidis
tttagtttattggtatttattaaattatacgaaagggcttatttttttaagtattttggcgagactcttgagggaacaggacaagctgaagactacaggctgaagctgtcccctaagaaagcgagccaacaatacgaagtattgtaa

SEQ ID NO: 1322 - DNA, 1425 bp, Staphylococcus epidermidis
aatttcttattcctcatgcaaatgaaattgggatggcacaacgtactattggtgaaaggaggcatttattatatgagtaaatcatatgacttaatcgtaataggagctggacctggtggctatgtagctgcaatacgtggtgcgcaacttggtaaaaatgttgcagtcattgaaaaaaataatgctggaggcacgtgcttaaatgtaggttgcatcccctctaaaacgttgttagaacacggcgagaaagcacacagcatacgagttgcaaacgattggggaatcacaacgaaagacttaaaaattgattttactcaatttgtccaacgaaaaaagaaagttgtacaaacacttacgggtggcgtgaagcagttgttaaagaaaaataaagttacttatattgaaggggaagcacgaatttctaaaaacttaaaagtggacgttaacaatgaaacgtatcaagcgaaagatataattttagcaactggcagtcagccgttcattccaccaattgatgggttagatcaagtcaattatgaaacaaccgatacatttttcgatttagagaagctaccaaaacagttagcggttatcggtgggggtgtgattgcaacagaactcgcatcctcaatggctgatcttggggttagagttacgataatagaagttgcagatgacattttattaactgaaatcaacgaaactagagaaatgttaaaagcacatttagataatcaaggtattaagatactgacgaaagcaaagataaaacaagtaaaggaatcgaaaataatattagatgggcaagatgatgttagctttgatacccttcttgttgcaacaggtagacaaccgaatacgcaagttgcaaaagatttaaatttggaaatggatggtaaattctttaaagtcaatgaacattatgaaacgagtcaaaaacatgtctatgctataggagatttaattaaaggatatcaacttgcacatgcagcaagtgcgcatggcattcatgttgtcgaaacaataatgaacaaacagccgtcacttgtgcgtcaagaagatattacgcgttgtatatacacaagacttgaagcagcatcagttgggttatcagaagagcaagctaaagaggctggttatgatgtgaaagtgactcaatcagcatttcaagggaatgcaaaggcgttaatcaaaggagaaaatgaaggatttattaaacttgtcgttgataaaaagtatggagaggttcttggtgcttttattgtaggaccacatgctacagatataattggagaacttttaagtgtcaaagcatcagagggtacgattcatgaactttctcaaattattcaaccacacccggctttattagaagcaataggtgagagtgcagatgcattttttgattctgcaattcatatgtag

SEQ ID NO: 1323 - DNA, 483 bp, Staphylococcus epidermidis
atactattattattactgtcattaaataaatacattttttgggagaaagaaatgaaattcaaaaaattattatctcgtattattatcgctacaatgattacatttactggaacactctcatatcaagctattgaacaaacgcatatttcccatgctgcacataattattatggtaaaaaacaatgcacttggtgggcatttaaacgtcgtgctcaattaggtaaacctgtatcaaatcgatggggtaatgctaagaattggtatagcaatgcacgtcgatctggttatgcaactggacataagcctcgaaaatacgctgttatgcaatcaacgagaggctattatgggcacgtagcagtggttgaaaaagtatataagaatggaaaaatcaaaatttctgaatataattataatgtgccattaggctacggcacacgcattattagtaaatcgtctgcacgaaactataattatatttattaa

SEQ ID NO: 1324 - DNA, 1260 bp, Staphylococcus epidermidis
gagtgtctattaactatgcttagcgcacaacaatttttaaaagaatttaataatgttgaatctctagatgaatctttgtacgagatagtgagtcagatttgtgaagaagttaaattacagggagataaagctttaaaaaattataatttacaatttgatcaagtggaaactgagaagcttgaattagagcaaagccaactaaaaaatgcatacgacatgctagataatgaaacacgagatgcattagagcaaagctatcagagaattaaagtgtaccaagaaaatattaaggtaaaacaggaatcatctcaacaaactgaatgttatgaacgataccatcctatcgaacgtgtaggtatttatgtgccgggaggtaaggctagctatccgtctacagtattaatgactgcaacacttgctcaagtagcaggtgttaatgagattactgttgttaccccacctcaaaatagcggtatatgtcaagaggtgttagccgcttgttacattacaggcgttcatcatgtttatcaagtcggtggagcacaaagtattgcggcgctaacttatggcacggaaactataaaaaaagtcgacaaaatcgtaggtccagggaatcaatatgttgcttatgccaaaaagtttgtattcggtcaagtaggcatagaccaaatcgcaggaccgacagaaatagccttgattatagacgaaagtgctgacttagacgcaatcgcttatgacgtatttgcacaagcagaacatgatgaaatggcttgtacttatgtgattagtgaaaatgaaaaggtacttaatcaattgaacactataatacaagagaaacttcagtatgttgaacggcaagatatcatatcacaaagtattgctaaccatcattatctaatattagctcaagatactgaagaagcatgtttaattatgaacacgattgcacctgaacatgcatctattcaaactcgagcacctgaaatgtatatagataaagttaaatatgtaggcgcactttttttaggtcatttttctcctgaagttattggggactatgtggcaggtccaagtcatgtacttcctactaatcaaacagctagatttacaaatgggctttctgtgaatgactttatgacacgacattcagtcattcatttatcacaaaaaacatttaacgaagtggcagaatcagctgagtatattgcacatatagaatctttatttaatcatgaaaaatcgattcacgtacgccgataa

SEQ ID NO: 1325 - DNA, 225 bp, Staphylococcus epidermidis
ggtgagatattgagcttttacgaatttatgcaaaatttcctaggtgatgacacgccattaggtgaattggttgattggattaatcaagatatcaatttccctaaagacgtgacgagccaaaaagaaatcttgacatattttcgaaatcatccatgtccggaaaacataccagtgacgagtatcaaacgggcactagctgttttcaaccaattcactaaagtataa

SEQ ID NO: 1326 - DNA, 138 bp, Staphylococcus epidermidis
caatacgtattaaaaaatcatctacatgtagataaaatgaattggctgattctgataattaatataatagcacagaagataaatattttgtctaaaaattctgaaaaattaacaaaaattattttcctcagtgattaa

SEQ ID NO: 1327 - DNA, 369 bp, Staphylococcus epidermidis
gaggaatctttaatggttttacgttatgctacaaatttaaaactagctaaagaattatatgatgcaagtaaacctaaattaaaaggcgatcaaggtatgattgatactttcactaatacatttggtttaccggaaaactcagttaagttagcaggtggcgttgaagctgcagctgctggtttatttgctgctagttttttaaataaaaatatttcacgcttaggctcacttgcagcaatttcagtacttggtgttgcagcttacaaacattttgaagcagggcatggtaaaaagggtgcacaacatgctttagacttattaggtttatcaacacttagcttattagatactttttcttgtaaaaaataa

SEQ ID NO: 1328 - DNA, 201 bp, Staphylococcus epidermidis
agcaattcattgatttgtttagcttgcccttccgtaaaaggactattggtaacacttaagttcaatcttatccacctcttatactttgttattccgatatttgtcattgtttatatatgtctatttttgaaagttattaattatatcttcaattctagtatgtaccatttgttattttcagtaaatgtaatactcaattga

SEQ ID NO: 1329 - DNA, 153 bp, Staphylococcus epidermidis
tctgaatcattgctattcgaacatcccacaagagcaattgacatcacaattaataaaattccccaaaattttttcatattctatctccttttaatttttatatacagagaaataacaattaaatattacttagttttaaattgctatttataa

SEQ ID NO: 1330 - DNA, 255 bp, Staphylococcus epidermidis
ggtacaccattagaattagtttttgtcaatactttaggacctaaaccttgtttcgctaaaccaaataaaattctactattagaatatattccgctatttgttgcagatgctgctgctgttaaaacaacaaaattaactatgccagcagcaaagggaacaccaattagtgtgaataatttaacaaacggactactatcaggatcaactttaaaccatggaatgacagacatgattacaagtaaaccacctatataa

SEQ ID NO: 1331 - DNA, 147 bp, Staphylococcus epidermidis
tttgttacattcaatcatcgaatattactcactgaactgggcctttcttctagaactgttcttcaaacatctattaatgtcggtatatggtgtgttgtttgcatgtataattggaattcctattggtattttcatagccaagtataa

SEQ ID NO: 1332 - DNA, 510 bp, Staphylococcus epidermidis
gttaacacatttgctttagggagtgaggatatggaaacggtatattttgctggtggatgtctatggggaactcaagctttttttaatacgattccaggagttattcaaacagaagctggaagggcaaatggaacgtcgaaatgtttagatgctccttatgatggctatgctgaatgtgtgaagatacactttgatcctgcaaaaacttcaatacttatgctgatggattatttgtttgaaatgataaatccttatagtttaaatcaacaaggtcaagacaagggtcaaaaatatcgaacaggtgtgtatagtgaaagttcgaagcatttaaatgaagcaaaagactacattaagcgcagggaagacgcgaaacaagtaatggtcgaagtacaacctctaagtaattatgtgaagagtgcagaagaacatcagaatcatcttgagaaatttccggaggattattatttatgtcatgttcctccagcattgcttaataaatacaagaaataa

SEQ ID NO: 1333 - DNA, 327 bp, Staphylococcus epidermidis
attcagacattatcgtggcttaatataagaaaagtaacagctcaacgaggtgaaaatcatcaaaaaaattataaaaaagacaatttctatattatttcaatagaaattgtctttatttacttatcttggacctttttgtcccaggctcatttgtatatttatatcgttttttggatgaatcgtatgatggctatcactacaatgacaatcattgaaacgaaagataagattttgaaatgcttactttttgtttctttattagattctccattttccatcatttcctgtagttctcgttctatctcaagatctaaatcagttttttga

SEQ ID NO: 1334 - DNA, 129 bp, Staphylococcus epidermidis
attcagacattatcgtggcttaatataagaaaagtaacagctcaacgagctgaaaatcatcaaaaaaattataaaaaagacaattcctatattatttcaatagaaattgtctttttttacttatcttga

SEQ ID NO: 1335 - DNA, 954 bp, Staphylococcus epidermidis
agttttcaattcatttcaccctcaatttcctttattattagcaatagtataatgaatcgtaaaaagaaaggaaagaataaagttatgacaattgccattataggcccaggtgcagtgggtacaacgttagcttttgaattaaaaaaagttctaccagatacggaactcatcggccggcaagataaattaatgacctatttcccagaaaatacttctaatggaagtaatgttaaagtgacttcatttaatcatattaatcaaacttttgatgtcattatcatagcagttaaaacacatcaattggatgacgtcattaaacaattacctaaaatcactcatgacgattcgctcattatcttagcacaaaatggctatggacagcttaataaacttccatatcaacatgtctttcaagcagtcgtctatattagcggacaaaaagttaacaacaatgttcaacatttcagagattaccaactatatattcaagatagcacactaactcgtcaattcaagcaaatggttcatccttccaaaatagaggtggttttacaagaaaatattgaaaaaagcatttggtataaattattagtgaatttaggtataaataccatcactgctattggacaacaaccagctaaaattttaaaatctcctcatattgagtcgttgtgtcgtcgtatattagttgatggtcttaaagttgctagagctgaacaaattgactttgaagatcatatcgttgatgatattttaaatatttataaaggttatccagacgaaatgggaacaagtatgtattacgatgtcattaacaagcatcctcttgaagtcgaggccatacagggttatatatataaatgtgcaaaaaaacatcatttagagacaccctatctagatatggcttatacatttttatacgcttatcaccttgaatacacacaaccagattga

SEQ ID NO: 1336 - DNA, 132 bp, Staphylococcus epidermidis
tcacctcaatttaaatataaacacattctgagaattcatttaagtgatatggaatacaattacaatattgtaagtttcgatacaaaaatactaatgattaaccacttaatgcttgtactaatgcgtatttaa

SEQ ID NO: 1337 - DNA, 186 bp, Staphylococcus epidermidis
aaaagacaatttctacattatttcaatagaaattgtctttatttacttatcctggaactttctgtcccagccactcttttaataattacaaaatttttaaatactatgttttgttatagagatgttggtatgttttacagttttgaaaaaagattatacgtagccattaacaaagtgaccgattaa

SEQ ID NO: 1338 - DNA, 804 bp, Staphylococcus epidermidis
ttatttaaatttttaggaggatatttaacaatgaaaaaaatcgctacagctacaattgcaactgcaggaatcgctactttcgcatttgcacaccatgacgcacaagcagcagaacaaaataatgatgggtacaatccaaacgacccttattcatatagctacacttacacaatcgatgctgaaggtaactaccactacacttggaaaggtaactggagtccagatcgtgtaaatacttcatataactataataattataataactacaactactatggttacaataactatagcaactacaataactacagtaattacaacaattacaacaactatcaatcaaacaacacgcaatcacaaagaacaactcaaccgactggtggtttaggcgcaagctattcaacatcaagtagtaatgttcacgttacaacaacttctgcgccatcatcaaacggtgtatctttatcaaacgctcgctcagcatctggtaacttatacacttcaggtcaatgtacatattatgtatttgacagagtaggtggcaaaatcggttcaacgtggggtaacgcaaacaactgggcaaacgctgcagcacgttctggttacacagtaaacaattcgcctgctaaaggtgcaatcttacaaacgtcacaaggtgcatacggacacgtagcatacgttgaaggtgtaaacagcaatggttcaatcagagtttcagaaatgaactacggtcacggtgcaggtgttgtcacttcacgtacaatctctgcgagccaagctgcttcatataactatattcactaa

SEQ ID NO: 1339 - DNA, 162 bp, Staphylococcus epidermidis
tttcctttttcaatttcatcaccttcacactttaataaatttattttaattttaacaaatgtatatgtgtttatacatccaaactactgcgaaaaatgctctgcttatgtatataaaatttattctttaaacaagtcgtggtttacatacttaatatattag

SEQ ID NO: 1340 - DNA, 138 bp, Staphylococcus epidermidis
ctacgcttttctttcacttttgcgaataaaactgtaccaaataatgtcgaacctattatagtagcaatctttttaaacatgaatgtgccaacctcctcaatctataaccattttaaaccatcagcgtctaaacgttga

SEQ ID NO: 1341 - DNA, 213 bp, Staphylococcus epidermidis
tggccgaaattcttggggaaccagaatatccaagttcatcaaactgcaaacaacagatttcttaaagaaagttgttatttactgggaaataatataagtatgggtactttgagacaagaatcatgtgactcttgtctcagtttcatatttttgggtaaacatttaacatatagcaatgataaccaatacaaatttaataagtatacaatctaa

SEQ ID NO: 1342 - DNA, 168 bp, Staphylococcus epidermidis
aaatgtgaattaaggtggtatttaaatagactatcaagatgtgtgtcgtttgtttcccttcatataatggaggttgaaagaagcaattgtatagctattttaatgaaagtagagggtgtgattgtaaaatcagttattcacatatatgacaacatggaattatgttaa

SEQ ID NO: 1343 - DNA, 1533 bp, Staphylococcus epidermidis
gcgattacttcaaatatcactaaaaaaggatgggttttaatgacaaatattaacgtaagaaattatatagatgaaagttacggcttgtttattaacaatgaattccaagctagtgatagtggggaaacattaactgtttctaatccagctaatggtgaagatttagctaaagttgcacgcgctggtaaaaaagatgtagataaagctgttcaagcagctcatgatgcatttgatagttggagtaagatttctaaagaagaacgtgcagattatttattagaaattagtcgacgtattcatgagaaaactgaacatttagcgacggttgaatcactgcaaaatggtaaaccctatcgtgaaacatcaacaattgatgtaccacaagcagccaatcaatttaaatattttgctagcgttttaacaactgacgaaggttcagttaatgaaattgatcaaaatacaatgagtttagttgttaatgaacctgttggagttgttggtacagtagtagcatggaacttcccaattttattagcatcatggaaattaggaccagctttagcagcaggtaatacagtagtaattcaaccatcatcttcaacgcctttatcattaattgaacttgctaaaattttccaagaagttcttcctaaaggagtagttaatgtcttaactggtaaagggtctgaatcaggagacgctattttccatcatgaaggtgtagataaattatcatttacaggttctactgacgtgggttacggtgtagcacaagcaggtgctgaacgtatcgttccgacaacattagaactaggtggtaaaagtgctaatattatctttgatgacgctaatttagagcaagtgattgaaggtgttcaacttggtatattatttaaccaaggtgaagtatgtagtgcaggttcaagattattagtacaatcatctatttacaatgaattgttgccaaaattgaaagaagcatttgaaaatattaaagttggcgatccatttgatgaagatactaaaatgagtgcgcaaactggaccagaacaattagataaaattgaaagttatataaaaattgctgaagaagatgacaaagcgaacatcttaactggtggtcatcgaatcacagataacggcttagacaaaggttacttctttgagcctacaattattgagattaacgataacaaacatcaacttgctcaagaagaaatcttcggtccagttgtagtagttgaaaaattcgatgatgagcaagaagctatcgaaattgcaaatgattctgagtatggtttagctggaggtatcttcactacagatattcatcgtgcattaaatgtagctaaagctatgagaacaggtcgtatttggattaatacttataatcaaattcctgctggtgcgccattcggaggatataaaaaatcaggtattgggcgcgaagtatataaagatgctatcaaaaactatcaacaagttaaaaatatctttattgatacaagcaaccaaactaaaggtttatattaa

SEQ ID NO: 1344 - DNA, 159 bp, Staphylococcus epidermidis
ttgttatattcttgtaataataaattttgctattattacaactttagctttgatgagtttaatctatcttttaaatatttagccaataaagaatatttacttgatgtaaatttaatcttagatatcgttaagattgttcataaaattgataaaaaatga

SEQ ID NO: 1345 - DNA, 135 bp, Staphylococcus epidermidis
tatacacattcaataaagcgtttacaatactttttgaaaattttacataaaaaaactcgactacttagagtcgagtttctaaaaatgtattattataagaaacgtttagctgctacagagattggtgggatttga

SEQ ID NO: 1346 - DNA, 204 bp, Staphylococcus epidermidis
ttaaaggaattaaatactactttcggtgacaagcaacgtggtcaagtgactaatgaaatactaaatgaatctaaaaaagatattcctaacagctatatcacatacaactctcaaatagatggtgtgaataataaagtaagacattttaatgttacaccagaatctatctatttaattgattataaattaagtaaaaaagaataa

SEQ ID NO: 1347 - DNA, 141 bp, Staphylococcus epidermidis
aatactaattctatagcctttttagaatttatcattttagccctctatttctctgataaaatcatttattctaatacttcatcatcttccctcatattgattgtgctcaattttaataatagaattaaagtaaattattaa

SEQ ID NO: 1348 - DNA, 267 bp, Staphylococcus epidermidis
acagactactcatcaattatttttgatgctttaaccgtagataaaaaaggttgcttatacacacccaatcactctcaatatgtcgaagaacgtggcgtctatcaagacgtaatggacaccttaaaacctatttggtataccgatgctgaactattaataaatgatttaattactgatagcatcccacaattaaacaataaatatacaaataaaaataatcagtcatttgaatatattagtaaacttatttcaaatcaattgaaataa

SEQ ID NO: 1349 - DNA, 1023 bp, Staphylococcus epidermidis
ttcaattcatcattagaggagtgtagaaatatggtagaaaaattcaaagcttttgtagtcgatcaagatgacaacggtattgtttcaaatagttataaagaactaactaaagatgacttacctgagggtgacgttttaataaaagtacattattctggcataaattataaagacgcactagccactcaggaccataacaaaatagtaaaacaatatccgatggtccctggtatagatttagcaggtaccattgaggaaacaaatgctccaggctttgaggttggagataaagtcatcgtaacaagctatgatttaggtgtaagtcattacggaggcttcagtgaatacgcacgtgttaaatcagaatgggtgattgaattacctgaagatttaacattggaagaagctatgatttacggtactgctggctatacagcaggtttagctatagaacaacttgaaaaatcaggtatgtctattgaaggtaaagaagtgcttgtacgaggtgccactggaggcgtcggaacgatttcattactcatgttaaataacttagggtatgatgttattgcaagtacgggtagagatgacgccgaagaaaaacttaaaaagcttggtgctaaagaagtaattggccgtttaccagaagataatagtaaaccattagagaagagaacatggcaggcagccattgatccagttggtggtgaaaacttaccgtacatcgtcaaacgattggataacaacggaagtgttgcattaattggcatgactggtggtaacaattttgaaacaaccgtctttcctttcattttaagaggagcaagtataattggtatcgattcagtatttactccaattaaactaagaaaacgtgtttggagaagacttgcaaaagacttaaaaccacaacaattacatgacatcaaacatgttatttcattcgatgaaatcccaaaagccatcgatcaagtcatcaatcataataatactggacgtattgtcattgatttcaatgtttaa

SEQ ID NO: 1350 - DNA, 888 bp, Staphylococcus epidermidis
tttgaaatgtcagctcaagatccgcgcaataaatttaaaactgataattatgaaaaacaagaacaagaagttccaggtatacaagctaaaatgtcaccacaaccagattgtggggaagattcttatcatggccaccatcgattagatggctttaaaatactagtgactggtggcgattcagcaattggacgtgcggcagcaattgcttatgctaaagaaggtgcagatgtagcgattaattatttaccaagtgaacaacaagatgccgatgatgtaaaacagattattgaaaatgttgggcaaaaagctatcttaattcctggtgatattagagatgaacaattcaactatgacatggttgaaaaggcttatcagcaattaggtggtttagacaatgtaacgttggttgctggtcatcaactttatcaagatgaattatcggagtttaaaactcaagattttaccgaaacgtttgaaacgaatgtctatccggtattttggacagtccaaaaagcgcttgagtatttacaaccaggaggctcgattacaacaacatcttcagttcaaggttataatcctagtccaattcttcatgattatgctgcaacgaaagctgcaattatatctttaacaaagagtttttcagccgaacttggccctaaaggtattcgtgttaactgtgttgcacctggaccgttttggtcaccacttcaaattgtcggtggacaaccacaaagcgctatacctacttttggacaaaacacaccgttaggacgtgccggccagccagttgaatgtgctgggacatatgtgttattagcctctgatgatgcaagttatattaccggtcaagtatatggtgtgactggtgggactcaaatagattaa

SEQ ID NO: 1351 - DNA, 204 bp, Staphylococcus epidermidis
ataagccagtccagtgattacgttcgacaccttaatcattggactggctttttcatatctatcaatttaaataataatcaatataaattcgctatattgattaaaaataatttattgcgtttcattagaactattgagatgataactgcttttgcatttaaaatcttaatttacttattagggtttgcattaacaggatattaa

SEQ ID NO: 1352 - DNA, 216 bp, Staphylococcus epidermidis
gtcctacttcctttctctaaatttattcaaattaaaatctgcaaaaaagtgcatattaaaatacaccattcattatttattgaaaatacttctttcctcaattttaagctaatgttagaaaaatacctttattttactttaatatctccattttcattgattaatttcactttattatttccattttcaactttactattatataacacacgatga

SEQ ID NO: 1353 - DNA, 480 bp, Staphylococcus epidermidis
tttgccatgttatggcatttaatttttatgattcctacaattattggttactcttttggaatgttctgtttaatatcaagtgaaacttttaaaagtaaaggatttctcttgttgggggtaggaatttttatcttttctttaatttatattttgatttatagtttagttacattaatacctaatgttgcgatattatcaagaagattccatgatcgctcaatgacgatgactcttccgattattttttatgttttcactgtcattgtatcaggttttaattatttaccaaatatagataattcagcggtattaatatttatgggaattatctgcttaatctactggattgggtcgatattaatattagtattgacttgcttagatagtaaaacagagtctaataaatatggaccaagtccaaagtacaatcgtaacgagacaaatttccatggtgataatgctaatccagttgataaataa

SEQ ID NO: 1354 - DNA, 141 bp, Staphylococcus epidermidis
gtgttgacgttattgcaaatatcttgtaacgttaaacacaattcaataacttatcaagagaagtggagggactggcccaaagaagcttcggcaacattgtatcatgtgccaattccagtaaccgagaaggttagaagataa

SEQ ID NO: 1355 - DNA, 969 bp, Staphylococcus epidermidis
ggtatcaaaacaatgttactttttttatgttttctaatcgaattattacttattgttttattatatacgaagcaatcgtttactcttaatttatttagtttcatcttatataacatcattggttttgttatgatgacttatcatatggtaactgtatcaataccatatgatatgtttatcattgtaattgtagcaatgatactgttgttgattaaacatcgttatattttcaagttgcaaacaggacgtttttttattttacaacttagtcatcatttttatactgtggggctatttgctgtgagttgtttatatataagtactattcccctaattatcattaatagcttagctttatgggccgctaccattgcatttagtacaatttattcatttatcggatacttatcttggtctacagcttttgaaaatcatcaatattataaacacgtaaagttaattatggtgcttggagctggaattttctctgaagaagtgactacgcttcttgctgcaagacttgataaagctttatctgtttatcattcacaacggactaaacctatcatcattgtaagtggtggccaaggtcctgacgaaccaatttcagaagcacttgcgatgaaaagataccttatagctcacaacgttccggaaaaccatatatttatggagaatcaatccacgaatacacgaaccaatttcttatactctaaatctatcattcattcgatgatgcctacttcaagtcagatgttgtgtgtaacaagtcaatttcatgttttaagagcgcttaaatttgctaaaaaagctcatctttctttcgatggtattggaagtcgtacaccataccactttttggcacaatctatgattatagactttttgggtttaatgtatcaatataaaacaatacttactatttatttcgctatgttgttttggcttgcaatactacaaaccatataa

SEQ ID NO: 1356 - DNA, 141 bp, Staphylococcus epidermidis
tttacaaaaacaaataagagtgaggctaagaatttacctaaatttctggctagcgttttattttatagtcgtgattttgtcactttaataaaaatgaatatgttttataatataatcttaaggaggattttttatgcgtag

SEQ ID NO: 1357 - DNA, 633 bp, Staphylococcus epidermidis
atgtctgaaacattacaaaaccaaagacaattcaactctcaatttgaacatcaagagatccatcgtggaaaaagatatggtaaaaagaaacgctcatgggtaagtctcattattcaagttttcgttttagtattaactgctattactggctatagtatgcttaaacaacctatatttaaaatttcatttgtaaatgaaactataaatttccatcaattaagaaattttcaagatacagttacgcaaatcggtaatttgaatttaggtaatattgatcaattacaacagtctgtcgataatctcatcattatatttaatattttctttgtcctatgtctgattagtttgtttataaccgtaattacaattatttttaatcgcacagcactcaaagtagtcaatatattacttttagctattatgctagtcattacattgtatttcagttatatcatacatacaattgctcagaaaatttccgaatctctaaaacaatattatttaacagtatcaccagaacaagtattaactgaagcagatgcgattcacaatgcactgatactcattggatgtagtattgcgttattgattgtaagtttgtttttccgtaatcgtttaccacgtattaaataa

SEQ ID NO: 1358 - DNA, 477 bp, Staphylococcus epidermidis
atgaacaagacatttaccgtaacccgaactgtgacagaagatgctatagataataataatcatatgcatgacgcatattataatattatttttagcgaggtcattaataaattcaatgaggttcatggtttatcatggtcagagagagaccgtctacaatatacagtttttactgttgaaacacacactacttttttacatgaattaacacttggtcaagaattcaatatagagctattcctttataattacgatgacaaacgaactcatttctttctgagaatgttaattgataatcaagaagttgttgcaaccaatgaggtcatgatgttaggaatagataggacacaacgtcgtgctgcaccatttccaaaacattatctgaatgctatacaagattatgctcataagcaagaaaaaattgaatggccaccacaattaggccactcaattggaataccatataaaggagaataa

SEQ ID NO: 1359 - DNA, 2184 bp, Staphylococcus epidermidis
agagaaaggacgtatagtatgaataaactgacaattattgtcacgtattataatgcggaggaatacatcacaggttgcttagagagtattaagcaacaacgtacacaagattttaatttgattattgtgaatgatgggtcgacagaccaaagtaaaaaattaatggatgaagctattaaagactatgataaaaacattcgatttatcgatttagatgaaaatagtggtcatgcacatgcgcgtaatattgcattagaagaagtagaaacaccttactttatgtttttagatgcagatgatgaattagcttcttatgcaatcacgttttacttagaaaagtttaataatactgatggtttaattgctccaatacattcttttactacacaacgtccgcaatttgttgatttagatcgagtaagggttgaatactttaatgccaaagagaatattaattcatttttaagaaaacagtcagcttgtaacattatttttagaacagctattgtcagggcgcatcatattcgatttaatgaaaatttaaatacatatgtggattggtcatttgttcttgaatatatgaagtatgtaaataagtttgtacgtatttttaacttcccattttatttccgtggggaagtctatgatccatttgaaacacttacattaagtgaacaaaattttgatattttatttaaagattacgtcaacagcttttatgatgccattaaacgagcaacaaatccaaaagttagagaatttattgtcactaaaatgggaaataaaattgctaatgaatttgaaccaactcgatatgatattaatgaacgctatcaaacacataaggatacgcttgttgaattatcgaaatttttacatgtacatttagttaaaaaccaaaagctaataaataaaattgaaacaattttgttaatgaataatgaaactgataaagcttttaaagttaatcaatttagaaaaacgttgcgacatgttaaaaatattgttctaagaagaaaaaataaagaacgttcattgtatgatttaacagataaagaagataatgttaaaccgaaaacgattgtctttgaatcgttcggtggtaagaattacagtgatagtccaaagtatatttatgaatatatgcaaaagtattatcctaattatcgctatatatggtcatttaagaatcccgataaaaatgtcgtaccgggtagtgctgaaaaggttaagcgtaattcagcagagtattatcaagcatactcggaagcaagtcattgggtatcaaatgcgcgtacaccactttatttaaataaaaaagaaaatcaaacgtacattcaaacttggcacggtacaccattaaaacgtttagcgaatgatatgaaagtggtacgtatgccgggtactacgacaccaaagtataagcgtaattttaatcgtgaaacatcacgttgggattatttaatttcgccaaatagatattcaactgaaatatttagaagtgctttttggatggatgaagaaagaatattagagataggttatccaagaaatgatgtattagttaatagagccaatgatcaagagtatttagatgaaattagaactcacttaaatttacctagtgataaaaaggttattatgtatgctccgacatggagagacgatgaatttgtgagtaaaggaaaatatttgtttgaattaaaaattgatttagacaacctttataaagaactcggagatgattatgtgattttattacgcatgcattatctcatttctaacgcacttgatttatctggttatgaaaattttgcaattgatgtttcaaactataatgacgtctctgaattatttttaataagtgattgtttaattacagactattcatcagtaatgtttgattatggtattttaaaacgccctcaatttttctttgcatatgatatagacaaatatgataagggattacgaggattctatatgaattatatggaagatttaccaggacctatttatacagaaccatatggcctagctaaagaactaaagaatttagataaagtgcaacagcaatatcaagaaaaaatagatgcattttatgatagattttgctctgtagataatggtaaggcatctcaatatattggggatttaattcataaggatatcaaggaacaatga

SEQ ID NO: 1360 - DNA, 1500 bp, Staphylococcus epidermidis
aaaagggggactgtgtttgttatgaatactcaacatagcaaaacagatgtcatcttaataggtggcggaattatgagcgcaacattaggaactttactaaaagaattaacaccagaaaaagatatccaattgttcgaaagattgagtcaacccggcgaagaaagttcaaatgtttggaataatgcgggaacaggtcattcagcattgtgtgaattgaactatacgaaagaaggtaaagatggttcagtagatattactaaagcaattcatattaacgagcaatttcaaatatctaaacagttttgggcttatttaatacgtgaaggtcatattgaaagtccagataaatttattcaatcagtgccacatatgagctttgttaaaggggaagaaaatgttaaatttttaaaaagtcgagtggcgagtttacagaaaaatgtattatttgaaaaaatgaaaatttctcaagatccagaaaaaattaactcatgggttcctttaatgatggaaggacgccaatcagatgaagcaattgccatcacgtatgacgagacaggtacagatgttaactttggtgctttgactaaaaagttaatagctaatttacaacaaaaaaatgttggcattaattataaacatgaagttttagatataaaaaaattaaataatggtaactggcaagttgtggttaaagatttaaatacatcaaatgtaatgaattatgaatctaagttcgtcttcatcggagctggtggtgcaagtttacctttattacaaaaaacaaagattaaggaatctaaacacattggtggtttcccagtaagtggattatttttacgatgtaaaaatccagatgtcatacatagacatcatgcaaaagtctacggtaaagccgaggttggtgcacctccaatgtcagttccacatttagatacacgatttgttaatggtgaaaaatcattactatttggaccttttgcagggttttcgccaaaattcttaaaaaacggttcatatttagatttagttaaatctgtgaaacccaataatatgataacaatgttaagtgctggcgtaaaagaatttaatttgacgaaatatttagtttctcaattaatgctttcaaatgaagaacggatcaatgatttgcgtgtattcttaccagaagcgaaagatgaagattgggaagtaattactgcaggtcaacgtgttcaagtaattaaagatacagataagtctaaaggtcaattacaatttggtacggaagtaataacatcagaagatggttcacttgctgcattattaggtgcttcacctggtgcttcgactgctgttgatatcatgtttgatgtcttgcaacgttgttacaaatcagagtttaagtcatgggaaccaaaaattaaagaaatggtcccatcatttggtttaaaattgtcagagcatgaagatatgtaccattcaataaacgaagaagtaaaaaaatacttgaatgtaaagtag

SEQ ID NO: 1361 - DNA, 204 bp, Staphylococcus epidermidis
tatgctgatgcacatgtcacacttaatcctaatgaaagtgaacctgaatcatatgataagtatgatgtaagggtgcctgttgagcaaaatgatcatacaatgaaagtagaattagatgtgccaaagggattaaacgttgagagtgttaaaactattgaaggttttaaacatcattttttaaagataaaaagggaacattactaa

SEQ ID NO: 1362 - DNA, 171 bp, Staphylococcus epidermidis
attttctattttcggcacgcgttttcattttctgtagttttttctttcgatcaggtgaaagataaggatttcgaagtgcatgatagattaatcttaaattatttcgctcattatagaatagatgatttaagtctttcacagatagacgtgtgtttgattctgcctttttaa

SEQ ID NO: 1363 - DNA, 171 bp, Staphylococcus epidermidis
ttgtctcgggctatattattgtttaaattttatttatcaactggattagcattatcaccatggaaatttgtctcgttacgattgtactttggacttggtccatatttattagactctgttttactatctaagcaagtcaatactaatattaatatcgacccaatccagtag

SEQ ID NO: 1364 - DNA, 1989 bp, Staphylococcus epidermidis
gggggtcattttatgacagcgaccttcattattatatatattgtagtagcgctcatactcattggttttattaatttctttttaattaagcgtaaaagaaaaaataaagacaaaagagtggaacaacgttcgacaatagattctaagagagaaagcaatcaatctaaatttaaagcaagcgatttagaacaaacaactaagtcaaatactgatccaacgcaatcaaacgatattgaagatgaaaaacgaaaaaatcactttgactcagaaatagataatgcatctcaatttatcaatacagatagtaaagaggatagaaacgcgttaagccataagaaccaagaggaagatgacgcatcgaacgatgtgttgaaccctatcgatccaaattctactgaaggtagagttaatgaaagaattaaaaatcaagagtctaactttatttttggtaaaggtataactagaggtaaaattttagcggcaatgttatttggtatgtttatcgcgattctaaaccaaactctattaaatgtggcattgcctaaaataaatacagagtttaatatttctgcttcaactggtcaatggttaatgactggttttatgttagtgaacggtatattaatacctattagtgcttttttatttaataaatattcttatagaaaattatttattataggtttagcactatttacattaggttccttagtttgtgcaatctcatttaatttcccaattatgatgagtggacgtgtattacaagccataggcgcaggtatattgatgccgttaggttctaacgttattgttaccattttcccacctgaaaaacgcggtgtggcaatggggacaatgggtattgcaatgatattagcacctgcaatcggtccaacactttcaggttatattgtgcaaaattatgattggaatgtaatgttttacggtatgttctttataggtattattgctatcgtaattggtctattttggtttaagttgtatcaaagtacaacaaatccgaaagcagatattcctggaattatttatagtacgattggattcggttccttattatatggtttctcagaagctggtaataaaggatggggctcaactgagattgtaacaatgtttattgttggtacggttttcattattttctttattttaagagaactaagaatgaaagcgccaatgttgagcttggaagtattaaaatatccaacttatacacttacaactattatcaatatgattgtgatgatgagtttatacggaggaatgattttacttccattatatttacaaaatcttagaggattttcagcattagactctggattattactattgccaggtgcattagtcatgggagcattaggtccggtggcaggtaaattgttagatacaatcggtattaaaccattagcaatatttggtattggcattatgacatatgcgacatgggaattaagtaaattaaacatggatacaacatatctccatattatgtggatatatattgtgcgttcatttggtatggcatttgtaatgatgccgattataactgcaggtatgaacgctttaccaccacgtttaatttctcatggtaatgcgtttgttaatacaatgagacaattagctggttcaattggtacagctattttggttacggtcatgacgacacaacaaacaaatcatctttctgcttttggtgaagagttagataaaacgaatcctgtcattcaagaccatatgcgtgaacttgcccaacagtatggtggtgagtcagcagcaatgaaattattactcgaacatgtcaataaacttgcatctgtagaaggtgtaaatgatgcatttattgttgctacaattattagtgcgattgcactgatattaagcttgttcttacagggcaagaaaaaggctcaattatcagctgaaaaagcaaatgctgaagattatccttcgcaacaagataaataa

SEQ ID NO: 1365 - DNA, 666 bp, Staphylococcus epidermidis
gtcaaacatttacggttaatcggcctacctcataaaaataaaaatacatatgtaaatctcattttaagggtgtcattgatgaaagcatatctatataaattcatgccattgctcattttcgtcataggactgattatcttttacgtttttaatgattatcccacattgatacatgtcatagtgattattgcttttataacgaatggattgaaaaatgtatattttgttaataataatattagaaatcatatgatatgggtgagccctaaactcgatcgtatccttggtatgatttcgggcatactatattttggtatttacgtggttggctttataaagcaacagcctttatggatagtgatgcttattctagtatcaacagtgggtactgcggttttattagaaacaaaattacatattacatcacttcaattagaggagacgttatcatctgaacggataaaacgtaaagtaatatcaagacataaagcacaacgtcttaagtgtatattttttactgtgattgttgtagtaatcatttcaatgctcatatcattatatttaaagttgatggttatttttggacttgcagtaacgatttttatcttagcatcaataagtgtggctattttcgaaaaatactttactattattgaaaatatgtaa

SEQ ID NO: 1366 - DNA, 168 bp, Staphylococcus epidermidis
tcttgtctttatcaatattttactgttattctaaattgtttgatactcaacttaaaaataaaatacagatggtgtgtatcaaagagtcattataaaactgtcaacaatcataagattgttgacagtcaatatatactatggggcatattttatttctttgacgattga

SEQ ID NO: 1367 - DNA, 219 bp, Staphylococcus epidermidis
gtacatcttctaaggtcatcaattttagctcttttgcatctttcatgtgtcgttgctctcctcttcataaaagtatctaattatattctacatgagattcaaatttttaacatacctcattttttatttcatattaatcatttcattttattgttaaactatttatatcaacacttgataataacttataaattaaaaggtcgtgatatacatgattaa

SEQ ID NO: 1368 - DNA, 1026 bp, Staphylococcus epidermidis
aagggagattatgtaatgatatctaaagttgaacatcaaagacacggtttagatttaattaaaattgataatgacgatacgaaaattgtatttacaaactatggtgcaagaattgtttcttggaaataccatgataacaatatcgttttagggaatgtagtagaagcggatgaattttattttgaagaaccttttaattttggtgctacgataggtcgctatgcgggtagaattgaaaatgcatcatttaaattagatgatgatacttttcaattagaatcaaatgatggtcaacatcatttgcatgggggcagtcatggattaaatagacgtatttttgattatgaaatagttgatgatattggacaagtaaagattatattcacaacaacgattaaagaagaagaggacaattatcctggagatatgatggtaaaggttattcacacttatgatgccaatcatcgatggtccgtacaatatgaggcaaaatcaacaaaaaaaacagtatttaatccttcaaatcatgtttattttaatttgaatcgtgataacaatgttgtctataaccactgtataaatagttcagcattaaaaatgtatatgttaaataataaacatattgttaaagaggggcaatctcttgatttacatcgattattggatacaaataaagtctatttaaaagatatttttgaaagtgacaatgaaactttgcaacaacaaattaatcattataatggcattgatcatcctttcgaatttggaggaaatgagcttaccattgataattctgaatttgaacttaatattaagactgatatgcctcattttgtaatgtttacgtttaatgatccacaagtttggaacaatgattttaatatttataaggcgcattctggattttccatcgaaactcaatatatgcctaatgatataaatatgtacggcgccaaagctcagtctattttagaggcagatacattatttacatctaaaacaagttttcaaattcatgaaaagtag

SEQ ID NO: 1369 - DNA, 156 bp, Staphylococcus epidermidis
tataaaatctatcaatccattatacgggaaagtaggttagattatgaaagagatgaagaatggcaatgcttgggcattaattcctttattgttatttgtcttactatttctaggtgttggtattattttctggtgattttaccactatgccattaa

SEQ ID NO: 1370 - DNA, 150 bp, Staphylococcus epidermidis
attgatagatatgaaaaagccagtccaatgattaaggtgtcgaacgtaatcactggactggcttatttatacattttaatactaaaaataaagagtaatactaaaatcaaacttttagaatgcgaatcattaacacaggatttattttaa

SEQ ID NO: 1371 - DNA, 333 bp, Staphylococcus epidermidis
ggaggtagatatatgaatgtacagtttaagaaaggtgctttagaattaattgttctgctaattattaaaaaagaagatcagtatggttattcacttgtacaaaatatctccagatatatgaccatagctgaaggtacagtttatcctctgctaaggcgtttggttaaaagtggggaactgagtacgtattatcaaccttcaactgaaggtccgtctcgaaagtattatcaattaactcaacagggggctgcgagagttaatcaattagaggaggattggaaattgtttacggaagctgtagaacatttcattgaggagagtgagaatgaatga

SEQ ID NO: 1372 - DNA, 150 bp, Staphylococcus epidermidis
tgctttctgtatacccagttatcatgtacgtttaatcatagaaaatctgaaatcacttcaatttataaaattatgtcaataaacgttgaacgagctgaacgaaatattgaggaactttttccaaaatacgctcatctggatgatatttag

SEQ ID NO: 1373 - DNA, 186 bp, Staphylococcus epidermidis
actcgatcgtatccttggtatgatttcgggcatactatattttggtatttacgtggttggctttataaagcaacagcctttatggatagtgatgcttattctagtatcaacagtgggtactgcggttttattagaaacaaaattacatattacatcacttcaattagaggagacgttatcatctga

SEQ ID NO: 1374 - DNA, 975 bp, Staphylococcus epidermidis
tttataaagtatgagggggtaagaaagatgacggtgaccgttagatttcaatctttatcgcaacctcttacattagtttcaaatgtgaaagagattcctaaagatgcaacgattatatggtatgattttgaaaatgccactgatgaagaaaatgagtatttaaaaaatcattttgatttcaattacttagaaatagatgatgctatcaatggtgacccacgagttaaatatatagaatatgacgcgtatcaatatatgatatttcatagtattattaatgatgattactcaccaatctcactaagtgtatttttagaaggtaatgttttagtgacataccatcacaaacattttccatcattaaagcgtgtggctcaatacaatgcagaaaatcatgatagtgaattagattgtgcagacatcgtcattcatattctggattgtatggtggataaatattttaactttgtttatggtattgaagataaagtgtataattttgaagctaagcatgtcgatgaccgctatagtaagagcgttatggaaaatgtctttcaattacgttcggatttaattaaaatcaaacgcgtattatttccgatgcaagaagttgtagatacaatgaaacaagaaggaaatataattaaagatgccaaacatagaatgtatattcaacatattgatgatcatcttattaaacaaagaagtgttattcggacttctcaagaaatgacgaatgagattcgtgaaaattatgaatcattcacctcatttaggatgaatagtataatgcagatacttacgcttgtatctgttatattctcaccactcacttttattgctggtgtatatggaatgaactttgaatttatgcctgagttgaaatggcattatgcttatttcgtgtgcttaactttaatgctaattataacaataatattaatcatattctttaaaaagaaaaaatggttttaa

SEQ ID NO: 1375 - DNA, 132 bp, Staphylococcus epidermidis
aaatgcaatcaatatatacagattaggtttatatttttaataggtaatgatagttattatagtgacattcaaacatacaacctaaattttataagatgttgtcgatttaatataaagagaaaggacgtatag

SEQ ID NO: 1376 - DNA, 126 bp, Staphylococcus epidermidis
ttggggaaccaaaggattttccgaatcacatttttccaccaaatttttttggaaatgggatttcataatggcttaggaatgaatttaatttttaacttttttgaaagatcggagaggcgttttttt

SEQ ID NO: 1377 - DNA, 1164 bp, Staphylococcus epidermidis
tggaggttacatacaatgaaaaactctagattttctgggttccaatgggctatgatggtctttgtatttttcgttatcacaatggcattgtccgtgatactcagagattttcaagcgactatcggagtgaaacgttttgtctttagtattaaagatttagctcctttcatagctgcaattgtgtgcatattagtatttaagcacagaaaagaacaattagcaggattgaaattttctatcagtttaaaagtgattgagcgtctacttttagcactcattctaccacttatcattttaatgattggcttgtttagctttaatacttatgctgatagtttcatcctattacaaacttcagatttatcagtatcattattaactatattaattggtcatattttaatggcttttgtagtggagtttggtttccgttcttacttacaaaatattcttgaaacaagaatgaacacattttttgcgagtattgtcgttggtcttatttattcagtatttacagctaacacgacatatggtgtagaatacgccggataccatttcttatatacattcatgttttcaatgattattggtgaattaattagagctactaatggtcgtacaatttatattgcaactgcttttcacgcatccatgacttttgctctcgtctttttatttagtgaagaaacaggcgaccttttctcaatgaaagtcatcgcactttctacaacaattgtgggtgtttcatttattattattagtctaatcattcgtgctattgtttataaaacgacgaaacaaagtttagacgaagttgatcctaataattatttatctcatattcaagatgaagaaccaagtcaagaagacgcctcttcaacttcaaatcatgatgtatcatctaaagatgaaacaaagcaacaagatattgataatgacaaacatcaatcaaagaaacctaataagagtgacgatgcacttactacttctaattataaagaagacgcctcttcagttaataaagaaacggatacaactcacaatgataacattaaagatcattcaacttataccgaagatagacactcatctgttgtcaacgatgttaaagatgaaattcacgaagttgaagatcataaagccgacacagataaatcacattaa

SEQ ID NO: 1378 - DNA, 687 bp, Staphylococcus epidermidis
gagcgtaaacatatgattaattgcttaatcgtagacgatgataaaaagttattgcaatatgtttcaagtcatttagaaagagaaagtattcaaacacatactttcacaagtggagaagcatcactagattttcttgaaaataaaaatgttgatattgcgatagtagatattatgatgagtggaatggatggttttgagctttgtcagactttgaaagatgattatcatattcctgtcataatgttaacagctagagatgcattaagtgataaagaacgtgcatttctaagtgggactgacgattatgtcactaaaccttttgaggttaaagaattattatttagaattaaagctgtcttaagacgatatcaaattaatgctgataacgagttacaacttggcaacttaatattaaatcagtcttacatggaaattactgtgggttcaaaaacgatgaatcttccaaacaaagaatttcagttgttatttttattagcctctaatcctaaacatattttcactcgagatgatattattgaaaaaatttggggcttcgattatgaaggagatgatcgtactgttgatgttcatattaaaagattacgtcaacgtttatctaaattgaaatcatcagtatcaattcaaactgtaagaggtcaaggatatagggtggaccaaaatgtttaa

SEQ ID NO: 1379 - DNA, 711 bp, Staphylococcus epidermidis
agaggagagcaacgacacatgaaagatgcaaaagagctaaaattgatgaccttagaagatgtacttagtcaaattgaaaatggtatgacaatcggaataggaacagggagcacaattgaattattaattccccaaattgctgaattaattcagcaaaagaattatacaattaccggcgtctgtacttctaataaaacagcatttttagctaaagaattagctatgaatatagttgatgtaaatgatgttgagaaaatcgacttagcaatagatggcgctgatgaagtagacagtgcgcttaaccttattaaaggcggtggtggagccttatttagggaaaaggtcatagatgaaatggctgaccgatttgtcgttgttgtagatgaaagtaaactcgtcaactatttaggagaaacatttgcattaccagttgaagtcgataaatttaattggtaccaagttgccaaaaaaattgagcgtacttatgatattcatgtaagcagaagagttaatgaagatgtaccgtttataaccgacaatggtaattacatattagattgttcattgcaaaatagaattcctgcttatgagctacacgaatttttaattcatttaactggcgttcttgaaacaggatatttcctcgatattgccgatcaagtaatagtaggaacacaagaaggcgtaaaaatattaaataaagaaacttag

SEQ ID NO: 1380 - DNA, 438 bp, Staphylococcus epidermidis
aaaacggagcaaaatttttatatgaaaggaggggtgttggttttaaaaataatgtctaaacatagtgctacgttagttattatgtttttaataactttattgcctatttttcaatatcaagcttctgcacatgcgactttagaaaaatcaacaccacaacagcaaggggttattaaagacaaaccagaagcaatcaagttagagtttaatgaacctgtgaacaccaaatactcgagtgtgaccttatttgatgataaaggtaaaaagattaaagaccttaaaccaataacaactggatggtctcagacagttgtattttcatctgagcaaattgttaatggcacgaatactattgaatggcatacggtatctgcggatggacatgaagtcggagatacgtttgaattttcagttggaaaagtgaggctaaagatgtag

SEQ ID NO: 1381 - DNA, 405 bp, Staphylococcus epidermidis
ataatgactaagattcactttgaagcacccagtcccgaagattactgtaatttaagagctaatgctggaatgagtagtaaatcgattgaagcggcaataaaggggcttcctcatgcatgttttaatgtgaccctttatgagaatgatatgttgattggtatggggcgagtgattggggatggtggtacagttttccaaatcgtcgatattgctgtgaaagatatatatcaaggtttgggtcatggaatgacaattatgcatgaaataatgaagtatattgagagtgttgctgaagaaggtacatatgtgagcttgatagcagattatccggcagatcaattatacgagaagtttgggtttaaaagtactgagccttattcaaaaggtatgtatatcaaatattaa

SEQ ID NO: 1382 - DNA, 201 bp, Staphylococcus epidermidis
acaaaatataaatgcttgcctcaatcaataacacagaaaacaaaaattaacatacaatcttacattttcggagttcagcacaaatcagttattgaactaactttattacaaattggaggactcaatgaatatgataagattgtatgtcattcatgtctttacaactctaatatgtattgtttgtgtaacttaatcacttaa

SEQ ID NO: 1383 - DNA, 186 bp, Staphylococcus epidermidis
atgaaatataaaacaactttcaaaataaaacctccttttaccccagctaaagacctagctattttttcaaaaattattactaaaacactaagtaaacttttgcttaaaaaattagttaatgtcttacatcaattagataaattgatattaacgtttataacaaaattgaatttaaacaaaatataa

SEQ ID NO: 1384 - DNA, 135 bp, Staphylococcus epidermidis
aaacgtcataaaatgcatttgcttttgcatccaatgacgttttttagttatttaaacattgaaatcaatgacaatacgtccagtattattatgattgatgacttgatcgatggcttttgggatttcatcgaatga

SEQ ID NO: 1385 - DNA, 1614 bp, Staphylococcus epidermidis
ggagagttcaatatgttagtagaatcttttaatccatttggtaatttactattatcatctttaattgcggcaatccctatcattttatttttactgtgtcttacagtatttaaaatgaaaggaatttatgctgctatcacaacccttgtggttacattattaattgcaattccattctttaaattaccagtaggaattgcctctggagcagttgttgaaggtttcttccaaggtatcttcccaatcggatatattgttattatggcagtattattatataagattactttgaaatcggggcaattcgcaactattcaagacagtattacaagtatttcacaagaccaaagaattcagcttcttttaattggtttttcatttaatgcattcttagaaggcgctgcaggatttggtgttccaattgcaatttgtgcacttttattagcgcaacttggctttagaccattacaagcagctatgttatgtttagtagctaacgctgcatctggtgcatttggtgcaattggtattccggttggtgttgtaaatacacttaacttacctggtcatgtagaagcgatgggagtttcacaaacatcaacattaactttagcaattattaacttctttattcctttcttacttatctttatcgtagatggtttcaaaggaattaaagaaactttaccttcaattcttgttgtttctgtcacttatacagttttacaaggattacttacagtgtttaatggtccagaattagctgatatcattccatcacttgcttctatgttagcattagctttattctctaagaaattccaacctaagaatatctttagagttcaaaaagatgttaaaccagaagcaccgaaaaaacttaaaggtaaagaaatcttatttgcttggagtccattcattatcttaactgtcattgttatgatttggagtgcaccttcatttaaagcattatttgcaccaaaaggtaaattatctgctttagttgcaaactttgacttacctggtactttcagtaatatttcacacaaaccaattactttatcattaaacttaattggtcaaacaggtacagcaattctaattacaattattattactgttttaatggctaaaaaagtcaactttggtgatgctggtcgcttatttgttgaagcatttaaagaattatggttaccaatcataacaatttgtttcatcttagcaatttcaaaaatcacaacatatggtggtttaagtaatgctatgggacaaggcatctcaaaagcaggaagcgtattcccaatattatcaccaatccttggttggatcggcgtatttatgactggttcagttgttaataacaactctttattcgcgccaattcaagcttctgtagcacaacaaattggtacaagtggttcactacttgtagcttcaaatacagcaggtggggttgcggcgaaacttatttctccacaatctattgccattgcaacagcagctgttaaagaagtaggtaaagaatctgaactacttaaaatgacattacgttatagtattggattacttgtatttatctgtatctggacatttatcttgtcattcattctgtaa

SEQ ID NO: 1386 - DNA, 123 bp, Staphylococcus epidermidis
aattgtgtcaaaattttaagtctctactatgattcaacagctgtcttatttgtttttcttcgagaaagtactaaagtgacgacaactgaaacaacaaatgcaattagcattcctattaagtaa

SEQ ID NO: 1387 - DNA, 225 bp, Staphylococcus epidermidis
aacaatcccaacaaacttgaagaactacctttggcccctttactctcatccattgctatcgaaaatcctaacgttgcaatccctgtaactggtgccactaaaatcacaaagccacaagaaagtatccaaaaagtccaatggttgagtaaagttagtgatacgattataacaccaataacttgtatagtagacatgattctcagcaacagtaatctatctatatag

SEQ ID NO: 1388 - DNA, 177 bp, Staphylococcus epidermidis
attaaacccaattataacagacataaaattaaaaagataaacttagtaaatttgcatctaaaggaggcatttaaatgtctgaaacattacaaaaccaaagacaattcaactctcaatttgaacatcaagagatccatcgtggaaaaagatatggtaaaaagaaacgctcatgggtaa

SEQ ID NO: 1389 - DNA, 156 bp, Staphylococcus epidermidis
agaattataaaaatagactggattttatcaaacattcaaaatattttattaaaagggaggagtaagcttgaaaagagtgtatcagtcagaaaatcaatcattactttttattgttattttaggttcattaacagcatttggcccattggctattga

SEQ ID NO: 1390 - DNA, 645 bp, Staphylococcus epidermidis
agatgtgtaaataaaaaatacaccaacatttttaataattgtgttggtttacagtttatttatttaaattttctttttgatttaggtgaatatatgaaacaacgtgcgaaatataaaataataaaaagtttaatcgaacttttagaatactatccttttgatgaaataaccattaaaatgatatgtgcatatagtggcgtgaatcgctctactttttatgatcattttcaagataaatatcaattactagataagatccaaaattatcatttaaacaaatatatatctttactacaatctttctataacgattttcatcatattaaaacagatcaaaaaaaattatataaatttttcttattgatagccaaatatattaaacgtaaagaagcgttctacagagcaacacttgtaacatatcctaataaagatattgcattagattacattaacgccactaaaacatgttatgaaaaagtcatgaatagatatgaaacctcaataaataataaacgtatgtttatcatttattcagtcggtggtcaagcaggtgtatttatcgattggttacgtaatggatgcatcgaatctcctcaagaggtcgctcaagttcttttagctaatacaattaaattacaacgataa

SEQ ID NO: 1391 - DNA, 159 bp, Staphylococcus epidermidis
ttagtccaaaataatttaaaagcttgtgtaaatctaactttttctctcattagatatactccttttcattttgtcattaaaacaagtgttttaaatcaacacattatttgttacattaataagagtttatttctattaaaactcatattaaaagtataa

SEQ ID NO: 1392 - DNA, 561 bp, Staphylococcus epidermidis
atgaataaaaatgattatttaaaagaacttaaaaagcatttgaaacatatgaataaagaagaaaaagaagatattttgaatgaatacgatacgcatttttatagcggacagcaagagggaaagtctgaatcagacgtgtgtaaagaattaggtaatccaaaattaataggtaaggaacttacagctacttccagtgtagaaaatgcacatcaaaaagtgtcgttaatgaatatttcatccgcaattgtagcagtaatggggctaagtttgcttaacttttttattgttataataccagcttttttatgcattttgctcgtattaaccttcatcatttttactctagcttcactagctgcaccattgatgttgctcattaaaggaattatggatggttttcattccattatcttatatgacgcatttatgactggtttaatgtttggtgttggactcgtacttgcagtggtgacttactatctcattaagtggctatttgatgtgactatgaaatatctaaaatggaatatctctattgtcaaaggaagtgtacaatcatga

SEQ ID NO: 1393 - DNA, 963 bp, Staphylococcus epidermidis
ctgataaaaaatcaagggggatatatcatgtatcaacttgcacaatctaatctatggacaggtcgtttagatagtgaaactgatcctacacaatttagacacttccaaactgttaaattcggtgatttaagtcaattagatttttcggatgaacacaaaggcgtgggcttattaggatatgcaattgataaaggagtagaattaaacaaaggacgtgtaggtgcaaaagaaggtcccaatgccattaagcgagcttttgctggattgccagatttgaatcaatgtgaagagattatagattatggtaatgtagaacacaatcatgagttgctaatagatacacagcgcgaattcgcagatcttgctgctaagtctatcaaacgacataaacaaacatttttacttggtggcggtcatgatatagcatatgcacaatatttagctactcgtaaagtttatcctgagtcgtcaataggtgtgattaatatagatgcgcactttgacacacgcgatgagggttattcaacctctggtactagttttagacagattctagaagaagatgataatgcagattatttagtgttaggtatatctcaaggtggtaatacacaagctttatttaattatgctaaagaaaaagatattcaatttgtatatgcagatgaattactacatcaggtatctccccccattaaagatatgatagaacgttttatccataatcatgatacggttatgttcacaatttgcatggatgtagtagatagtgcatttgcaccaggagtcagtgcaccagctgtcctaggaatatatccacatacagttttcgaacttgctaaacgggtcattccaagtgaaaaagtaaaatctataagtatagctgaaatgaatccgacgtatgattcagatcaaagaactgctaaattagttgctaatttagtacatcattgtttaatttaa

SEQ ID NO: 1394 - DNA, 903 bp, Staphylococcus epidermidis
ttaatgaaaaatagaatgatgaatcgcgtggttaataaatatatacttcacaatagatcgatattttttagtaatgatgatgaagttaaacattttttagaaaagagaagtatcgaaaatagtaaaaaacatcagcaacctgcgacacttaatgtaaagtcaaatttagataaacttactcttaatgatatgcaagtgtttagatttaattttagacatgagaaaaatcaaaagatactctatctgcatggtggatataatactttgcaaccttctccatttcattggagacttttagataaactaactttaaatacattgcatgaggtcgttttacctatctatccaaagtcaccagattatcactacttagaaacgttcaaagcgattcgtgacgtttataatcaattagttgaagaagttggtgcgaacaacattgttatgatgggggatggttctggtggaggactagcattaagttttgttcaatcacttatcaatgataatcaagaagtgcctagaaagttatttttactttcaccgcttttagatgccactttgactaatcctaatattacgaaaacgttggaagaaaatgatatcttagttagtcgatttggtgttcatcaactcatgaaatcttggacgaatgatttacctttatcagacgcgcgtatatcaccattatacggtactctaaaagggttgccacctatatatatgtatggaggtggcagagaaatattaagcccagacatgcatgcatttactcatgctctagaggaatgtgggaacgatgttgagtttaaagagtatcctaaaatggtgcatgattttcctatctatcccatacgccaatctcacaaggtgttaaaacacatcactaaatcaatcttagagtaa

SEQ ID NO: 1395 - DNA, 618 bp, Staphylococcus epidermidis
ttgatagtgaaaaaaataaaagctgaaacactttcagatatgcaaaattataaattacttagtggaagtattatacctaggccgatagcatttgtaactactcaaaatttaaaaggggatatcaacgcagccccgtttagtttttttaatgtagttaatcatacaccacctatgattgcaattgctgttcaacgtacaaagggaaatagaaaagacacctcaataaatatagaacaatcaggtgagtttgtagtgcatattactgatgaggctattgttaatgatgtgaatgaaactgctgccccgttagaatatggtgttaatgaacttaaaagaacctctctaagtatgattgattcagatttaattaaagttccagcaatcaaagaagcaaaagtaaggtttgagtgtaagcttcatcaaatagtacaattgggcaacaaagataacgggagtgatttgataattggtgaaattgtcgtgtaccatatcgatgaagaagtttattttgaagatagtaaaattgatgcaaatcaattaaatccggtagctaggttagctggaaatgattactctttgttaggtcaaacatttacggttaatcggcctacctcataa

SEQ ID NO: 1396 - DNA, 723 bp, Staphylococcus epidermidis
tattatgccctttttaatattttaattgaaattcaattcaacatgataaagagacaaagtaggaggcggtttcaaatgaaaaaagtattagcaagtgcaacgattttatcattaatgttagtaggttgttccaatggtggaaatgatgaatcaagtcataaagatgatagttctaaaacagaacaaaaggataaatcatcatctcaacatgactcaaaaaaagattcgaaacgtaatgatacaaataataagcaagacaatcaggaaaataacactaataaagaacaaacaaataatcaaaatccaaatgatggagaacaacgaacaagcgaaagaccaacaacaaattcaaacggaaattcatcggataatcaaaataaacaacagcaatcagtacaagataaccagaataaatatgtagcaccataccaaagtgaaaatgcgacacgtgttgctcgatgtctttctccatttgagggcgaccgcagtcaagctttgcaacaattaccaaattttgaaactgcactttccattgctaaaaacgaagctaatatgtatggaagcgaaaataaatcatataatgattattcaatagaacaaacagaagatggatttagatatgtgtttagctttaaagatccatcaaaaagtaatacttactcaattgtaacgcttaatcgacaaggtcaacctactgttgtagatcctaacttccaaccttaa

SEQ ID NO: 1397 - DNA, 1080 bp, Staphylococcus epidermidis
catataaagaaatgggagaggatatcaatgaatctagcttggaaagagattaaattttataagttcagatttatattaatcatgttcattatttttctaatggcgattatggttttatttatcagtggacttgctcaaggcctagcacgagaaaatatatcaatatttgatcaaattaaaggtaatcaatttgttgttcaaaaaatgaaagaaccacaattagaaaaatctattctatcacgaagtaaacaagacaatatttcaaaaattattgatgaaaaaccttttaaaatggcaggtaaaactttcaaaatcaatggaaacgaagaaaacgtgatggctataaatagcgtgaaaaatcatcagccaaatttgaaatctggtcattatcctaaaaatggaaatcagatagcaataaatgaaaaactaactgcagaaggtctttatttagacgataaagttaaagtcaaaggtgacgatacaacttataaagttgtaggtatattaaaaaacacgatgtattctcatagtaacattgttatgatggaccaatccaaaatagaacaaagtagtaatgtcgcaacattttatgttacgaaccaattatctaaatcggataaaaataaaataaatcacatcaaaggcgttcaaacagcaactacagacaatataacaagtaatatcgcaagttataaagcagagcaaacaccattggatatgatgattattagtttatatattataactgcaattgtattgagtgcattcttttatgtaatgacgatacaaaagacatctgaaatcggtattttaaaagcaattggtataactacaaagcacttattgacatcattgattttacaaatttcaatgattacatttataggtgtagctatagcagaagtagttattttgctcatcagtcaaattttacctgtatctatgccattccatatagatatgcataatataatcattgtacttgtcatatttatgatagttggattaatcggtacatcattatcatttattaagttaattaaaattgatcctattgaagctattggaggtggccaataa

SEQ ID NO: 1398 - DNA, 186 bp, Staphylococcus epidermidis
accatgaacctcattgaatttattaatgacctcgctaaaaataatattataatatgcgtcatgcatatgattattattatctatagcatcttctgtcacagttcgggttacggtaaatgtcttgttcatttatttaacctccttagttataacactatactaaccgaaaagagcacatacatgtaa

SEQ ID NO: 1399 - DNA, 1137 bp, Staphylococcus epidermidis
gaaagggctgagcgatatatgacaaattattctacttatgtagattggagaagaacgtttcatcaatatcctgaactttcagatgaagaatatgaaactacagaaaagttacgaaaaatactcaaaagttatggtatacgtatactggaggtacctttaaaaacaggtttagtagcagaaattgggcaaggagaggaaatgatagcagtaagaacagatattgatgctttgcctatagaagaacaagtgaagcatgaatttacatcaaagtatcaaggtgcaatgcatgcatgtggtcatgatattcatatggcaagtatattagctactggtattcaactaaaagagattgaagatgaattaaatggacgcgttcgattaatatttcaacctgctgaagaattaggacatggtgcatttgaaatcataaatactggagtacttaaaggagctaaagcagtacttggttttcataattatcccactttaaaagttggtgaatttgctattaaatcgggtgcaattacctctgctgtcgatcgttttgagtttaatgttaaaggtaaaggtgcgcatgctgcaaaacctgagcaaggaaatgatccagtcatcgtcgtaggacaacttatcaatagtttacaaactattgtgagtcgaaatttatcagcttttgatagtgcagttgtaacaatcggtgaaatttcttgtggtaacacatggaatgttatagctgacaaagcttatatacagggcactgttcgttcattcgatgaggatatacgtcattatattgaaaataggatgaaaaatattgctgatggtttaagtcgtgtttttaatgtggatattgatttaacttattcaagactacctggtgcagtagtaaatgatgcacatctaacacaagaagcaatcgaggtcgctaaaaatgttggctatcatgtatcaatgctcgatgaaccggttactattggagaggatttttcaggttatacagaagaataccccggtgttttcgcatttattggctccgacagtaaatatgatttacatcatcctaaatatcatccagatgagcgtattttggaaaaagttcctcaatatttcgttcagctcgttcaacgtttattgacataa

SEQ ID NO: 1400 - DNA, 861 bp, Staphylococcus epidermidis
tgtgactatgaaatatctaaaatggaatatctctattgtcaaaggaagtgtacaatcatgaaaaaaattgcagcgataatatttttaataggcttgtcactaattattatttgtagcgtgggagtttatgcacaaaataaaaaattgagtaaagacaatcaatataataatcaaacaacaaatttaatgaaaaactatgatgataatactgtgaaaagtatttacattgatggaaaagtaagtgatataactgtgaaaaaaggtaaacatttttcggttaagtccaaagggaatgacaaaaatttaaacgtaactagcaaggtgaacaatcaacgttgggtaattacagagcgtcaaacaagtccacatattaattttagaatacaaggtaaagttagtaatcacattacgattacagtacctaaatatattaaaaacatagatattaaaactaatgccggggatttaaatattgttggagtaaatagtggcacaggaagatttgatgctgaatctggagacattaaagttcaaaaaggacgatataaaaaggtgacacttcataatgaggatggggatattcatacgaaagatattcattttaatcaagctaatattcaaaatgacaatggggatattcaaatgaaacaattagaccctgatattcctttacgtattaaaaatgaagaaggggatataaacttgaattataaaaaagaacttcatcacacccaaatcatcactcgtaatgaagaaggggaaacagacatcgatcatcgtgtgttatataatagtaaagttgaaaatggaaataataaagtgaaattaatcaatgaaaatggagatattaaagtaaaataa

SEQ ID NO: 1401 - DNA, 1194 bp, Staphylococcus epidermidis
tgttataatgacttaaatatcatagaaaacaatgaggtgttttacgcaatgaagtcgttcacattttttatgcataatatttatgcaatgggcggaacggtaaagtcggtgacacaacttgcaaatacactggcagaaaaaggacatcctgtaacaattatttcagtttttagaggcgcagactctccatattttgaattacattcagcaataaaagttaaagtcgtagtggactatcgcttaaagcttaaaaatactagagctattacggcaaatcgtatcaaaaagtataccccctttttaaatacaaaagtgatttctcaatttgagccaggtaaaagtcagttttcgagttatgtagagaaaaaaatgattaaagcaatcaggcatactaaaactgatgtactcgttggaacaagagctagctttaatattctcatttctaaatatgctaaagctgaaatagtgaccatcgcaatggaacatatgaattttgatgctcaccctgatcagtatcaaaaggaaattattgctgcgtaccgtaatatcaataagattacaacgttaactgtcgcagaccagcaaaaatatcaatcacaacttaaaactcctgtatacgttatacctaatatggttaccgaaaaaagaattgctgctccaaagaaaaatcgtattattagcgccggacgtttagaatatgaaaaagggtatgatttattattagagagtattcgtttaatacaagaagacttgcgtcaattgaattatgacgttcacatctatggttctggtagtaagaaaacatcacttgttgactttattaatcaatatcatttaaatgatttgattaaaatatatgagccaacgcaagaattaaataataaacttgcacaaagtaaaatcgttgttgtaccttcacgcaatgaaggtttcggaatgattattttagaggcaatggtgcaagataatatagtaataagttttgaaggcaatgtagggccagattcaatcattaacaacggagataatggttatttagtaaactatgaaaatgtgtctgaacttgcaaaacgtatcgatttaacaacacaacattataatgagttagatcacatcattgaaaatagtaaagatacgttgaaacaatttagtccggatcatatatatcaattatttatgtctatgtttaaataa

SEQ ID NO: 1402 - DNA, 141 bp, Staphylococcus epidermidis
atgaacgccgaatcaagttttattttaacgatattaaatgaatctaatatagccactaatattgcaaataaaagaccaccaatgacaggtgctggaatacagattcgccttaaaatagaaacatggttgattattgtttga

SEQ ID NO: 1403 - DNA, 1383 bp, Staphylococcus epidermidis
gaggtcaaggatatagggtggaccaaaatgtttaaaacattatattcgagaattgctatatatgcaattacagtcattttgtttagtgcattaatgagttttctttttacgaatatttattatcactttcatttgaaagcttctaatgatgcaaaaattatgcgcacactcaaagaagctcgtgaatatgaaagaacacaaaaacctaaacctctagatacgtatttgaaacatttaggtcaaatgaattatcaaattatgactgtcaacgaacatggaaccaaacatttttatggggaaacttttcgtaaaaatactataagtcagtctgcaatcaaaaaagtgctcaacggtgaagattatcatggtattaaaaataaaccttatgcattttttgtaacagggttcttcgataatgaaacggataatacagtaggtattcaatttaaaacagatgatggggcattagcagtttttatgcgcccagatatcggggaaacttttagcgaatttagaattttcttagctgtgttgataacacttttacttattatttcaatttcactagtcattgcatcaacatattctattattaaaccagtgaccgcattaaaaaatgcaacaactcgaattatgaaaggtgatttcagtacgcctatcaaacaaacacgtcacgatgaaatcggaacactgcaatcacgtttcaatacaatgcgtcaaaatttaggacaagtagatcaaatgagacaacattttgtccaaaatgtatctcatgaagttaaaacaccgcttacacatttacaacgattgcttacacaacttgaattgacgcaaaatgaagaagagaaacaactatgtatcaatgaaatgtttgaaatcactaatcaagtaagtgaactaactaaggaattgctacttttatctgaattagataatgcttcccaccttacttttaacgataatgttcatttaaatactttaataaaggatattattagacatgaacaatttcgaactgatgaaaaagatttagttatgtttactgaattagaagatttgtatttccgaggaaatgaaagactattacatcaagctttcaataacctcatcattaatgcaatgaattatgctcctcaaaatagcatgattaatatcactctaactagtacaaatcacttgattatatttaatattgaaaatgatggatcgattgcagaagaagatgcgaaacatatcttcgatcgtttttataaactgagtgacgaatctagtagtaatggtctaggtctagccattacccaatcaatcattcatcttcatcatggtagcattactctcacttcagatgataaaacacaatttattgtaaaactatttatttag

SEQ ID NO: 1404 - DNA, 123 bp, Staphylococcus epidermidis
ttatcaagtttacttattttagtgatacctagtttgttcttcatgctatatgatgatagaaaaatacatgtttatagcaaaccggaatttattaaacgtcatcaagtcaataaaaaccaatga

SEQ ID NO: 1405 - DNA, 126 bp, Staphylococcus epidermidis
gctgggggtttgttatatgggattaaaattatatttttcacacagctaaaagattttgtttttatgatgggtaattcgattcatagaatgtacattagtcattttttctggcttgggctgatatga

SEQ ID NO: 1406 - DNA, 879 bp, Staphylococcus epidermidis
attttcagttggaaaagtgaggctaaagatgtagatacatcttcacctttttatgaaaagtctaaattttggtttggattattaagatatgttactgaaggtgcaaactttctacttattggcttgttttggttaaatggtattgctaggaaacgaggattaagacaatttaatgtgttacccaagcaatcaggaattgcatggattatggctatgtcattactcgtgagtcttgtggtttatatgatgacactcacatctgatatattagaagatattctatcatttaaattagaagtgataatgcaatttccgtatatattaagctctatttcactaatcattttgtttatacttttcattttaaaagatatggaaaaaatatggtactggctcatttcaatagttatgattgctgtgataagtatgtctggacacgtgtggtcacaacaagtgccattatggtcaattatcataagaacaattcatcttatagggctaacgttatggttaggttcactcgtttatctcatttgttatgctattaaagtgaaaattaatcagttgacgagtgtaagacgtatgcttttaaaagttaatatcattgctgtgattatgctcgtttttacagggattttaatggctattgatgaaacgaatactttaacactttggaataatgtgagcgcttggtctatttatcttgtcataaaaatcgcaggaattattgctatgatgctattaggtttctatcaaacgatgcgtgctttgagacaacgacaacaggtccatcgttttgcactgatgactgaattgttaattggtatgatattaatttttgcaggtatcatgatgagtcaaataaatatacctagttga

SEQ ID NO: 1407 - DNA, 165 bp, Staphylococcus epidermidis
ttgaaattgtgtatgctaaaaattttatatgttagcacctacgttaataattatctcaatgattcatatcactgtggaacttcatatgcagcgatgtacgattgtatcaacgctgacatgtttattcatttcaactttaatcacggtatcgttgattcaaattaa

SEQ ID NO: 1408 - DNA, 906 bp, Staphylococcus epidermidis
  modified_base (18)..(18): a, c, g, t, unknown or other
gcgatttggtggtatccntatttaggtgcagctctaggtatgatacttgttcatcctggattgatgagtgcatatgattttccaaaagctgtagaagaaggaaaagctattccacactgggatgtctttgggctacatattaatgaagtaggttatcagggacaagtattacctatgctcgtagcaacatatattttagctacgattgaaaaatggttacgtaaagttattccaactgtgttagataatttattgacgccattattatcaatttttattacagcatttataacatttttatttgtagggcctgtcactcgtcaattaggttattggttatctgatggattgacttggttatatgaatttggtggagctattggtggacttatatttggtttattatatgcgccaatcgtcattacaggaatgcaccatatctttattgcagttgaaacgacattaattgctgatgcgactaaaacaggtggttcatttatcttcccaatcgcaacgatgtcaaatattgcacaaggtggtgcagctttagctgcattctttatcattaagcaaaataaaaaattaaaaggtgttgcttccgcggcgggtatttcagctttactaggaattacagaaccagcaatgtttggtgtcaatcttaaattgagatatccatttataggtgctgttgcaggatcaggtataggtgcggcttatatttcattcttcaaagtaaaagcgatagcgcttggtacagctggattacctggatttatatctataaatcctacacacgctggttggttacattacttaataggaatgctaattgcatttgttgtttcagttgtcgtcactttagtactttctcgaagaaaaacaaataagacagctgttgaatcatag

SEQ ID NO: 1409 - DNA, 123 bp, Staphylococcus epidermidis
caatatgtaagtgaaacactgctgataaaagttgaatttaaaaagtcttatattgctattttcaagtataaagtgtttgatatgtttagccaaaaagctacccctttatggcagacatcttaa

SEQ ID NO: 1410 - DNA, 540 bp, Staphylococcus epidermidis
atgggggaaaggataagaagtgttcaaataactgaggtagagcaactacaactaattgctaaaagaacattttttacaacgtttagagaatcttatagtgatgaggacttcaagcaattttttagtgatgcatatgatatagatgtgttgagaaaagaattggaacaaagtaattcttttcattatttttatgaagttgatcaaaatatagtaggtttcttgaaattgaacattaatgatgctcagactgaaaacaaaggtcatgcatatttggaaatacaacgcatttactttgatgaagcatttcaagggagtggaagaggacaattatttatcaatctagctattgatcaagctatcaaatttgggaaatcgaaaatatggcttggtgtttgggagcataatcctaaagcgcttagcttttataaaaacagaggatttagagttacagggtcgcatcaattttatactggaagtgtagtagataatgatttgattatggagttggatcttacaacaaactataaacaaagtttatag

SEQ ID NO: 1411 - DNA, 690 bp, Staphylococcus epidermidis
agctattggaggtggccaataatgggtttagttgttaaagatataagtaaaacttttggagaaaaaacctcaaaaacagaggtgttaaaagatattaactttgaagtgaaagatggagaattcatcattttaaatggtgcttcaggatcaggaaaaacaaccttattaactattttaggtggtttgttatctcaaacatcaggtgatgtagtatacgaggggaaatccttatttgaacgacatactaataaagcgcacttaagactaaatgatattggttttatctttcaagcctctcatttagttccatacttaaaagttttagaccaacttaccttaataggtaaagaaactggaatgtctagcaaagaagctcaagcaagagctaaagaattattaaaaaaaattggattagaagagcaacttaatagctacccacatatgctttcaggtggacaacaacaacgtgtagcgattatgagagcacttatgaatcatccgaaaattgttttagcagatgaacccacagcaagtcttgatgctagtcgtgctcaagaggttgttgaaatgatcagaaaacaaataaaagctaaccaaatgataggtatcatgattactcatgatgaaagcttgttcaaatacgctgatcgtattgttcaattgtacgatggtaaaataaaaaacagttaa

SEQ ID NO: 1412 - DNA, 165 bp, Staphylococcus epidermidis
gagcgtctaggtggttatttttataaaaaagacaaactctatattatttcaatagaatttgtctttttcacttatccagaaactttatgtctcggaatcataaacaaaagagatgattctcgtattaaaagaacattaaaatcatctttatttaatacgtggtaa

SEQ ID NO: 1413 - DNA, 1431 bp, Staphylococcus epidermidis
gagattgaaggaagatttatgataaagcaaataaatatttcaaatatggacaaattaaaagagcaaatggaacgtgcacttagcgacggctatacgcatgtcatcccctattcaaatgaaattcaaattcatcagtccatgattaaagctatcactttacctaagacttcatttatagttgactatacaattaacaattattatttaaacgattgtaaatacttcgggttggactttgttgattttgaggactgggttaaaaatattaatttatatccaaatgttatttatgaaattaattcaacattagaacttattgataaatttgaagttgaaaatatctttgatttagcattattaacaattcttaaagggcatatcgcagttgaaggtcatgtcgtattagactttaaaggaccattaaaaacgagcaagggattttggcgctcatttgaccgtaatgatttaacttatagagataaattcttcttaaacaccatcgcttatgcacataaacaaagaatcccatttacgcgtgtaccatttaacgatcacgatagtattagatattatgattcagtactacttagtactaaatttaaagctccaagatggttagtgactcctattaagaattattcagttaaaaaacacaaagagattagctatatttataaaaaggattcatcaaaacttaagaaccacgtcgtttttctaggatttgatttcggctatcgaggaaactctaagtatttatttaattactttgttaaacacaatcctatgatagagtcttactttataacagatgagagaacaggaccacattttatttcaactaacgatgaaaatgtgaagaatttgattgaaacagctacttttgtcattacggaaagctatattcctgacgacattcaccctaatggtaaaatcatccaattatggcatgggacacctattaaaaaactatttttagatagtaaagagccacaccaaaatttaaatatatataactaccgagctcgaaaatataataaatggacacaacaagattatttaattgtagattcagaagaatcaaaaacatactttgaatcagcgtttcctagtcaaaaaattgatatattacctgtaggatatcctagaaataattatttattaaatcgtatcaatgatgtaggtttacataaacgtatatttagtgagataaatatagatcctactaagcgagtattattatatgcccccacctggaaaacaaattcatctgatgatgatatatttcctattaatgaacagttattaacacattataatgtgatctataaaggacacgtcgagagtaaaaatgacttggttcctgaaggcgtaataaatccgcctaataatattgaaacgcaagacttaattattatttcagatgttgtttaa

SEQ ID NO: 1414 - DNA, 126 bp, Staphylococcus epidermidis
tatctttttatggaaaaaacaaaaattataacaacaaatacccttagttatagattagcactcaatctaactaagggtattattatatgtttaaaattgtgtcaaaattttaagtctctactatga

SEQ ID NO: 1415 - DNA, 126 bp, Staphylococcus epidermidis
cattacgttatagtattggattacttgtatttatctgtatctggacatttatcttgtcattcattctgtaaatcaaaatttattgaaatgtatttttcatatacaaagcccgaaatgaagctataa

SEQ ID NO: 1416 - DNA, 183 bp, Staphylococcus epidermidis
aaattttatatgttagcacctacgttaataattatctcaatgattcatatcactgtggaacttcatatgcagcgatgtacgattgtatcaacgctgacatgtttattcatttcaactttaatcacggtatcgttgattcaaattaaacgtcttaaaaaggataacaacttaaatcaaatatga

SEQ ID NO: 1417 - DNA, 141 bp, Staphylococcus epidermidis
tgtttaagtatagtttacatgaatgtaagtgtttacaaaaatgataattatattttcgaatcatcttacatacaatttatttacgttaattgccgaaatctatggaatattacaagaaaaagtgtaacaatatgtaagtga

SEQ ID NO: 1418 - DNA, 132 bp, Staphylococcus epidermidis
attcctttcattttaaatactgtaagacacagtaaaaataaaatgatagggattgccgcaattaaagatgataatagtaaattaccaaatggattaaaagattctactaacatattgaactctcctcattaa

SEQ ID NO: 1419 - DNA, 189 bp, Staphylococcus epidermidis
aaaccatccataattcctttaatgagcaacatcaatggtgcagctagtgaagctagagtaaaaatgatgaaggttaatacgagcaaaatgcataaaaaagctggtattataacaataaaaaagttaagcaaacttagccccattactgctacaattgcggatgaaatattcattaacgacactttttga

SEQ ID NO: 1420 - DNA, 345 bp, Staphylococcus epidermidis
aaagggaacattactaaaataacatggactgctacagataaaggtattggtccccatgagtttattgaatttcctattgtagtggctaatcctaaaaaggaaggcacattcaaatggaacactactcaaacttatgataatggagatgttgttaagtggactgggaaggaagatagtgcgcaccctgcaccaactacaactgtaaaaaaaggtgcaaatccaaatgacactcattctgactcgagtcaaggtgattcaatcgctttatggatagttgctatcgtggcaattgtgatttcgttgattgctctttttaaacaagcgcatccaaaaaaatttaattga

SEQ ID NO: 1421 - DNA, 1059 bp, Staphylococcus epidermidis
ggtgttttaatgagtgactcacaaagagaacagaggaaaaatgaacatgtagaaatcgcaatgtcacaaaaagatgcgctggtttcagattttgataaagtgagatttgttcatcattccatccccagtattgatgttagtcaagtcgatatgacaagtcatactacgaaattcgatttggcatatccaatctatataaatgcaatgactggtggaagtgattggacaaaacaaattaatgaaaaattagcaattgttgctagagaaactggaattgcaatggcggtgggatcaacacatgcagctttgcgcaatcctaatatgattgaaacatttagcattgtgcgtaaaacaaatcccaaaggaacaattttcagcaatgtgggtgccgatgtaccagtggataaagctctacaagcggttgaattattagatgctcaagcgctacaaattcatgtgaactcacctcaagaattagtcatgcctgaagggaaccgtgaatttgcttcatggatgtcaaatattgaatctattgttaaacgcgttgatgttccagttattattaaagaagttggtttcggaatgagtaaagaaacattacaagcgttatatgatattggtgttaactatgttgatgtcagtgggcgcggtggaactaatttcgttgatattgaaaatgaaagacgttcgaataaagatatgaattatttatctcagtggggacaatctaccgtagaatccttacttgagagtactgaatttcaagatcgattaaatatttttgctagcggtggcttacgtacaccactcgatgctgtaaaatgtttagcattaggtgcaaaagcaatagggatgtctcgaccgtttttaaatcaagtagaacaatcaggtatcacaaataccgtagactatgtagagtcttttattcaacatatgaaaaaaattatgacgatgttagatgcgccgaacattgagcgtttacgacaagcagatatcgtaatgagcccggagttaatatcatggatcaatcaacgtggccttcatttaaatagaaaataa

SEQ ID NO: 1422 - DNA, 123 bp, Staphylococcus epidermidis
actaatttaattatatatataaattgtgttacacaaaagaataaaagtcaacattatgagaatagcttcattacacaattcaaattacaattgtttacatgttaccccttatatacgaactaa

SEQ ID NO: 1423 - DNA, 402 bp, Staphylococcus epidermidis
aggagaataataatgtctataaaagaaaaattagtaatagagctcatgaatttaaaagacactgtaaaatacgaattgtcagaattaaatgaacaacaatatttgtttatgaacggcccagcacctcagttgatgaagcgtgccatgaaaatgagctatattctaggccaaaaagaagcgattgatcactttctattactcatcgacacttgccatgagaatgtcttactagataactgccaagactatcaaaaacaaattcaacataaacaattctctttacaagaagatattattcaccaaataaatcagtcaaaggaattcgaatcatttttatcaacttattatgtaaataaaggtaaatatgatatcaccagcaaaataaaaacattacttgaataa

SEQ ID NO: 1424 - DNA, 1647 bp, Staphylococcus epidermidis
tttattacaattacgctatatataggaggcatacacatgagttatagtataggaattgattttggaaccgcttctggaagagtgatattagctgacacatccaacggacatatcatatcaagatatgaggaagactatgcgaacggaacttatatgaactcattatatgataaaccgttacctgaaaactacttcttacaaaatgctgacgactatttacaaattcttgaacaaggcgttcaatttgtattagaagatagtaaagttaataaaaacgatgtggttggaattggagtcgactttacaagcagtacaattatctttctcgatgaacaatttgaaccgcttcatcgtcatgaagatttaaagacaaatccacacgcgtacgtaaaattatggaaacatcatggagctcaagatgaggcaaactatatgattcagatgagtaagaataaaaattggttagattattatggctcaagcgtaaatagcgaatggatgataccgaaaatcctggaagttaaacatgaagcaccagaaatacttagaagagcacggtatataatggaagctggagattacatcactagtatactaacaaattcaaatatacgatcaaattgtggtattggttttaaaggtttttgggacaatgaagctggatttaattacgacttcttccatagcgtggatcctgatttacctaaaatcgtcaaagaaaaatgtgaagcgccaatcatatcaattggagaaagtgcaggtcgtttatgtaaagactatcaacaaatatgggggctttctcaagatgtccaggtttcaccttttatcatagatgcacattctggcgtcttaggtgttggggcaatagaagctggagaattcactgcagtcattggtacaagtacttgtcatctcatgctagattcaagacaagtacccatttcttcaataactggctcagttaaaaatgctattatacctggattatatgcctatgaagctggtcaaccagctgtcggtgatttgtttgaatactcaaagaaccaagcacctaaacatattgtagatcaagcaaatgaacatcatatgcctgtgcttaactatttagaggaattagcaagtcacattagaatagaagaacaacatgttgttgttttagattggttgaatggaaatcgtagtatacttagtaatagtcatctaactggaagtatctttggtcttacacttcaaacaccgtatgaaatgattcatcgagcatatattgaagctacagcatttggaacaaaattaattatgaaacaatttgaagataatcatattcctgttcatacagtgtatgcgtctggtggtatcccacaaaagagtaaattactcgttgaaatttatgcaaatgttttaaataaaagggttgtcgtcatagattcatctaatgcttcagcattaggtgcagcgatgttaggtgcaaatgttgggaatgcatatagtacattaaaagaggcggcattatctatgaagcaacctatagcttatatacaagaacctgaaatccaaaaagttcaagcttataaaccactctaccataaatattgtgaactacatgatttattaggtcgtcaatatcctgaattatcatatttgatttaa

SEQ ID NO: 1425 - DNA, 465 bp, Staphylococcus epidermidis
gagataaaaatggtaagaagaatagaagatcacatctcatttttagaaaaatttattaatgatgttaatacattaacggcaaagttacttaaagacttgcaaactgagtatggcatatcagctgagcaatctcatgtgttaaatatgcttagtatagaggcgttaactgtggggcaaattacagagaaacaaggtgttaataaagctgctgttagtcgaagagtcaaaaagttgctcaatgctgaattagttaaattagaaaaacctgattccaatactgaccaacgtcttaaaataattaaattatctaataaaggaaaaaaatatattaaagagagaaaagcgattatgagccatattgctagtgatatgacgagtgactttgacagtaaggaaattgaaaaagttagacaggttttagaaattatcgactatcgtatacaatcttatacttctaaactttga

SEQ ID NO: 1426 - DNA, 147 bp, Staphylococcus epidermidis
gtttgtatgatgtttagcaccttcgtcgtgctttcacttcgaaaaatatatactaatcaacatgctatagttaagttaatctatttgagtcccaccagtcacaccatatacttgaccggtaatataacttgcatcatcagaggctaa

SEQ ID NO: 1427 - DNA, 696 bp, Staphylococcus epidermidis
aaggtcgtgatatacatgattaaagtgaatgccatatctattggcaaaatagaaacattgtcttatggaaactataaaccaatgcaatcagcgttaaacaaaattccttttaaaggtcaaatgtggctcaatcgacttgggttcgtggacgatgaacaagcctatcataaccatggtggtatacataaagcgatatgttgttttagtaaatctaattatcaattatttaaagatgacttagatcaattacctgaatttgcaatgtttggagagaatttgacagttgaacatctagatgaagcagatgtttattttggtaatcagtatcaactaggcgatacaatcatagaagtatcagatatacgagaaccttgttggaaaattcaagctaaatatgcaatacctaatttagttcaaaaaatgtcgcaatctggtaaaactggattttattttagagttataaaagaaggatatgtacatcagagtgataatttaaaactcattaaaaaggcagaatcaaacacacgtctatctgtgaaagacttaaatcatctattctataatgagcgaaataatttaagattaatctatcatgcacttcgaaatccttatctttcacctgatcgaaagaaaaaactacagaaaatgaaaacgcgtgccgaaaatagaaaattcattaaatctgacgataaatag

SEQ ID NO: 1428 - DNA, 1416 bp, Staphylococcus epidermidis
tgtagtgagatgagtagaggtgataaaatgagtcaatgcccaaattgtggtcatcaagtgaaagatgatacatcgcaatgtccaaactgtgggcaactgttaactaagaagaaaaaaagaaagattaaagaccaatcatctcaatcgagtaatgagaattctaccaatatacgtcttcgtaaaattgtgccgataggtattagtgtatttatcttaatacttattatcgtgttatttttccttttaagaaattataattcgcctaatgcacaagctaagatattagttaatgctgtagataataatgattcacaaaaagttgctacattattgagtactaaaaataaaaaagtagacgatgttgaagcgcaacaatatattaattatgtaaaaaaagaagtaggtattaagaagtatattcaagatatcaataatactgtagataaattgaataaaagtaattcaagcgtggcatcttatatacaaacgaaaagtggacaagatgtacttaagataagtaaaaatggtacaaagtatttaatttttgataatatgagtttcacagctccgactaaaaagccaattattaaacctaaagtagaaactaaatatgaatttagaacaagtggtaaaaagaaaactgtcattgctgaagcaaataaaaatacacctttgggtgaatttattcctggtacatatcatttaccagctaagaaaattacagaaaacggtacattcaatgggcatttaaattttgactttagagaaagccactctgaaaccgtagatgtagctgaagattatgatcaatcatttatcaatatcaaatttaagggtgcgaataaattaagtgataaatcagaaaaagttcaaatcaatgaccgtacattcacttattctcattctaaagaatttggtccttatccaaaaacaaaagatataacgatttctgcaactggtaaggcaaaaggtaagacgtttagttctgagacgaaaacaattagtgcagacgatttgaaagataatacgaaagttacattggaatttgatagtgataaaataaatagctatgttgagaagaaagaaaaagaagaaaatagtttgaaaaataaattaactgaattttttactggttatgcaacggctatgaattcagcatttaatatgaatgattttaactttatatcgagttattttaaaaagaattcgtctatatacacatcaatgaaaagtaatttccaaaatcgaacgaacgtgactatgatatctccgcaagtgttaagtgttcatcgaaacggacatactgtaagaacaactattcaacatatcgatcatattggtaattatataaataaagattatgaattagaaatagataatgatgatagtaatatgcagttggttaaagaattataa

SEQ ID NO: 1429 - DNA, 174 bp, Staphylococcus epidermidis
acattatttttaaaaccaacacccctcctttcatataaaaattttgctccgtttttcatattagacattatcactcatcttaacaataactattctaattttttcgaattagacacaaatataaaaatagaaattttatctagtaaattaaatacaagtatatataaatcataa

SEQ ID NO: 1430 - DNA, 1227 bp, Staphylococcus epidermidis
aagggaggagtaagcttgaaaagagtgtatcagtcagaaaatcaatcattactttttattgttattttaggttcattaacagcatttggcccattggctattgatatgtttttacctggactacctaatattagtcatgattttgatatttctgcatctacaactcagcttactatctccttttttatgattggattagcgttaggaaattttttggctggccccatatctgatattactggtagaaaaaaaccattaattttctcactgattatttttactattgcgagtttaggtattatattcgtcacaaatatatggattatgattattttacgatttattcaaggattaactggtggtgcaggtgcagtcatctcaagagccattgctagtgatatgtactcaggtaatgcgctaactaaatttttatcattattaatgcttgtcaatggcattgcgccaattatcgcacctgcgcttggcggtatcattttaaattatgggccatggcgaattgtatttgtaatactaacaatgtttgggattgtcatgttaataggaactttatttaaagttcctgagtcgcttgaaaagagcctaagggaaagtagtaacataggtacgatgctaattaatttcaaagaactttttaaaacaccccgttttgtattacccatgttgatacaaggggtgtcatttgtattactatttacttatatttctgcatctccttttatagttcaaacaatttatggtttaacgccattaaacttcagtattatgtttgcttttataggcgttacactcattatttcaagccaattaaccggaaaacttgttgactatatagatagattactgttgctgagaatcatgtctactatacaagttattggtgttataatcgtatcactaactttactcaaccattggactttttggatactttcttgtggctttgtgattttagtggcaccagttacagggattgcaacgttaggattttcgatagcaatggatgagagtaaaggggccaaaggtagttcttcaagtttgttgggattgtttcaaactttacttggtggcgtcatctctccacttgttggtattaagggagacagtaatgcgataccttatataatcgttatcgttattacagcaataattcttatggttttacagttgattaatgtgaagatatttaaaaaagctaaaattcattga

SEQ ID NO: 1431 - DNA, 627 bp, Staphylococcus epidermidis
aaaagagaggtgatatatttggactttataaatcagcagacaacccaaactgcaaaagctttattaggtgttaaaattatttaccaagatgactatcaaacatatactggatatattgtagaaactgaagcttatttaggtatacaagataaagctgcacatggttttggtggcaaaataacaccaaaagtgacttctttatataaaaaaggtggcacgatatatgcacatgtgatgcatacccacttattaatcaattttgttacacggactgagggcataccagaaggtgtacttattcgtgctattgaaccagatgaaggtatcggcgctatgaacgtcaatcgtggaaaatctggatacgagctcactaatggtccaggaaagtggactaaagctttcaatattccacgatcaattgatggctcaaccttaaatgactgcaaattatctatagataccaatcatcgcaaatatccaaaaactattatagaaagtggtcgtatcggtattcctaataaaggagaatggacaaataaaccactacgtttcactgttaaaggcaatccatatgtctctagaatgcgcaaatcagattttcaaaatcccgacgatacatggaaataa

SEQ ID NO: 1432 - DNA, 165 bp, Staphylococcus epidermidis
aatttactatttaactattgttgtccctttgcagacataattataaataaaaagttaaagaagatcgtatattcaattgaatcactgttagcctataagataagaaagcctaggacattgatatttgtcctaggcgcttattatcataaacaaatcttatattaa

SEQ ID NO: 1433 - DNA, 963 bp, Staphylococcus epidermidis
aaggaactattaattatgattacagcttataaacacgcacttcatcatccttcacaaattattgaaactgaaatcaatcatagtgcttcatggataaatgtagtagaaccagatagagaagaaattgaaggtttgatggaattttacaatatacctgaggattttattcgagatccgttagactctgaagagagtgcacgtattgaatatgacgaagatacgggatactcgctaattattattgacttacctatcgtcaattctaccaatcggcgtgtcttgtcgtttgtgaccatcccattaggcattattattggaaatggtatcgttatgactgtttgcgatgctgaaaatgaatttttagaaaactttgctaaacaagaagatattaacttgaaatttcacagtcgatttgcacttgaaatactaacaacaatagcaaatcactacaatagaaatttaagattgcttaataaatctaggattcgtattgaaagagaactcaaaaataacattactaacaagcagctttttaaactaatggaagtagaaaaaagtttagtatacttcttagctgcactaaaaggtaacgacacaattattaaaaaactctttcgtcttcctgcaatcaaacgttttgaagaggatgaagagctacttgaagacttggtgatagaaaacaaccaagctattgaaacgactgaattacatcaacgaatacttgagagtatcacttcttcgtatgcttcattattatctaatgatatgaataacatcatgaaaacattaacgttgtttacggttcttttgacccttcctacactcgtctttagtttctttggtatgaatgtacccttaccaattgatgatcatagttacgtgtcttggattattgttgtgggaatttcacttattctagtagctatcgttagtatctttttatggaaaaaacaaaaattataa

SEQ ID NO: 1434 - DNA, 660 bp, Staphylococcus epidermidis
gagggtatattcatgaaaaaaatgatattaatcaatgtgattactatcattgtcctagttgttattggtgtgttaggcttttggttctggcataacacaacaagttatgtgacaactgacaatgcaaaagttgatggagatcaaataaaaatctcaagtcctgcatctggacaaattaaatctcttaatgttaagcaaggagacaaacttgataaaggtgataaagtagcagaagttttagcacaaggccaagatgggcaatcaaaagatatgaacatcaaaatgccacaaaaaggtactattgttaaaacagatggtatcgaaggttctatgactcaagcagggaacccaattgcatatgcatataatttagatgatctatatataactgctaatgtagatgaaaaagatatttctgacgtggaaaaaggcaacgacgttgatgtagatatcgacggtcaaaaagcatcaatcaaaggtaaggttgaagaagtaggccaagcaactgcagctagcttttcattgatgccttcatcaaatagcgacggtaactatacgaaagtttctcaggtagtacccgtaaaaatctctttagattctaatccatctaaaaatgttgtcccaggtatgaacgctgaagttaaaattcataaaaattaa

SEQ ID NO: 1435 - DNA, 1233 bp, Staphylococcus epidermidis
gtgttggtattattttctggtgattttaccactatgccattaaatgttgctattacaattactgttattgttgccttacttatgaaccgcaaggaaacttttgcaaaaaaagtagaggtatttacaaaaggtgcaggtcactctaatatcattttgatgatgcttatttttatccttgctggagctttttcgacgactgctgaaaaaatgggaggcgtgtcatctacagttaatttaggcttatcacttattcctcaaaatctaataattgttgggctatttattatttgtatgtttgtatcaatttcaatggggacttctgttggcacagttgcagctattgcaccagtaggttttggatttgcacaagcaacagatgtaccagctgcattagccatggcaacagttgttgggggagcgatgtttggtgataatctatctatgatttctgataccactattgcagcagtaagaacacaaaaaacaaaaatgagtgataaatttaaagtcaattttaaaattgtactaccaggtgcgattattacaatcatcattttattctttttaacaaatggtatttctatagatcatactaaaaactatgattataatttaattaaagtcataccatacttattagttttgattcttgcgttagttggtattaatgtaattattgtattaataggaggtactgtattagccggtataattggactgattgatggttcttttggttggaatggccttttaaatgctatttctaaaggtattatcggaatggaagatattgctatgattgcattgcttataggtggtctagtaggaattatccaacataatggtggtattgattggttgcttaattttgtaaggtcaaaagtaaaatcaaagcgtggtgcagaactaggtatagcgagtttagtgagtgcagctgacatttcaacagcaaataatacaatttctattattatggctggaccattagctaaaaatattgctgatgaatatgatgtcgatccaaggaaatcagcaagtatattagatatctttggtgggtgttttcaaggattattaccatacagtccacaagtgatttcagcagcaggtgtagccggaatttccccattcctaatgttacaatatagtatttatccaatattattaggtgtttgtggattagtagcaattattttaagagtacctcgtttaaatcaatcgtcaaagaaataa

SEQ ID NO: 1436 - DNA, 429 bp, Staphylococcus epidermidis
ggaggattttttatgcgtagattattatactcttttttattttatatggtcataggtttattaagtggcttttactacagagaattaactaaagcgcatgactttgtgggtgacacgcaattgtctttagtgcatacacatacacttatcttaggcatgtttatgtttttactcttattaccacttgaaaaagtatttaaattaagtagttattacttatttaattggttctttttcgtgtatcatttaggtgtgttaatcacgatttcaatgatgacagttaaaggtacattccaagttattggtaaaaaattttcacccgaaatgtttgcgggatttgcaggcataggtcatacaggtatgcttgcaggtttactgttactgtttttcttattaagacaggctattcttacagaacccaaaaaataa

SEQ ID NO: 1437 - DNA, 285 bp, Staphylococcus epidermidis
tgtaagacattaactaattttttaagcaaaagtttacttagtgttttagtaataatttttgaaaaaatagctaggtctttagctggggtaaaaggaggttttattttgaaagttgttttatatttcatttactttttcgttgcgttttttgttgtagattctttaattagtttggtatttccaattgaatttgatgtgtatacaaatttaattactgcattcatttttgcagtttttatgacaccactattatttgtattaaaacaagacaaaaacaaaaaataa

SEQ ID NO: 1438 - DNA, 123 bp, Staphylococcus epidermidis
ctttttaaattcaagattgagtgtatagtcttgtctttatcaatattttactgttattctaaattgtttgatactcaacttaaaaataaaatacagatggtgtgtatcaaagagtcattataa

SEQ ID NO: 1439 - DNA, 168 bp, Staphylococcus epidermidis
catataaaatttttagcatacacaatttcaattatgttttttgatatgaagcagcaaatagatattgcgaaattaatattaagcttaaattcattggtttttattgacttgatgacgtttaataaattccggtttgctataaacatgtatttttctatcatcatatag

SEQ ID NO: 1440 - DNA, 126 bp, Staphylococcus epidermidis
cacgctatttctcattcagtcataaactgtcaacatgttaaaatgcccgagacatcaacgaatatcacaggcattttgaaactaaatatatctaaaattattaaatttttacatgacgacttctaa

SEQ ID NO: 1441 - DNA, 132 bp, Staphylococcus epidermidis
gttattgaattgtgtttaacgttacaagatatttgcaataacgtcaacacttattattttaaatattttaataatagtttacatattttcaataatagtaaagtatttttcgaaaatagccacacttattga

SEQ ID NO: 1442 - DNA, 1209 bp, Staphylococcus epidermidis
atgatagaatttgatgcaattaccacattatgtttggcatgtgttttatatttaattggtcaaacaataatcaaccatgtttctattttaaggcgaatctgtattccagcacctgtcattggtggtcttttatttgcaatattagtggctatattagattcatttaatatcgttaaaataaaacttgattcggcgttcattcagaatttctttatgctcgctttctttactacaattggacttggcgcatcattaaaactattcaaaattggcggaaaagtcatgttgatttatttcactttttgtggaatcatggctatttgtcagaatattattggtgtatcactcgctaaactcttaaacattaaacctttattaggtcttacagcaggttcaatgtcaatggaaggtggtcacggtaatgctgcagcttatggtaaaaccttacaagatatgggtgtagattctgcagttgcagctgctttagcagccgctacactaggccttgtattcggtggactcattggcggtcccatcgttaaatatttaataaaacgctatgatcttaagccagagcatcgtgacgattcatttaaaaattatggtgtcgttgaatacaatcaatcattacatacaaaatataaacctattcaagtcttttttatacaattttctatactcgtattttgcatggcattaggaacatatattggcaatacttttaccgatttaaccggagttaatattccaatgtatgttggttcaatgtttgtagcagtaattattagaaatgctacagactttattggttgggatatcgttgatttaaaaatgagcgaacaaataggtgatatttcattaggcatctttttatcattagctttaatgagtatccaattaactcaaatatattctttagctatcccactaatcataattgttcttgtacaagtcgtatttatggtactattctcgattttcatattatttaaaggactcggtaaagattatgacgctgctgttatggtaggaggatttattggccatggtctgggagcaacaccaaatgcgatggctaatttagatgttatcactaaaaagtttggcaactcccctaaagcatatctagtagttcctattgttggtgctttcctcatcgacttaatcggtgtaattattgttatgagttttattcaacttttcagttaa

SEQ ID NO: 1443 - DNA, 189 bp, Staphylococcus epidermidis
actgtacattcatatatctacctcctcagtcgtataaacagtattaaactatacacagtagtgattcaaattaactatagcatccactactatacattgcaaggtactgagtttaatttattaatacacacgtctttattcaaattacaccatcttttattgacaaattataaaaatcaatatttttaa

SEQ ID NO: 1444 - DNA, 129 bp, Staphylococcus epidermidis
gctcctatctcaaataatattgactttaaaaagctcttttcttctaatcattttaaaaataaaaatcatatatttgctttatcacaatatattcttaataatcatgattattttgtattaggtatatga

SEQ ID NO: 1445 - DNA, 144 bp, Staphylococcus epidermidis
atcattttatctctccttattcttagttgtgtaaataaaaaaagacagaaaaaacatacgttaaaaaagtttctctgtctaaatctaattaatttatattcattttatatcaattgtattttaccacacacaacaaaaatatga

SEQ ID NO: 1446 - DNA, 1089 bp, Staphylococcus epidermidis
gatataacatcaatggaaggaggctataaattgaatataacaaaagcaattgttgtagcaatctatatcattgttggtgcagcacttggtgttataattatacccgaagttgttacagatcttggcattcatcaccatgcggttatcactaattattatgtagatggtttcatagggatcattatattttttataatatttggattgttcattaataaagtaacatatacttttaaacaatttgaacaattaatcatgagacgtagtgcggtagaaatattatttgctacaattggtttaattattggtttatttatttcagtgatggtttcttttatcttagaaatgataggtaattccatattaaatcactttgtacctatgataatcactattattttatgttatttagggtttcaatttggtctgaaaaaaagagatgaaatgcttatgtttttaccagagaatatggcacgttccatgtctaataatatacgaagagcgacacctaagattgtagatacaagtgccattatcgatggaaggatattagatattatacgttgcggatttatcgatggtgatatattgataccacaaggcgttataaatgaattacaggttatagcggatgctaaagatagcgtgaaacgtgaaaaaggtcaaagaggattagatattttgaatcaactttatgatttagattatcctacacgcgttatacatccaactcaatcccatagtgatatagatacattattaattaaattagcacaacagtatcatgcacatgtgattacgactgattttaatttaaataaagtatgtcacgttcaaggaattacagcactcaacgttaatgatttatcggaagcaatcaaacctaatgtacatcaaggcgaccagttaagtattttattaacgaagataggtaaagagccaggacaaggcgtaggatatttagatgatggtacaatggtggttgttgataacgcgaagagttacattggtcaacaagttaatttagaggttgtaagtttgttacaaacatcatcaggaagaattgtttttgcgaaatttgttgactga

SEQ ID NO: 1447 - DNA, 207 bp, Staphylococcus epidermidis
attcagacatcctcgtggcttaatataagaaaagtaatagctcaacgagctgaaaatcatcaaaaaaattataaaaaagacaattcctatattatttcaatagaaattgtctttatttacttattttggaactttttgttccaggctttccacatctatatagatattgatttaattataattacaatgtttgtaggaattaaatga

SEQ ID NO: 1448 - DNA, 996 bp, Staphylococcus epidermidis
gaggttaaatcattggtgaaaagtggcaaagcacgagcacatacaaatattgcgttgattaagtattgggggaaagctgatgaaacttacattattcctatgaataatagtttatcagttaccttagatagattttatactgaaacaaaagtgacatttgaccctgattttactgaagattgccttattttaaatggtaatgaagtgaatgccaaagagaaagaaaagattcaaaactatatgaatatagtgagagatttggctggaaatcgtttgcatgcgcgaattgaaagtgaaaattatgtgccaacagcagcaggacttgcttcttcagcgagtgcttacgctgctttagctgccgcttgtaatgaagctttgtcattgaacttatcagatacagacttatcacgattagctcgacgtggttcaggttctgcttctagaagtatttttggtggatttgccgaatgggaaaaagggcatgatgatttaacttcatatgcacatggtattaattccaatggttgggaaaaagatttatcaatgatatttgtagtgattaacaatcagtcaaaaaaagtatctagtaggtcaggaatgtcactaacaagagatacttctagattttatcaatattggttggatcacgttgatgaagatttaaatgaagcaaaagaggcagtcaaaaatcaagattttcaacgcttaggagaagtcattgaagcaaatggtttacgtatgcatgccactaacttaggcgctcaacctcctttcacgtatttagtgcaagaaagctacgatgctatggcgattgtggaacagtgtcgaaaagccaatttaccttgttactttacaatggatgcgggtcccaatgtaaaagttttagtagaaaagaaaaataaacaagctgtgatggaacaatttttaaaagtatttgacgaatcgaagattatagcaagtgatatcatcagctctggcgttgaaattattaagtaa

SEQ ID NO: 1449 - DNA, 273 bp, Staphylococcus epidermidis
acgcataaatctttgaggaggatacaatatatgactaaaaacacattaaatgacttaaacaatcatttatttgcgcaattagaaagattaagcgatgaagaattaaaaggcgaagaattacaagaagaattgaatagatctaaagcagtttctgatgtagctaaaaacattgtgagtaatggaaacctaattttacaagcgcataagtttaaagatgagcaaatgaatgctgacgctaaattacctaaaatgttggaaaacaaagaaaaatga

SEQ ID NO: 1450 - DNA, 1242 bp, Staphylococcus epidermidis
gtaaagtttttagcttctcaattattcaaaggaggtttttttatcgattacttaggtgttgatattagtaaaagaagtagtgtagttgcacattataaaaatgaaaaattccaaaaagagtttttcatccaaaataataaaaatggttacaactatttactcaagtatttgaatgacttagaccacccacaactcatttttgaatctacaggtatctattcaagaagtatggaacgattttgttgtgtaaatcaaattaactatattcaaatgaatccgttagaagccaaatttaaaacgagcgctctaagatcatggaaaactgatcaggcagatgctcataagcttgcttgtttaggaccgacgcttaaacaaacagacaacttacctatacatgagttaatattctttgaattaagagaacgcgtccgttttcatctagaaatcgagaatgaacaaaatcgacttaaatttcagatccttgaattactccatcaaacattccctggtttagaaagattatttagtagtcgatattcaatcattgcactcaacatagcagaaatctttactcatccagacatggttcttgatatcgacaaggaggtactgattacacatatattcaattctacagataagggaatgtcaatggataaagctacaaaatatgcacttcaattaagggtgattgctcaagaaagctatcctaatgtcgatagacattcctttctagtcgaaaaattacgcttacttattcaacaattaaaacaatctattcatcatctcaaacaattagatgatgccatgattcaattagcacaacaactcgattattttgaaaatattcattcgatacctggtattggtaagctaagcacagctatgattattggggggattggtgatattaagcgatttaaatcaaataaacaactcaatgcttttgttggcattgatatcaaacgatatcaatcaggtcatacacactgtagagataccatcaacaagcgtggtaataaaaaagcgagaaaacttttattttgggtgattatgaatataataagagggcagcatcattatgacaatcatgtcgtcgattattactacaaactaagaaagcagcctaatgagaaacctcataagactgccatcattgcttgtataaatcgattattaaaaacaattcattatcttgtaatgaatcataaattgtacgattatcaaatgtcaccacattag

SEQ ID NO: 1451 - DNA, 132 bp, Staphylococcus epidermidis
cgtcatactttccctcctatcctatatattccaaaaaacatttattttttgttcctcatattactagacgaaacaatgttaattattcatatgtttgttaaaatgatttcttcattaaagctaaatccatga

SEQ ID NO: 1452 - DNA, 426 bp, Staphylococcus epidermidis
ggtggaactttgagtaaatacaattctaaaaaagttgaatataaaggtgtcgtgttcgatagcaaaattgaatgtgacttctaccagcatttagaacgtaacttgggaaatgaatatgatcatatagaattacaacctagatatgagttgatacctaagtttgataaccaacgtaaaacagaatatatagccgactttgcattatggaaaaataacaagctgcttgaagtgatagacgtaaaaggtatgccaacagaagtagcgaagttgaaagcgaagatattcagatatcaaaacagagaagtaccactcacgtggatatgtaaagcacctaaatacacagggcaagagtggataacgtatgaagaattaattaaggtacgcagaaagcgtaaaaaggagaagatgaaggatggtaaagattaa

SEQ ID NO: 1453 - DNA, 126 bp, Staphylococcus epidermidis
accatccatccacaagcgccgacaaagccacaagcaaaatacaacttcctaggggcatcaaatatgacacagaaaaagagtgaagcaagaaagctaaatataaaattaaatatccaaaacatatga

SEQ ID NO: 1454 - DNA, 135 bp, Staphylococcus epidermidis
agcaattaccctgagtgtgttccgttatatggtttaccaataaatggctcatgcttagggcatcgccatatctatagtacttattcagtaaatactggaaggagaaaaaatacatggcaagagacttttctttga

SEQ ID NO: 1455 - DNA, 996 bp, Staphylococcus epidermidis
tttggagtgttatatatgtgtactgccatttctttatatacaaaacaacgttaccattatttagctagaacaatggactttgcatttgaatttaatggtatcccaaccattgttccacgccattatcactaccaatttgatctagattcagacatgcgtcttgaatatggttttgttggaacaaatttaaaagtaggacgttatagatttggtgatggtataaacgaaaaaggtttagctatttcgaaccattacttcactggtgaagcctcatacagtacccataaacgttatggttattttaacttagcacctgaggagtttattgtttgggttttaggttttaataaaagtattagcgaattaaaacaaaaggttaagaaaatcaatattatgaatgaaaaaaatacgactttgaatatcgttcctcctttacatttcatggtcactgatgaaacaggacataccgtagccatagaacctcacaatggcttattaatagttaaagataattatgttcataccttaacaaatgaacctaaattagattggcatctatctaacttaagaaattacgcttttttaacgccacagaaatcaaccaatcaattaataggtaaagtgctagtaagatcaatgggctgtgaagcaggaacaaatggcttaccgggtggttatacgtcaacagatcgttttatacgcgctacatatttaagacaccaactacgctgttcccataatgaagatgaaaatttaatgaattgttttaaagttctagaatcagtcagtatccctcaaggtgcagttatcgatgccaataaaatacattacacacaatatcaattagtgatggaaagtaaagaaagaagttattatattaagccttactttagcaatcaaattttcaaaataaaattaactgaagaccttttaagtaagaatgagatgacattcttacctattaatcacgaattaaagataacatcaatacaatag

SEQ ID NO: 1456 - DNA, 129 bp, Staphylococcus epidermidis
catactctaccaatagaaacttcagtacttatccccgcgaatgatatttcacgatatgtacatgatattgtagaaacaattcacgatactgaattcgatgaattcagacatcctcgtggcttaatataa

SEQ ID NO: 1457 - DNA, 144 bp, Staphylococcus epidermidis
aatgaaccacctggatgtgtgggattaaaaaatgaagagaggaggacatattcaatgccaactattaaccaattagtacgtaaaccaaggaaaaagcaaaacgaaacaatcagattcaccagctttaaacagaggtttcaatag

SEQ ID NO: 1458 - DNA, 1218 bp, Staphylococcus epidermidis
gcgggggaacccgcttttttacataaaaagtggtatacttaccacaaggtgattaatatgaaaataataaataataattttacatttcacaaaggtaaaaattggataaatttaagtgggctaccaaggaagaaaacaaaaagaggcgaacaaattatttggaaaaattccataggttataatgtgaattatttttttgaaggtatcagtggagatataaaaatattagactcttacaggaaaaatgatgaaagatatttaaaagtggaagtaaaaaacgaaacatatgaaatacgttcatctaacttcaaaaattgcgaaataaagaaaattgtgactgatggttataaacataatttaggatttattataaatggttgtaaagtaattggtaaaagacttaatccaagaagtaaagaaagagaatataaaatgttgtgtctaaatacaaacttgacattttatagaagagaatcaagaatagatgtcggtgcgccaagtccatacattagcggtaaatatgtttatgaaggaaattggttatacaacgaaaaaaatgttttaccttttttaaaagatgttaatgatgcaaaaaaatatacaaagttctcaaggagagaaataaattgcgtttgccctaattgtaaaactgaaaaaacaacgcctgttaataacttggtccaacaaggtttcttttgccacgtatgttctactaacatatcatatccagaaaaattaatgattgctttattaaatgaaaatagtgtagtttttgaatatcaaaaaatattccaagatcttaaacccaaaagatttgatttttacttaccagaatataatttagttatagaaacccatggaaagcaacattataaagaaaacgaaatttggtatagaaaatctaaggaatctgatgttgtaaaaatgagttattgcaaaaagaaaaacataaaatatgttgaagtggattgcagtttatctgattacaactttataatgaataacattaataaaactgaattgaaacatgtactaaaattatatgacaaagaaaatataataaaaagaataaaagaattagagcaaataaaagatgtggatgaaataattaaactatacaagaatggtagaaaccttacatatatcagtcgaaatgttggattaaccaaatggaaaatagaggggctattgaaacgtctgggatatattgcacgctaa

SEQ ID NO: 1459 - DNA, 681 bp, Staphylococcus epidermidis
aggaggttgccaatcatgactgatgaaagacacgtacttgtgattttcccccatcctgatgatgaaactttttcgtctgctggaactatcgcaagttatattgaaaaaggtattcccgtcacatatgcatgtcttaccctaggacaaatgggacgtaatctaggtaaccctccttttgcaacaagagaatctttaccatttatacgtgaacgtgagttagaagaagcatgcaaagcaattgggattacagatttaaggaaaatggggttaagagataaaactgttgaatttgaaccttacgatcaaatggatcaaatgattcaatcacttattgacgaaacaaatccatcattaattatttcgttctatcctaaatttgcagttcaccctgatcacgaggcaactgcagaagctgtagtacgtacagttggacgcatgcatgaatcagatcgaccccgtcttacacttgtagcgtttagcaatgatgcatcagaaattcttggagaacctgatattcaaaatgacatatctcaatatagtgatataaaacttaaagcttttgaagcacatgcttcacaaacaggaccatttttaaaacaacttgctagtcccgaaatagatggtcaagcacaaagtttcttaaaaatagagccattttggacatatcactttgaatcttaa

SEQ ID NO: 1460 - DNA, 126 bp, Staphylococcus epidermidis
ataaagatgccaataaatgaatttatgaaaatccatttactggctattttgctaggaattatgtctcagcgtctcttctctttcctttcaatccataataaatattgtatacatataaagtcttag

SEQ ID NO: 1461 - DNA, 834 bp, Staphylococcus epidermidis
atgatggctttaaaaaaagtattaacgatagctggttcagatacaagtgctggtgccggtatgcaagcagatcttaaaacgttccaagaacttgatgtatatggaatggtcgctttaacatctattgtaacaatggataaagaaacatggtcccatgatgtaacacctattgatatgaatgttttcgaaaaacaacttgaaactgcaatatcaattggacctgatgctattaaaacaggaatgttagggacacaagacattattaaacgtgccggagatgtttttgttgaatctggtgcagactattttgtagttgatccagtaatggtttgtaaaggagaagacgaagtacttaacccaggaaacacagaagcaatgattcaatatttactacctaaagctacagttgttaccccgaatttattcgaagcaggtcaactctctggtttaggaaaattaacatcaattgaggatatgaaaaaagctgctcaagtgatttatgacaaaggcacacctcatgtcattattaaaggtggtaaagcactcgatcaagataaatcttatgacttgtactatgatggccaacaattttatcaattaactactgacatgttccaacaaagttataatcatggtgcaggatgcacatttgctgctgccacaacagcttatcttgcgaacggtaaatctccaaaagaagcaatcattgctgctaaagcatttgtagcttcagcaatcaaaaatggttggaaaatgaatgactttgtaggacctgttgatcatggtgcatataaccgtattgaacagattaacgttgaagtcactgaggtttaa

SEQ ID NO: 1462 - DNA, 603 bp, Staphylococcus epidermidis
tttcaacttactcgaaaggttagatatatgaatctgaataaacagcaacatgaatatacagcactgtgtctatcgcaaacagaaaataaatcttctgaagaactatttgagtctttaatagaagagctaaagccactgatttacaataaaataaggtatatctcccataataagtatgacattgaagacatgtatcaagagattgttattaaattctaccgtgccttgcaaaaattcgactatcaacaaggtgtaccaatagaacactatatttactttttaattcgttcggttaaatatgactatcttagaaaagtaaaagcgaattataaacgtcaacctctacttgttaatgaatacattgttgaatataacgctactttggcattaaacgatatagaaagatcgataattagaaaagaattaacattagcttttaaaagaagcgaagtcaaactcagtcgaatggaaagacgtatcattcgattactacttaatgattacaagccaaaggagattgctatggttttaaatttggaatccaaagttgtttataatgcgattcaacgtagtaaatgtaaacttaaaagaagttttgaataa

SEQ ID NO: 1463 - DNA, 153 bp, Staphylococcus epidermidis
caaaccgagttgagaaggcgcttaagacaaactcttctcaatcgtagctattattgcgagggagtgaaactaaactcagtttcgctcctacttttttatatcgctcttatagtattaaacgtttcaaataacttatttactctttttttataa

SEQ ID NO: 1464 - DNA, 276 bp, Staphylococcus epidermidis
tcaaaatatacggaggtagtcaagttgagacacaaattattaaaaacggccaatgatttaaataaattgattttgcatagtgatgaaaaagtgaaagcagaatttcatacttttgataatggagaagttggtattaccttttggcactattctcaaaaatatgaaagtgactgtaatcatctgaatttctacgaatttttcacagataaagaattacaaagaagttttgaattagcaaaagatgtcattgcaggggagtgtttaatcgatgagtaa

SEQ ID NO: 1465 - DNA, 339 bp, Staphylococcus epidermidis
tctgctgatacaatgttaaccaaattacttacaacaagtggtaatgatgtggaatatacgataaacccacaagctataataaaaggaaacactagctttttattgaaacctaaatttcttatcatcgctaaagcgataggcgtcaaaattaaggttgctccatcattagcaaaaaatgctgcaataattgcacctaatatcatgataaacacaaacatttttaatccatgtccttgtgatgctttaaccatatgtatggcagaccactcaaaaaatcctatttcatcaaggattaatgaaataaggataactgcgacaaaggtaagtgtggcattttaa

SEQ ID NO: 1466 - DNA, 123 bp, Staphylococcus epidermidis
aaatacaacacaaatcataatacctcacttaaaattaataagaaaaaatcgtccataaaatttttgttattaactgttattatagaagataaagtttatgtaaaagtattcaaaaatatgtag

SEQ ID NO: 1467 - DNA, 177 bp, Staphylococcus epidermidis
actaaattaaccgggtgccttatgtataaagaatataacatgactcaacatactctaccaatagaaacttcagttcttatccccacaaataatatttcacgacatgtaaatgatattgtagaaacaattcccgatactgaattcgatgaattcagacatcatcgtggcttaatataa

SEQ ID NO: 1468 - DNA, 171 bp, Staphylococcus epidermidis
ccaaatgtaactgcgtgttcacccattagaataatctttccagtagattctccgtatccttgtctagtcatgttttctcacctttatataccttctttaaaatatcacttcataagatgtactgacgatgttagaatgattgacttgctattttacgtgatattaatttaa

SEQ ID NO: 1469 - DNA, 147 bp, Staphylococcus epidermidis
gtgttatcaacatcattatttaattttaatttgtcagattcaacttgtcagtttaaaatagatttgttcatattaaatcggaggtgtctcaatggccaagaaaaaagtaatattcgaatgtatggcatgtggctatcaatctcctaa

SEQ ID NO: 1470 - DNA, 522 bp, Staphylococcus epidermidis
ggtattccaacacatatgaaaaaaaatcatgattacatgcgcttagcaattaatgaagcacacaaagccaaagcattaggagaagttccaatcggagcagttattgttaaagaggatcaagtcattgcacgtgcacataatttaagggaaacattgcagcaacctactgcccatgcagagcacatagcgatagaacgggcgtcagaagttgtcggcagttggagattagaagaatgtacgttgtatgttacattagagccctgtgtcatgtgtgcgggcactattattatgagccgtattccaaaggttgtgtatggtgctactgatcccaaaggaggatgttcaggaagtcttatgaatttattagaacaaccgcagtttaatcatagggcaatcgtagaaaaaggaattttagaagaagagtgtgcagaactattgagaagtttttttaaggaaatacgtgaaaagaaaaaagcagaaaaacaggggaagatacaaaaggatataaatttgttaaaatga

SEQ ID NO: 1471 - DNA, 528 bp, Staphylococcus epidermidis
agaatggcaacgtgtgctagattatgcagattatataagaagcaaacgcaaataaagggtgtctttatggggttatatgaaaaaatgttaatagaacatgattatatagaagtcagagagacagatgttatgcctaatgacttacatggtctatggttaggtgatttaattttaattaagcgaaacttatcagaaatacgaaaagccgaagtattatacgaagaactagcacaccataaacttacatatggaaacatcttagatcaatctaaattcaacaaccgcaaatttgaaaactacgcaaggcgttacggatatgaaaccgctctacctttgcgcattattgtggaagcgcataactatggtgttagtaacttatatgaattagctgaatatgttcaattaagcgaagaatatatatcagaaatattgaaacattacaaaaacaaatatggcattggaactaactacggagaatacttaattacatttgatccgttaagagtttttaaatataaagaaatataa

SEQ ID NO: 1472 - DNA, 255 bp, Staphylococcus epidermidis
tattcaaaaactacactattttcatttaataaagcaatcattaatttttctggatatgatatgttagtagaacatacgtggcaaaagaaaccttgttggaccaagttattaacaggcgttgttttttcagttttacaattagggcaaacgcaatttatttctctccttgagaactttgtatatttttttgcatcattaacatcttttaaaaaaggtaaaacatttttttcgttgtataaccaatttccttcataa

SEQ ID NO: 1473 - DNA, 927 bp, Staphylococcus epidermidis
gaaaacatgactagacaaggatacggagaatctactggaaagattattctaatgggtgaacacgcagttacatttggtcaaccggcaatcgcaattccatttaatgctggaaaaattaaagtcctcattgaaagtttagatgaaggtaattattcttctatcacaagtgacgtatatgacggaatgttatacgatgcccccgaacatctaaagtctatcattaatcgctttgttgaaaaaagtggagtgaaagaaccactatcagtaaaaattcaaactaatttgcctccatcaagaggtttaggttcaagtgctgcagtagcagtagcgtttgtacgcgccagttatgattttatggatcaacctttagatgacaaaacattgattaaagaagcaaattgggcggagcaaatcgcacatggtaagccaagcggtattgatacgcagacgattgtgtcaaataaacccgtctggtttaaacaagggcaggccgaaacattaaaatcactaaaattaaatggttatatggttgtcattgatactggagtaaagggttctaccaaacaagcagtagaagatgttcatgtattatgtgaatctgatgaatatatgaaatatatagagcacattggtacacttgttcacagtgctagcgaatcgattgaacagcatgatttccatcatttggctgacatatttaacgcatgtcaagaagacttgagacatttaacagtaagtcacgataaaatagaaaaattacttcaaattgggaaagaacatggtgccattgctggtaaactaactggtggaggaagaggtggcagcatgcttcttcttgcggaaaatttaaaaactgcaaagactattgttgctgctgttgaaaaagctggcgcagcacatacatggattgaacatttaggaggttaa

SEQ ID NO: 1474 - DNA, 210 bp, Staphylococcus epidermidis
ccacaaatgactttaggaaatcgtattaaacagcataggcaagacaaaggtttgaatatgagagagtttggagaattcatcgacaatgcctctgacagcatagtaagtaggtgggaacgaaatatttctgtacctaatgctaaaagacttaaattaatagctgatgacatgaatattactgtaacagagttactgaaaggagtgaaataa

SEQ ID NO: 1475 - DNA, 441 bp, Staphylococcus epidermidis
tatacgatgacgaaactgaaccttaaacaacaagcatttgttgatgagtacattaagacaggtactgcttatcaatcggcaatcagggctggttatagtgagaaatacgcaaaatcaagtagtcataaattgttggaaaatgtgggaataaaagcagaaatagacaaacgaatggaaaaactgaaaaaagattcaattgcagaccaagatgaaatacttcaatatctcacctctgtattacgtggggaggtaacagaccaagagttgatacctattcaagttggcagaggcgaaatggaagtagaagaactagaaaaaaggtcagatactaacgctagaactaaagctgcagaattattaggtaagcgatatatgatgtggacagataaacaacaaatcgaaacgactgcgatggtgcatttcgatgatgatatcaattaa

SEQ ID NO: 1476 - DNA, 204 bp, Staphylococcus epidermidis
ccacctactgcatttgtacctaatgcgataggaaaaacattgacatcagatttacctaatcgtacttgttttaccattaaaagtcatctcctttatttaaaatacttaaatatattatacccaaatcataacttattcattcatgttaattatctattagaagcaagtatcttgaccttaaaatcattatacgctttaatgtaa

SEQ ID NO: 1477 - DNA, 747 bp, Staphylococcus epidermidis
tacacttatgcatatggctgcactgctttctgctacagcggaaaagaaaccactagttgcctgggatttgaatatgggggacttataaatacactcgaagcagcaagaaggtatcaattaaaatattttacgccaagttcaataggagcttttggtatttcgacacctaaagtaaatacacctcaattaacaatacaacaaccaacgactatgtatggtataaacaaagtaactggggaattattatgtcagtattattatgtcaaatttggagtagatacacgtagcgttagatttcctggtttaatttcacatgttaaagaacctggcggtggcataacagattatgcagttgatatgtattttaaggcagttagaaaaggacattatacaagttatattaatcgttacacttatatggatatgatgtacatggaagatgctattgatgcgattatcaaattaatggaagaagacagtgttaaattaaaaacaagaaatggctataacttaagtgcgatgagtattgaacctgaaatgctaaaacaagctatacaagtatactatccagatttcaccttagattatgacattgatttagagcgtcaagatattgcattaagttggccagatagtatagatacgagctgtgctcaggaagagtggggatttgatcctaaatatgatttaccaactatgactaaagtgatgttagaggcaattgagaaaaaacaaaaagaatgctga

SEQ ID NO: 1478 - DNA, 129 bp, Staphylococcus epidermidis
acaggtagtgcatcgaaatctgctcgtaatgcaatcgttggtccatttgaatcagatcctttaaaagttgcttttataccattacgtccaactggtgtttctatggtgcatgctaattggctcaattga

SEQ ID NO: 1479 - DNA, 357 bp, Staphylococcus epidermidis
atggaaatcgcaaaaatgagagttaaaaataaatacttctctattacacctaatgtagtagagaaaatgaaagaagcagatatcaatcccgatatcttaagacaaagattagcttctggttggaagtttgaagatgcaatagaagctcctttgggagtaagacgtagtgaatgggatagtttaaaacctaaagaggacggaatcgctagttataaagagagaatggcacaacgtagattacaagagttgaaacgtaagaaaccacatttattcacagtgcctcaaaaacaccctcgtagtgaatggtgtacgtaccttatggaaaatgacatcttccctagaaaggttgcgaaatga

SEQ ID NO: 1480 - DNA, 318 bp, Staphylococcus epidermidis
gtaatgaacgcacaagacgttaaaatattaaataatctttcactcgatgatacttctaacgatgaaacaatagaattacttattgaaaaatatctgaatgtagcagaagaatattgtaaccaaacattcaatagacagtcattacctagtaacgtagagaaatttattgctaattgtattaaacaaggtacgactagcaacatttcttcacgtactatgggaactgtaagctacacattcgttactgacctacctaaggaaacatacggttacctaaaaccatttagacgtttacgttggactggttatcatgtttaa

SEQ ID NO: 1481 - DNA, 246 bp, Staphylococcus epidermidis
tcttcattagctcctgtatccggtaatttatcttttgtattcttatctgagctattgtctaatcctgagtcactgtctgagtcggaatcgctgtctgaatctgaatcactatctgagtctgagtcactgtctgaatctgaatcactatcggaatctgagtcgctgtctgagtcggaatcgctatcggagtctgagtcgtcgctatctgagtctgaatcactatctgaatctgagtcgtcatcatag

SEQ ID NO: 1482 - DNA, 531 bp, Staphylococcus epidermidis
ataatgaaagctatacctaaaattttcgacaaagaaaaagggcaatggattgaactaatggctaaacctatcgccgaagaagtagttaagataatgaaagaggattggttatctaataagaaaacaattgactattggttattacaatatacagagggtgtagttgagcctatacaagttgctatatttactgacggcaatgaagtcgatgaaatcttaaaaagtaacttagaatggatgtttaatggttatgtatctaatctagaaaacaaaaagctctttaatttacaagattttataaactattgttacagcactaaaacagagttgcctaaacagttcaaagtcaacgctattgtaaaattcgatagtttagacgaacctattaaattacaagagatagataatatcacgactaatcctgatgttttaggcatattagatgaaacttctgaaggatctatagaggttaaatatatctataatgatcattctatcgaagataaaaagttaataaaagagaataaataa

SEQ ID NO: 1483 - DNA, 1029 bp, Staphylococcus epidermidis
aaagtgagagcgaggtgtctcatgatgagtaatatccatactaatattagtgagtggatgaagatgtctgaggagacacctgttattatttcttccagaattcgattagctagaaatcttgaaaaccatgtccacccacttatgttcccttcagagcaagaaggatatcgagtgataaatgaagttcaagatgcgctttccaacttaactttaaatcgattagatacgatggatcaacaaagtaaaatgaaattggttgcgaaacatcttgtgagtcctgaactagtgaaacaacctgcttcagcagtaatgttaaatgatgatgaatcggtaagtgttatgataaacgaagaagatcatatacgaatacaggctctaggaactgatttatcgctaaaggatttatatcaacgcgcttctaaaattgatgatgaattagataaagcgttagacattagttatgatgagcatttaggatatttaactacctgtcctactaatattggtacaggaatgcgtgcaagtgtgatgttacatttacctggactctccattatgaaaagaatgaacagaattgcacaaacaattaatcgttttggatttacaattcgaggtatatacggagaagggtcacaagtatatggtcacatttatcaggtttcaaaccaacttacactagggaaaacagaagaagacattatcgataacttaactgaagttgtaaatcaaattataaatgaagaaaagcaaataagagaaagacttgataaacacaattctgtagagacactggatagagtttatcgatcattaggtgtactacaaaacagtagaattatttctatggaagaagcctcatatcgtttgagcgaagtgaaactaggtattgatttgaattatattttgcttgaaaattttaaatttaatgaattaatggtagcaatacagtcaccatttttaatagatgacgatgataatagaacagtaaatgaaaaaagagctgatttattaagagaacatataaaatag

SEQ ID NO: 1484 - DNA, 3558 bp, Staphylococcus epidermidis
atctgtttggcaggtcaagttgtccaatatggaagacatcgtaaacgtagaaattacgcgagaatttcagaagtattagaattaccaaacttaatagaaattcaaacaaaatcttatgattggttccttaaagaaggtttattagaaatgttcagagatatttctccaattgaagatttcactggcaacctatctttagaatttgtagattacagattaggtgaacctaaatatgatttagaagaatcaaaaaaccgtgacgctacttatgctgcacctcttcgtgtgaaagtgcgtcttattattaaagaaactggtgaagttaaagaacaagaagtcttcatgggtgattttccactgatgacagatacaggtacgttcgtaattaatggtgctgaacgtgttatcgtatctcaattagttcgctcaccatccgtgtattttaacgagaaaatcgataaaaatggacgtgaaaactatgatgcaacaatcattcctaaccgtggtgcttggttagagtatgagacagatgctaaagatgttgtatatgttcgtatcgatagaacacgtaaattaccattgactgtattactacgtgcgctaggtttctcaactgatcaagaaattgttgacttattaggagacagcgaatatttacgtaatacattagaaaaagatggaacagaaaatacagaacaggctttattagagatttatgaacgtttacgtcctggcgaaccaccaacagtagaaaatgctaaaagtttattatattctcgtttcttcgaccctaaacgctatgatttagccagtgtaggtcgttataaagcgaacaaaaaattacacctaaaacatcgtttgttcaatcaaaaattagcagaaccaattgttaacagtgaaactggtgaaattgttgttgacgaaggaacagtgttagatcgtcgtaaacttgacgaaatcatggacgtattagaaacaaacgctaatagcgaagtatttgaacttgaaggtagtgtaattgacgaacctgtagaaatccaatctattaaagtgtatgtgcctaacgatgaagaaggtcgtacgactactgtcattggtaatgcattacctgattctgaagttaaatgtattactccagcagatattgttgcctcaatgagttatttcttcaacttattgaatggtattggttatacagatgatattgatcatctaggtaatcgtcgtttacgttctgtcggtgagctattacaaaatcaattccgtatcggtttatccagaatggaacgtgttgttcgtgaaagaatgtcaatacaagatacagattctattacgccacaacaactcattaatatcagaccagttattgcatcaatcaaagaattctttggtagttcacaattatctcaatttatggaccaagctaacccgttagcagagttaacgcacaaacgtcgtttatctgctctagggcctggtggattaacacgtgaacgtgctcaaatggaagtgcgtgacgttcactactctcactatgggcgtatgtgtccaattgaaacacctgagggtcctaatattggtttaataaactcattgtcaagttatgctagagtgaatgaatttggttttattgaaacgccatatcgtaaagtggatttagatacaaactcaatcactgatcaaatagattatttgacagctgatgaagaggatagctacgttgttgcacaggctaattctagacttgatgaaaatggtcgtttcttagatgatgaagttgtttgtcgtttccgtggtaataacactgttatggctaaagaaaaaatggattacatggacgtatcaccaaaacaagttgtttcagcagcaacagcatgtattccattcttagaaaatgacgactctaaccgtgcgttaatgggagcaaacatgcaacgtcaagcggtgcctttaatgattcctgaagctccatttgtgggtacaggtatggaacacgtagccgcaagagactctggtgctgcaattactgctaagcatagaggacgcgttgagcatgttgaatctaatgaaattttagttcgtcgtttagtcgaagaaaatggaactgaacatgaaggtgaattagatcgttatcctttagcgaagttcaagcgttcaaactctggtacttgttataaccaacgtccgattgtatcaattggtgatgttgttgaatataatgagattttagcggacggtccttcaatggaattaggagaaatggcattaggacgaaatgtagttgtcggtttcatgacatgggacggttacaactatgaggatgctgtaattatgagtgaacgactagttaaagatgatgtatatacatctattcatattgaagagtatgagtcagaagctcgtgatacgaaattaggacctgaggaaatcacacgtgatattccaaacgtatctgaaagtgcacttaagaacttagatgatcgtggtatcgtttatgttggtgcagaagttaaagatggtgacatcttagtaggtaaagtaacgcctaaaggtgtaactgaattaacagctgaagagagattattacacgctatctttggtgaaaaagcacgtgaagttcgtgatacatcattacgtgtacctcatggtgctggcggtatcgttttagatgttaaagtctttaatcgtgaagaaggagacgacactctatctcctggagttaaccaattagtacgtgtatatattgtccaaaaacgtaaaatacatgttggggacaaaatgtgtggtcgtcacggtaacaaaggtgttatttctaagattgttccagaagaagatatgccttatttaccagatggtcgaccaatcgatattatgttaaacccattaggtgtaccatcacgtatgaacattggacaagtattagaattacatttaggtatggcagctaaaaacttaggaattcacgttgcttccccagtgtttgatggtgccaacgatgatgacgtttggtcaactatcgaagaagctggaatggcgcgtgacggtaaaactgtcctatacgatggacgaactggtgaaccattcgacaatcgtatttcagttggtgttatgtacatgcttaaacttgcacacatggtagatgataagttacatgcacgttctactggaccatactcacttgttacacaacaaccattaggtggtaaagcacaattcggtggtcaacgtttcggtgagatggaggtatgggcacttgaagcttatggtgctgcttatactttacaagaaatcttaacttataaatctgatgatactgtaggtcgtgttaaaacttacgagtctatagttaaaggtgagaacatttctagacctagtgttccagaatcattccgagtattgatgaaagaactacaaagtttaggtttagatgttaaagtgatggatgagcatgataatgaaatcgaaatggctgatgttgatgacgaagatgcagcagaacgcaaagtagatttacaacaaaagagtgctccagaatcacaaaaagaaactactgattaa

SEQ ID NO: 1485 - DNA, 186 bp, Staphylococcus epidermidis
ttgtcccaggcattttatttattggcaattgacaaccgagttgaacttgggctaatctcaattttcaactctagtcctcattaccaagtgagacagcgaattacttacgctttctatctcactcttcttaatttaatatttaacgttataattgtagtaactcaatatgcgaaattaaagttataa

SEQ ID NO: 1486 - DNA, 522 bp, Staphylococcus epidermidis
atggattttttacagcaaaattggactaatatattgaaaataattgtgtctttgatatcaatagtaacttttataagagtattcctttatgaaaggtctagactcaaagttaatattattggttatgatcaaatagaagaatatttagatgtttacatttctttttctaactcatcaaagttacccatttccattaatgagattcagatatttcataaaaacacaatgattggtgagatagaaaatttcacagaaaaaattctaggtcaaacagatggtaaaagtatagtctattctaacccaatgccattaaatttaaattcttattctagcgacaaagatttattcagaataaaactggtagaagaattacctttaaataaaactttaacttttaaatttataactacacgaaaaaatatcacttataagattaaagatttcaaattaccgcaatatagaaggtcattccatagaaaacttaaacatcacaaaaaggtttcaaataaaaacaaagattaa

SEQ ID NO: 1487 - DNA, 876 bp, Staphylococcus epidermidis
cttatctattattacagctgctcaagctttacaataatggacttagcaactaaatattttaatcaaatcaactggcgttatgtcgatcattcaagtggtttagagcccatgcaatcttttgcgtttgatgacactttttccgaaagcgttggtaaagatttatcttgtaatgtagtacgaacgtggatacatcaacacaccgtgattttgggcattcatgattcgcgtttaccatttttaagtgatggtattcgttttcttacagatgaacaaggatataatgcaattgttaggaattctggtggcttgggtgtcgtattagatcaaggaattttaaacatatctttgatttttaaaggacaaaccgaaacgactattgatgaagcctttacagtgatgtatttattgattaataaaatgtttgaggatgaagatgttagtatcgatactaaagaaattgagcaatcgtattgcccaggaaaatttgatttaagtattaatgataagaaatttgccgggatttcgcagcgacgagtacgtggtggtatcgcagtgcaaatatacttatgtattgaaggttctggctcagaacgggcattaatgatgcaacagttttatcaacgtgcgcttaaaggggagactactaaatttcactatccagacatagatccctcatgtatggcatctttagaaacccttttaaatagagaaattaaagtgcaagatgttatgtttttattattatatgcactaaaagatttaggggcaaacttaaatatggatcctattacagaagacgagtggacacgttacgaagggtattatgataagatgttagaacgcaatgcgaaaatgaatgaaaaattagatttttag

SEQ ID NO: 1488 - DNA, 771 bp, Staphylococcus epidermidis
catgaatattactgtaacagagttactgaaaggagtgaaataatggcggtttttagagtttacaaagaaactggaaacttcgtaactgtacacaaaaattttattcatgacgataacctaagctggaaagctaaaggaatcttgctttacttattaagccgacctgatgactggcaaatatacgaatcagaattagttagacattcaactgacggacttagtggcctcaaaactggcataaaagaattggagaaagtcggttatattcaacgaactagaaagcgtgatgataaaggtaggttgaaagagtatgaatatgctgtctatgaaaaacctaaccacattcgattttccaacgtaggaaaaacctatataggaaaaacctacgtaggagaatcgcacactactaataataatagtactaataatgatttaactaataataaaaacactaataatgtgacagacgagacatcaaaatcatttcaatatattagtaataatttagaaatcatacaaagtccattaaaagcacaacaactagaagaagctataaaggattttaaagataacaaactagagattgttactgtagctactgattattgcaaagaaaataacaaaggcattaactatcttatcaaagtattagaaaactggagtaaagacggtgtcgatactaaagaaaaagcgatatctaaagttaaacctagaaacaataaagaagataattacctagctaagaagaaacaggaactattaggaggttag

SEQ ID NO: 1489 - DNA, 825 bp, Staphylococcus epidermidis
aacctttactataattataataatgatttattcttaattttaaaaaaatttggtgatgaaatgaataaggatacaattgaaacatctcgtgaagcattgataaaagatgttgttatgattgctgctcgtatattacttgaatctggagctgaaggtacacgggtagaggataccatggcacgtattgctacaaaattgggctatcctgaaagtaatagtttcgtgactaatactgtaattgaatttgttttacataatgaagcatatcctcggttgtatagaattaaaactcgagatacgaacttaataaaaatttctcaagctaatgaaatctcacgtcaaattacaaatggcacaatgacgcttgaagaagctaagtatcaattagaggaaatatatgttgctaaaagagatagcagtctaccttttaaaggaattgccgcagcaattatcgctacgagcttcctctatctacagggaggtcgtctggttgatatcatcacagctgtattagctggaacgattggatacttagtagtagaaatattagatcgaaagctacacgcacaatttattccagaattcataggttctttggtaataggtattatttctgtaattggacatgcatttgttcctagcggagatttagctacaattatcattgcagcggtcatgccgattgtacctggagtactgattacaaatgctatccaagatctattcggaggacatatgttaatgtttactacaaaatctttagaagctttagtcaccgcctttggtataggcgctggtgtaagttcaatattaattttagtctag

SEQ ID NO: 1490 - DNA, 1506 bp, Staphylococcus epidermidis
attatgtactattttgtaggtaataacatcggtcataaaactgctggtatagaaaaagcaatgattaatcgattaaacctatttaaagcatatcattatcaagctaaaatcttattactagcatggaatcgctatttaactcaaacagcatcgcaatatattaatagcgaagattatataaacatgtatgattattttcaagaagcaagtaacgtaacatcagtgttcagtaaaaattggattcattactggagaaatgaatgtggctatactataaaacctgtttctgagacaaatgacgttcggatttatgatcaacaacaatttataatgtatgcgcattttgctgatgaagcttatcaaaaaattgattatattaattactttgatacatctagaagaaaaataaaaagagagttatacgatacacgtggatttttaagttgcgttagagttttatcaacggaccaaaaaatacaagcagagtactatctttctcctcaaggaaacgtgaaaattgaaaagtattatgatattaattcaaatcatccctatgtggcaaaaaagattatattaaatcatttaggtaaaacgcactttttaaacaatgaaactgagctaggtgctttttttattgaaacaatatatcaaagtagtgacttattctttagcgatcgtaacctcgttacatcacatatatttaacatagttgcatcttacatccctgttattgcagtgttacatagcactcatgttaaagatgttactgatttaacgcattcaccaatcaaaaatgtttataaaggggtttttgaacatttacaaaggtataaagccatcattgtttcaacacaacaacaaaaagctgacgtaattgagagaatcagaggagtcattccagtatatgctattccagttggttattcatcttttgaaatgaacgatgactctaataaaaataactatgtttcacctaaaaaaattatttctgtcgcaagatactcacctgaaaagcaattgatacaacaaattgaacttattaataggcttaaagatacgtttccaaatatcgaactacatatgtatggttttggtaaagaagaacaacatttaaaagaacgcattcaagaattaggactagaaaaacacgtaatattaagaggttttttaaaagatttaactgatgaatatcaagatgcatatctaaatttaataacaagtaatatggaaggcttttccttagcattattagaatgtgaatcacatggtgtgccttctatcagttatgatattcaatatggtccaggtgaattgatacaggacggtaagaatggatatttaatagaaaagaataatcaacacatgctatttgaaaaagtaaaattattgctcaacaacccccaacttcaacaatctttttctcaccattgtattgaaactgcacaaaagtattctcaaacacaaatcatgttactgtggaaaaatttacttcaacattttaactaa

SEQ ID NO: 1491 - DNA, 219 bp, Staphylococcus epidermidis
gtcatgttatattctttatacataaggcacccggttaatttagtttattggtatttattaaattatacgaaaaggccttattttttaaagtattttaatataaaattacatataagcacaaagtattttggcgagactcttgagggaacaggacaagctgaagactacaggctgaagctgtcccctaagaaagcgagccaacaatacgaagcattgtaa

SEQ ID NO: 1492 - DNA, 996 bp, Staphylococcus epidermidis
ataatcctatataatacattaaacgcgtgggggggattcataataatgaaatatatagatgagcaaacacaagctcaattattagacatgaatgaagtcattttagaagtagaaaaagctttgcaagctttttcagagaataagacgataacgccattaagatatgttttgccatttaatgagcaaaatcgttatttagtgatgccagcattatcagatgaattaaatatcgttggacttaaaacagtctcatttgcacctgaaaattcaaaaaaagggaaagcgactattactggatcagttattttaagtgactatgaaacaggagaaacattgtctatattagatggtggttttcttactaaagtaagaactggtgcaatttcaggtgtagctactaaatatctagcaaaagaaaacgctaaaacacttagtgtaataggggcaggtgtacaagctgaaggtttaattgaagcgatacttgctgttagagatattgaaaaaattcacatcgcaagtagaacgttcgaaaaagcagaaaaatttgctcaaaatatacgaaatcgatttaatattaaagtgagtgtatttagatcggcagatgaagcgatagacagtgcagatattgtagttacagcaacaaatgcaaatcagcccgtttatactcattctttacatccaggcgtgcatttaaatgcagtcggatcctttaaaccagatatgcaagaaataccttcagaaacaatgcttgttgctaataaaattgttgttgaatctatggaagcagctttagaagaaacaggtgatttaaaaattcctcaagcagaaggaatattaactaaaaatatgctacatagtgaattaggcgacattatttctggtgaaaaagttggccgcgaaactgaagaagaagtgacagtctttaaatcggtcggtctagcaattgtagatatcattgtggcacaatatttttataaaaaattaatacaatcttag

SEQ ID NO: 1493 - DNA, 384 bp, Staphylococcus epidermidis
tggaggaaatataaaatggctaatcaagaacaaatcattgaagcaattaaagaaatgtcagtattagaattaaacgatttagtaaaagcaattgaagaagaatttggtgtaactgcagcagctccagtagcagcagcaggtgcagctggtggcggaaatgctgcagctgaaaaaactgaatttgatgttgaattaacttcagctggatcttcaaaaattaaagttgttaaagcagttaaagaagcaactggtttaggattaaaagatgctaaagaattagtagatggagctcctaaagtaattaaagaagctatgcctaaagaagatgctgaaaaacttaaagaacaattagaagaagttggagctagcgtagaattaaaatag

SEQ ID NO: 1494 - DNA, 408 bp, Staphylococcus epidermidis
tatttagtgtattcaaaagcatctatattaaacatgattgatggatataaaatgaattgtaatatcttagaggatgtagtacctgaatgtgatagtaattctatagcacaatatgggatacaagctacgttacctaaaccacaaggagaaaacggcagtaaagttgaagatgtagtaattagattagaaagaacaaataaaagatacgcacaaatgttaaaagaagttgagttcatcaatcaatctcaacaaaaattagggcatgttgatttttgttttctagaacacctcaagaaaggcagacgtagagataagataatagaaaagatgcctaatgctaaattgaatagaaataattttttagcacgcaaagatgagttagcagaaaagatttatttattgcaatga

(The sequence listing continues in the following parts.)

The invention claimed is:

1. An isolated nucleic acid molecule comprising the nucleotide sequence encoding S. epidermidis polypeptide SEQ ID NO: 6352.

2. A recombinant expression vector comprising the nucleic acid molecule of claim 1 operably linked to a transcription regulatory element.

3. An isolated host cell comprising a recombinant expression vector of claim 2.

4. A method for producing an S. epidermidis polypeptide comprising culturing the isolated host cell of claim 3 under conditions that permit expression of the polypeptide.

5. An isolated nucleic acid molecule comprising a nucleotide sequence encoding the S. epidermidis polypeptide wherein said nucleotide sequence is SEQ ID NO: 2580.

6. A recombinant expression vector comprising the nucleic acid molecule of claim 5 operably linked to a transcription regulatory element.

7. An isolated host cell comprising a recombinant expression vector of claim 6.

8. A method for producing the S. epidermidis polypeptide comprising culturing the isolated host cell of claim 7 under conditions that permit expression of the polypeptide.

9. An isolated nucleic acid molecule consisting of at least twenty contiguous nucleotides of SEQ ID NO: 2580.

10. An isolated nucleic acid consisting of the nucleic acid sequence of SEQ ID NO: 2580.

11. An isolated nucleic acid consisting of a nucleic acid sequence encoding the amino acid sequence of SEQ ID NO: 6352.

* * * * *